United States Patent 8,067,671 (METHODS FOR GENETIC CONTROL OF PLANT PEST INFESTATION AND COMPOSITIONS THEREOF) - sequence listing, part 20

SEQ ID NO: 22807 - DNA, 1897 bp, Heterodera glycines
  misc_feature (1789)..(1789): n is a, c, g, or t
agattataatggcaaccgatattaaaactattttacttcgactgtcttcaattgaaacgttattatcaaacaacaacaacaacactttggcaacgcaaatggcagaacaattcaacgccattgctgaacgcctcaacgaaattgagcgcaaaatcaacagcaacaataacgacaattccagtgcggaggaaaaagaacgcaaacgaagcctcgttttgattggcctgccggaggctgtggctgaaaagccgtcagaacgcgccaaagaggacgcggaaacagttgcggaagtgttggacgctttggatgtggaggtttgcccgcagatggtgtatagaatggggcggcggattgatgagaagcgaaaggggccgcgtttggtcaaagttgtcttgccagcgacgacgttccaacgttttgcattggcacaatgggggcgcaaccggacggaactgaagcagcatgttggttggcagcgacttctcgtcaggccctctctgacgaaagaagaattggcggctgagcgggagattcgtgaacagaggcggatgaattatgaagaaagcaaaaagaatgaaatggtgacgacgcggcgtggaggcaacatgggaaaaaacttttgaggtcacaaaattttctcaattgtctttattttaactcaagaagtttagtgaacaaaatgaatgagtttaagcttttacttttagaaaataggtataaaattatcgcgataaccgaaagttggttgaataataaaataaacgactcgcaaattttagaaaattttcctttctctttaataagaaaagatagaaagaataaaaaaggaggaggggtagcgtttgtcatttctaatgaaataccgtttgaaattataaaaactcaaaatatacaaaattctgatatactttgtattgatgttttttcgcccatttccgaatcaaaaatccgtcttattttggtttataggcctgtaactaccgaaacattcgaaaattttatgctctagaattaatttcctcactagcagtctcgacagaaaattttgtcattcttggagattttaattttactaatattcactggaaccaaaatggccctttctctatcctaaataatttgacaaattatgaaagtaatttccttggttttgttgaaggtttacgacttgatcaaatgattaaagaacccacaagggaatgcaattttttggatttaattttaacaaataataaatttctcataaaagacatttcaattggccccccattctcacttagtgatcacaacactataaaattcgacttaagactaaatgtttttccttgtaaaaaatttaaacactttaactttaaaaaagctagttacttggaaataaatgccatgctctcttctactgattgggttacctttttttcggactgtatagaaattgaccaaatttataacaaattcgcagcatttttgcattttttaatatcgaaatatgttccattaacagtatcaaattctaaacataatttcccagatcatattaaaaaaattatgatttatcgtcgacaactttggaaagaccttaaaaaagataaaattagagaaaaatttaaagaaacctctaaaaaacttgaatatgaaataaagaaataccttacaaatcgtgaaaataaatttttaagtggtttagaccctaaacaacgatttcgatatattggttcttttttaaaaactaaaaacacaaaaattccccctcttaaaatagcgaaaacaaattgccttttccgaaaagctnaatccatttattagccgaacaatttactcggtctcactgaccaaaaattcctgttcatgtgagtccccctaaaaaaatattgacttttcacatgacacttatgaaatt

SEQ ID NO: 22808 - DNA, 1875 bp, Heterodera glycines
tattgttcaagtaggccatgggagcggaaatcccaacgaccgggcgttgctgtgacaggagcagcagcagctgcagtatcatcatccgcatcaccgattttccggcgttgccgctttctttggcccccgctcgaagctgtgccagcctgtgtcacccctcttttggatgatgatgatgatgatgatgatggctgcatactgtcaattcaaactgttcataaatgcgcattttaataaataatgcaatgcaatattagcaataccatatcggttcaagcgtttgacaaaaaatgaaagcggaaacattattataccatttttttcaacaaatttcgcttccaattaatgaaagtgaacattttggatgtctaaaactagcaaacaacaacaacaacatcggcttgacagcaggccaatcgacgggcaattattttgttttttcactatttggtttctcctttccctcctgctcgtccacagcagaggtggatggagcagtgacggcggtcttgtgatcgacaacaacaatttcgtcttcgtcttcttctcgttcagcctcaacaattctggcttttttagcggtctgtgagctgccttcagcttcgtcatcagaggcaaacacctttgaaatcagccaatcgaattggccttcgaagtcttcggcagtggcttccttcatacaaaaaaaaacatattgcgtacatcgttgtataataataataataataataatcacacattttttgtaccttaatagtcatttttacgactagctccttttcaagttttgcttcaagcagtttctccaatttgtccgggttttggtcacgcatgtcgagcatcgatgccgctttgataccgatgtacttctcagcaacgtagctgaacatggtggcacactgcgtaacttccggattctcgatgtctttgagctccactcggcagtacatgcaaactagcggttttttggcacggtgatcacacgacggacatcgaagctcagaatccagcttacgtctgcagaacagtccgccagaaaattttaacgggcatgcctgtgaccggatggaaccatcagcaacaacaacaaatttaataaaatattgatgaaaactgacattgtaaaggctgtattggaggttgacgagtttggcgcgtacataaaacacgcctaccgagccgaaatcaacgacttcggcgagccccttcagatttgcgggcagctcttcggcggatgacccacgccgtttccccgcggcgccggtggatgacgaaatttcgaagcgagacaggcctttggcaccgcttttgctcattttgaccaagaatgttaaatattcaaaattccttaatgcgtattagagttgactatgattattatacgctaatatggcacgacgacatttcgcctactggacatttcgcctactaagccaagatcggacgtttcgcctactaagccaaaatctgacatttcgcctacgaatttttgcctactgaaaaaatgctagagaaaagaaaaaaagagagtgaaagagtagaaatgctttatttttcgatcaaataagttcgtgaaatacatacttacgagtcttaaaaagccaataaaaagccccgcattcattgaaatgaagacagtgtactgaatcttgagagtgcagccaaagaagcaaatggaaaatgtttcagacaacaacgatttgaacttagccaaaatgcggatcagggatggcacggaattccgattttcgacatttttgaccgctggaattccgattttcgaaaatttttggggcctcggaatgccatccctggtgcgggtccttgacgagaccgactttgaatcggacgaaagattagcaaacaccttgcacc

SEQ ID NO: 22809 - DNA, 1881 bp, Heterodera glycines
  misc_feature (55)..(55): n is a, c, g, or t
  misc_feature (58)..(58): n is a, c, g, or t
  misc_feature (62)..(62): n is a, c, g, or t
  misc_feature (64)..(65): n is a, c, g, or t
  misc_feature (67)..(67): n is a, c, g, or t
ttgtatctcttctaatcactgttttacctttcttaatctcttaagtacctcttcnaancatngnngnacctcttctaatcatttttgtacctcttccaatcacagttgtacctcttctgatctctggtgtacctcttctaatcactgttgtacctcttctgatctctgttgtacctcttctaatcactgttgtacctcttctaatcactattgtacctcttctaatcacagttatacctcttctatcactgttgtacctcttctaatcactgttgtatctcttctaatcactgttttacctttcttaatctctgttgtacctcttctaatcactgttgtatctcttctaatcactgttttacctttcttaatcaagttgcacctcttctaatcactgttgtacctcttctgatcactcttctaatcactgttgcacctcttctaatcacttttgtacctcaaaatttaaataacgggcgctaagcgcccgtccaaggccgcgaagcggcctaacaagctaaaaaacgggcgcgaagcgcccgtatgagttcaacgaatttaaaaaacgggcgcgaagcgcccgtccaaggccaacaaaaattgaaaaaccggcgcgaagcgcccgtctgaggccgcgaagcggccttaatagcccaacaaatttagaaacgggcgcgaagcgcccgtctgaggccgcgaagcggccttaatagcccaacaaatttagaaacgggcgcgaagcgcccgtctgaggcctcgaagctgccttaatagctcaacaaatttagaaacgggcgcgaagcgcccgtctgaggccgcgaagcggccttaatagcccaacaaatttagaaacgggcgcgaagcgcccgtctgaggccgcgaagcggccttaatagcccaacaaatttagaaacgggcgcgaagcgcccgtccaaggccgcgaagcggcctaacaagctaaaaaacgggcgcgaagcgcccgtatgagttcaacgaatttaaaaaacgggcgcgaagcgcccgtccaaggccaacaaaaattgaaaaaccggcgcgaagcgcccgtatgaggccgcgaagcggacttaatagcccaacaaatttagaaacgggcgcgaagcgcccgtctgaggccgcgaagcggacttaatgagaccaaatgattttaaaaccgcagatatgcgaaccctggctatcataaatatttgataatatgtctattaaagtattaatgtagaccgatttgttgcacaaaaactcgttagatataataattttacatacaaaattaactaataatatataaataaataatgaaaatactaacgctttatctatttgataatgtataaatttatgtctgcattaaggtattgatactccaataggatattttagattctctttaattattaaacgataaaatatttagaaaaaggccaatatttaattaaaaatcaaaggtttaacacagatttacaatgctacacaaaatcaaattttctgaaaaatgaataaagcgaagttcgaatccgcgcggtgtatattattttctatgtatttttgggttatttttaacgttttaattcatttaaaagaatgtttttttcttaataaaaataaaattttttaatttaaattaaattgtttttttgtgaaaaatgttttaaattaaaataataatttatttacttttattaaagaactcctgtatttttaaattagaatttgtaaaattaatttcaatttaaataaatattcaatccttgtacattttcaactttctttttaaataataaaaaggaataatttattttatttttttaaaatttatttaattacattcaatatttaatcttactttttaataaacgatttcct

SEQ ID NO: 22810 - DNA, 2147 bp, Heterodera glycines
  misc_feature (1957)..(1957): n is a, c, g, or t
  misc_feature (2062)..(2063): n is a, c, g, or t
tcaatctcatcgctcttcggtataataatctccggcaaaccaatcgggtaagctgtaccgtaattcactgacggatacagactcacaatatcataaacactaatttttttcttctcatccgatttcgcaaacaatttcatcggtcccgtcctccctcccgcataagccatccgcggatcaatcggccccttctcattccctctatcgtcgaagaagtccctcatttcctcatcctttttcaactcctcaatttgacagccctaaaaattcacaataaaaatgtaaatgtcaaataaacttacccaaacttcttcgacgtccaacgtcttccgcagctccgccaatctctcctgcgtctcatcattcaattcctgggccgtccttcctccaatcagttccgctgccgggtcataacagttcatacatccatgtatatagcatcccataacttcaatgcacttgtccctagctccgttattcgcaataaatccatccaatttgtaattcccaattttaacttctcgtccgttccccgcgtgccttatctcaatctcatcacgcttgctccgccactccaaatacttaatggccataacactcgctctatcacaccgctcatagcctttctccggcacaatcgataactgctcagtcaataaaaacattgccttaaaaatattcatcgcaacccccgcattcgtacaactcctcggtaaggggtcaaatcccttcgtaatatcgttaatcaatatcctcctaaactcaataatcgataacagcaatatctctgtgtcgtttctgcaataatttctcaattcgtcattcaaataaaaaggcgtgtccttgttttcgttgtacctgaaaaaaattatttattgttaattttgtccttcttttcttaccatttttcgaatttttcgtatttattcttgttcatagatcccggcgaatagtcctccatcggtggtagatgttgtaatcgaactccataattttctttcttattgtagtaataggggaaaaagggcttgtcctcacagcccaagttgaaggtcgccttcagcgactcgagtttcaccggcatcaataagcatgagtctctccatatcagcattgaatgtttcttcgagtttcgcactttgaattcataaattttgagtccattgataagcggtatcgggttcttcccggtacggcagaggtagttaaacacaaaatgacctaaaaattttaggatttaaaaatttagattaatttttttttcattaccatcaaaacgcccagcattgtgcgcaaatatgtacgtatcgtaatttgaaaatgccgttaaaatccactccacaaatgccttcgtcggctcatgcccctcagcctcgctccaatccttggtcctctcctccccgcatattttgcaattcgtcctatttttatcatcacagcactccgtacatgtaactctcaccaaaatataattgatcacatgctctttctggtcccccttataaatcgaatcctgtgatgtttccgtatcctgaaagttaggttttattttgtctttttctttattaaatcttacccaaacgacaattcggtagacggccttttcctctttctcctcgatcggtataatataacaaccccgcttggggtcatggctcacactacaaagttggcaataagtctcttcacattcatgtcccttcttcgggttaaatcgataagtcttgtcacagataacgcaacgcctccataatttacaagtctgatgttcctgatggtaattataacactccaaattgtaaaagtaacgacaacacttcgggcactcaatcttcactccactctccttttggcatggtactcctcctactttgttacaataataacaccttgcccggcagtcgaaagtatggtaaatatctttgtcgtaaaagcactcgcaatcaatacagaattntctcccacggttgaaaaagcagacataattcttcagaccatcccaatggccattctccaaaaatatcggcactacattttcgcgtcccatagggcccttccatannacacggatcgatttccgcggatccgcagactttttcaatggcacaacccggtatttaccgggggaaaatctcatcctaaaaatc

SEQ ID NO: 22811 - DNA, 1740 bp, Heterodera glycines
atccggcgagcactccgccaattattgagactgtctttcgtcggcgcattcgctttttctccacttcttcgttcaaaacctgaagttaggtttcggatttcgccctcattgtccttaagcaactcgcctccaattcgtcgtccgactgctcctcccctctctttttggctttccttttctcctcctccgtcaacatggtcgtcctcttccgtgcgatgaattcctcggccgcgttgtccaccggcactttcgggcactgttcgccggagggtttcccatcgtccgctgatttgctgctgtcaagagtcgcctgtgtttgtattaaaatttacaatgaaaatataaagcaattcggtcacattgataatcggttcggaccctatcgacgagacagtgcttccactttgggtgcccgactttgaccaaaccactaaaatatgaatacttatagcaccaatttggtctaaccaaattaaaaattcgcacttttgcaattaaaaaataatacagaacaatttaggaggaaataaaatgaaacttaaaaaagtgaaaatttcagggttcggagacatcagcgaccaagagaattttgacgaatttaatttcgggactcggaattgtgtcttttcttgttaaattgcaacatgtccttgcctccatgggtcgtcgttgtcttttgttcggtttcgccatggccaattgtttcccccttgtgattttcgccagcctccgatacatttccatcgtcgcttagtggcggagaagcggccacttgagcataagtctttttgaccgtcgaattattggtagacatattttgatatttgaaatgcttaatattttgattaatctgtgaattaataggctgcaggttttaggtttttagaaagggcgaaggcagagagaagcgagacccaatggctttggatggaacgtgtctcgagacgagtttattttcattttgtttgctgctttttgacaaaataaataggtatctttggttccgataagtgctaaaattgaaaagggttgctgcccatttttcatcaaaaagaaaatttttcttgagtttcagggtgggggtatagcccccaaggtacgattcgttctttattcgaacctctcgtcaaaatgttatgacaaaaatgttcgaacaaccagttatttgaattcttctggccataacaacttttttgaaccttattgaagtttttcgaaattttgcaagttaatagaggacacttagggatatcgaatgatacattgttggatttgattagcaaaatttttgcaaaaatatgttaaaatatgaaaagggcctctaaaagcgcaaaatttgaaaaaaaaaattgtaaatataggtaggaggtggctatatatatttaattggacagtcttgtggtccgatctttattttctaatattacagctctgattagatcatttttaatgttgtattttggagattcatactcattccatatataggtaacattcactaataaatttatatggccaatgttttgactgcatttttcgttatgcattgatttgattagaataatcaattattaattaattaaattgtgttaattgagggtggagcgggagagatgaaagttactaaagtaatcacagatggggaagaaagtcgatgaaaggaggcggcgggggggagacgaaagacacccaaaaaccctccccaaattcgaattgaaataaattaattgcaattgactg

SEQ ID NO: 22812 - DNA, 1817 bp, Heterodera glycines
acaaactgcataagagccgacaatttaacgaaaactattgaattataaaaaaattttatacaaattttagaactcaaaaaataaccatttttccggtaccattgaaaatattggtaccggcttattttttaaacaaatcaatcccgaaaattcaatttattaaattttaagttattttttgcacaaaataaaagcaatatttaataatttaaattgaaacaatttttaaaaatgtttaaaatataatattttcatttaaaaaatgattaaagaaaaaattttagaaaaaattaaaattttttcgtaaaaaaaattttcccgttcccggcggatttcccgtttaaaattgacgggatttttacgggaacgggaaaagggcggggaatcccgtttcgagaatccccgcccctttttcttttcgtttttcccgttcccgttcccggaaaaaattttttaccgggctctactttttggtgctttttttgcctttgcgattttggtgccaaatgccgggcacgtaatttttgcggtcggggtggggtcgttttcgcgccagcccgagtttctggttcttactttttcattgtcgatcaaatctaacaaacttggtaacagtcgaatgctttacatgtttagaagctattcctaaacaattgattggcgaaaagacaattcctaaaaaaattataagtgaaattggaaaaaagtcagaatttaaaacttttttcttaattacttttttataggccataaaatctttttattttttgtaacaccaatagagtatgtgaagggctttcgaatgataccaagattgttaggtttgaaagacaaagaaaaaagttagaacccaattggtcccggccctccgggacctggccttaggaaaagcttctcctcatcgagagctttcgcatgataccaagattatccaatttggttggcaaaaaccttcaaaaataattaccaaaattcgtcattttttaatatttggacaaaaataaataaaaatattcatgttgcacaacggactcgaaccacctccctttgtccctttactatcttacaaaaaccacttcgccacacatgcaaatcttattggaactgagaggccaaaattgaaacggtgtgtataatatttatttttatattgaactttgcgacgacgccaaaactttttgttgaataattgaaaaaaatgctagcgaaaaagttactaataaaatacctccggcaaatgaaacatttaaagaacaaattaaaaatcctactcagtctcaacataatattgcaaaaaacggacttaatttttcccaaatttaagacaacaaattcatgaaatagttaaaattatcgaaaaccactaaatctgtcattaaatcttctctccatttgtttaaccttatttaatgaaatggctaaatatggcaaattttaaatattaaatctgctttgatagatgagtttcgttcaactaggcttttttttaattccgcccttttcattacgcgattgcatcgcatcaaaatgcataatttagtaaatgccattgaaaaggttcagccaaagcaaaaaaaaaaaaacggaaaatgaactgaaaaagcaaaaatcgaaggctaacaaacgcaatgggaaggagaaagagtgacaaaacgaatgagaagagatggacagattggcacttctgttgggggaggggatggaaaatcgaatggatttttttgatttgttggtgtgttatttccaaaggattccaagatgaattttgcataatatctttggcttaaaagccacattcagagtcgaaaagcctcgtt

SEQ ID NO: 22813 - DNA, 1487 bp, Heterodera glycines
  misc_feature (1466)..(1466): n is a, c, g, or t
aaaaaagaaatttactgattattggatttggataagataaaattaattacttttaaagaaaattatttaatcacatttggatactgcaaaatgaatttttatttatgggtaaggaaagtaatttcaaatgagtcaccgacctgtcacgttgtacaatgcacatttgatcactaattaatataattaaaatattaaaaaacccaaatttaaattttattttacacaatggtgacaggtccacaagttcgcgccgtccctgcaattcggccaaattttttgtcaacattcgtccatatttgttgaaggtgggcgtgtactgttccaacatggagaagtgaaagatgggcaacaacattcggcgctaaattaaatgaatgtattttgatacggtaattagaagggatacgatacggtaaatttcatttaataaacaattttttatctaaatattgaaaaaaacttgtttaaaaagagatgactgataattcgaaaaagtatatgtgaaaattcatgaaatccgggtgcaaaagacaaaaagcccgaaaattggccgaaagacagtttttcaagcgtgcccccccaccgaagccccgaaaatcctaaatcttagtaatcctcggctgatttatggatttatgggactcacttggcgaagccaatggtccccgtcgctgaccaaaacgccgttgcccaaccattggtgaaagaatttataatctggtccctttttcatttcttcagtgctctcaagaagaacctggcattgttttttgcaaattaaaaaatcaacaaaaatttttataaaactcgacatttaattccattaaatcccattgcttaattcctaattatgtgtccattttttaatttagttaatcttgtttaaattgccatatttattaaaaacaaaaatcgagcattataattcttaatccagttaaaagaatattttaaaatgataaaaaatgaccaaaatgggatacaaaattaattagtaccaaagctattttaggaaaagcaaatactgtatttaaacattaaattgttaatcacttttgcggtctctccatccaacatgataataataaatttattagcgacccacctaaaaatgaaattgaaaaatgtaaaataatggatttattttaatttaattatttattatttttttgaattgtttaaccatctcatcaaatggtgtccattacggatggcctctgaattaataaataatcaaccaattttttaaaacattataaaatttaaattttatttcttaccatttgcatgctccaacataaagttggaccattctgaaaatttaaaaaaggcaattaaaaatagaaaactaattaaaaaatatattaaatgatcaaaatgattgctaatttaaaaattatctaagcaatcttctgatcaatattaatcaacaaaaaattgaagcagtgggggattctaccccaaanagggtcaattttaggaatttt

SEQ ID NO: 22814 - DNA, 2919 bp, Heterodera glycines
  misc_feature (66)..(66): n is a, c, g, or t
  misc_feature (78)..(78): n is a, c, g, or t
  misc_feature (2879)..(2879): n is a, c, g, or t
tcagatggaactcccgcgtacacatcaactcctgccttttcattacaggcaccgctgcattcattncaccaaaacagnagagcatggacacgggctttggtgtgattaattggtccgattcggtaatgaatttcagtaaaaattcagttttgcccgatgatgaaggccccgaaatgattaggccaaatggcaatttaaaacaaatatctttattggtgaatgcttgtgtgttcaacatttttgagaaaatgatgaatgttaaattattcacttaaataggcacatttgaggttgaagcattaaggctgttaaagaagtcgtcaagagttttgtcaatgtctccaatgtcttctttgttttcttcttctccctgcacattttcctcttcttccttgatgtcagcggcttcatttgcctgcgtcgggacatcagtggaattgcggttggtggagtccagtgattcagccaattggagattgccaagcacgttgatagcggttttggccttcttccaccgtgtgccgtcctgcatagcatcggccattagttcagcctccaccaggtcaagtgctacctttgccttgcgcttcagatcctgttgttgttgttgttgttgttgttgttggtggtctgtcggtttgcttttggcacacgtcccggagggcaggtctccgtaggggacattgaacaccctcgctttgttcttcacgcggaaaaagcagtgccctggcaggtcgtagacgacatcgaacggcacaaattggggtttgttgatacgagtgcaccacaatgtgaccccctctttggtcaccattatgtccacctcggcctcggttgctttgcaaacgcggcagcgtccacaatcgtcaaacggcaaaaaacggggggtcgataggcgtggaccactgacagttatgccgcttgtggttatggtgatatcggactgggcgaggatttgattgaaaagcgatttggtgtccgaaatattaatggccattttagcggaaaatttcaagaatgaaaacggaaaatgagcggaagtcaatttcagtttatttttataggcctcatccccacctcactgagtgtttagagccaatcaataaaattgcagaacatgagaacaccgccatatttaactattatttaaatcaattttaaattctgccctttcaaaatattcaccaccatttatttgacaaaattcatcaccaattttttaaatgtcccaaaaaaaaagatcatatatccacatcactatcaacaaatcggtcatcgatcgacatttcatttcttgtcacgcttttctctctcctcaagcgtcttcattattttcagaatgttctcgtgctttagtccaccttctcgcgcgaatgccaatgcctcgacgcatgcttgtttggcggtcgttggagtgaaccagttgtaccactgcagaaatgataaataagatttgaattcaaattaaagaaaaaaattcactacatctttatcattttcgaggatgtcccatgcaatgcttatttcggtttcgggcgttggactgtcggacatttttaaaacaaaaatttgaagtaaattttgtgtgcttaaatgatatgatttgggatatagcaaaatgtaaagcggataaataaatgtgaaaatattgagcaagtgatgtgaagaaataatgagagcgagacgggagggatgcatttaaatggtgcgctgttgaccttgcacaacggctttattattattctccaaatgggaggcagctttattatacaccaacgcatcccgaattcccgataatggatgtgacccatttttaaacaaattgctcatttgatgtaccgacagatttactccactatatcacacattaatcattcaaaaagattatatcgcatgtttaaaattcaaaattcattaatctcgcctaacgatctgaatacccaacagtaaaacatttgaaatttctcctatttagtggtctcctataaattgccaatttgtcattttgttacatttatttgccaaatattgtttaatgtgaaatgaaaattcccaaattttataaaaatttatgaggaattaaagctcattgttgtatcggctcatcgttcaaaaactgtcgtcgtcatcgtcgtcttccggcacaccatccgctggcacatcataaatcacctcgcgctgctgcgtttgtggctccttttttaaaaaatggtataaaaaagggaagcgaagggctttgttgtgtttgtacctggtacggcggcccgccgcccaaattcgccggcacaacagagggtggcatcgatcggcggcccccgacttgtccagtcctttgcgcgtccccagtctgaaataatttgaaaatttaaaatagtaaaattaaaaagtttttactcacctgatcaaaattcaccaccattggcatcgtttggcgacccacttggttgcgaagggttttcattccttaaaattgtttgaaatttttattggttggttaaatttttaaaaaaaactcactcttctgacgctgctgcaattttcgctggatggcacgatttttgagaatgcgccgcaaaagtgctccaacttgaacagcctaaagaggagaaggggttaggttcaaattgagggaggggggggggctacctgcgcgatgaacaccaaaaagatgaaaaatgtgaggatgaacagcaaaatggaatgtgatgattgaatgggagagggaatagggcaaattgttgcgtttgttgtcgttgtcgttgtcgtcgctgggaatggtggcgaagtcccctctctgaggtatgatgtcaaattgttgacactcgcatgcaaacataaaataggcttccaggaaaccgatgggggcctgaaaacaattncaggccctcatcgcaactgggtgcagtcaaatttaaccca

SEQ ID NO: 22815 - DNA, 924 bp, Heterodera glycines
  misc_feature (48)..(49): n is a, c, g, or t
  misc_feature (55)..(58): n is a, c, g, or t
  misc_feature (64)..(67): n is a, c, g, or t
  misc_feature (73)..(74): n is a, c, g, or t
  misc_feature (98)..(98): n is a, c, g, or t
  misc_feature (103)..(103): n is a, c, g, or t
  misc_feature (126)..(126): n is a, c, g, or t
  misc_feature (147)..(147): n is a, c, g, or t
  misc_feature (149)..(150): n is a, c, g, or t
  misc_feature (161)..(161): n is a, c, g, or t
  misc_feature (175)..(176): n is a, c, g, or t
  misc_feature (179)..(179): n is a, c, g, or t
  misc_feature (182)..(182): n is a, c, g, or t
  misc_feature (186)..(188): n is a, c, g, or t
  misc_feature (190)..(190): n is a, c, g, or t
  misc_feature (193)..(193): n is a, c, g, or t
  misc_feature (195)..(198): n is a, c, g, or t
  misc_feature (200)..(200): n is a, c, g, or t
  misc_feature (208)..(209): n is a, c, g, or t
  misc_feature (217)..(217): n is a, c, g, or t
  misc_feature (221)..(221): n is a, c, g, or t
  misc_feature (234)..(241): n is a, c, g, or t
  misc_feature (245)..(245): n is a, c, g, or t
  misc_feature (247)..(248): n is a, c, g, or t
  misc_feature (258)..(259): n is a, c, g, or t
  misc_feature (264)..(264): n is a, c, g, or t
  misc_feature (269)..(270): n is a, c, g, or t
  misc_feature (287)..(288): n is a, c, g, or t
  misc_feature (290)..(290): n is a, c, g, or t
  misc_feature (294)..(294): n is a, c, g, or t
  misc_feature (299)..(302): n is a, c, g, or t
  misc_feature (313)..(314): n is a, c, g, or t
  misc_feature (323)..(323): n is a, c, g, or t
  misc_feature (347)..(347): n is a, c, g, or t
  misc_feature (351)..(351): n is a, c, g, or t
  misc_feature (358)..(358): n is a, c, g, or t
  misc_feature (361)..(361): n is a, c, g, or t
  misc_feature (365)..(366): n is a, c, g, or t
  misc_feature (372)..(372): n is a, c, g, or t
  misc_feature (389)..(389): n is a, c, g, or t
  misc_feature (392)..(395): n is a, c, g, or t
  misc_feature (402)..(402): n is a, c, g, or t
  misc_feature (405)..(405): n is a, c, g, or t
  misc_feature (408)..(408): n is a, c, g, or t
  misc_feature (416)..(417): n is a, c, g, or t
  misc_feature (419)..(419): n is a, c, g, or t
  misc_feature (427)..(428): n is a, c, g, or t
  misc_feature (437)..(438): n is a, c, g, or t
aaattcaaaaacccgaaaaccgttttttaggcctacctttaaagaggnngaaaannnncgaaannnnaaaagnnaaaaccttgagctggcaaagctcnacaanaaggccgcgggagccccctcgcncagaacaaacgcggacgcggnanncacccgggacngaaggggacaaagnnganacngaannncnccnannnncngcagcccnnccaacaanaggnagaggccgggaannnnnnnngacngnnagacaacacnncaacnaaggnnccaaccagcggaaaganngngaancgagnnnnacagaaaaagnnaggggccgncaaacgcacgaaaaaaggagaaancagncccgggnacncagnnggcccnaggaccggaaaaccaanatnnnncccggangcnccncaaaaagnngnaagacccnnccaccactnncagggcgctcccggccttcggccgggagaaaatggttttagcaacgaaactccttgtcaatataacatatatagtaactagcgggtgtgtgcttacatgtttcttgggtgcttaaagcgcttcgcgctttgggagcttcgctacctaggccttgtattagggtctttgcgtcagccgacatgcacttggtttcactcacgtgatgagctgacacattgcatttatcagtgcaatggaaaccggaagtgccctaactcgcacgtcatccctcctccctcccttagtccaggtggcagcactttttgtatgtgtatccgtttaaagtgcagatgagaacggggcgacatcagtaaagtgccacacacgctggactataactcgtttgccttattgtaatttgagcatgtttttggccacaatgttcaacactttggtttgaccttggccatcggtctcccttctgggagcgtacactcggacgttgtt

SEQ ID NO: 22816 - DNA, 1169 bp, Heterodera glycines
cttcgcgacatcagtcggacgcttcgcaacggtttttcaatttttgttggccttggacgggcgattcgcgcccgttttttaaattttgttgaacttatacgggcgcttcgcgcccgtttctaaatttgttgggctattaaggcagcttcgaggcctcagacgggcgcttcgcgcccgtttctaaatttgttgggctattgaggccgcttcgcggcctcagacgggcgcttcgcgcccgtttctaaatttgttgggctattaaggccgcttcgcggcctcagacgggcgcttcgcgcccgttttttagcttgttaggccgcttcgcggcctcagtcgggcgcttcgcgccggtttttcaatttttgttggccttggacgggcgcttcgcgcctgttttttaaattcgttgaactcatgcgggcgcttcgcgcccgttttttagcttgttaggccgcttcgcggccttggacgggcgcttagcgcccgttatttaaattttgaggtacaaaagtgattagaagaggtgcaacagtgattagaagagtgatcagaagaggtacaactgtgattagaagaggtacaatagtgataaaaagaggtacaacagtgattagtaaattcattaaattaaaatcaaaatattttttaacaaatttaattaaaaaaatacatgaaattctatcaattaaaaaaataattcatttaaacttataaaatttattcattaaaaaaaaaattagtttaaatataattttttatttattaactcaaaaaatattttaaatgaataaacattgaaaaacacgaaaaaaatggtagaaaaataatgttacaccccccagatccgaacttgcccctcccctcctcaaaatgatgccccagaatccccaatcacacggggattctgaggtctaaacgatgtcaaaagtaaaaactgattacgtattcatgatcagcggcccaaataacccctaaagacatatttttggaagatttttgtcgaaaaaatttttccactcaaaaatcctggtcacccccctttggacccgaagcacaaaatcacttttatttttatatctttttttaaaagatgtgataaaaatgtaaaataaaatttatattatagagaaaaaaattgcagatttttgtagtattttacttttctcaaa

SEQ ID NO: 22817 - DNA, 990 bp, Heterodera glycines
tcgtgcagcaccatttggatcagttctcgtgcaaagtgtcaacggcactgtgtgagtgatttcagtccgcccccattttttcttttgaaataaatgtttgcggcgtttgttgagccgaattccgaccgcttcgagttccttctccaacagcgttttctgaaaaatgccaatgaaatgacaaggaatttgaagggcggggggaaatggcaaaaattatgaaaattcctttgaggttttattagacgctagcggaaaatttaaagaaagttgcataaatgatcagatctttgacaaataaaactcccggaaaagtgcatttttaggaaaagacaacccttgggtatttatttataagtgcatgagttacaatttattgacatatgcaaacaggtttaaaaaagtcaactgtttacttggatctcccccttggtagcgtccaacatcatcagaatgaggtcggcagtcttcgccacggcgatcacttgtcttcctcggcctgaaaaaaatgccgaaattgttttttaaaaaggttctcaactgctgacctttgccctgcgctgccccctcaatgatacccggcaaatcgagcagttggatgttcgccccttcgtactggcgaaagcgtttgtggacaaattgcagcaaaatgaacgcctacctctatcacaccaggaatgccttaaaagtaaacaggaaaaatgaaacatttcgcactgatttaagcccaaaatgaaattacatgtcaaagtggtgaattcgtacgaagcagcaacactctgaaaacaaagagaagtcaaaaactaatatttacacttttatttggcagcgaaaatgaaaatttgtgttaaaaatgcgattttttgtaaaaccaaaatatattttcccgcaaaaaaggcgttcacaaaacattgcctctgttgttgtgacggttgaaagaaacgttgactttccaaccgatgggaaaccgaccaaagcgactgaaaacaaatt

SEQ ID NO: 22818 - DNA, 1706 bp, Heterodera glycines
tttttatgaataccttttaaaaaaaattaaaagttatttatttttttgtatatttggaaaattgtaaaaaatcattcctcctttttagaatttttgatcttttaaaacaaattgttaaattatcattgtgaaatcatttattaatgcaattcaatgcatatttctttgttttggaaataattaaattaatgaaaggaattaagagtaatattagaaaaatatagaattaatccaattaattattaaaaaaatgaaacgtattataattggcaatcagttaaaaaaaaaaagaaaataaaatgtttaaaaattacacaagaaaaggtttaagtaatttttcttaaattgtaaaaaaatgtaatcaaacttaactactcctttgtttgaattgctactaaaatataatttagttaaaaaataatatttatattttcttttttacatgacaacaaatataacaaaaataatttaaagaagttatatttatttataataatataaatataaacttgattaaaatgaaattgaaatttattaagcataaatttgaatttaataaacattttttcgtataaaaacaaatcaaatgaaaattattactaataaaactataaccaaaaatattgttaaataattatttattagcacaaattcaactacatagataatattgcgagtttacgagtttgagaattaaaatagaaaaaaatgaacttgcagaattttgaatgaaaaatttacttaaataataaatatttatcaggaatatattaaagtgtataggagaaattgctaaagataaaagaatgctaataaattttaatttaatcaaaaaagtaaaaaattattaaaatattattaaataataagctgtggtataaaagaaaccgtggaaaagtaaaatgtagatataaagttaatcattaacatataatcattcatgggcatagaacaaaataaattttttcatttcttttaaaaaaatgttttaaaaaaataatgataattttacttttattttaatttttaaattaatatataagttattattgagttcactaatttatattaagttatatcattattttaataattttcgaaaaaattatccaataaatagtaaagaaattatattttgagcctatttatagtttatactaaaataattctcatataaacaaaaataaaataaactttaattaaaaaataatgtaatttcaatttagaattgattaatgaaataaaacaaataagtgaaaaatctattccttttatagacagatttgaaagtttgaaaatttatttgaaaaatagtgataatttttgctgcttcggttttttttttatatttttgttgcgatgaattttatttaacatttttgcttttattttataaattacctttttattgctttgtttttcttttttaattatttttttttaattggaatatttttttctcattaacttttcttttttcaattcacgaccaaactcccatttccgtcttcaaatgggtgaattcgaccaatttatttattcatgtatttattttatttttataattttttctttatatcttctatttaaatcctattgacttatgaaaataaattttttatttaattataatcaaatttatgataatgaagaaatttatatataagaatatgaaattagaaaatttcaaaatattctttttatga

SEQ ID NO: 22819 - DNA, 905 bp, Heterodera glycines
cggctggccccggtgttgaaagcggccccggcgctttcctgggccccttggggccctggttcactctataagggaaaaatgtaacttgaaatgactttttttgaataactctcttcaagttggtcggatcggctccgaacaaaagagtacaactattttttaaggattctctatcgaatggtgaaaaccattttttgaaattttcacgtaaaaaaaagtttcttcagaaaatttttgaaaattttcggaaattttttgaacggctctcagaaaaagggctgtatcttggcggggagtgccgaaaccggcttagcgatgttttggaggataaatgtcgacactcaggcgcttctaatgagctatcatacatctttctagcataaatttaaaatagagttttgctctggacacgaattaaaaatttttggaaaaatttttgcctcaagaattaggggggatacgcagggattctgaggggttgatgggtaattatgatgaattttttacactggaaatacttaaaatatgatgttattacgccctacatgcatttgggcattacatgtcaaattcacattaagatacttgatgcggaatcatgtccagaatccgaaaaaaattttttttagaaagaacaaaagtaatacatcagaaagtcttaaaacagtgtaaaaagatgtttgacgtttaaattttggatataacttcaagtctcaccaagatactgcatgtgcatcttggtatgtaaaatagtcaacttttgaaccactcatgaacaactaatgaacaactgatgaacaactcttgcacaaattctgcactactgctgctctaattaataaattaacaaaatatataaggggaagggttgtaaaggaggggagaggggggagagggggggagga

SEQ ID NO: 22820 - DNA, 2327 bp, Heterodera glycines
aaaaggatttttcaaggttcgtttgttgtttatgatcagtcaatttaccttccttttttaggtcgaagttgaagagttggtgactttctgaatgctagcaactttctcaatttgcaatctctcgtaagcgaacaagcggcaggatgggtctcacttttctaagaatacaataagaattccttttcgcagtcatttgcacccactaaattttgtaatttacctttcctgggattaggcgttgaatgatcccgaatcccatatccattccggttaattcataacccagacggttactctcacattacgtcccatgcggtccaagccaatcgtatatttgtggtccgacttttcgacaatttttgttgcctttgaattatttttgtttttttaagtatcgtcattcgtgtcaggctatggctgctttgctcaaggaccgttctcctgaggaaattcgtgatctgcttgggattgaggacgatctgactgaggagcaaaaggcggaaattcgtcgcaaaaatgtttggtgcaactattgagagttcagaagaagaaggaatgacgaccgattaccgattctaagggttttgccataacattttggttcttctgttattgttattatttttatgctttaaacaaacgtcgttcgattagatgctcattgtcattaaatgtttgctcggatttgatggaattattgccttatttgttatattcgtgttccttaatttgggtattcgtacattgccaatatcatttacttttgggttgaactcttctgaagtgttagtcaattttgctttttgatgtgaggctgctaattcgactatgactccaccttctgactagtggctggactaggcgctcgagaaagcactttgatgaaaaagatataaataaaattcgtcagcttaacaccgaggtcggcaaaatacgcacaaaaataaaacacatgcagcacaatttgaccatctttgaaaatgctgcgcttcagcgcgaccaccaaaaatctttgtcggaatatgaggagctcatccaccagcagaatagtgcatttgttgaggaattttttcaaaaacatcccaaaaattattggcaaattattcacaacaattataggggtcttacagaacattttcagaagatagaagaactgcaagcaaaggcagtagggttaaaggataatgcctctttcgaaaagcaaatagagcgagcaaaacagatgattgagtacagacgaaagagattcgctgcgctggaatttgagggccaaaaagcgtgatgagcaacaacagtttgttgcagcagcagcaaatacaattactgcaccgactgcgtcggcattgatcggaagagaggcgttaaaaaaacgtacaggcatctctgccagtacggatggtgaagtaggtgataaagcagatgtcggtccacaaacagctaccacaacaacacatggggaggtattaaaagagaaaatactggagcagcaaaaacacacggacaacgatgataaagcagatgtcggtccacaaacagctaccacaacaacacatggggaggtattaaaagagaaaatactggagcagcaaaaacacacggacaacgatgataaagcagatgtcggtccacaaacagctaccacaacaacacatggggaggtattaaaagagaaaatactggagcagcaaaaacacacggacaacgatgataaagcagatgccggtccacaagcagctaccacaacaacgcatggggaggcagtacgtgagaaaatattggatcaacaaaagcgcacggacgatgatgataaagcagctgtcggtcagcaaacaatcccaacagcaacaaaaacacatggtgagacgttaaaagaaaaaatatcgcaagagcagaagcacctagttgacgataagtcaaattctgccaatgcaaaacaagatgatggtagcggtactgatgagaaaatcgcgcatggtcaaacgctaattgcccgacttaaacagagcgaggagcagaaaaaagaatggggggacccatcccaagataatgatgatgatgggcgagcgccgaagcatggagaaatgctgtggaaactgttgcgatcaacggtgccgactaaccaacagcaaatgggcgatgtcatccaccaccaatttgctgatgctgaacaaacccgtggacgaggtactgatggagctgttgaaaaacattttagaagaaaaaactgacactgcggatgcacgagcgaaattatcaccatctacggaaatcggcctatctttcttcaacactgcgaagaggtgaagcgtgaaggaactgattaaaaa

SEQ ID NO: 22821 - DNA, 2167 bp, Heterodera glycines
tttttgatgagtttgtccacctccggcgcactcaccccttctatgatgcgatagtgcggcgccaactcgtccagccatcctgggcgtacaatgctcaccgtatgcagaaagcggcggtcggagtggtcgcgttggaccgcctcgttgaacagcacccaggccggcttctgattgctgtactgtttgttgcccttgaatattggggggggggggcttaattagattaattagtgcgttcaatcaaaaatataaaaatgctatttgtttaattggatacgcaatcccattcaaatttctcttttatttatttttttttacctttaaataacaaaaacaatctttggcaaaatttttgcttttttaaataaaaaaaatattttttatttaaatttcgggaaagaaaatgtggtattttccgttttgggcttacacctcaaaattaaaaaaaatgtcaacaaagggcgcttaagggacaatttgtattaaataacccaattaaaaatcccgttaaataagctaattgaagaaagcaaacaggcaatcattagccggattatttcgtatttaaaaaaaaatcattagcgtccataatttaattgcattatttttctaatggctccgaatgttcgaatttgatgagtcatccttttttgtttttgtttgtggtgccaccttatacaacacagaagagccgtgcagcatgtattcgtcagtgacagcattttgcttcccatttctattcagttggctttccaccgtcacataataacctttgcgcgcctgagacgtgtggccggtgccagaagaatagaaatatgccaacttaaaagtaacaaaatgcattttttacgaatgccatctccaaacgaattggtttttgtttcgttgatgtaaacaaaaaaatgaaaatatttttggcattttttcatttttaaaaactaatttattcaaaatttgcccataaaatttcattaacttgagaaccctgtctaagatggatttccaatttcaaaaagctttcactcactttcatgaacgaagcggcgagcaaagccttcaaaatgttgtgggggtaaagcggcgaagtcggcttcaaactttcaagctaacaaaacggcatttgaaaataaaaatataaaacatttcattcacttggatgttgagtctttggatcatcgcattggccaattggttgcgaacatcgccggcgtattgcaaagttcggaagttcagaaaattcgcataacaccattcttccttggaactatctaaaagagagcatagaaaagcaaaaagtcaaatacagtagcagaagggataaggtgctatgacgaagcgaaaaaagtatgcgtgtggggcgatcggagggggtgggtcatttcagtacggaagagttgttctaatgatcaattaattatttaaatttttaatctattaattagatttgttaccataattataattctattattctctatttcagtttacacgaccacaaaaaaagacacgaccatgttatattttgataaatttcaggcaacataactttttatagaagcacacaattaaacattcttgacatcttttgatagacctgagagcgcactaattcggtgtctgctacgattttttagagatgccgcgggattaaattcgggatcccgacctcgagatccgtcccgattacttttccaaaatcttctggatttggacgggatcccgactcggggttcctccgaccccaatcggccggtcactactttatataaagaatttgatgatttcaaaatttcgggaagcttattttgggctagtaagaatgatagccattttcagcgtgggttgaagcttatagtaagaagttttcttattttccattttagcattatttgctatataagaacccatttttataatttcgaaactgcattagcataaaatttttttgaatccaaaatttaattttaaaatttcaagtatttcgagcatttcttagaatatcgaaatttaggcctcaaatttcgaatcttatatcaatttaatttgagaaatttacgccgtattttgccatttttgttaatatttgtacataggttaacaccaattcatttttgaattttgatttatgaattattatccttatccgagctctaagaataatgaaata

SEQ ID NO: 22822 - DNA, 2805 bp, Heterodera glycines
  misc_feature (10)..(10): n is a, c, g, or t
  misc_feature (19)..(19): n is a, c, g, or t
gcctcgcggnccaaaaagncgcgcaaagcctcgtcttttgtggcgggcaatccgtcgctgttgctgggctcgtgcaattcgtccactgagtcggttgagtaagagaaggtcactttgccggacgggtggacaattttggactaaaaagtgagaaatgtgaccacttctagagcatgcttttgttaacaataagccatctcacatttaaagccattccttgctgggagaatttcttacgtgccaactcttccaccgtaattttgtcgtcgtcatcttttcctgtaaattacagtaaaaaaatgaaggaaatagaaaccggaaattttgaaaattttcttaacaaattcattaaaaatccaaaaaatttccccggcggcgcctggcggcaccgccgaaccccaaaattcctatttttcttaaaaaattggttcaaaatcgcaaaaattggccattttttggtgaaaatctgttaacaaatcacacccaaagatcaaaaatttcccggcggcgcctagtggcaccgccggcccccctgttcccgaaaagttttttggaaaaagcgcgccgaaagaaacggtttttgaaaagcaaaataaaggtcatcggcggccgaccccccttcgcaaaaatttttaccgacccacccccctttttaatgtatggctgtcgcccaccaacattttaaatgccctgctttttgaatttgacttcttccctccccattttgctttcagcaggccttgaacatttccgagaaggaccgcgtctgcaattttctcgagaatgagctgcaaaagcggatgaaggcaaaagcacccgccgctttggacgccgccgcgctcagagatcagcagactttggacattttgaacaagcgttttgtgcgtgacgatttgccgttgtcgagttgccgggacacagccacaaccgccgaattgatcgccgcctataggaaaatgccgaaattcgacgaaccgcgcaattcgcgacccgtctcaagcgcgtcggaaatggacctggcgtaacgcattttctcattcattaataaggcattgagtcggtccaatttctgttttttggtgccgtggcaccaatcatgaataaaaaaaaagccaaacttagcccgattattcactcgctttgaatacaatcggcacacccatttaattcagttcctcctcacgcagcaaattggcatttgagcggggcaaggacaaactgaacttttattgtgtgccgttcggcgactgtttgacgctgcgactgaaagtttggaatgtggacacaatgcaaatgcgactgaaatgcgaaataacggacgaaacgggggcaacgcgacagtcaaactttaaggtctgtcacccgccgggaaatggtcgtcccccctcccacgccaactaagaaatgtcgagaaaaaaaaattttaaagaaaattttcagcgattttttggaaacatttttggaaaatatcgttatttttctaattttccgaacaggaaacgatacaggagggagacgtattcgtcataaattctttgttaatttcctccgttttatcggcggcactttctctaatatgcaaattttataaaagtagctgcttaataagtatagactgttttgagaaagtctcccaccgaacgccggtttcgtttaccatggatttttttcaaaaaatttatttaaaatttaaaaaaactgctccaagtttaccatttgttagattgtggaagtcactgcgccaataatggagcccggcggacagtgtgaaatcgctgtgcaataccaaccgaccaaagtggagaccaattttgcgcatttggtgctggagcggacaaattgtgaacacttcaagaagagtgtgcgttttttgggggaccaatacaaaaaattttggaaaacaaaatttgggagagaatttttcaaaaatgtcgcgtttttgcattgtttgtgccacctttttcagttccaactcatcggccacgggggcagcgcctgcgttggactgtccgcctcaaattacgaggatggcattgccaaaaaggcggcttcgagtcaggcaattgtgctgcggccggacgaccccaaccatttttggttggagtttgaaaatcggggccaaaggtggctttattccttggcattccccggggaaatggcttatttggtccaattttaggccgggctatgtcaaattggtggccacaaatcgtttcggaaaggcaatccccggtgatcagatcaacataaagcccaatcaattcgtgctcaatgcctccggccttggcggcgatggcaaagtacaaaaacaaaatcttcgggtcagtttttcaatttatgcattacaatgtttgaaatttgttcatttttcaaatttattgcttttttgcattatttaaatggtcccaccttccatatctcttccgttctaaaattataaaaaatcttcgaatttttttataagaaaatttaaagaaaaaatatagtaattgcaaaattttctggcgatctttccaaaatttaatgaattctaacaacacgtttttttcaaaaaaattattttgaaattttcataaatttttttttataaaacttagaaatttaaatttcgtggggaaatggcggggccgggaatggaatccacccttatttaaatgtctttttgtgctgcaaaatctgtcattttttctcgtgggtttcatatttttcggtctttatttatttttaattttctcatttttttgcacgttttgtcacctagagcgaatttcatttacctcccaattaattttaaaaatttcgagt

SEQ ID NO: 22823 - DNA, 1524 bp, Heterodera glycines
cagacaaaaaagagagagagagaagcgccaattaattggacaggtttgggagaataattagtaaaataatatcgttactttacttaatgattttatataaaattaaaaagaatacaaaaaataaaaattgttttgtatgagtgagagccgaaagaagcaacaaaaaaggaatgttttgagcaaattgcgaggaagaaagatcaatggaaaagagcgacaaagaaaagccgaagagcgaagaaaagaaaagagagggcaagccgagggaaagagagaaagagaaagagaaagaagagaaaatgagaaaaaggaaaagggagggggggggggaaggaactgctgggcccggacagttcagtatcagacagtcccaatttggcgatagtcttccttcccacaaataaatattatggatatttattttccacaattgttttccttaaatttcggaggggggaaaggggagggccaacaatttgttcaaattttcgtttggttttgccgtacctttgctccaccgattcttttcatgctaatacaaatacaattgttgttcataataattttttaataattttcattttttggctctttctctttttgtcctttagttttgtttggatttctatcaccaaaacacggcaatttttaataaatcattttttgccattttaaaattaatgaataaaaaatcgaaaaacaaattgtattaccacttttagactcttttaacatttagcaatgaaataatgtaagttgagctttggcacataaaagaaagattaaaacagaagagaaacgtggcaaatgccgcatttccacagcaaaatgggaaaaagtaaccattgttttgtttcttttttttctccgtttttccttttcttttcacttttatctgactgatagaattaagcgaattaaacaaaggaattgccgcgggcgataactgcccaaagcatttgctgaaaagcgcattaatgaaaagaaaagcaaatcgatcggagaatcgcccaaatcatttgatttttggacaagcgtaacaaaatggcaaaaattggaacccaataaaaacccaaaagtgatcaattaacaaaggaaagctttaaaatactcaccggaaaagttcagtgtcattcatcatctcaatttctgacccgtcgacttcttcaatggatgggttcatagcttcggattgtgtggttttgagcagtgtcaattattcgttgtgcttcggtggggcagagattttgttggtggggggcgaccgtttgatccgtcaaatgaatgagcaattgacaaaagggcgattaattaattaattagcagcgcgaagaataggcgagggaatgtgtgcgtggagggagtagcactcgtattcagcaattcccgaaaagagctcaacaaatcaactgaaaaagaatcaaaaagaatcatttttaaacggcaaaaataaaagggaaaacacaaataattttgtttgttaaagtgagctttttaaacattttaaagggcgaattgagacat

SEQ ID NO: 22824 - DNA, 1374 bp, Heterodera glycines
  misc_feature (10)..(10): n is a, c, g, or t
  misc_feature (17)..(18): n is a, c, g, or t
cgaattaaantttcagnnattctgtttagggaatcaaactacttttatgctatcaaaaggaattttgcaaacttttgtcaggggtttcaagttatttgagacttttttagccattttgagaccaaatttttggccaaactataaaatttaggacctgagctaggaattttttcatttaatactttcaagttgccaattcagaccattctttttgggattcttcacttaactttggctaaaaaggctttcaattttatttagttattttttaatatcattttttatccaattgctctcattattccctttttccataaatttctatttaattaaatgctcaaaattgtttctgtttgtttccaggccaaacatttcgacccgtgcagtgcgttgcttgtccatctcgtcgccgtgctcgcccagtacaacgaacgggttcagcaactgatgttgcgcagcaccgcctttctgccccactgtttggacatcgctgtggacaatgaacgttccgtggttcgttttaaaaaaaaaaacctaacatttttttagcccgcttttcaatctgccattttaaaagtgccacaaataaaatttttttttttttgtaggaatatcggcacaaatgcgtgggcgccatctccgcaatggtcaaggcctatctgccggcactgatgtatgtcagccgccggtgtttcggtcctctcccaccccgaaaaatttttctaaaaaaattcataaaaaaaaatcgctggaaattttttttccaaattttacttcaaattttctaagtcccgacactcgttaattgcagtcgcttcgtggagcttgacgggcccgcccggctgatgcgctgttttgaggacggtgtccaaatgggcgcggcgcccgagggcagcggcgtccgcacaaagttggcccaccggtgcgctgtggcggcggtcgcgttgaagcgcagtttttccgtcgaaggtgggcggaaaagacctgctccggcctcaaacagtgaccagcggacccaaattttatagtgccaattttatagcccgtttcccaacaaagctttttctcgcgcatgcgttcgattcccacccaattcctgcatatttttttcaaacttgcaagaattttgcaaaattatttgcaattctcgaatgaacaatcagaatttgatttcagtgctgaatgccaacccgagctttcgccgtgtggcccaatgtccggccgaaatgcgtgccgtgttgtcaaatgtgaatgaagacggcaaatggaacgacacacttgaatttttggcagaataaatttgtgttttctttttcacttaggatttgttttactgttttttgccatagagttcaattgtaggttaaaattata

SEQ ID NO: 22825 - DNA, 990 bp, Heterodera glycines
tttatgaggtacaaagagacccctatcaatcatagcaaaaaggactccgcgtttgacaatgtgtggaatccatgaaagagcatggcatagcgtgtgggtgatttggagcttcaaattaatgaccgactatttttatgaggtacaaagagaaccctagcaatcaaaggcagaaggactccgcgtttgacaatgtgtggaatccattgaagagcatggcatagcgtgtgggggatttggagcttcaaatttatgaccgactatttttatgaggtacaaagagaaccctagcaatcataggcagaaggactccgcgtttgacaatgtgtggaatccattgaagagcatggcatagcgtgtgggggatttggagcttcaaatttatgaccgactatttttatcaggtacaaagagaaccctatcaatcaaaggcagaaggactccgcttttgacaatgtgtggaatccattgaagagcatggcatagcgtgtgggggatttggagcttcaaatttatgaccgactatttttatcaggtacaaagagaaccctatcaatcaaaggcagaaggactccgcttttgacaatgtgtggaatccattgaagagcatggcatagcgtgtgggggatttggagtttcaaatttatgaccgactatttttatgaggtacaaagagaaccctagcaatcaaaggcagaaggactccgcttttgacaatgtgtggaatccattgaagagcatggcatagcgtgtgggggatttggagtttcaaatttatgaccgactatttttatgaggtacaaagagaaccctagcaatcaaaggcagaaggactccgcgtttgacaatgtgtggaatccattgaagagcatggcatagcgtgtgggtgatttggagcttcaaattaatgaccgactatttttatgaggtacaaagagaaccctagcaatcaaaggcagaaggactccgcgtttgacaatgttggaatccatt

SEQ ID NO: 22826 - DNA, 2020 bp, Heterodera glycines
ggaggggaccggcggaaaggaggggacggggcagcacttggaggaagaggcacaacttcggcaaattggcccaacaaccgacacaacgccaagagatgccgaacagacggagatgagttttgttggcaaagtggacacattggactagaagattgggccggaggcgaagcggctgcaaattctgttggaactcacgcacaaccggcacaacagggcgaatctgaacgcaaaacagctgcacgtggtcaatgaaatgttcaacttgttcatgtacaatcacgcatttgttgtttgcctttcattcattcgttattattctttggcaggtcgcggtgtcttaaagttgtggccacaaacagccaattgctgaacacgctggccaacccggaaccgttgctgccaaagaggaaggccaaccaacagggcacggaaaaggggggcagcattgctagaatggcccaacaattgtccgtttggctcagagtgtctgccaaatacgtcgacgaattgccccctcaatgccgccaagaggaaaagctgaggaaaaccgcacaaattgcacggcaattcagcgaacagcaaaaccaaatgagccaaataaacgaatggtaaggcaaaaaaaaaaatgaaaagtggacaaaaggaaaaaacgaaacaatgtcaggcgaaattaactggggaagaggaatgccaattggaagcattggagggacaaatggtcgaactgttgggccgaattgacacggagagacgggaagcagagaagagtgaaaggcaaagtgccaccagcagacaggtaaaagattaaagcgatgaaaataggtgccaattgggaggaaattaaaaaaaaaattttttcgaatcatcaacaatttcttaattttttttgaaaatttcttaaattttctggggtaaaaccctgcttcctaattaagtaattatcatatggaccatatccataactagaaaacaatagaaaatttaaaaagatttgatgacataaaacaataaggttttttggggccggcggtggataaacgccgcagggcagggccaaaaaataaaaattctggcgcgagtggtggcaccagctggcgaagcgataactttttttgctcttcgacctcaacacttttctgcagttaattttccaaaatttaactgagctgcaggagaaatcgttactctttttaacaaatttttgataaaaagccattttttattaaagagatttttagataaatagggttaagcgtcgcgcggtgcagtttttcatttcgggagaggggggacccacttaaatttttctaaatttcctaagcccgaagtctcgccccaccaactggtcgccgtagtcaagtgcgctggtttttagcgcaataggcaaaaattaattttccaaataaaactttaaattcccattttcttcttttgcttttctgtaaaaagatgagtcaatttcaatttcgggatttttttaaaaatgaaataaaaagtccactaagaattaaaaattagtttttatggatttttttatataacaccctttttgatggtttttatgtaacgacataaatggttaaaaatgtgggatcacctcacaagagggggggggggggatctgccaagatgaagtggggaaaggggaaaacttgaaattcaaacaactttttttaaacaaatgcattaaaaaccagaataaattctcggcgcacgaccataaaattcgccccctaaagaaatgtatcaacaaattttcgcattgaattaatgtcgataagaaccgtccgtgccaccatttcgcaaatattttggtcgaccctcccccaccccttgctcatgtatggtgataacaaattgggagaattgtggcaaatgatagcgctgaggaaaggttaaaattgtaatttcatctcctctattcaaatttaccaaaaaagtatctacaaaattcaaattttattgccaaaaatcccttattttttgatctaagcaagaaaaatgcaaaatcaacacgatg

SEQ ID NO: 22827 - DNA, 803 bp, Heterodera glycines
ctgtgccgagaaccggcaggcaatggatggctttaaatctgcaagaaattagattggcaataagaggttgtaaaaaacttttggtaaggaattattttttgaagtgagtcaaacaccctattagtgctttgctgtgccgacaaccggcaggcaattgatggctttaaatctgcaagaaattagattggcaataagtggttgtaaaaaacttttgggtaaggaattattttttgaagtgcttcaaacaccctattagtgctttgctgtgccgagaactggcaggcaattgatggctttcaatctgcaagaaattagattggaaatatgtggttgtaaaaaacttttgggtaaggaattattttttgaagtgagtcaaacaccctataagtgctttgctgtgccgagaaccggcaggcaattgatggctttcattctgcaagaaattagattggcaataaattgttgtaaaaaacttttgggtaaggaattattttttgaagtgaatcaaacaccctattagtgctttgctgtgccgagaaccggcaggcaattgatggctttcaatctgcaagaaattagattggcaataaattgttgtaataaacttttgggtatggaattattttttgaagtgagtcaaacaccctattagtgctttgctgtgccgagaaccggcaggcaattgatggctttcaatctgcaagaaattagattggaaataaattgttgtaaaaaacttttgggtaaggaattattttttgaagtgcttcaaacaccctattagtgctttgctgtgccgagaa

SEQ ID NO: 22828 - DNA, 907 bp, Heterodera glycines
  misc_feature (778)..(778): n is a, c, g, or t
agaaaatttattaaaaatttcaataattttcctcgtttctccctttaccggcgacccactccccgaaagggtaatccttaacagtgtaaaaatttctccttttctgagactaaaaacccgagaccgggaaccgagaccgggaagcgaaaacccgagaaatttcccgaatcgggaaccgagactctcgcacatccctactgccaatggacgacgctatgtttggcatgcatttgctcgtcaattgtttaggcatttctccatgccacaacttcgaccagttatacaattaccatttttatttcactgaatgaatcaacgtcaattattgttgagccattcgaattggtgaacgaacgaaccagggaaaagctggcatttatgaagaaaaaacgcaattttaatagttggattttgaaaagatgccaaatttttgaagaggcaggcgacgacagtttgccagaaagatgaaaatttgaacaatttaaacaatgtccacttttatttgagtgcccacagatattgcattggatgagcaatggcaattcttttgttattaaattctcagtaattatgtactaaataattttgaaaatttttaattctatttggggcattaaaaaagtttccacaaaataattctcaaaaattgctaattctgtgcgaaaaattcaaaaaatatagaaaatccgaaaatatgtaaatgaaagtcccaagtttttgttcgcaaacaaaaaagtgtttttcttaactcttcagggcatttgagaatccaagaccnaaatatatatttatatgaaatttgcagctctattcataaaaatttggaaaatttctagttgagatttttaatttcaaaaccccttaatttggtaacaaacataaaaaacaacttttttgtcgcattttt

SEQ ID NO: 22829 - DNA, 1077 bp, Heterodera glycines
  misc_feature (840)..(841): n is a, c, g, or t
  misc_feature (848)..(849): n is a, c, g, or t
  misc_feature (852)..(852): n is a, c, g, or t
  misc_feature (854)..(855): n is a, c, g, or t
  misc_feature (859)..(859): n is a, c, g, or t
  misc_feature (866)..(866): n is a, c, g, or t
  misc_feature (868)..(869): n is a, c, g, or t
  misc_feature (874)..(874): n is a, c, g, or t
  misc_feature (879)..(879): n is a, c, g, or t
  misc_feature (883)..(883): n is a, c, g, or t
  misc_feature (885)..(886): n is a, c, g, or t
  misc_feature (897)..(901): n is a, c, g, or t
  misc_feature (904)..(906): n is a, c, g, or t
  misc_feature (909)..(911): n is a, c, g, or t
  misc_feature (919)..(919): n is a, c, g, or t
  misc_feature (923)..(923): n is a, c, g, or t
  misc_feature (925)..(927): n is a, c, g, or t
  misc_feature (929)..(932): n is a, c, g, or t
  misc_feature (935)..(936): n is a, c, g, or t
  misc_feature (940)..(940): n is a, c, g, or t
  misc_feature (943)..(943): n is a, c, g, or t
  misc_feature (947)..(947): n is a, c, g, or t
  misc_feature (950)..(953): n is a, c, g, or t
  misc_feature (955)..(955): n is a, c, g, or t
  misc_feature (959)..(961): n is a, c, g, or t
  misc_feature (965)..(965): n is a, c, g, or t
  misc_feature (969)..(973): n is a, c, g, or t
  misc_feature (977)..(977): n is a, c, g, or t
  misc_feature (982)..(983): n is a, c, g, or t
  misc_feature (985)..(986): n is a, c, g, or t
  misc_feature (999)..(999): n is a, c, g, or t
  misc_feature (1008)..(1008): n is a, c, g, or t
  misc_feature (1015)..(1018): n is a, c, g, or t
  misc_feature (1021)..(1021): n is a, c, g, or t
  misc_feature (1023)..(1023): n is a, c, g, or t
  misc_feature (1026)..(1026): n is a, c, g, or t
  misc_feature (1028)..(1029): n is a, c, g, or t
  misc_feature (1032)..(1032): n is a, c, g, or t
  misc_feature (1040)..(1040): n is a, c, g, or t
  misc_feature (1042)..(1043): n is a, c, g, or t
  misc_feature (1064)..(1064): n is a, c, g, or t
aaaaaattgttaaaaatctgatttttggtcccgatgcagtttacaatttcctaattgttaaaaatgataataggaggcgaaaatgcaaaaattgacattaattgattaaattataaaaaaaaatatttaaaactatgttgttaaatgttctaatttttgaccctaaagtctgactttttaagcatgatatctataattttgcaaaacaaaattctataaaaacctgatataattaccattccctatttttcacaatagaattgatcaattataaatattagataagcattgaacaaaacttagcacaaaattaaaaaaaaaattgggttttagcaagtcccgataatcccgcgggatcccgaaaaaaaatcttcggggttgatcgggattcggtcgggatcccgattcgggatccgtcccgatcgtttttccaaaatgttcgggattgatcgggatcgggattcagtcgggatcccgactcgggatccctccgaccccagttgtccggtctctaatgcaaattcacaagcattttgcagaattaccacatcaattttgaattaaatagcgaatttaaatgagaggaaaaactattaattacttttttaacttttttttattttaaatttaaaaaaaagttaagtatctgtctcgagaagttgttatttacggattctcgactctctgcggtcaaatgaatatttttcgtcggaaagaatccttaaaattaatggacaaaaatgaatattaaaaaagaccagggtataaaactgaccattaaacaatctcaaattagccaacaatttcgcaattataatcacttcgcagaaacagccaatnntttcgcnnttntnnttcncttcgcngnntttgncggtngggncnnttgcccgtgcnnnnnttnnnttnnntgtttttnttgntnnntnnnnttnnttgngcngtcnggnnnntnttcnnntttncgcnnnnnggcnccatnncnnttctctttctctncttcctctntgttttnnnnctngngcncnnttntttttggntnnttggtaaaaggcagggatggnctttcgctttcgg

SEQ ID NO: 22830 - DNA, 1997 bp, Heterodera glycines
ccccccccccccccctcaaaggatgcttcgaaagtttcttcgtcctccgttctttgctcaccgtaacggtcgacgagttcaatttgtcgctgctgcgtcagcacggagtgcccgaggccactgttaagtcggtgtttttgtttctccttgcgatttggcatttttggaggggtgggcataaaaataggaaatttgctatgccaataaccccaattcaataacttccatttctgttttctttcacagtttttatgcccaatttccgtcggaatggcgtcagaatgaaacggagaatcttttgctggggatgcttctgctgttcgacgtggaagtggccgatctgaagtgtgccatttccatcactgtggagaatatgaaattccaatccattctgaagcggtctgtctgttcttttttaaaacaacagcaaatgctttcctttctcttctgctgttgatctttaatcattttattgtttttatcatttttccctcattcctctgatcacttttcctctcttttcgctcatctgatcagtttctctcctcttctcttcaggttgctgtttgtcctctgtgagcgcgactcgggccgtgccgatgctgccaatgtcgagctgctttcccgcctcgacttactcaagcaaatctttccgggccccgctggttccggcactctctcctccgccccctgtatggtctctctgccgatgagtgccgctaccgccccgcttcttttgcctccagtgtccgtcactaattccgaaaacaatggcacaattgcgcaaatggtcgaaattgcgcgaacaaatgtcgcctgacggatgagcgacggagccaccagccgaacgaagcgccgcttccgattgctttttgggtttttgtgtttgtgatagaatgttgtaccgattcaaaaactgatcagttatctgtctgtctgtcattattcgacttctctctccccaaattttaccatttttaatttacaaaattttatggcatattatttatcagaagtattctccaaattgcattgtcaagatcaaaaattcgcttgcctttggcaattcccttggcaatttggcaaatgattttttaatttttcattcttttcattttgttatttatttgttccgtcttcccaaaatgcctatgttaggccattcattcattcgccgtccaataattttcgctttttgcccttcggcacggattactgtatcacatgccccattaaacaccgtatctctcttttttctttctttaatttatttttatttttgctattggaaatgaatgtttttctccgatttggtgggattttaaggcgaaaggcaataaatttactctctttgagtgttctgtttgctcgtcgttctgtccattcgctcaccaatttctgatcggctgtgatcgatcgatgctaatcaccgtcttctactgtctgatcaaatattccgttcattctttcctaccgtatccttgccaccgtacccccccccccaccttccgtccattttttttttttaaattctaaatggaaacaaagtaattcttggtaagttgacgaggtaaatgaataaagagaaataaaagttatttatttatctgttgagtcattttaatgcgaattggcaaacaaaggaaaatgccaaagggtaatgcaattacagggaaaatggccaaatgaaatgaacacaattaaatttcgcattacttttgctgtgtccgcaactccgccgcattcattggcacaatttcacgaggacagaaaactgacggaaagagttggcattatttaagcgagaatggcacttaccgaagaaacaaccaaagaacaaacgaatgacaaatctgcccttactttttgtccttttcaatttgtgttcatttgtcatatagattaatttgtgattcatttgaatttcggcaggtgtttttcgtccctcgcccttccctaattctttagccaccctctgctcaattcgttttgtgctc

SEQ ID NO: 22831 - DNA, 939 bp, Heterodera glycines
cgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaagattcggtctccccataaatctgggcgcatcggttcggggggactgccccgaaaacaaaaaaatcgattttttcaagtgtccgtttggggtactcaaacaattatggggagcaaaaatccaacgcagaattaaaagtacaggctatagggaagctattccggaaaggattcggtctccccataaatctgggcgcatcgggtttcggggggactgcccccgaaacaaaaaaatcgatttttt

SEQ ID NO: 22832 - DNA, 1411 bp, Heterodera glycines
actagagaccggcgcgggattttgcgggatctcagaccgcaatcccgcattttttggaaattgcgggatttgctgggatttatacctgcgggatcccgtcccgcaaaatttttcagtaccaatctcgcagatccgcaaatttgaaatttccggtctctagacggtaccattttcctagagacattttttctattagccaaacccaaattgcgattttcatacatattttatggctgtattccatttttatatccattttattacatgccctaacaattatcgttcatttgtcatttcccaataatccattcactttttcttccgctggcccgggactcattttcaaagaatatttgcgttcattttgcccgccttttgcacagacaatggcctaaatgaaataaaatttaaatctgatgaacgctttaaccgtggttggtcgattcctaaaaaagtgtaaaaatcaaaaaactgatttttcctataaaaaattaaaaacaaattcttctaaaagttttttctcgaataaaaataaccaagaaatttagcttgagttgaagcggatacatttctgtataaatattatcattttttattcaatttaagttcattttttaatttagtccatttgtaattgaactttaaaacattttaaaaaaatcaaagtcgtccggttaatattttatttaaggcaaatttaattattttattcgagatctaaaaaaattttaaaagaacgtatatttaagcattaatttaattaaattttaacatatttataattaaaaaattgattaaaaaatcataggaaaaatctgacttttgatttttgcacttttaagaattgacatagcaccactttagcaatggcaaaagctgttctcactcacccaatgtaatctgcataaagcataaagttgacattgttcaaattgtccgccaaattttgctcctcccactgaacaatttgcccaatttggcatcgcttcatcacccaataataatctgtttctttgctcagtgtcagcttttgattgattcggttgttcaccagtgcaaatggcacaattggcgttgacgggtacagcagaaaatgaacaatgaaattcactgaagtgttggcaccgataaatttctaaacaaaaaccaaaatgcaattaggtaggtaattgttttttggcgaagtgtgtggcccgccggaccgtacttctttgaaatcgttgatccattttatgtttcttgatatatcagtgtctgtacaacgcaatcgcttcggctgtccatcttttgtcggagtgtgcaaccatttggacaccactttccgagcagttgcatttttatctgtcagcagataaaattcgaagttacaagattcgattgaattaatgtccaagtcgaatagaattgttgg

SEQ ID NO: 22833 - DNA, 1657 bp, Heterodera glycines
  misc_feature (1585)..(1585): n is a, c, g, or t
  misc_feature (1603)..(1603): n is a, c, g, or t
  misc_feature (1627)..(1627): n is a, c, g, or t
aggtctatatgggtttaaataaacagttcccgtctttttttgtagcatttgctgaacaatacttcttcgtcttcgtcttcttctgccgatgatgggccatcgtcgtcgtcgtctccgtcttctgtttctgctgccgacaacaccaacaaaacgccaacatcatcatcttcgccatcgccaattcgtttctgcatccgattgaccgtcaacgattggggtgagccggtgcagcggttgccgttccgttggctcggcagttcgctcagcggacagtgtgtggtgttggtggagcgtcggccggtggacaacctgaacgtggagctgtgcattgtgcgatgtccgtacatggaggcggtgcagcgcgggctcatggacaacgcggtgacaatgaacgacttggaggcaagttgatgcatcggacagatattgagcagagaactttgcaaaatgtcgatggaaatcatggacaaaaattgagagcagctcgtttccactcgaaatttttttttcaaaaaaatctagaaattaaaaaaaaaatatttaaatttgggagccaaatgcgcaaaaatgtctcaaatacgtctatctttcattttatccccggtcgggtacggaaatgaaatacgagtttacgcaggggcgtagcaagacccttggcttcggtgggggggggctgaattaaaaaattcgatttttagagatgcatttttctttttcttttttataaatcccgaattcgaggggtgcattttacaggaatttgtagccttttttcgtcaaaaaattaccatttttgccatttgtggtccattttaaaaatatggtaaaataggatccggcgatgcacacaggcgccgccaggaaaatttttgaaaatttgggtgtgctttgttaagggggttgtttaaaatttcaaaaaatttatccctcccaaaaaaatgttttagtgaacataatttagcaatgtctaatttgtcacatcatttcattgcagacaagctttgaatgggcggagccgctgtgtacggtggatgtgatgcaccgttcggccagtgccgaggacggcaacgacgatcaccaagcgttgaacgagccgcccgccatcgcaacaccatttctccactttttctgatcacagccactcactaactctgccccctggcatttgttgtgtgtgtttctctgctacttaatggtttggatgatgacgaaattggaggccaaccaacttttgatcatgatcatgattttaagccccccaccaatcacaccactaattttcacattgtattctctttttcgtttatacataattactgggagacaaaaaaaaacaataatacacacaataattaagagtttcatgaagtgtgtgtgatcacggatgtgcggttgccgcgcactgaaaaattgaatgggggagaattggcatttttacagttaattaaaatttcttttttgatagggcacaaatttaccgaaaagcattggtggcatgtcccgggagagcagctccagccacatgccatacacaggcgacaggacaatgttggcagtggcaaatggcatcgagctatttaattgngaaacaaatggaggatgngtcattaaaactggcattttttgnggagtatttttgggcactgccacgaatttt

SEQ ID NO: 22834 - DNA, 903 bp, Heterodera glycines
cccggtcagctaatgaatcgagaattttagtaatattttggttagtgccccgctctttttaaagtttttgtttgttttgtttttaagtgtcatgaaaaacatgttaacgtaggtattcggggtttctgatcagaaatcgcatccatttggacctattcgaaccatggactctcggattggaataaaattcgaaaatgcatcaatttctcattttgtggcaaatcaaaatgcacacttacgtttcttgataaagctttccctcgtcataatcctcagaaattacatgcactgaagcgaaatgaatgctggaaaaggtaaattttagaaaattctacagtcagacaaaagcataagtaccgaaattttttcaacatttccactaatttctgatgcacatcatctgggttcagttttgaacaaatggtgaaaatgcgcaatttggcattctgttgaaaatataatttaaaaattggcacaaaaagttgatcaaaatgccgtattcttaaaactgcctgataacttgttgggaagctgcgtgctcgatagagaaaaattgtatgatacagtacgcttatataagaaattgcttcactcaatttgggttaggagaggaatacggtatcatatagagtacccttgaaagggtggaacaattacaatttctgatagttgaaactgcgtgctctacagagaaaatactttttaatatgtacagtattcttattcataagaggaatacggtatcacacagtacccctcaaaaagcagaacaattacaatttaagataatcaccggaaggtatgtgttgtgttccctcaacagatgtgaaaggagcagtaccaatccaccatcgtcgtacagccaccaaacgtcgacaaaacctttgggattttcaaaaaaaa

SEQ ID NO: 22835 - DNA, 763 bp, Heterodera glycines
ctagagccgtaaaaaatataaatcaacaacccgaataaacaaaataattgcggtcagagttccacctcccaccttctattcgtacatccgtttgtttttatgccgtaggttgagccgaagtgttgcctggtaaataattttttacagcgattttaaaactgaaaatttttggtttctaaattttttgtaattttcagtttttctaataaaaaaacaaacattataatcgactcgttaaatttattttaacaaaaaaaagaaaacaagaaaaacattttttaattctcatgcggggttaaatgttggtgctcacacattttttgaaaaaaatttttctaataaaaaattctcgaatccaataatttttacctccctcgcccaccgtcgggtctaaattttttttttttttgcaagtttagtgaaccataactttttcaagaagcacccaaattaaacattcttaatatcattcgatagcactaagaatcctctatcagcctgcaaaatttcaaaaaattccgttgggtttcaaaaaatatatgaccaaaaatgtttaggaaaccaactttttgaaattttcaggccatatagtttttgaaacccaacgaaattttttgaaattttgcaggctgatagagaattcttagggctatcgaatgatattgagaatgtttaatttgggtgcttcttgaaaaagttatggttcactaacttgtaaaaaaatttatggtcgtgtctttttttatggtcgtgtgaaactgca

SEQ ID NO: 22836 - DNA, 1281 bp, Heterodera glycines
aagaattatacaccttaacatattatcttttaattctataacttgcaacattgtaccattacaaagaccattttcaatacttatgtttcgcataagcattactttacaattttgttttaattttaattcatgcaatggaaaaccgggagaattgaaagagttcattatttctggtgtaattggaaaattattgcttgtttcaacttcatcaatactaagataagtaacgcattttcctgggaatttatccaaagctatttcattataattatcggtcaaattgttgtatggggttagaattatatgattttttaattcattaaaattatgctttaaaaaaatgtcaccgtaaatttcatcgattaaatcagattcatttgataaaatacactccggaggtaattgaatgaagctgtttggactaactccatcgcctatatcaagaatttgttttgcaaatatgtccttggctcggatatttatagttaatttcaattgctcaaaattgttccataaaacagattttttgattgttagatcaacaatttcactttttactgcaaatttttttattggtaaggtctgtctaaaatcaccagcaagaataatagtttttccaccaaataataggttacatttagttaattcacgtaattttttatcaataacgtcaagtgcaaatcgtggtgtcataggagcttcatcaatcacaaaaaaatcactgtttattatttcttcggcagcctttgtgccttggacaacaccggaaacagtctgagcatttaaatttagcggaaatttaaatcgattgtgtattgttcttccactttttaataaagttgaagcgattcctgagaaagccatgtttgttatttgtttttattaccacgaattaaatgataaagcgcatttagtgtaaatgatttacctgttccgccaggtccatcaatataaattaatttttgttttatctctcctgttactaccttttttattgtttcatagattaatctttgatcactattcattaatttgtataaatcatcagcaatttttttttcttcatcaaaatttatatttttaatgtcgtcataatctatgaccgtgtcttgaggcaactttttaaaatcagataacgatttaccttcttgtattaaatttctatttatacgtgaaagagctaatttataagcgatatgttcaggttttttagtcaaaaaatcttcagataaattatttaaaaggtgttcccataatttctttctgggtatttggatcacc

SEQ ID NO: 22837 - DNA, 993 bp, Heterodera glycines
  misc_feature (976)..(976): n is a, c, g, or t
aaatcagatactgtatccatttgcaattaggacaaccctttttctatacaaaaaactgggtttacggtcatacagcgaccgccatcgcctttatagaaagtggccataaaatcagttcgtttaaagagagaactgcactttattctcatattagccgtcagatgcccgacttagcttcaaaacagttaaagccacacattctctatcattatgaattttgatcgcctcacttcccggcaattcatggccgtaaaatgcgtttgaatttcacaacttttgccatcacatgcaacttgtgtttttattttcaacggcgtgttggcgttgtgaaataaatcagatactgtatccatttgcaattaggacaacccttttctatacaaaaaactgggtttacggtcatacagcgaccgccatcgcctttatagaaagtggccataaaatcagttcgtttaaagagagaactgcactttattctcatattagccgtcagatgcccgacttagcttcaaaacagttaaagccacacattctctatcattatgaattttgatcgcctcacttcccggcaattcatggccgtaaaatgcgtttgaatttcacaacttttgccatcacatgcaacttgtgtttttattttcaacggcgtgttggcgttgtgaaataaatcagatactgtatccatttgcaatttggacaacccttttctatacaaaaaactgggtttacggtcatacagcgaccgccatcgcctttatagaaagtggccataaaatcagttcgtttaaagagagaactgcactttattctcatattagccgtcagatccccgacttagcttcaaaacagttaaagccacacattctctatcattatgaattttgatcgcctcacttcccggcaattcatggccataaaatgcgtttgaatttcacaacttttgccatcacatgcaacttgtgtttttattttcaancggcgtgttggcgttgt

SEQ ID NO: 22838 - DNA, 1422 bp, Heterodera glycines
ttactggataaagaggaaggtccaaagcattccctccaccttcgttcacgcaaacatcgcgtgttgtggtctagcggtttcgtcacgcataaatcggcgtcatcttgatggcatcaatccggaagacctcaagctgggctcacttgtgacggtggttgttgccaacattccacaggattcacttgtatcaatgggatacattctgccgaattcttcaccgtacaaactgggaacggaaagaagagccgaaacacctgaatttttcggtgcagttgcgtgcattcgtcctcatctgttggagtggccgaatctgaatgcaaacatgacgcccaaggtttatccatgctccgcggagcttactaaacatcatgttgtggcgatggagcatgttgttggagcagctctccagattgagatggagcgagaggttgacatgatgattgaagcacgctttgaaggaagggctcggaagttcgatggtgctgattgtctgattgtctttggttcgagatcgaagaaagaagtgaatgagttggccaaggtctgggagccggagtcccaagtgaaggtcttcaaagaattgggtgagaagcattttgctttgggagtggtcaaggatgttgaggtgctccacgcagagtacgaaaagttggaactccacatcgtcatcttcttgaacaacatccaagaaaggaagaatgtcgacatcgcaagaaaagtggatgagttcatccagggtggcagtgttgtcatacacccggtccctgccactgcggttgaggacagactgttctgtttccgctgcaacgtcccatcaataattgctgatgaagactccccgaggggaaggataatggcagttctgctcggccgtccagccatggaaggcattcgaatggagaagcaaagcgttgacgactcaacggattcgtggatggaagaagaagggccgctccaccctgcaattcttgctctcaactcgcggcagagagtgactgcacgcctaatgttgggaggaggtctggtgcaacaacaggcgccgccaggcaccggcaaaaccaaagtcgctgcggcgatcattaaggcaatgatggactcaaatcccgggttccggattgtggtgatggcttgtgccaacattccagttgcaaagctggtacaagaggcggaaggcacatgtgctgaaaaggatttggatggagcacgagcgattgccttattttccggttttgccagatgcaaatacacggatcaaataagagatgtccaacgacacacgctgcccaataaagtaaactctgaggagttcgtcaagcagttatcgcccaatgtacagaagcaggtgaaggaataccttgctcattatgagaagaacccgcgcttggcgcctgagagagcgatcggaaaagtgtgcacctcatg

SEQ ID NO: 22839 - DNA, 1185 bp, Heterodera glycines
ggaccccctccgttccccaaaagtttttaggaaaaaccgccgcaaaaaaatagggtgaaaagcaaaaaaaaaaaaaggtcgtcgcccgggagggaggtaccccccccccaagccgaaatcctgggaccgtccctggtggggggggggggggggtcaactgggccccaggccggttttttgtgcgataacttctttcatagttgaccgaattgaatgaatttgataccattcgatagccctatatgttctctatttccctgccaaaactcgaaaaatttcgttaactttcaaaaaagttagggccaacaaacttcaaaaaattggtgtttccgaaaatttttgaattaattttttcccagtccggtaaacaccaaaacacagccgccgaaaacacagctgggacataacacagccggagataaatttttttaaaattttcaaacttagaatcttaagagaaattttctttgaaaattctatgagaaaaaaaattttcagcgcttttttttgaaacttttttgaaaattcttagaattcgtcattaaattttgaaaaatagtctaaaatttcgttatttgaatttttttttttttaatttattcccggtgtgttatgtctcggctgtgttttgtgctgttccgcacacagtcgtcccagcagttcgtttttaaaacttgtcatacatttagtgaattcttttgctgttctgttcaggtgctcggtctctacggaatgattgtctctctgctgctaagttcctcctgaacaatggaaggaagaaagaaggaaagaatggcacgtctgctgaacattgtgccgaccgtcgtgttgtgatgatcaaaatgaccagccaccgtatataatagataaataccgtattttccatccatttttttttactgtgcccccccccttttctcttttttactattacatttttacaacatttaaaaacttgggaaataactgcggtggttgattttttgtacaaagcagaaagtggcatatattagagaatatccgttatgggcgtcaagctcaaaggttacaaggaacccaaatgttgttttatacttatagacagcaacaaaataaagggatttgactgacaaagacattttctaacctttacaaatgaaagtttgggtaaaaattatccgtcaaattgattatttgattgattga

SEQ ID NO: 22840 - DNA, 1373 bp, Heterodera glycines
aagcgcccgtcttgaggctgcgatgaattgctaaattacatcaatttctagtgacgcggcgaagccgcgtccctgagcgcgaagcgctttccccacagcaacagaactcaattgataatgttttgtatgttttaaaataacaaatgagggccatatattaccaagccacgcatgcacaccatagccaactgggcaccctagtttatatatatatagaataatgttgcagttcgtagaaaaaattataagtccccgtggtttgcccggaggctcctgaaagtgcggcattgcttaagcaactttttgaggcgcatctgggaaaaataaggatttttcggtccggcggccagttgagcgccagcggcgctgaaacggccaaataaaaaaaatcgtcgcggttttcgggctgtaacttttctcagggaaccgggagcggaaaaagtccgctgagagggcacaccccagacatgttggctacaactttgtcactgatcactttttgatcagatcaaatgccgagcctgtagaaattggcgactgaacggcgctcaaaatgccggttttggcttttcgtgaataactcgctgggggttaagcggagcgggttggcgccgcttgagcatttgtgcagtttttaaagctgcatccgatggcgttttcagattttgaaaattttcaaaatttttcgagctaggccccctcgaaaatttttcgtttttgaattttattattttttgccgatttttcccaggaaaacggagaccactttcaagcaaccgtttttcgagctctatcgattggtggcatttttgaaaaaatttcaaaattttccggaaatagaaaaattttccggaattgagctccccatttccgtttgaggcttataactcgtcaggcgttgatcttagcggaaatttgtcttagagcatttttgtagagaattttaagctctatctaatgtgctttatctcatgtttttaccatgagtttaaaaaaagttataaaattaattgtgattttgaaactcaaaaccataggggggaccccatggatttgcatttcttgagaaatttttttgctcctaaaattgccaaaaaatacttttctggggtattttgaggtgctgaacacgaatatgcactttctattgcgttttggatttttcagagggtggtaaaaaaaattttgaaaattcaataatttttggcccttgaaaattcaacctaaattttaaaaattcataactcgcctcaaaatggtccaattcagctcatttaaagcataaaaaatagcaaaaaatcgggagaattttatgagatttatttgaaatttataccacaaaaacaaaaaaagttattcccagaaattctgga

SEQ ID NO: 22841 - DNA, 2248 bp, Heterodera glycines
  misc_feature (2094)..(2094): n is a, c, g, or t
  misc_feature (2170)..(2170): n is a, c, g, or t
  misc_feature (2215)..(2215): n is a, c, g, or t
ttacaacaaatttaatttttcagggtcacatcgcttttctttccaaaccacaaaattgcctccgcctgcacctaaacaggtaaaaagacgcatttttcaaaattggcgtttttaatttgctcgaaattgcaggcgcccatcgttgctgagcaaatgcaggaccatttccaatttgagtggaactccgtccgcttcagagaccaaaacggcattggcaccggcggagaagagacgccgctggacggagagcagcagagaagcgaatttgtctaccgattgcaggtggtcgcttattttctggggattgaaattgttttgtacctacagtaaccctatcgtaatgacaaaatgcccacgcccgcttcatctaatccacaatttgccttacagtaaataagctgcttcctttagatggcacccaaagttggttcttcagtgaaggaaaaggccgcagtggaagtgtggaagaccatttttgaggatgtaagaattaaacaatatcagtcattatacactagtattaatcgttgcgatgcttcaccccttacaatgggagagaaaaaacaaaaccaaactttgcagaaactgactcaaacgccgccaatttacgttcacaacgcatcgcaacagccgcgccaagtccgtctttttgtggtgcaaagatttgttgatacaaatggaagaacaattggtaacaaattacatcgtaatttttgtatcttgcccccttttttgcattttatttctattagtgatggttttaccataaatttaagctcaacatttcagaggaattggtgtccgccccttcgcccatcgccgtgtttagctctttgaagacaccgaacgaatcgcccaaaaagcggaatttgcaaagccaacaaccccagcaagggatgagcagcaacaaagcgacgggtgagcgaaaaatcgggaaaacaaatcttaatttaattccaggaagtgccgtcgtcggcagaaagtccgccaatccctacccattgcccaaggagaccaaaatgagtttgggcaagaaggttcgacgcatggcgagttggctgcgcaagaccgtgtcggagaaggactgcgcactgattgttttggtgggtttgcccatctgatatttcattttattgctggacaatgcgaaattaaggccattttcgtcattcttgcctttgggatcgcaattttgcttaacaacttttatctgaactgaacgccatgcatatttggtgaaatgagtcatcgcagaaccaacgaacgaacgaacaccttttaagactaaataatttatcactaaacatacataacatattccatttaaccctttttatattccgatcacattatttgcatatcattcgttcattttcctgccgctttttccttttcctaatttaattgatttttctgtactataaccacacacacacacacacactgaacagtttgtaaatgaatttggttgtctattgtcattttcacaatttctatttttcttattttaagaatatattacagatttcatacataattaattaaatgatagtttattttgtttggttttgtgcggtggtgctccccccccccttctgctaataaatattaattaatgaattataaatgtttctttttctttctccacttttatttattcttttgcttctgttcttcttgtcccataacccttaaaaaatagaatcgaattgacttcttttgtgatatttgccccgaattcgccaatcgaattttattatttttagtttttgcatttaattattttttgttctatattttgtgttaaattccgcgcggaaaaggtcgaatgtcccaaattgtaaaaaattatttaattttcgcacttttcaattccattttcgatccgttcccctcccccgtcgtgcataatcaattaaacattattaatcaattcctaattttattcgagaaagttttttatgcttacagaaatgcgcgtgttcaatgaattgttttattatgagcatttattattcattattatcggatcccaacaaaacattattttctatcggtcgcccatttcgaacactatcatttgacgacgactanattttccatagaaacatttttaagacataaaattatttttattattcattttttctgttaatcattttgtacttangggaaaagtgttttcttataaaacagaatgataagcaacggttgngagcaaccgaaaatattagtgtaaatataaaat

SEQ ID NO: 22842 - DNA, 1976 bp, Heterodera glycines
  misc_feature (1851)..(1851): n is a, c, g, or t
  misc_feature (1869)..(1869): n is a, c, g, or t
  misc_feature (1929)..(1929): n is a, c, g, or t
gcacatatttattattccaaaaaagctgcggggtgggtacggcgatcctgagacccgagaccaaaatcggaaaccccgagaccgaaaaaacccgagactctagacatttttcaaaaaattttactattcgtttaaaaattgtttaaaaaatttttctttctttctttaagtcaatttaaaaaataaaggaattttggagttccggcggtgccaagaggcgctgtcggggaacatttttttaatttgagggcaatttattaacagttttaccccaaaaaatgaacaattttgcgactttgagctatttttaaaaattagaatagaggatttttagggtacggcggtgccgataggcgccgccggggaaaattttgaattcttattgcactttgttaatagatttagtccaaaaaagacaaaattttgcgattttaattgtagaaaattatttaatttccttcgtaaaaaggaataatttagaaaattaaacgtaaaacaactacatggagtggcactgatccaaagcaaagaaaacaacaaaatcacaaaccactggaccacgaatatgagtatacgtcactaaaaatttattaaattaatgtttaccaaaagcaaaacataggggtataaaaaagtcttggttttgagtctcaaagaccgagatgaaaacccgagactcgagaccaaaatttaacttaaaaatgcaaagaacttttattgaaattactaaaaacgcacgaactaatgaattcagctacaaaattatatttaatccgtattatagtgttaattgcatgagaaaatacattttaaatattgcgattaatacgaatcacagtaggaaattttttacagtttcatcttttgcgtgccaataaatgaaagatttctattaaaaaaatttgtctaatgtttaaaaacgtttttggcctctaattctgcttctttttttagattttaattaaatgtgctttttaaacttgattatttttatggttgccattttgttcctatttttatttggttgtctcattttttaattgatttcattttaaattgccttaatttaaaaaatttataaaaatttccaatttttttcctcacggtgccggacgacaattcctcaacttttttcaatttatgaataatgttccaacagctgctggtggtgagttgcgcttcaataattatttgtatgcctcgtgataaattttggctgaaaatttcggatttaattaattccatgaaaataatttttggcaattttacctcatcatgagaatggctgctgcgctggctgaagccaaaattggaatagaagaaataaaagaaaccaaaaaataattcaaaactttgagaattttcaccatattttaagcatattttctttaaaaaatcataattttttttggtttttatgaaaaaatttagcaaacttttttggaaaataattttcgttttgatgcttttttaaaatccaattaaataaggtcttttcggttttgtgtacaaacccataatttaaaaaaaaagtacaaaagatacacggagtttttggatgtcacaaaaggataattcaaaattatttaaaaattaacagattctaatgatttacccaaaagcctcaaaaatcttcaatcctcattacaaaaaaaatcttcattgacctatcaaaaaaccacaaaatgaggataaaacttcaaatcttggagccctggaaataacaaaatgtaataaattcactgaaaaaaacattaaaaaaagaatttgaaacagaactaatattaaatattacaataagaggcacaatttaaagatacttttaataatggttgttggcaatttttttanataattttctttaattanaataaatagattttaagtgaatattattttatattgttatttaatgatgaagatgatttncattatcagcaaaaccgtggacgcgcgaaacttggagcttcgtgctt

SEQ ID NO: 22843 - DNA, 1484 bp, Heterodera glycines
gcagtggcgtgaaaagccatttggccaccgcttgtccattcaaagcattggcacactgtcatcgcatggaaattcggcgaagaaatcatcaattcaacgaagtgaatcaaacaaaaaaattgtcgtaaaataaaattcaacgtgtcccgacatttgcgcctatgtctaaaatcgggttcgaacttacatttttcaatcttagagctcttaaacagcattaaattttagaaactggttcttttggttcattaggattaatgatttgcttgtttgaaaaattaattattttttaaaaatttcctgacgatcaaattatcgcatacaaacactttcaaacgcttattttaagctgtttaggctattatggattgaaaaaaattaagtttgactccgattttggacataggcgcaaatgtctggggcgcaaatgtggggtaaccaaattcaaaatctacctgtttttatgagtcaatcgagagtgaaatcccttaacattcattgaaaaaacataggctaaaaattacaaaattttgttttctcaaacgttttctgtggaggggaaaaagctttcaaaattgcaattgaattcatctcaatttccacttaattgagcaaataatgtatacgaaatattatcattcattcgttttgggaataaattataggagcgaattaaatttcgcccctcttttttccatttgtgaggaattccgttccaaaaagtctgttaatgaatgcacaacaaataaaacttatattttttaaattaattcttttttaatatttcatgttttattttttgaatagaattaatagtgaccggaaaatgcgtcagcgatacaaacattttaaaacaaaattctgtttattgtaatattaaattaattctgtaagaacaccattctgaattccgaaccccggacacgaattcgaacaaaaaatcgaaagtccaaattttggaaaaggttcaaatacacggaaacagactggaagccatcaatccttcaataagagatcatttatgccgtttttgaacaataaatgctaaattcgaaaatttgggcattcgaatttttgttcgaattcgagtccggggtccggaattggcacaaatcggtaccggattcgtgatcaatgacctcgaaaatccaagggagttgtttttatgccaataaaatttccactggcgcattttccgggagccgaagtaatttattctatttgaaattatattaattttaattgtctctttatttttcgaaattccttcatttatattcatattatttcgtcactccctcttgcctacccactcactcacccactaattagacaaaattaattatttcattagttcccattacgtaaagtgctcccgtttgtagcgtcaatttcctcctgcccatcttcgccatgaaaatcccaaaaatccgtaagccgtaatccatcatgacggggtccaaaaaggccgtaatttccgtaat

SEQ ID NO: 22844 - DNA, 2293 bp, Heterodera glycines
  misc_feature (357)..(357): n is a, c, g, or t
  misc_feature (401)..(401): n is a, c, g, or t
  misc_feature (407)..(407): n is a, c, g, or t
  misc_feature (419)..(419): n is a, c, g, or t
  misc_feature (454)..(454): n is a, c, g, or t
  misc_feature (456)..(456): n is a, c, g, or t
  misc_feature (465)..(466): n is a, c, g, or t
  misc_feature (500)..(500): n is a, c, g, or t
agtagagagagaggcagggaagaggggggaggggccagagactggatcaactaaaaaaaaatcaaaagttggcttctccgacggatttggcctattgcctaagccttttccttttgcattctttccttttgcatttccttttccctttttcctgccccttcagttccctttgtacggtttctctttcgctaatccttccattcgcttcggtggaccttcttcctttttctcctccgtcgatttggagttcgctcagtccgccctttgggctctgttccgtcgccccgtcctttccggtccttccggccttcctctttctcgtctgtctgtgctctttttgtcctctgtccgtctgtnggcgttggccctctgggtttttggggggtcgtcggccgttcgtntggtcntcgcttttgtgngttgtgggcttctgttcggtgtggtgcggctcccntncctgcgtgnnggtcttggcccttcggcgttgtcgggggccggtnccgggttgctaattcttctccccacccaacagattccaattcgcctcctctgcaaattgtgtcgctgttcgacttccgaaacggccaaatgctcgcggggacggcacttccaatttcggcaccgggttgggctgcagcggggcccaattccatttcgaatgtgcaatacgacgcggtaaaaaggaaacaaataaaagcgatgcaaaaagtcaaagcatttgctgggaaataattgtctaatcagcaggaatccgattcggtgattgttttcgacgatggcaatgtttacacaatggaaatccatcggagaaaagcgacccaaaaacattgaggaaaaaggcgagagaattggcattttagacgatcactgactgatcaatcagcttcttcttttgttcgtttggctattacctcatgcattttaaagtaatgataaaatatgagtacagtacaataatcagtcgttaattaattaattaattaatcaaccaatgagtgtcgtctgcttaatatgctttttctcctcctttttataatttttcgtctcttttcgtccgttttcctttggcattaatccttcgcactttgcttcgtcttgctttgtattccatccacggattggtcccgtggcttctcaaagtgtgcttgcgcagtgatgatgggtccgtgtaggcgttggcacagcccaaaaccacgcaagagtattgtttctgcaaaggcaagcccaatcaaaagagccgacaattaggggcggggcttaaagtgagtccaaattggcactcctcattagtaaattaaagtgagtcccaatttggcattcgtccgtttggcattccgtcccccattctctctcaaactttgctgaccttctttttgtgcacgcgtttctcatgctgaaaagagctgatcaatcatttgctttccttttaatgtttgtcctttcattcactgaaccttcattttgtccgaaatgtttgtaaatgaccgtccacagatcgtacactgaaacggacgttctccagtgtgcgttcgctggtgcgttttcagattttccaaccgcgcgtagcgcttttcacaacttgcccactgaatgttaaacaaaaagatggctattaaggaacagaacgccggaaagggaatgatcggacattagagtgatcagagaaaggaatgatcggacattagagtgatcaaataagggaatgatcggacattagagtgatcaaataagggaatgatcggacattagagtgatcagagaagggaatgatcggacattagagtgatcaaataagggaatgatcggacattagagtgatcagagaaaggaatgatcggacattagagtgatcaaataagggaatgatcggacattagagtgatcagagaagggaatgatcggacattagagtgatcaaataagggaatgatcggacattagagtgatcagagaaaggaatgatcggaagaaaatagagtgatcaataagggaatgattggacattagaatgatcggacattagaatgatcagagaaaggaatgatcggaagaaaatagagtgatcaataagggaatgatcggacattagaatgatcagaaagaatgttcgaccaatccaactattcccctctattcttttaattgttcgtcccacgatttttaggaaacatttcaaacttttaaatttgcctcgcatttgtatggcttctcgccggtgtgtaccccgaaagtgttgaacaagcatataaatagcgggggaaggggcgtccggcccctttcgcagcccttccac

SEQ ID NO: 22845 - DNA, 1144 bp, Heterodera glycines
taatttatatgtaatattcgaaagtgccaagctaattaccgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattgggcgaaaaagagatagccattttctgaggcccgaagggaaaattgagagggctaatttatatgtaatatttcgaagtgccaagctaattagcgattcaggcgcacattggggcctgaattagccattttccc

SEQ ID NO: 22846 - DNA, 2281 bp, Heterodera glycines
atttttagcatgcccctgccggatgttttcggcggctctgagaggcgattccatgtcacgcgaagggcacgacgctaatttgtaaagaaaaaacactaattaagaatttcataatttaaaaaatgaatttaatgggattggttgagttctaaacattttttacatgcccatcgctgagtttggcgttgaattcgcccacaaattgggccagtgacaaatactcctgctgctgctgttgttggaagtgctcaaatgcggcgaagctggtcaacggctctgacgtggcaccgccggtggccgactcatcgccgaaagtgcagccgaacgcatcgccggtggaagagaggggccaaggggagatgccagtttgggaggagagtttggaacctatgcaaaatgaatggatagcacattttaagaaggtccagtataaaatctgcttacaatgagcttgacccgaaggtgctatgatgttagtcaaaaaccattaaatgaaaatatttattgatataactttgctcaaaagcaaccaaatttttaattcttgctataaagtgttttctattatcttgcaaaattcaaaaagtttcaagaaagttataaccaaaaatattcacaaaaaaggttattgagtttttcaggtcataacttttttgaaaataaacgaattttcttgaaattatgcatgataatagaaaaaacttaaagttagcgaatgataacaagttttttaaaatttgtgcattttaggcgaagttttgaataattttctgtcaaaatttttcattttgattgttttttgactaacgtcccagcaccgacccacaaaattagtggttttgaaacaccaaaaaaaaaagtaaaaagcaaaacaaattcaatgttttctggcttggaattgttgatttgttagaccgggatttagtgtttttaatttaacgataaatcaacaaattgaaacttcgactgcgcaaaaatgggtgcgattccgactcaatttgggacaccaaatagtcctcattcaactgttggatgagctttctgcgttgaattgcctctttgattcgcatcattttgccaagttgtctctgtaaatttaaatatttctttaaaaaaacatttttggtaataataatttgcatgggatggcagtgttaggcattcacttaagaagtgtgggagtctgttctgtctctcttgtgcagcattaacattcttttacaaggacttttaaagaggaaaagccttttttaaagaatgagaaatttgcagaggtattaaatattttaaaaaattcgtaaaattttataatttaaaataacacaaaagtgtgttcttcttctcatttgattgccatttaaaaatatatttgtttattagtaaaaagtgataaaaaggaaaatctttactttaatattaagtgatttaagcaacaaaaaaaaatgttaacataataaaaaaagttaaaaataaaatttgcctatggattttatcttaatgagaaaactaaacaaccaaaaactcaaatttttaaatttgttagaaaaacataaccaattaggttttgtttaaaaatcattgagtaattaattaacaattacaaataattatttgcttctataattatttaataattcttaaataattaaattgaatgaattttcaatttaataaaaaaggtttaagccatcattttgggccgaattgtgccgattaatgtcattgcactttttcgtactctgcattatacggcttacagacattagcggacggaaaattgcggacattttcggggaaagataaaaatatttattgaaaaatttttacaaaagaatttgtttggaaatatgtagaatggaagagcgggccttgggtctcgtcagtacgtctctaccaaacaagttttaaatttaaaaaaatatattttttattttttgaggcatgcttattcggcaacaaaaaattttccgataaaatttattgggaaagttggagaaattggaaaaaaagacatcggtgagcaatattagctattttcggaatttttagcttaatttaactaaattgaagcttcaatttggaaaaatttatatgcatatttttcacttttatgcgcatatttcaagattttatattcatttttttagactccctagttatacgttgtatgcactaaaaattccaaatatgcgcctaaaatatgcaaaagaacccctcaaatatgtatggaggcgctatattaaaagaaggacttttgaaacaaaaggggggagggaccctt

SEQ ID NO: 22847 - DNA, 1974 bp, Heterodera glycines
aagtatcagttataataaagataattaaatttaaatgttatagtgactaaatcctataaaattctaattttttttgtgcatgtttcataaatattttggcattttaatacatatttatttacatattttgcaatttttcttacatataaactcaatcactagtaataaacaatttctttacatattcatttatgccacgtatgaaagaaaagtcaattaagtcgtctagtattatttcctaataaaataacattgataaatattaagaaatttttttataaaatattgcgtttcttatatgttgcattaatacattaactcagaaataatgaacaaattttttatttttaaacttattttgttctcatttctactcgattattcggcaagcaccaaatcaggatttgaagaatttctacaaaactccgaagcaataacacttgtcaaaagctatgaaaacaaggaaataaaaacaattaatgagctgcttcaacggtagcgacttttttttgcgccgcgccatttgcgccgcgacacttgcgccgctcagcaaaaaagactcttgcgccgcggacatttgcgccgcaccatttgcgccgcgacacttgcgctgcctaacaaaagcgacatttgcgccgcgaaatttgcgccgctcattaaaaattttataagattgacccaacaatttttctaaattataatcgattgatattcaatcaaaaatcgtgaaataggggagaaaaattaaaatatgtgctttttttaaaattaaaatcgatgtaaataatttttaacaattttaatgacaaaatacatacataaatttcatcttttttgaataaaaagcaaaaaatagtctgtttttcttacagaaaacatagggaggggggcattaaatgaagtatttttgtgttaaaatgtgtttctcttttctcattgaattaaaagccgcagaaaaaataactaaaaacctaaatatcccccaccctactcatcaatttcaattattttttgagccgtgggcagtcaaaaatccgtgagtaggactaattcaaacagtgtcagtctgtttagttgttattcttcttcatttttcatatttttgataaacctaatcaatgttaagctttttaatgattaaaaataaaaaaattaatgtttatctttaagtagtgattttttgaaatttttcacttcgttattttcgccgttggtttttagtaatcttattgatattagtgaaattgaaatgaaaaatattatttttgactgcgcggcgcaaatgtccatttttgctaggcggcgcaaatgtcgcggcgcaactggctgaggcgcaaatggagcggcgcaagtgtcgactttgctgagcggcgcaaatgtccatttttgctgtgcggcgcaaatggcgcggcgcaaatgtccatttttgctgtgcggcgcaaatggcgcggcgcaaatgtcgcatcacgtcttaaagatttaaaattttttatgtttaaaaagaaaaagatgggtctcttgatttttcgggcccaaataagccgggtattcaggtcaaagtccaaacagaaaatagtttacgtctaggcctacgttaaaaaagtgctgtatgatttcgtcaatgaactatttcgtcagtgattttcgtcaataaacattttcgtcagtgtactatttcatttattttgctgttttccattttgctgaggaaatcattagccacggtttaaaacgagattttgaaacaacattatgccagaaaaacatttggctctaacagaatttttgatttagaaaaggacgcgaaaaacgttcagttgcatttattttttgattcactgtttttgctaatgaaattactcagaaatttccagtttttaaaaagatttggtattacctaataaattttattatccgaccaaagaagcagtgacaaatgccacagcaaataagctgggtagaaattgaaagaac

SEQ ID NO: 22848 - DNA, 1745 bp, Heterodera glycines
tttaaaaagggttcaaaaaaattgcccaaatatgaaggaaaacgaaaaaaagcgaaatacaccggggttatttgggctaaaaccttcactaaatcaaaaattttcaatacaagaatgctatttttgagtttcttcttttatagcatatgcaccaaaaatatttaaacccagccttggggattaatctttaaaaaaggcgcctaaatatgcacaaaaggcaaaaaaaaaaactgttttctacctaaataaaccggtttttctgttttcaatttagactaaatatatttaattatgcaaaactttaaaaatgaaaaaagttcagaccacgctaaaaagttttcatgcttatttcaatgcaatagggcgaaaaaaggcatcggcctaaaaaatggagccccaatgacatataataaatcaattttagccaacatcaattttccaaattcatttccatttaacctttctcattcatttttttaattttcgtcaaatgggacgatttaaaattactaaattttttatttctccattttttattattggctcaatttctctgctggtaaatgggcgaaatgacaatttgggcccaaattccgattttaaaattggaatttcgtcagctaaaaaagggcaaattggtgaacagaatgttaagggaaaatcacaacaaataattgaagatggcacagaaaaaagaaatgatttgttctcaattttcaagaaaaaagaaatatttgacgaattaattgaaaagaaacgaattgaaaagggaaaatttgacgaatttgtggaggaaatgagagaaaatgaccaactgatcaaaatggcattcgaacctcaacaaagtgatgattaccaagaagaaaaggtaaaagtggtcaattagcaaatatgttatgaagatcactgaaagaaagcgactcatttgtgaaaaatttgcgcggtttctgacggtatttggtttttaaatagaagtgatcggagaattttgaaaaaattaagtaaaaaattaaagcgcttctccaggggactcggtggtttcagcaccatcgttttggtgccagcccgagtttttttgggttgtaactttttttcattgttgaccaaatccaataatcttggtatcattcgaaagctttacatgtttagaagctgtttctaagctattgtttggcaattcgacaattaccaaaaaagttgtaacatgaaaattgcgaaaaaatcgaagttaaattttctagcatatagaaaagttattatgaaaaacttcaaaatttcgactttttcgcaattttcatgttataccttttttgataattatctaattgccaagcaatagcttagaaaaagcttccatttttttaaaaatgtgcagcattaatatttaaataaatttagaataaaaaatttaagctagaaaaacaaacgattcgggcaatttcaaaaggtcttaacaatgtaaaaatcgacaacgaaaaaataacagaaactcaacaggaaaaacaattcaaagagaaataccgcgagtttagaggccataaaagaaaaagacccggcgttgtgtcgattaatggaacaattaaattcgtaccgtactcaaatggagtcgggtgagctcacgatcgggcggagttattgtagaaataagaaccccgaaagcttgtaccaatttgtttattttattttaataattttgcccatgggtctatcttagtgctcttatttttaagggtgaccctgccagg

SEQ ID NO: 22849 - DNA, 1352 bp, Heterodera glycines
tttgagaaattttataaaataatttatttaatacacaacactggggagtaaggactccgaccaagtgttgtgtccaaaacaaataaaataaataaaacagaaattgaatgcataaatgaaacactggggagtaaggactccgaccaagtgtagatacaagcaaataataaaatttaaatggttgtttttgccactatatatctgtgattgtctgtcaaattgttgaagtggtggaaattacacttcagctttgcaacaaaacgaaattttgtaattgttttgatttacagttttacacataaaacaaccatttaattttcagaatcggaagacaaattgataagctcagtggaattattttcagaattggaagacaatagattatgggcttctttcactttttgagcttcttcatccattttgagggcagctattagatttgtgtcgtctccacgattaaatgaatccttttgttttaataataactatagttgaaatatttttaataattttacgtcaagtccaacatgtttgtcaaaagcgggcacctctttaataaaaacaattgaatcatcttcgtcatcatgcaattttggctttttagttgcggtttgatgctataaaaacaacattatagatttttaatacttttttgattgaccttaaacatgttgctataagccattagttctggcagcgtaatattccgctttcgccgttcttcaaaaagcaattctttttcctgccttttatattccttgaaaatgttgtcaacaacattgtcaacaagaaaggcaacagtttcttgaacatcttttgacacatctgaatgaatggcctcttgatccataattaataattcaaaattcgctgaaaaaaaaaatcattaataaaattgaaataggtaaatgaaatgattgacaaataaatattaaataaagcgtttttaaatgatttattgagaataaaaacttgtaattgtaaataattggcaacgaaaaaacatttgagatgcatcaaaggagtgctcactattttttattggcgacaaatttggtgaaataaattgtacattggattcagaacgttttggagttgaagtcaatataagtttgttattttgcatcgtttaaatattgaataaatctgtaagcaagtttttaatttattttttctataatattttggaatgattatcaaccatgctctttgcagaaatttattttataaacacatatgaaaaacaaattattttacctaatgggccgttagcttcaccaacaatgtatttttgttgttggctactagacttgcacaccacgatgaggtggcccatatgtgcaagacctacc

SEQ ID NO: 22850 - DNA, 2953 bp, Heterodera glycines
cggctcatgttttattttgggcgtcgggggaggcgggctatacccggcctgccttgatgtggatggtcgtggatcgagatcaccaaactctggcactctttttgccggagtggggtgaccggtttttttttgatgtcgacggcggtttgaattctgactttggcttttgttgttgttctctcttgacgttaggacgcggccggggtgtaggaggcctcggctgctcaacttttacttttgcgcgaggcagtggtggaggttgataaatcatcatatattttttgcgttgcaaatcatcatcagcatcagcctcgtcctttttcaattttcttctgatggcaatcctgcgctgagcagtgtccatttcctcaatttcttccgcattgtcgggcagcacaggcaaatcgccatagtattgtgatggtgctggtagcgcgaatccattctctagcatatactcatcatcatcatcatcatcatcatcactttcgggcagtggcgccgcagctgcttccgcaaggaggtcccgcaccactagcggcggcggctgccgttgctgttgttgtatatcgtatcgccttttccgccattgctccatacgaccacctctccgagaagtcctgctcggtctcggggggcgttgtggacgaggcggaggacttgttggtggcgaaggacccccgggaccacccggaggactgggcggtggacgacgaggaggtcttccaggcggcggaggtggtggtggaggagcgggaggacggcgtggggtatcaaccacctcgccttcttcgccacctctattcatcagtacacttattcccttggtcagctcaactttggttggtctgtccgcatgttcctttctcatctgtaaataacgtcggagctgctggttataatgcacatttttcgccgaaggatttgtctgtccacccctggcccggtccaggtcgtggcgaaccgcgtccaaattgaggtctcccgtctgcgagacggaggtgagaccccgataaatttcttgtggtacgagaatgaatttgtttgccatttttattaatgaatgaatgcgtgtgtgagacaattttacgagggtatttatgtgtttcgggtcacaaccgatttggccaattcaattaagacgggggttaaaagggctgcaaatagtccgccaaacccctctcctttctggatgacaagcgctcgcttcgcacccctctcgctcctcgctctgctcacgcggcgcaccgtgtccacgtagggcattagtcgtttcttctgccgagttgtcagtcggaatcgggaagcaataatgttcaagcacacttccaccagtgacagcagctgatcagtgttcgcctttctgatcagtctcccgcatcgtttcacacattttgcctttgacagtgcgcaaagccagttggcattttcttttattagttgactaactttagcttgttgttgttgttgttgttgccgtttataccgctccatttttgggaatgaacacaactgttccctcgtcctcctcctgctcctctttaaatatgttggtgcggaggcgaagcgatggatcagatgatgcgtgcatatcgattagcaaatagccataggggcgggcggtcgccttgcggtaggcgtcaaggaaaaaatcgagttgacgtggaaaaagctgaacttcaatatttcgaatggacagcagtgagttgggcgcgcacattagcaccaaatactgcgccgaaaaggcgagccaccttgatcttccgctcaaacagattctgagtgatgaacactaccgcaaactgatggtgatgggattttttggtgaacaaatcggacagatagcgctcctctattgacagcatcagatcgtcgagaatgagcagcatcggtttgggaaggcgcctaatcagctcctccgaaggtacgcccgaatacacctcaactcccgccttttgcagtagcggaaccgccgaattcatctcaccaaaacagtacagaattgagatgggactgggtgcgatcagttcattgcactcagcataaattttagtaggaattccgttttgcccgacgaggatggcccggaaataattataccgcaaggcaatttgaaacaaatatctttattactgaacgattgagaatttaacattttcaaaaattatgacaaatcgagcagtaatcaacttttatatatagggcagagcgagttttgcgctttttttgctattgcatattgcttgtcgccgcttgaatgctattgacgaaatcgtccattacatcaccatcgggagcagattcagttgttgctgcagcactgctgttgtttgtgcattcctccctcttctcctcctcttttgacgatagctgttgttgttgttgttgctcaaaagttggcgagacatctgttaatgattccgccaaaagcaaattggccagcacattgatcgcggttttggctttcttccaacgcgtcccatcctgcatcattgcgtctgccgctagaccagcttccactaagtcaagcgccacctttgccttacgcctcaaattcttctcctcctcgtcgtccggtgtccgttgatgttttgctgttgtcattggtggtggtggtggtggtggtagaggctgggcgcacctgtctgaggacggcagttcgctgtacggaacgctgaacacccttgccttattcttcacgcgaaagaaacagtgaccgggaagctcgtagacaacatcaaaagggacaaactgagccttttctatgcgtgtgcaccataaggtgattccctccttggtgaccattgtgtccacctcagcctcagttcctttacatgcgcggcaacgcccgttttcctcaaacggaatgaaacggggaacagacaggcggggtccgctcaaggttatgccgcccatgcttatagtgaggtccacctctgcgataacacgctta

SEQ ID NO: 22851 - DNA, 2755 bp, Heterodera glycines
ttgcgagcctacagtccttttcttcgtcgccgaaatcttctgaatggtttaccattcagaagggaaaggtgctctgtgtgtctctttttttatttataaaatttataatttatagcctgttgcaacggctaaacttttggccaagctcgtgccttccgttcctattggttttgcacccaaaaaggtgcaacttcattatttatatgtcaaaaatggaattcatataagcgtttagaagcggagcactttcaagccaacggaaaacaaaactgaaaaagtcagtttgtgtttggatgactgcaaagtttggccggttttgcctggattgtcttcaaaagaaacggctcgtgttgtggaacgtagcccggttttgatgcgttatgctgatgtgctaagcaggccagctgttatcgaaaagaaggtcgctgtaccaaattctggtcgtctgtcgccaccgaaacaaaagtcggccgcgcacacttgcaaaaatggcaataatggacgttctatcgtcccaaaaaaacaccggaagttgtgttttgagtccttggtctatttggaagagcgtaattggcagaagtttttgaatgccgggcgtactggcaacattttgacttccgttgctgtccaaaagaaacgagacgacatgccaattgcggccgctacaaaaaaacaacacttcggccaaagaacatacgctgatgtggttgcgacaaaaaacgtaacaacttctgtcgtcccacagacttacaccagaaattatacgtctaagccgtcttatactcgaaaaggcttagtgcttggtgacttcatttgcagtagttttttctcttctaagcatcagcgtggtggtgctgatcactctcacaacacaacgcctgcagaacgttcgggaactaatccaacgaacgaagagcaacacgcctttcttcttgctctattcaaagaggataaagaagggagagaacgtgcttttgcttcacttgtgaatcgttttggcctaaatgttgtatcccgttggacttatggacgttggtggaagaacttcgaatctggtcaattcatgctgagtcaacgtggacgtaagaataggcggataacattaaaactgcaatataaaaataggaaaattttcaactccaatggcctcgccagcgtcgtcggagagagatgacgctgtgacaattgagtcgcaaactactgcgactcctttatcctcacgccggaccgcaaagcatggtagtcaacgcgaaaactttctatataaatggataaaatcattgtattaagaagctggtatgtgcccgcaagagatccaagcaaggccacaaaacgttgacaccgaaagtgatgttacttgcgttgacttaacgttgagcgcagttgagcatgcaaattgtttggaacaaggaataggttaatgcaaaagcaatattcttttttggaactttttattcagaaaagcctatgcaatctgctttgttaccagtcgggaaacgaagccaatttacgtcgatcaaatgcgttaattgcaaacaggagttggatgccatggatggttatgcactggtagattgcagtcataaatggcattttgagaagccttttgctgattggtccgtttgcacaatgatttttttgcatttttttttgtaggtatgccgaatcatctataaaaaaatgcaaagttgatgattgcaagaaaaaatttaaaaaaactctttgtcgtgaatgcagagaaaatttgggggccggtgttttcgagacagggtgttactgttctgtcacgtcggcatcacctttacacgctgacgaactggaaataaagtaaattatatagtgatttgcataattattaatatttaaggctaagacaaaacattggtaaatgtccggaatgcaagagtcagcatcccggtttctgcttgctttgtcagcagttgttcaaattgcagtcaactggaatccgccaaagcaaagtttttttacgctgctgttcggcatttttccattatgaatgctggtaaacctgggctgatttgtgttctttaaaaatcgttgctaaaggtattctgaacaaccaagactaagctgcccgtgccagtgcaaaaatccatggcaaggaatcatggatttgcattatcagtaaggcttatcttatataaaaatatagtactatatgttatagtgaggtttgtggggtgaagaacgctgctccgctgcgaaacattggcaagaagaggggcgttattggcggccgacctcagaaagccgacatgtcagcatctgctgtttccgattcaaagaattctgccaaagtttcaaaaagaatcgtttccggttcggttgatcaggcattgatggactcacaactcatgccacctccttccttggttcctcgccgcagttcaagaattagcacgcagggatcaaggacaagcggacagacaaatgtgtcttcaaggaagccagttgctccggttactgatcagtgcgcaacaatgcattcatcgcatttgggttttggatgcggctcgaaaaaggccaaccatctgccatcatactacacttctttaaggagccaagtaaaaaatataatgtcctgaaagggtataactgattttacaaggaaacaccgctttgtccctactgcaacgcacttctcttgccgtccgagtcgactggcccaaaggcgtattccaaatgttgtgccaaaggacgcgtcaatctcctgcaacgctttaaaaaattgcaa

SEQ ID NO: 22852 - DNA, 2590 bp, Heterodera glycines
  misc_feature (1711)..(1711): n is a, c, g, or t
cttggtttacactcagcaaataaagaggacatcgaaaagcggatttgcgggcttggtgttttgggccatttttgggccgcccggagctgcgacgaggggccccattttgggtgtccccgagtcccaacagtctccagagtagggctttgtcatggcgctcctgggtggatccgttgtcttagccactagaccacatccaccactggagggatgactgttgttatgggggttagccgacatttgcggaccgacttttgcggaccactatttctcgatagaactgtctaaataaagaaaaaaataataagaaattttaataaattcaatattcccaaattgaaattagtgaaggtaagctgatgcaaagcgatctgtctcaattggagagaagtcttatttgacataaattttttctttcttttttatagaatttctaacttataattaaactgtgaaattggcgaaaaaattagctaaattaaatataaaagtcagttcaagaattttataccaagaaaattttttatcttgtttcacttccacgctttagttaaccgagagcttaattttttccggcatgtcaaaccaattaaattaacaaacaaaaactaaaatagtttatctttttctcaaaaattgtccgtaatttgtgttattaaaactatgggtccaaaattaaaaatgagcaactacatactatatttatctatggaaactaaacttctttaaaaaatgggttctttcgatgttgattgcaaaaagttgatcgattactcttgaagggcgatgttcaacttggtaaaaatcacaaataaaactacttagtcactcaatttttgaaaaaattattattttttgttttttttgacagttcaacccagaaatagtggtccgcaaaagtcggtccgcaaatgtcgcactacggttatggggccatctttccttcattttggcccctgtctttttgctcccacagctattttcgatcagccattacagcgttatatttttcatttacactaaaatgacctagagataaggcgctaattctagatgaaataaccgtatttaaaagagacacattcgacgggttgaaccgtcgaatattaataaatttgggtgtttgagtagtttttggaatagacatagtgaaaagcttactgaaaaagtggcaaaaaatttcaccaaatttactcttagaaaatggatgcccttccttccattccaggtctctttttgaaaaattaaaatcacctaaaacaacgtaattttggaaaaaaattttttgaaaaatttgaccaaaatataggacccaaaccaaattagtaccaaaatttaattgattttaaattttgtaattggaaaattaaaagttcacaattaaattttgtgccagaaaattttatgaaaaatcctatttcctttttgatcaaaatagcacaaccgccgccacgagaacaagttttagattttcttgatacaaaaatacttctgtaccatatttttactaattaccaataaatttaaagttcaaacaaataaatgtgccaataaagtaatccaattcattcagcattctgtgatcacttcccaaaaaaacatttcatttttttcgtcctccgcgttctttcaactgaagttgcactgaagcattcggcataaaattgtagtaggccaaactctgactgtccttcatgaaaatgccctgtgnaaatgggaaaacaaaacgttagccaattaatgcaaatgacttaaaatgggaattaaatttgtgttcacctcgtagactaatttttgtttggttgcaggaactccgatctgctcttggattaacgattttaacgcagtgacctgaatacaaatcgatttatgtgcaagccccaaaatagtcattaatttgttaaaaaactagctttaatttttaaaaaagtggaaaaaatttttaaaagcacgtataaaatatttaaaaaatttgaaaaattaaaaccagtaaaataatacttgcaaaaagccctgcgaataacgcattgcttgatcatcctaacttatgactgaccgatgaactgatgtccaactgaatttgtactgtgttccccttcaggttccattcatcattttgcggcgtagcgatttgcacagcgatttgaccgtggacctgtaagcaattaaagattttttttcctcgttttagcaaatatcggtggagaccggcgctcaccttttgaagccaacgttcttccggttccagcgtttcttcgcgcgggcgtttgtttggcggctcatcgccaacagaggcgccggggggcggaggaggaagcatgaaagagccatgcggtggacgcatcatgccaggaggaggcattccttgaggaaaaattagaaaatgaatggatatgccattgagtcaatccacttattgtgtgtttgtccaaagaacaatggggtgacttcattattactatatttagggctaaaccgtgtttcgagttttatttagaaaagatagtgtttttgaatagcattgaaaaggcattccaattatttgggaaatttcactaaaatcgaaaggaacggactgatcctcatcata

SEQ ID NO: 22853 - DNA, 1461 bp, Heterodera glycines
  misc_feature (64)..(64): n is a, c, g, or t
  misc_feature (77)..(77): n is a, c, g, or t
  misc_feature (160)..(160): n is a, c, g, or t
ttttgcacttaaaaaaattccaaaaatttgatcgtccataaataatttgtaattgatcagcgcntcaccaaatttgncagagatacgtatcggagcactacaaatgcttactatttttctagattttttaaacccgctgacaaagttaagcctaaacttnttcgtgcctgtttaaaaaggaattagaaatttttaaaatatttattcatctccctttttgataatataagagtcagagtgccttattcaacttgtaaataaattttggtgcgtttcagagcagtttctgaaaaaaatttatgaattaattttgcaaaaataaataaataatgaaccctcctccttaataattttcctgcgcccaaggtactcactcggccgcttcgcggcctcgtggctgtaaaaaaaatttggggcgatttgaaagagaatagaaagaaccaggttcgatgaagttttggtaagccaaaaaaaattcaaacatttaaaaatctataaaaaatttaaaaatgagaattcatgcgagattttctggaaataagcttaattgggcctagttaagctgtaaaaaaaatttggggcgatttgaaagagaatagaaagaaccaggttcgatgaagttttgttaagccaaaaaaaaatccaaacatttaaaaatctataaaaaatttaaaaatgagaattcatgcgagattttctggaaataagcttaattgggcctagttaagctgtaaaaaaaatttggagcgatttgaatgagaatagaaagagccaggttcgatgaagttttggtaagccaaaaaaatatccaaatatttaaaaatctataaaaaatttaaaaatgacaattcatgcgagattttctggaaataagcttaattgggcctagttaagctgtaagacacccaccacttttgcacttaaaaaaatttcaaaaaatttgatcgtccataaataatttgtaattgatcagcggctcaccaaattttgcagagatacgtatcggagcactacaaatgcttactaatttttctagattttttaaacccgctgaaaaagttaagcctaaactttttcggcctgtttaaaaaggaattagaaatttttaaaatatttattcatctccctttttgataatataagagtcagagtgccttattcaacttgtaaataaattttggtgcgtttcagagcagtttctgaaaaaaatttatgaattaattttgcaaaaataaataaataatgaaccctcctccttaataattttcctgcgcccaaggtactcactcggccgcttcgcggcctcgtggctgtaaaaaaaatttggggcgatttgaaagagaatagaaagaaccagaatcgatgaagttttggtaagccaaaaaaaattcaaacatttaaaaatctataaaaaatttaaaaaatgagattcatgccgagattttctgcaaataagcttaa

SEQ ID NO: 22854 - DNA, 1914 bp, Heterodera glycines
tgcatcaaattaatgtaatcgtaaagtacggacaaacgacattaaaatatttacccttttaggcatatcgtgatttgtttggcgatgaataaaaacaccaatttaaagaaataaatgaatgaaataatgcaacttttatgacgttttgaaaaaagcattgtaattttcaagttactttaataaataaggtcaaaaaattggaatttatacttttcacatccgcttctcacattttaatcttattttatcttgcggatattagcattttgtcgtcatggaatttagaataaaccaacagaagcagcaggaagaggaggtacggagttgaggaggagttggtaatgctcggaaagattcgcaattgcgctgagatgtcgagatttaagggacaactgaaaagaaaaaaggggaaaatgggagcaaacgccacaataaaaaataaaataaataaaataaaaaatcatacagaattgagagtgcctataaaaactcacagtgagtgttgtactgttctgcaacatcttcagttcagacagaataaacacttggttagtatatttgatgctgaacggtgaacataaatggaaatattgtcaaagaagcggattagtcactaactaattgacgggtcaattaattaattacctatgataaagaagttcttgcccgtctaccgtacgacgcgcgacagtaaacacattattctgttggaggactgtgcaaatttcatctgaatagagagaacccatcggaatttgaattgttctttcgttcccttaccggcagttaaatttctgttgttctgcacggtgaattggacctcattttgttccgggatttccttccaaagttgcagaaagtcgcgtttgtccatttgaccactttcttcgaagaacacattaagcgggacaacaatagcaaaataaaacacgtcgacattgtttttgacggccaccttaaaattaacaacagattgatgcgagaaagaacaacaacaacaacaacaacaacaacagacttgcaaattggtgagtggttccattcgttggatgggtccgttggtgttgcagggaagcgaagcggacgcactttggttggggaaaatggtggccacacttagcggttcggagggaatgagcccaaaactgaaaatgagttaattgggcaacaaagtggggtggaattaaaagattgagtgctaattgaaaagtgcctgtttccgttgaattgaatggcaaaagagttcatcggttgcagcgctttgtttgttaaattcatttccgcaattattcgcccgcttcgacggacccaacggccctcaatttgtaatcctttacccttggaagcatcgagccatgccttatgatataaaataagattatgcaaatttcgagaaataatgccacctcatagggcggaacaaagggtccgagtgtttgcagtgaaggagcaacgccagtgccggcactcgaaccaccgaacaagttggcgaattggtcaggggattgcgaagtggttatagccgatgattgtgaaatagaagcgcaaaaaatctgatccaatgggttggtggcattggcggacgaaagagtagtcaatggatgttgtggttgaagtgggggcggtgcgttgtcaaaaacggacgaagacggaggcgcatcgaaaatatttggtggagggacagcgggggcggcagaagaagcggttgtatcagcagaaggggccgaaggaatgccaaatatgtccatgatattcgcggtttgagaaggcagggctgaaacaaaggccaaaaagtgataacaaagaaagagaataaccttacccgcaacgggaggcccagaaatgtccaaactgagaaggtccgcaattatcgagtcttgtggaggctgaaatgacgtcgggctgcggaggaac

SEQ ID NO: 22855 - DNA, 986 bp, Heterodera glycines
acaggataatggtggagtcgacaaaagagctgggcggcttatgataaactgaagccagcgaaccaatgtgacagacctgaaaagccgggagggaggggtaagagcaacgaaaagtctaattaatgtcctgaaatatgcattttaatgcatttcaccagttggttaagaagcgacggttccaggagatcagtttcctccgaaatcaatggcttctccgccagaacaacttcttttgccgcttgtgggtcggcacttaaaaggcgccagtaaatgtagccgcggtcccgaagatcgggattgtcagaatcctatttcaaaatagaaaaggcaatcattgaccattgagatactccccgaaataacgggtaccccaccacccagaatagaggtggtctgtatccacctgcgtcgccaatgtgagcacacgttggaccaattgttgcgtgtcagtgggacgctttaaaaacaatttgaccaccttaacggatggaaaataagaccaaaaattaaattctaattgatgagtacggccgtgaggagctgcagttgaacttgggtattttcgtcatgaaatccttcgacgaacgattccaacaattcgtccgcattgtcaatgcgttcggcatattcaccaataatctgtttattgaataaagaaatagttgttttatcgataggatttacgctgtcacccaaatcatcgacgcgcgtgcctcgggctcgtccaacgtgtcgaggttttcacacagcgtggaaatgatgccctcatatcgatttggatattttcggaagatatcctaaaagggataaaattagaaattgttgtctctcccatctctcgccgatggtcggccaaatcacttttatgacgaccactgcctcttggaccacataattcactttcgtctggatcagttccaacagcgtgttcacacatcgttccgcactgtgctccacttttatggcacaacgtccgatcgctcgga

SEQ ID NO: 22856 - DNA, 2026 bp, Heterodera glycines
  misc_feature (1849)..(1849): n is a, c, g, or t
aaaagaaaaaaaaattttccaaaaggggggggccgaccaacggcagtattaccgcaaaatcaaaccaaaaaaataccatcagaaaaaacatagacgataagaatgcctttcttctcttggtaaatgttcagagcagtagtaacgtcaccagaataccattccattttggagtcaattaggtattgtaaaatccaagttatactcgagaataaatacctaaatatatcgtcataagcatatcatcaaattttataaaatgctttttactggttttattcaaaatcaaattaatgacttaggtataagttttttgaatagtacaaatcgcggcagtacattttgagttttttggggggcccccaactcgaagcatcgggccctaaactggaaaattatccaaattcggacggaaacaaatttattttttatttagtaatcaaaacgccaaaattttgcaaaatttaaaaaagagggatttttccttgttaaggtacaagaaaccgacctcgatttaaaaagtttttggaaaaagatagtcgtaagcaactcatacacagatgttgtagagattaaaaaaagcattggaatgagctattgaatgtctagagatgtctaatttttattttaccattttattgtaatttaattactgtccgtaggggtcatatgaaacggggatgtggggttcgagcccgcttggcttcaatttaatttttatgatacttgatcagaaataagacaaaaaattggattcttcgaaaatttattcagcagcgcattttttaacccggaaaggctttttaaaattttacaattttttcccattgagaccacaattctgcaccttagctattagtcaaaaatcattgcaacatcaaaaaatggtcatccgacaatgagctcagggtagtgaagtacatcttttctcatagaaaatttggtttttaaatgtttatatttttcgcaaaaccacaaaactgcacttttgccatcattaccattgacttccccccccccaatgcaatcaatgttttcgtttttgaaaatttatgtcattaactttaaatcaaacataaaacaaatggttaacaaatttatataacaggaagaacaattgcatataatgtcacctcacgaaaaggtaaatgtaatatttaccaagccacatatttaatatttcttaatgtttgcctggccacataattaatatcccacgttctgcaaatatttgtccaaatcgggcacgttattcttcagcaaactctctttgactttaatggattcgacggcttgacgaagaggccgctccaatgttttcagagaatgttcgtccaattcttttttaaaaaactcctaaatttaaatgggtctaaaatctccgcttttgccactgattgtgcattaacccaccataatgtcctcggccatggcattcgaacagaaacccgaagtcacgcagtcaaagcaatgcaagaacacgttgctgttgacgctgccgtacttctcgatcaaaagtgcgaaattgtttttgaaaaagtcccatgcgaaatgtccacagcacgccatcggtgccatttccgttgccgcgaacaaaagataaaggtcctggtcgcggattttgccttgaataacaccataattgaaaatgtcctcgagcattttcaagtccgaacactggccaagtccttaaaaggtttgtcataagggaccacctcacatttgcctaatatctcatacctaatacacatgacaactccacttgtgcgtagcccgatgtctccatcaaatttttcaatgcagcaatgattttttcatcatttgtagagcctacggcacggaaaatgagctntcgcaagtccgggacaacatcgacgcctttctcgatgagggcattgaatttggaagtgccatttgaatagtcggttgatggcgaaatgtgacaaacggctgaggagcagggcacgaagacgtccaacgtgtatagctaaaaaggaaagaaagttatgaaaaaaacaaaatgagtttc

SEQ ID NO: 22857 - DNA, 1686 bp, Heterodera glycines
  misc_feature (76)..(76): n is a, c, g, or t
  misc_feature (99)..(99): n is a, c, g, or t
gcgaaacgctttgtcggctggagggcggcggcagggaccaggcgagcaaatggcataatttcgaatttaaaaatcnttttttgtgccattcattagcgntaaggcgtgagaatgtttggcgcatcggagtgaagcgttgcgcattgacttacgtccgctggcatggtgagcagtgcatctgcccgagtacgcgctgttcgctgtgctgcactccaactcggagatgtacaaagcagcgagtgcatattacaatcaggtgggagaagggaggggggggggaagtgattggacggagagacaaaaagtgatcaaagtggactcaatgtgaagcagggagggaaactgattgatcagagggaggggagacatgttgagaagcaatgatagagaactaaagatcagagagagagaggagagatgatcagacaaattgatcacttaaggagccattgctgaggaaaatgatcagaaaacaatggcaaaacaaattaaatttaagaaaattgtatgatcaatgggttatgggtaagaaaactttgatcaaacacataagttcattgatcggaaaaacaatgatcggcactttgttcctaagagggttgtcgagtgccgaatcgctgcccaagtgattgccaaacaaagcgggtgtttgccggcggacactgattggcgttctgttcgaaccctgcggcagggtataaagttgggtggttagacatgattcggatttctcgggacccgaaaaacttttcttggccaagtttcagttgctgcactgctcggcaaagatggccatccggagcaaatgttgacgctggtggacgagcacttggcaaaacggtgccaacgccaacagcagcagaaattggcggatggcattcacacgagggaggaaatttgtgccattttggactgttcagacgcacaattggcccaatggtcgttgaatgcgaacacacagaacagtgagaagaatgatctcgaattagaacaaatcccagggtttcttggctttcgcaattaaattcgacttctacccaatgatttaaatgccaatttgagacttttctcggcttagaaattggatgcttaatcagaatggcgacattgctttttctctcacttcatttaattcatcccaatttccccaaaaagtgactgagttttggctggccaaacgggcacggcacgtttatgcggaggcggcacgagtgttggaattcgaatgggtgtgccgtgaagggagagaggacaatggcacagtggcaaaattgggcggtaaattgagacaaaattcaacatttaatgaccaacggtttcccgaacagaactgatgaacgcttcgcatttgtcgtgtgcgcaactgttcgagtgcagttgccccgaattggacgaaacggtggccaattgtttgagtgcgggatgcattggtgccagactgacgggtgattttcacggagtttaatgcctggtttagtggaccaaattctataaattttggtgccatcattctaatccattcaaaatgctttaaaagtgatgcttgggccctacttttgtaggttaattttccaatgggagaaggtaagacggagtttgatgagtttatcgttccgtgatcattgaaatacatttcatgatgatgaataaaacggaacacaatacaggacggtctcaagttacata

SEQ ID NO: 22858 - DNA, 654 bp, Heterodera glycines
ttctcctcccaacggcacataaattaaaaaaaattatttcaaaatgaattattatttttttgtgattccaaaacgaaaccaacctgtggcaaaagggtgcaaacggcgaagaaagcgctgagttgccacgagcccttgggcagcaccgtctgggggatcagaatgtcggtggcaatcacagcgaaattcatgtgactgacacttctgacaaaaaaaacaacaaaaaattgggaatttttgggtaaaattttttaaaattatttatttattttattttttttgatgcgtctcacctcaaaatatgtataaaatttgtgaacacaatgcactgaaagtcttttgcgctgatcagttgctgaaaaaggaggagtggaagagcagcatacatgtgcaaggggtttctcagcccaagggccatacaacagacgattgggacagggggggtgtctcgggaccgatttttcatcatacgaaggtccaaaattttatttctccgacgaccgttttttttttgccattcagccacactttttttgcggtgttttccaaaaaacttttgaggaaggggtgacgggcggtccggcggtgccgatagaccccccctcctttacagccgccccccttacgacgcacgtgggtggggggggggggggg

SEQ ID NO: 22859 - DNA, 880 bp, Heterodera glycines
gagtcaaatttcgcaagaaaaaatgccgaaaaattgtgaaacgatgagggggggggggggggtaggtgaaaattctcataaaaccgcccaaattagtcaaaatataaattttctacccattaaacccctccctggcgcctaaaaatttaaaatttcaccaattttattggcctggccattgtaacctgaaaaatgcgtcgtagagaaacagtgagacgatcaaatgcaatccctcgacgtacggcggcgaattgggcgcacttcgccacgggaaccaagtgatcagaaaggagaggacgagaaaggggccaaaataggtgaaaattttgccacggtctttcatccaagtgccaccgacgtcctaaaaaaatatgggaaaatttggaataaaaaaatgcgcattttttttttgttgtaaagctaggccttaagataattctgaaagaaatttcccataaattccccaacgatggctaaaccatgtcggattttgttagccaaatttatatttgaatttacaaaaatttcgttaaaaatcacaccaaaacaaacagaaaatggttgtatttcttcgctaaattttcaaaaattagactcaaaaattgagtgagtctaggtaaaaaaagcacgcttaaaaatttttgcgatttaaaacttcatgaatttggttaagagtttttgttaaaagcgggagattcgctcgctacctgcaaatagccaaaaagtgggtcattgatggcattccaaatcagaaacaacagctgggaccagttgaaccaatactcgttgacttggaaaatgttgagaaacacctgaaaattggggtaaaacaccttttataacccattaaaaataagaaattcttaaatttcatattttt

SEQ ID NO: 22860 - DNA, 846 bp, Heterodera glycines
tcataaccgaccttttttggcctatttacgcgcaatcgctttccggatgccggaaccaaattgatttgattgaaatatttttaggaaataatccgttctgatgactagaaaaatttttttttaatttaaatttactgtcggattgtccgctgttggattgtccacttctgtcggattgtccaggagcactctaatttctttcttttccttccctctctctgccctaccctcccacctctatcacgctctctctctttatcccttttactctctcccgctttctctccctctctcttaatctctctccctctcggtctttcttaaccattctccctctatcttttttctctttaactccctctctagctctctctcttttcctttcactctctctctcttttcctttcactctctctctcttgctctttaactccctctctagctctctctcttttcctttcactctctctctcttttcctttcactctctctctcttgctctttaactccctctctagctctctctcttttcctttcactctatctctcttggtctttctttttctccgcataatttatgttttttaattgtatttatcttaaacgaacttgatcatccaaattgagcagcgaaaatgccatgacggaacggaaaacgtcgagcaatgaaaaaaggtccatgcacagtattgttctgtagcttgtttgtccattgctatcgcataacggaacggtgtatttgtccgcatcactgagaatggagatgtgcgactcgaacaatttcgtgaagagtgccaaatcgcgtgacaaaatcgtcccgaaagacgcgttcagtggcataaaatg

SEQ ID NO: 22861 - DNA, 761 bp, Heterodera glycines
  misc_feature (706)..(706): n is a, c, g, or t
tttcattttacatcagtaaaaaaaatcaaagaaatttcacttaaaaatgcatacccgtgatggcattccgagaccccaaaaaattttctgaagacggaattccgtgccatccctggtgcatacattcgataccaaacccactataattgaatttactcgtctttactttatgtatttgtgatttagattgatagaaaaaaatgtaattggtagagcccggaaaaaaatcatttacggagcgggagcccgaaatgttccgggagcgggagtcccataaaattcccgcgaggctcccgctcccgccgggctctagtaattggactcaaaacttgattttattaattgaaaaacagattggactcataacaaagttttcgcccctattaggctcctaaaattgtaaattttcgcctttaaaaattaccctcacaagtgaacacattgtaatatttgaagaagcaaactccgccacaaacggcacatgttctgctgttgtttatcactctcatttggtgttcaacaacattttcttcatgaaacatggaaatatgataataaatttaatggaatttgtaatttgatggaaaaaagcaaattaaaatttctaaaataaaacatatccaattgatgcattaattaattggagaaaatatttgaaacattaaaaaaatcactccattaaatgaatcgtttttctctcattttncgagacataaaaggagaaaatttaaggcaaattgatcatttttcgctaattaagg

SEQ ID NO: 22862 - DNA, 2979 bp, Heterodera glycines
ttaaataaaggtgtaaaaaacctggttttttcgcaactcctccaaacaggtacttgattgggatagcagctacaatttcccaaacaagctccgatggtaaacgacgtttgttttgttgttgttgcgcattttttcagtgaaatagacaatgaatgaatgagtattagagttggctgtaggcgtcaagcaagggatataaattattattacagtaccccaattcccaagggaaaattttgaattggcttctaaaagttttgatcagcatgaccttgcaaacacctggcgtcatattgatattcccggggattatcgattgatgggaggagcttactaatatttggatggctttataagagctcactgacactctatttggttatttttacattttcaaatttgctgttaaccagggctgtttctcaacttaaagagctccgtttatcctggcagaaaatttttcaatttgccttttaggtcttgaggtagtgcactagacatatctaatttcacgaaacgctttaggtgctctgtcgtcttgtgcttcatgggtggcggtgcgctgctcatcaggtcatggttggttgctaccgatttcacaatgatccatgcctatataagcatgctttttctctcaactcatcattttatttatgcacaaaattcaaaaatttattatttaatttaaatagatttaaaaatgtccaaacaattcactgacttttctattgacgccattctcggcaaaaaaccccgacaaggcttccttatcaaccaaattttgggcatagcacacctgctcggatctgttcaacacggcgaaggttcttccaaaaaacctgtcaacaaatacgtcaagaagttgaaaggcagtttggaacacaacgaaaagttccactacacgaaggtcaagagccgattcagcattaaggacgtgcctgccaatccggaagcactgctcgcggaaatcctgcatcgaccaatcaatagcagacagtcgcggcaagggaatcgagccaactcatcttggttgtctcatcagcagccctttactcagtggcggcgacattccgatccccatccgacaaatcacggacaacactgtcaacaccatcctaaaccgcttcaatcaagtggcacagagcaagaaacaacaaaacgttacactctgggttgaaccgtttaccgtggttgtgacaacagtggatcggtctggactccccgcaaaacgacaagtgaagggaggtgctgcttgtccattggctccagttcggcatcaaatacatgatcgctgtttgatcaaggtttaacctcaattggaagcctcttggcatatatcaatgtgttagtttaagatcaggaacccggacaggcaaaatttctgtctcttctatgcactgcaggcgacaatggttgccaagaccagaggatggccccgatgaaagttttacgattatctacaaaaccgacatggacaacggggagaacttcaacatgatgcaattcagcttatgaatcaaattggtgcacctatgaatttgaacgcgtatgatgcagatacttatgtgccgcgcgttatcgactattggaacaacaacaatcaacagcatcgattctctgtcttcatcttaggggcaacaggccaccacaagcccatctacaaatatgtggacaacacctacaacacaccactgctcctttatttcaacaacagccattttgatggggtgcagaagcagggtggccttttcggaaagccttactgtttggagtgtgaacgaccatactcgagggcaccgcaacacaataaatcgtgcagggctcgcagtttgttatgctcacggacgggcccactatttccatgtcaagcacatgctggattctttatgcattgcgatgggtgcaacaaatcttcaacaacaatgactgcttccggcaccatctccagtcaggtttctgcaataggtccaaaaagtgtaaggactgtggtgttgtttgggacgtgaatgataacaacagaaatggaagaaaaggtcacgtgtgtggtgagcgctactgcaacctctgcaaaaatttccacaatcccgaacgtggctgcttcatccaactgcttgagccaagggaaatggagccttatcggattgttgcatttgatctcgaaacaatgcagcaccagcctgttagtcctcgtgagccagagaaaagggagcatcagccaaactttatcgcagcaaaagtgttctgccctgagtgcattgacaacagcagatggcggaacggaactgcgggttgcaaagtgtgcggtcctcaccgaacagttgccttttgtcagcgccgctttgtcaacactaccgtcgacaaacaagttgtcgctgacaaccctttggaggcctttgtcggctggctcatcaacgctctgcccaaaaaattcgacacatacgcattctctcactttgggggtcggttcgacatggtcctcgtgttccgcgaactattcaaaattgggttcaatcctgaaatgatccgacaggtaacttaattgttatatttttttattgtgttattatttttagggcaataaaatgttcgagatgaaagtcaagaagcagaagaaccgcaaccccaacatcgtgttccacgactcgttcaacctaatgccctgcgcattggcgcagctggtaccttcctatgggctggaggtcgaggacaagcccttcttcccgcatttggccaaccgcccggaaaactacggtcgacacatttacccaacagtggatgactacctcgcaaatggaatgatgccggagaagcgacgacaatttgacctgtggtacgagcgcatcagcatgagccatttcaactggatgaggcattggcttcctattgcaccaatgacgtggaaatcttatcggctgctctcatcgccttccgccgcgaattctttgaagtctcgaagcggaatgactacgttgatggagt

SEQ ID NO: 22863 - DNA, 1741 bp, Heterodera glycines
tcattattaatttaatttgaaattttgtgcaatatgatattatcgaaaatggtcattgtctaaaaggtactgtcgaaacggtcattggagaaacggacattgtcaaaatgtctagccaccataaaaatttatttgttttcacattattattagaatttatttattttaaaagcacaaatctaacagtctgtcaaaatcgttaattaattccttacggtatccaaaagtgagtacaagcgcattgcggaattttctgtttaagagcaaaagaaaatcaccacaatgactatgcatgcggatcagggctgtggaccagggctggacgtaattacggattacgtattacggattacggaaattacggactttttggagttacagattacgggttactgatttttgggatttttccgtaattttgatccgtaactggcttttttagaatatttttcgagacgatttcttgtaagattttttttataaaagaatttattctatttttattaaaaggctacccatatttcgatttcatctgacttattcttgttaatttgtagtattattaacatacataaagggcggggggcgggaggctagcgaatgggaaaagaggaaatgtctaaaaaatttggctattttttaacaaaattcgttaaaaattctgaaaatttttcctcggccgtacttatcagcaccgtccgccccaaaaactcctaattatttttaaatattagctccaaacttagtcctttttagacaacatcttttaacaaattgcataataattttcaaaattttttttggcggcgcctttcggcgccgcctgacccccccccccccccatgttccccagttttttggataaagcatgccacgaaaaaagctgtttaaaaaaatcaaaaaaggtcgtcaatttacatagctgggacccttcacaaatgattcccaaaatgaaccctaaaaattttaaaagaaaagaatgaatttttacgtcacaaattataattatttgcctttcggcaccgccaaaccaggaaatcgttttaattttgtttaaaaaggacttctaaaagggtgagattactgaaaattgatgaaaaaattttgaaaattttcgaccacagctctgaatctgccatttttgcccctatttttctatcttcctcccggctcatattttgggatttttcacctcaaaaaatcatgcaaagcttttattctgatcataagttactcttaaccaatttttagattggatttttttaaataaaaatttttacaattaaaattttttttttttaaattacggatcacggattacgcctaattacgcctttttggacctccgtaatgacggattaagccctggtgccgataggcgcgtgctaaggaattttttttaaaacctttgtttgattttactaatgtattgggttggcaaataagtccgtgccattaaaaaaaatctttttaatcattttatagtgaatttaaaatattatgaaattgtaaactagaaaaaatgaaataatttttttaaaaaatattttgtttttaaatgtactttaagtttttatttatttggaatagcacaatcttttgaatttttcaagagaatctattggtttttttttgtcaattagccctaaaaatgtaattttttttacatcaatattaaatcaaaaatgcttttttcaaaaggtatgactgagtttaaaatcaaacgtaaattattatctat

SEQ ID NO: 22864 - DNA, 977 bp, Heterodera glycines
  misc_feature (40)..(40): n is a, c, g, or t
ttaatgaccctgtgccatgcctaccaatgtctccgtgtcncaatggaaatggacaagccccgtctgctcaaatccgtactccttcaacgtgttctcttcgtccaattttttcttttggtatttgttatcaaatgcaacagcatccggagtgagtgtgaatggaccgtattggaaggaaaggtgccgagcaacaaactcacgaacactcgcaaacttttcattctcatggaaaatgccctataaaactggttttttatcaaaaaaaattaatatactcaacggaatatgattttaataaacagatttgcaaaataatttatatataataaaatttgatatttaccgctttccggaaatgagccgttttttatttggaccggtaaaaagtagagaccggacaagagggtcggtcggtcggtttcggttaaaaaccgaaaaaaaaccgaaaccgaaaaaaaccgacgaaaaattttcggtatatcgtttcggtttcggtttttttgaatttttatatttttccaaaaaaagcaataaaacatttttattaacagaaaaagctaaagatcacctctgagtaaaattgtaaagctattgaagctctatcgaatggtgtactaattttggaaaattgaaaaaaggaagccaaaaaacatttttttaaatagtgagaaaaagtgccaaaatagttaaaaaagtccaaaatagtgacaaatagtgactaatacaaaacttttagtatcactatgatgaaattaccttacaaatagagatgattgaattttctattcataactctttcaattaataacctaatatgttataaaaatggatataaattatattcttttgcatattttttctgcgcatgtgcaatgaagaaaggggttcaaattttttttaataaatttaatgctattttttaactgattttgtctaaaaataacaaattttgagattttgggcttattttttaagaa

SEQ ID NO: 22865 - DNA, 1005 bp, Heterodera glycines
ttgttgtttgagccaacattttgtgctaacatttgcttcctctttcgcttctttaagaattaataaaatatgcatgagaaatgtgggcaatgcctcggggggcggcggcgtcaaaatgccaatggcacggcgcgacatgccaaactttgattaggcaactggtgaaaaacaagttctccattttcattgcaccttcctcaaccacagtggtgggcttgaagacaaacagcagcaaaaagcccgctaaattttgtgtccaattaatttgaaatgaagcgaagaagtgagagagataaaggggaaaaagagagagtgaagagagaaagagtgtaagagagagaaatggagaggaaagagtatgagagagcgaggcagagagaggagaaagtgaatgaaagaaaaatggggaagagaaagagtggctgaaaagaatagtgctgctgaagagagtgagagagagagggagataaaaagagaaagcgcatggaataaaaacagacagagtgcggatgagagagcatggggatcggagagagttaataagcgacgaaaagcatccttgagggctcgacgcaaatccacgcaagtgtcatgccgacttctagtggaccaatacaattcggactgcattcgccacaaccttcaactccaaccattccattgtcagaagaaagcagcttgcagcttattccacgctgggaacaagacatcgtctgtcctccacgcttcccaatctcgttttggaatgtgtacaccagagctcaaatggcaattgagcgaacgaacaacggcatggaagccgcgcatggacaatttgcagtaaaaatttgtccgttggaaaacacttattttttgttaatttagcgtgaactcaatcatcatcccgtcactgagtgatttcatagcagcattcttcaggacatcgacaaacactggacttcggacgcgcaaaacagttccagaaaagtagaaaccaccgcaacgtacattatcaagaacaaaatg

SEQ ID NO: 22866 - DNA, 1277 bp, Heterodera glycines
cgttaatgaccccctaatgatttttcgcttctttaaaattgaagccgatagacaaaaagccctaaaaatgtttagtggcgctccatgggtaatgttgatgaatcaaccgcaggcactgctgaaacgcaacaccaacagcatcataatcagcatgccaatttgaacgtcagcagttttggcgggttgaaaagtcggttggcattcagtttgttcgggttgggcaaaagtgccgagacggagagagacaaatcgttgacaatgacgacggcacaaaagcaacaacagaagcagcagcaccggcgaagctcgtcagctgccactgtgccgccaaatgtctgcttaatatccaatcattcatcagcaacgacgtcaccgtaccatccaatcggtggtggcagcaacggcagagtgccctgcggtgcgacagcgaaacgaaaagccgaagcgacggcacatgccaacggaacgcaagcgggcatgggcatcacaaccaagcgcatatcgaacacagctcaggtgatgcaagaagaaggtctatgctttgctagctgttcatgctttacggtctgcagaaaaatgggggatttatgatggcaaaagcggggggatttttcttcaaaagtcccccccccctccccaaaatccgtttaaatatatacatatatatatatatatatatatatatatatattatatatatatatattatatatatatatatatataagcatattaccgttttcttacctgatgcagcaactgatcatgtcctgcttggacaagtcccgtggcgatctgagcgggcgcgtcctttcccgtgccattcacaagcgtgccgacttcagcacattttgtgccaatctttccgccgctgaacaatggataatcttttccgaacagttccacacatacattatggatgtgctcggatcactgcaaaatgttgagcaggtaaaagcgtcgagggcataagaaaagatcggaatttgttaaagtcgaaagggaacaaaaatggtcaaaaaatgttcatagtgtcaatcatatcaaaacctattcggaagagacaatcaatcggaatccaagtgaattttggaataaataattcgagtgcccttggccaataagtctagagatagccatagaagaatgccgaaggctgttgtataaatttggttggcttatcctaattggtcgctctagaaaagtatggaatttcaatcaaaattaagcgcaatttcctttacttagtcttaatggtatcccctaaaaattgtaaa

SEQ ID NO: 22867 - DNA, 1664 bp, Heterodera glycines
cctagacatgtctttatgtatgatttaaaaacttttttttatggtctgtaacgacataagtacccaaatttgggctgtttaaattgagcaaaataaattggcctaccaccgccgccttctgaacatggcacgtattgaacaggataaactctggagcattctcattgaatggtgccactaaaattgaggtcggcgggggcttgtcctcctcttcttcccctaaaaattcaattaaaaaaacaattttattttgtcggagtgcctggccgtccaaatcggttgtatgaaactgcggtttgatcacgatgacggatcagccaactgcgcattttttgaatcattaagacccttccaccactttcagacccctcccgacagccgttcgactcaaattagtttttaagacgagttgcaacttttctctatatatgtataaactagcgggtgtgtgcatgcgagggtggcgcttgggaaagcgctgcgcgcttcttgagcttcgctacctaggcgcgttttagtctgttagggtctttgcgtcagccgacatgcacttggtttcctccaataattggagttgacacatcgcataatgcaatggaaaccggaagtgccctaacgttgcacgtcatggccctcctccctcccttagtccaggcgttggcacgttattgggttgagcgctaaatggcaattcacctgtaggccctaaagagggctgaccggtccatgtcccggatccaagcttctcaccattttcgcacccaacatagtgcagatgggaatgggattggcatctctccaaaaaccatgtgcccaactgctctggactaagccatttattgtaacttgagcatattagtagctacaatattcagcactttggctcggccttgggcatcaatttcccggttgggagcatgaacacggacattgtttccgtctgtcgcccgagagaaggccgtatacaattgaccgtgggaaaatacttccctttccagatcaatgccgacagtgcggattgtttggccctgaccctttttgaatggtcatagcgaatgcaggctttcattgggaactgccaaagctcgtattttatgccgccaggcgatttgtcttcatagacatttcgtgttcttccaagaaagaatctcacttggccgccaatagcattgctattgataacacgaccaatgaggcgatcatcgccaagttcttccagaactatgcgtgtgccattgatcagtccttccttatcacttttattgataagaaggacgacgacgcatccgactttaagccggagactgtgcgggggcatgcccgagtctgtgcgccggttcaacgcagccacttcggactcgatctcatcgatgtccagtgggcggtcgtcaaggggcttatccgtggacaagtattcccgcacttgacctggcacattcgccatcatgatctcgttgacttcatcacacgtgtcaatgtgcggagcgagaatcaaacgattgagcagctctttgtcattgccaaggagttgttggaagttaggatagacataatctatcagctcttccttgctcttaacgaggaactgcggaggaatccagaagtgctctccggtttctccgggagagatttggcggcacatttgcaagtacgcttgctgacct

SEQ ID NO: 22868 - DNA, 1593 bp, Heterodera glycines
ttatggctctgacagtgccgacaaaaaggtcggcgaaggctcttacattcaaaattggggcattaatctgtaaaaattgtcaatttcccaacccaaaatgtctcctaataaaacttcagacagaaaaacctgttttttgatgtcctttgggtgtttttgtggtggtgccggtgcttgtccaactccatcaccatcgttctcctgctgctgtttctcctcttcactattcactcctttttttgatgccttttgctgctccggaaagtgcgctttgtcgtcccattcgttgtcctcggatttctgcatgccatcctcgtggggcgctttcatctgctgaacggcgagaaaatgatgaaaatttgcttttttatcacaaaattttccgtttcacaatttaaaaaaatctaatccgaggttcgaattaggcaaaagaatgtaggaaaattgttcagtaagcatgaaaaaaatgcataaaagttagcaaaattggaaaattggtgaattttagaattttttttttacttattttacgctaacttttccattccgatcatccgccgatgaacgaaccatgaaaattgtgccagtgataattgtggcgatgaatgcaccgcaaacgcaaatttttaggaaatggacgatcttcatttgtgattgtgctttggaaaataagggttaaaaattttgttcaaaaaaataagtaaaaatgttcatgttgcacaagggactcgaacctccgccctctttccctttactattttacaaaaaccacttcgccacacattcatttcctttttgaacttggagcctaaaattgactcggtgtgttaatgaacgcatttttggcacctgattagagaaaggcaaatcaacatttttctcttagcgaacattgttttaataaatatcaacattgacgttgatatttaattaatagggcagcaacttttagtgaaaaaaactttttttttgctcaattgttttgaagaaaggagctcaaaaaacgcatttctgcattaaaattttttcatttggacgtcacttttcgtcactagaaatcactattttggggttttgtcactaaaatagttaaaaatcactattttggcgttttgtcactattttttcactatttcgacattttttggaaaattccttaacaaaaatgtaataaaaccaaaaaatacacccctaagaatcgacctaaaaaaatttcaaaaaaatacacccctaagaatcgacctaaaaaaatttcaaaaaaatacacccctaagaataaagcttcaaaatatactcctatgaaatgaaaaaaaaaatttctcaaaaatttacattcttggcaaaaatttttattttaaaaatttttttaggtaactattttgggttttttggtcttaaaaatcccagtcccactcatttgcaactgcaaatagtgaataaaaattagttttgctcaatttttggctgaaaattatgtcactattcgtcactatttcagactttttgtcactatttcttcactattttggcatttttactcactattttagttaactattttgggatttttcgtcactaaaagttgctgcccta

SEQ ID NO: 22869 - DNA, 1078 bp, Heterodera glycines
cctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaaggatagccatttt

SEQ ID NO: 22870 - DNA, 2167 bp, Heterodera glycines
actatgtgtccaataaatgaccatattcattttattagaggacttttttcttgctaaatgccaacattcttggtatcaaataaaagatttaattcccggtggtttataaatgtaaggagagagagcaaatactggcattaagaaaaaagtataatgaaaacaaactgctataattattttaattttaagaataattttggtttgttgtttttacattggttggacgcctaaagtgcaatagagccgtgaattgagtgttttatgatttgttctattaaaggcccaaccgatcacactgacgaaaatgcccaacgtcctgaacttctcgacgagaatggccatcgttacgtcggcctcttcaaccaagcgatgacttgctatctcaattcgctgattcaaacattgtacatgacccctgagtttagaaataaagtttacaggttgtgcttaattcctggtaaaatacggacttgagaatttcagttggaaattcgtcgacacgccgacggatgaggacaataaaaacattccttaccaattgcaaagactgttcttgttgctgcagaccagtgagaaagcgtcgctggagaccaaggagttgaccaccagttttggatgggtgtcaaacgaagcgtttgaacagcacgacgtacaggaactgtgccggattatgttcgatgcattggagcaacgatggcgcaaaacggagaacgacgaatcggctttccataagctttacaagtgggtgggttcggcagaatgccgaaaattgctgtgaattttcagaggcactgtggaagactatgttaaatgtttgcgttgcaaaagagaaaatgtgcgaaaggacgactttttggatttgtctttggccgtcagaccgttcggcgccagcgaatcgtttaaatccatcgtaaaaaatttgatttgcaattgggagaaaaataatgaaacttcgaaaggaggaggctttgagtgcgtttattaaacccgaaatactcaacggaaacaaccaataccaatgcgaagtgtgcgcatcaccgcaagacgctgagaaggtgaattatcaatgaaaaaatagaaaaactgccaaaaaaacttaataaaaaagccacataattttggattggttctcgacataaaattgcatcttttgcatttcttttgtactccttcattttcagggcttgcgcatcgtcgaatttccgtatttgttgaccattcaattgaaacggttcgactttgactatgcggctttgcaccgcatcaaattgaatgacagagtgacatttcccgattatttggacgtcaacgactttgtttattcgccttcggcgtcggcccaaccgaagccgagttacgcagaaatggccaaaaagtttttcggtctacgaatttttagaaattgacatggttttgttcagactaccagagcaggacacagcagttcagccatcgacgaatggacagtgcacttccgccacagaggacgaagtcgcggcggactgtccgaatggggaagggccaagcggtgaacattttgttgtgggacattaggcctaatttctgcggcaatttcttaccaccgatggcattttccatttaggtcaaaggcttgtggaagagaaaactcgtgctgaacacattgctcaattattgaagcgtggcaaatacatttacgagttgttttccatcatggtacaccagggaagtgcgtcggcagggcattattttgcttatataaggtaaagaaagacccatttgtcaaactgattgtctaaatgctttgccttagaaatttggaccagaataagtggttttgtttcaacgattcgtccgtccatgtcgcttcgcttgacgacatttttcgaacatttggtggccatgccaacggatggatgaacaatatgaacggttctaaatgctatttgtttcgtgatttgttctcatcggtcccttaaaagcgtatatgttgatgtaccgacaaattgatcacagccaaaacgaacatttcgtcaggagcaccgaacttcctgagcatttgattctgctcaaggacaaattggaggcggaggaggaagaacgaagtcgacaacgacagattgacgagcagaattccgcgcaggtgagaagaattttaagcattttcatgaaaggagttaagcaggag

SEQ ID NO: 22871 - DNA, 1120 bp, Heterodera glycines
ttaagctgaaacttgaacgaattgacggaggggcaccaccattagtggatcctcgtggctttatttgactcctacggctcggacaccataaggcttgacagattgttttgctcgatcgtgggcattaaagagttgacgacccagcttttgtgggcacaacttcttggtggatgtttggtggtgcattgactggcttcgagtcaaagataataagcaataacaggtctgtgatggatgtctgggaatgtacagcacattgcaatattgtgcgtagccgcgaggacactcctagtaaagatgcgttatcaaaccatcttgaatacgtccctgccctttttacacaccgcccgtcgctgctcagaactgagctatttcgtgattttcgtggacggttagtgttccagctgcagttgcgacgcagactggaaacgatttgatcgcaatggcttgatctgggcaaaaagtcgtggatttgattacacagttgattggcggtaagggttcgccgcatgtgaatgtgaattggatagacaggtctgtttagaaagtgccgcgagcaatgttcttccgttggatttggtatgccgcccagtgctgcacaagtgaaagccaactgctaggctgcttgtgtggtaatgggatggtggcggatcgccttgctttggtgggtttgctgtccggcggaggagacatgttcgtggtgcgaaagaaaagtgcgtccattcgctcgtacgtgagtacctgactgcgcagcaggcgaaagcgtatgagtgttatggatggactcaatgttgaactagcgaggcaccaccacatgcccgtctgctgcttgcggacgccaggcccgttcgatggggtctgtggcgctggtgatgatacattgttacatactgttcacagtatgttccgtgaccctcaagtgccgcgagcaatgtgctcttcttcagttggatttggtatgccgcccagtgctgcactagtgaaagccaactgctaggctgcttgtgtggtaatgggatgggtggcggatcgccttgctttgctgggtttctgtccggcggaggagacccgttcgtggtgcgaaagaaaagtgcgtccattcgctcgtatgtgagtaccc

SEQ ID NO: 22872 - DNA, 1135 bp, Heterodera glycines
  misc_feature (1072)..(1072): n is a, c, g, or t
aaaaaataggcccaccccagggctagggagtttttttggatattcagaaaaaacaggtccaggccagggctaggagttttatttggattttcagaaaaaataggcccagccagggctaggagttttcttcgattttcagaaaaaacaggtccagccagggctaggagttttattggattttcagaaaaaataggcccagccagggctaggagttttcttgggttttcagaaaaaacagtcaagccagggctaggagttttattggattttcagaaaaaaaaataggtccagccagggctaggagttttcttggatattcagaaaaaacaggtccagccagggctaggagttttattggattttcagaaaaaataggcccagccagggctaggagttttcttcgattttcagaaaaaacaggtccagccagggctaggagttttcttggattttcagaaaaaacagtccagccagggctaggagttttcttgggttttcagaaaaaacagtcaagccagggctaggagttttattggattttcagaaaaaaaaataggtccagccagggctaggagttttcttggatattcagaaaaaacaggtccagccagggctaggagttttattggattttcagaaaaaataggcccagccagggctaggagttttcttcgattttcagaaaaaacaggtccagccagggctaggagttttcttggattttcagaaaaaacagtccagccagggctaggagttttcttgggttttcagaaaaaacaggtccagccagggctaggagttttattggattttcagaaaaaaaaataggtccagccagggctaggagttttattggattttcagaaaaaaataggtccagccagggctaggagttttattggattttcaggggaaaaaataggtccagccatgggtaggcatgaatttctgatccaaacttttttgaaaaacttttattttcgtgttttgcacttgcaaaagtaaagcactggtcaaaggcagggctaggagttttcttggatattcagaaaaaacaggctgcttccgtatnccaacgttggaaaaaaagcttaggaggaaagacacaaaattcaattgcaaatgggtccaaact

SEQ ID NO: 22873 - DNA, 1389 bp, Heterodera glycines
ttttaatttaaaatttctaaggacagaatggcaaatattcctcaaatcatttttaaaatttcttatttaaaaacattttcccttgcaaatctcacccataatttatgaaattttccggcggcgtctatcggaaccgccggcacgcaaaagtgtttatacctttaaaaaattgaacaaaatagcgaaatttggttatttttgcgcaaaatctgctaggaaatcgtggcaaaattttcgaaaattttcccggcggcacctatcggcacagccggctccttcccctaatttaaatttttttcgaacaaagcccacagtgaacgttgtacgaaagttttaaaaaatctgatttacgaattgaccccattgacaattgaccgtcgtacacctctccgacacctggaactactcaaaaaatcttggtaacaaaaattcatcgttttaacaagtcttaaacctaaaaataataataaaactcattaattttttttaattcgctcgaataaagtaatttaggcaaaatatttgaacaaaccttaacaaattttcaaaaagtgccttaacccaaaactcctatttttcttcaaaaatttgttcaaaattccaaaatattttttgacaaaatatgtacaaaatgaactgaaaattttttaaaaatctttcccggcggcgcctaccggtgcagcgggtcctattaggctccaaaaatttttaaaaaaattataccgaaaaagacggtgtgaaacaaaaaaaaaagttcaccgccataaaaataaattctaccatttgtatttttcttttatgggggctttcaattttcgtcttcttaacaacattcagaaatgttttttcataacgtaatgtgtcactaataaatagggttcggaattacatgcacataaaatcgtaaaatatgcgcataaaatatgcaccaaaaaacgcgaaatatgcacataaaattttccaattgagggtgtaatttctcaaaatttcttcaaatttgttaaacataaagtaaaatcttcaaaaattggctaaatgtggtattaaaaatcattttaggagaaaaaaacacgatacagcttaaaatttactcattttagcgaaaaatcaacctgaaaagcaaaattttgcttatttttgacctaaattaaccattttttgagaaaatttatttattcaatatttttcgtgaaaattttgctaaaaaattattttttttggaaaattttccggtttttgaggtaaaaaaggccaatttgtctgttgggggccgttctattagaggttttttggaaaaatgccaaaatatgcacaaatatgcacataaatcgcgaaatatgcacaaatatgcaaaatacgcatatggaaagtcatcctagaagcttcaaa

SEQ ID NO: 22874 - DNA, 1234 bp, Heterodera glycines
gttggctcctccgtcctcattcattatgcttaaattggcagttcacattttttcagctgccgctgaaatagccgcaaaaagccccgattttttgctggccaaatccccaattttagttttacaaatattttgatataaaaaacgctataggagggggggggggggggggggggagaggagggcgtcaccttgctgccaaatttcgatttcaatctcatttatttcactttacatttgatatatatgtatgtatttatgtacataattttctattttctctctatcatttgctctctttctctctcttttccttttcgtcctcctcttccaatttcttcttctccgcatggacagtaatttataatccattaattactgtacagtaaaatcaatttttcttgtttgatttttgattccttcgctttcttttcaccctccacatttttttattgtcctttcgcaagaatttaatttgtccaccctcatgcggtgttccctccccctttttaatctccgcccactcccacacggatacaatcatcataaccaagaacaaattgccgcaaatcctttcattataaattaattgtaacacagaaataattgataaacactttttgattgatcaaactttgtcagctttatttttggttctgattttttgaacagataatgacggttttaattgatagaactaaaggagagggtcccaaaagggacccccccccccgaggggtttttttgtcgtcacgcgactctttccgtacgtcgcccatcgggcgctttgtctgactaatgtgaatgaatgtttctttttgagaatgtttgaccccacctgactgatagaagaaacgacgaacacttctgccgactaaactttgctcttcgatttttggcttttctccaaatgattatttttggtctttttttgattacatttttttcaatctaatggattgtcccaataaattcggataaatgccattgcaagtgatcaaatgatgaatcactctcatatcatctcccctagcgttacttctccgatcagtcactgattggtttgctttgtttttcattggcttttatctctccgattttcttcccctccccaatttataatatacatatttcatttccgttgctgctgctatgcactcattttctgtcctctccttcactctactgctgataatacaattgtttatttggggaagctaaatattcctcttggaga

SEQ ID NO: 22875 - DNA, 1178 bp, Heterodera glycines
  misc_feature (64)..(64): n is a, c, g, or t
  misc_feature (72)..(72): n is a, c, g, or t
  misc_feature (107)..(107): n is a, c, g, or t
ggacgtagcagcaagcacaaacacacccgttagttacggcacgtaagaccgggaacgaaacccnccatcccncagtcaggtgttatgtgcctgccacaacaaccgcntcaacgacgcacagacgccagcacagccgttaggtcgccccacgagcgtgcatcccacattggcgcagcgaaccagccaagcgaggcggcccgccaccgacacattgccacgcagcagccatacacaggctttcacacgtgcagcactgagcggtataccacagctccaacgtatggaagcaccccaaaagcatggctcgtgaggcagctgccccgtaatgttgggcagcgtccacaagtcatctcgaacgacctgtgcccatcagcggacgggggcatttggtggtgccaacgctagcccaacaggacagcaggtaggtggtgaataggaatcacttgggtaatgatccagcagcaggttcacctacagctaccttgttacgacttttgcccggttcaagccactgcgattaaatcggttccagtctgcataccgaccgaagccggaacactaaccgtccccgaatttctcgaaatggctcagtcccgggcagcgacgggcggtgtgtacaaagggcagggacgtattcagagcgagttgatgactcgcccctacaaggaattcctcgttcacggacaataattgcaatgtccgatcccaatcacggcaaattttcaccggtttaccaacccctttcggggaaggacaagcacgctgattttgccagtgtagcgcgcgtgcagccccggacatctaagggcatcacagacctgttattgctcaatttcgtgcggctgaacaccgaaaatccctctaagaagttgtgcccacagaagcaatgagccaactatttagtaggctagagtctcgctcgttatcggaataaaccagacaaatcgctccacgaactaagaacggccatgcaccaccatccaccgaatcatgaaaaagctatcaatctgtcaatccttacggtgtccgggccgggtgagtttccccgtgttgagtcaaattaagccgcaggctccactcctggtggtgcccttccgtcaattcctttaagtttcagctttgcaaccatacttcccccggaaccggaagactttcgtttccgggaagctccccaccag

SEQ ID NO: 22876 - DNA, 1830 bp, Heterodera glycines
  misc_feature (41)..(42): n is a, c, g, or t
  misc_feature (44)..(44): n is a, c, g, or t
  misc_feature (59)..(59): n is a, c, g, or t
  misc_feature (61)..(62): n is a, c, g, or t
  misc_feature (64)..(66): n is a, c, g, or t
  misc_feature (69)..(69): n is a, c, g, or t
  misc_feature (81)..(81): n is a, c, g, or t
agtccacagagaaataatcagtgtgctgccttctaggaatnngntggtgagtgagtgananngnnnaanactttacagagntgtgccaaaaatatcattagacattgtgccaaaaaacagatgaattatgcccctgatattttacgttaatttaatcactgtccttttcgttaagcgcggattttacatccatggtcgttctgtgcatggctttgccgacactgacatgctccagatgaaaaatcccttggcatggcattagaaggaaaatcccctggaatggcattggaatgaaaatccattcgcatgcattggaatagaaatcccttttcttcttttgccaggacaatttgtgtgccatgcgcggcttggagtcgaggcaaaaaaaaatgaaaaaaaaatttaaaaaattatttcgtgctgtcttacttctttgatcactgatcagagcccgtaagggtatttactcggcgtgcgaatgccgttttgtttgttgttccaggcaattgttatttcggctttgtttggtttggccattgtcccctttttccagggactgctccgagtgcgagtacagctccgcctttctctacggcaacgaatgggcactgctctccgccgagttggcactgttctgtttggtggatttgttctggcgccacagactgctcgccgccttcgtcacttttttactgtccgcctccgttcgccacacggtcaagctgtacttcacccaccaattggttaagagcagcatggtggacagccgatttctgatctgatcagaccacttctgatcagaacggttgctgatctgtcctcctctttaaattccccgtcaatgcggtgttaatataattgatcaattatcacctcataattgtcattgatcagttcaaactgttcctttgttgtgaccaacatggtgtccaaatgggagaagccgacgagcctaagcgggaaaaaattacgacggattaacaaaatgccaccgtatttttgaggtttttggccataactttttttgtaaaccgacgaaattttttgaaattttgcaagctaatagagaatcttaagagctattaaatgatacaaaaattttttaatttttgttgctaatgagaaaagttattaacaacggcggcgaaagggtcggcggcgaaccgggcggttcccatcagacaccgccggaccggaaacaaaaaatctaagggggaagagaaaaagagaagggagaagagaagaagagaagggggaagagaagggggaagagaagaagagaagggggaagagaagaagagaagggagaagagaagaagagaagggggaagagaagggggaagagaagaagagaagggggaagagaagaagagaagggagaagagaagaagagaagggggaagagaagggggaagagaagaagagaagggagaagagaagggggaagagaagaagagaagggagaagagaagaagagaagggggaagagaagaagagaagggagaagagaagaagagaagggggaagagaagggggaagagaagaagagaagggggaagagaagaagagaagggagaagagaagaagagaagggggaagagaagggggaagagaagaagagaagggagaagagaagggggaagggtgttgtctgtgtctgttcctggaattctctctcatccttcaacagtaataaaagaacacaaagatgtaattaaggttttgcttcttgtttttcatgatcgcgtaaattcttccctttttttaccaatttattcagaagttgtttctccctgtgcacccattcacttgaataataacaaaaattta

SEQ ID NO: 22877 - DNA, 1723 bp, Heterodera glycines
  misc_feature (1690)..(1690): n is a, c, g, or t
cgtttgtggacatgtatgccggtcttgggttggatgactttgacacaaaaacggtgtccattggactccaacgtttcctaaactggatgggctttcttcgtcatcccaatgacctcaacgctggatgatacggacgggtttgagctgatccgacagggcacgtgcacgcttaaagtccaatttgagaagcctataaaagatgacggttacgaaatgttgatcctcggcgagtttgattccgtcctttccattaacgctgaccgtgtgttgagcacagacggaagtgtttaaacaaagagagatagagagagagagagagagagagaaaatgaattctgcacaaattgacacgttgctgagaagattgcgtgcaacaagaggtaagttcatcggtgtctacccgtcaaacaaagtgccgctgattcacgacagacagagacgactgcagcgctatccgcactgcatggttgtcaacacggaccgggaaggcacacggggagaacactgggtggctttttatgtgcctagtgcaactcaaattgagtactttgacagcctaggtgtggcaccaaaccctgatctgtctgcctatctcaacaattttcgccatgttcaagtgaacacgcagcaaattcagttcccctcatcggacgcttgcggccacttttgtgtctatttcttggccagccgttgttccggtgtcccgttttgtgtggtggttgagacgttacgcaaaacgcgcgggatggcggactggttggtcaaatggtatgtacgcatgttagtccatcatgtataaaagggtgactaaaagagagggatgccacacaaatgcccgctcgctataaggcggataggcactagaaaaaatggcgttattttccatgctactaatgctgctgctactcctgctccatctgtccggcggagaatggatcaacgtagagctgagcgttgacccacccaatttctttgaccgcacctttcgctccctttccaagacatcacccatccaacattggttcggctacaaccggaacaccgcgtgtcacgttgagcgggaaacaaacataaatcgactgtacaacagtgctgatatgtggaacattgccctcactgatgtggacaacttcatgagcatggggcggcaaactatcgagttgttgtccagcgcattgccgtgggcgtgttttggacatgaccgccacagttttgtgatttttgaccttcgaaatgacgcaaatgaagtggcagttgtgcgcggtcatcagcacaagatagcacgaaatttgagtgcgtatggacgcattttgttcgaccatatttccggccggttgtacatggtggacaagcacgagcgccggatccatgagctgctcatcaccgattttgtgcgatggtggactctgaataacactgacggaggtggtggtggtggtggtcataacggcggcggtgagaacagcacggcaacacactcgttgaggagcaactttgtcgggtttttaccagaacaaaaaacggattttttcattgcggccgaccatgtgtacctgatttggcgtagacgtgtatacaagttccgtgttgggcactacttcaatgatccttcctcgcagctacagtttttgaccaactccagtgacattcgcttcaacttcctcatattcgagagagatgatgacgccanaattggaagacagcactgatcgtagaaacagca

SEQ ID NO: 22878 - DNA, 1186 bp, Heterodera glycines
tctttacaaaataataccctctgagagaagagagtgggacacatgattttcgaaattttcaatttttttgtattctaatctactcaaaccggtttcagaattcaataaaaataacattcacggtgcgaaaaatggggtatgaaaaattattggggaaaaaaagtttttacaaaataatacccctgggagaagggagtgggaaacatgatttcgaaattttcaattttttgtagtctaatctactcaaaccggttcagaattcaataaaaataacattcacggtgcgaaaaatggggtatgaaaagtttattggggaaaaaaagactttttaaaataatacccctgggagaagggagtgggaaacatgatttcgaaattttcaattttttgtactctaatctactcaaaccggttcagaattcaataaaaataacattcacggtgcgaaaaatggggtatgaaaagtttattggggaaaaaaagactttttacaaaataatacccctgggagaagggagtgggaaacatgatttcgaaattttcaattttttgtagtctaatctactcaaaccggttcagaattcaataaaaataacattcacggtgcgaaaaatggggtatgaaaagtttattggggaaaaaaagactttacaaaataatacccctgggagaagggagtgggaaacatgatttcgaaattttcaattttttgtagtctaatctactcaaaccggttcagaattcaataaaaataacattcacggtgcgaaaaatggggtatgaaaagtttattggggaaaaaaagacttttacaaaataatacccctgggagaagggagtgggaaacatgatttcgaaattttaaattttttgtagtctaatctactcaaaccggttcagaattcaataaaaataacattcacggtgcgaaaaatggggtatgaaaagtttattggggaaaaaagactttacaaaataatacccctgggagaagggagtgagaaacatgattttcaaattttcaatttttttttagtctaatctactcaaaccgggtcagaattcaataaaaataacattcacggtgcgaaaaaaagggggttgaaaagtttattttgaaaaaaaaactttacaaaaaaattacccctgggaagaagggaggggaaaacatgatttccaaaatttt

SEQ ID NO: 22879 - DNA, 1454 bp, Heterodera glycines
tgggttgagtgccagtgattgaaatgttggtgggtccctctcagtgattgaaatgttggtgggttgagtgccagtgactgaaatgctgttgggttgagtgccagtgattgaaatgctgttgggttgagtgccagtgattgaaatgttggtgggttgagtgccagtgattgaaatgttggtgggttgagtgccagtgattgaaatgctgtgggttgagtgccagtgattgaaatgttggtgggttgagtgccagtgattgaaatgctgttgggttgagtgccagtgattgaaatgttggtgggttgagtgccagtgattgaaatgctggtgggttgagtgccagtgattgaaatgttggtgggttgagtgccagtgattgaaatgctgttgggttgagtcccagtgattgaaatgttggtggattgagtagagattggaatgttttgatcattgaaagttggtgggttgagtgccagtgtttggaatgccggagatttgagtcccattgtttggaatgccggagatttgagtcccagtgattgaaatgttggtgggttgagtgccagtgattgaaatgcaggagaattgagtcccagagattgaaatgctggtgggttgagtcccagcgattggaaagcctgagaattgagtctcagagattgaaatgctggtgggttgagtcccagagattggaatgtcattgaaagttggtgggttgagtcccagtgtttggaatgccggagattttgagtctcagagattgaaatactgatgggttgagtcccacgattggaaagcctgagaattgagtctcagagattggaatgctggtggcttgattttcagtgattgaaatgttggtgggttgagtgccagtgattgaaatgctggtgggttgagtcccagagattggagaaaaagccaagaaaatgatgcgaggccgcgaagcggccgagccagtcgattttatcattcataattctataacacaatcgtactgcctagcgggggatgcgccgaaggcgctgaccccgctagtgtaaggatattttcgactaaacataaccaattccgagtttcatgaggcatcaacttcattcttttcttgtcctgcccaattgtctcaaatgtatacctaaaaatgcgctaaaaatgatcaaacccgtttttagccgaatatcctgtcaatatttccctattagaaacgatactgtgaattctttcgcctctttaatattcattcgtgctttgcttcggattagtctaaaaatttctggacgccaattttacatattagccaatttttattttatttgtgaccgccaatttttacatactagccattttttattttattgtgaccaagcatatctttcctcgtatttctgggatttttttcgaatgtggtcatagaataggtgggttgaattatttgtattttttatgagtatcat

SEQ ID NO: 22880 - DNA, 1355 bp, Heterodera glycines
  misc_feature (1282)..(1282): n is a, c, g, or t
gtttttatcaggggctcccaaatttttttttttcaaaaattaagacaaaatgggctttaaaaaactaagattcgggaccacaaaaaataagatttttttctaaaactaataatagcgcaaaggaaacgcaataaaaacacgaaaaatcgacttaaaaaatatttttttagcgtaaaaagccagggctttaaactgaaaattttcaaaaatcagcattcgtccgacaaaaaatcatcatttgaggtcaaaaatcaacattttccagagggcggacacctcaattaaataaatgtttttctctcattgattttattatttttaaaaaatgaacgaatatttgtaagaaaaaattcagccaattataaaaaacaataaatgaaaaacatttaatttttttaataagagggaaatctttattttatttctccttatttcaactaatctttattataaaaatgtatcatttcttaatattttggaattcttcatagaaatatgcttgtctaaaacgaacttttttttttggacattttctagcttttcaaaaaaaaaatttaatgagggttcaaaaaaggcgatgcaaattctaaataggcctgcaatatacattaaacagtctgcttaagataattggattatgtgaaaggtattatgaaaatgatcaatatatgtatattgaatgaaatctttttatttaattttttggcaaaataaatatttcgaaaaataaggtaaagaaatgtcaaaattcattagtgaaaaagatcatcattagggagtccaaaaatatggatataaaatcgcgaaatatggccataaaatatggaccaaaaatcgcaaaatatggacataaatggcaaaaatgtcaaaatatggacataaatttttcaaaattgagtgcaaaatttcttcaaatttattggttgaaattgcatatgagatacatttccaaattttttgactcggtaaggcgctttgacaaagacggctttcgttttgcaattagtcggtcaacattcggaaattggtctcgaattttttcggcaattacgtgcaatcattttaaaagaaaaaaaacataaaagctaaaatttattaatttttttagcgcaaaatcaacaacaaaagcgaaattttcgcttttttgcttatttttgacataaatttattaatttttaagaaaatttaaatttattcaatattctcgagaaattttggcgaaaaaatgattttttgaaaatttttcgggttttgggctcaaaaaggctaatttagctgctgngggccgttctaatagaggtttttttgaaaaatgccaaaatatggacataaaatatgggaccaaaatggccaaa

SEQ ID NO: 22881 - DNA, 1794 bp, Heterodera glycines
  misc_feature (4)..(4): n is a, c, g, or t
tttntgtgcataaagatactggattttttcaattttaccttctatttttgcacttattttagcattttggcgtttttagcatctattttgcacttttttggtacctaatttagtacctatttcaggatttttagcacctaaaaatccggtctttacttataactgaattaagataattaataattatatatactataaaagaaagatttaaaaaatcaatagatatccaacataatattgagtgaaaagataaaaaaattaactatatatgcataactggtacttttgcagtttacaggctacttttaacatacattttcagatgcttataaattactcaatttatatgtttgtttaagcatggaaatctaaaagactaatattcataaattatttactctctccaaaaatctgacgctgaatttgaagaatggcttcgaaaatttaaaaaatattattgaaactcattttgcgtcatacatgtgaaatttgaaaatctgtatggatggtaccctcatggacatctctgcccatgatggtactcttggtacaggaagctgtcaattcgttgtccaatatacaactccaggggtgcacaatagcgctgatcagagcccgggttcgttatcagcaccattaaaaaccctttgaaacttatttccaccaattattaacacaattttttttgtgaaaaatgtacgttaaaagtagcctgtaaactgcaaaagtctgcaaactaaaagataaatttccaaacgctttttttatgcttgattactttaagcatatttaaaatagtgaagaaaaaatttgtgttgggtcaaggcatctcatccatgggctatgaattagactatgaattataacaaagaggaataaactgaaacattacaaaataattttgtatttttaaaaacaatagtattgagacaatttaaggactagactttcatttaaacatgtgcttatccatatactttttattcatattctttatcaaatatataaacattaataaatttttataaaaatattatgaaataagaattgaaacttaaaccaaataatttatacatttaaaatatctgtgaaaattaaaaaataaaacaattaaactggtctcaattattatattacattaaaaatgttctaactataaattttgtcaatgaagaaaaaacaaattattaacaacaaataaatattattttaatctattctaaagatgaaggaactagcgggtgtgtgcatgcgagggtggcgcttgggaaagcgctgcgcgcttcttgagcttcgctacctaggcgcgtttagtctgttagggtctttgcgtcagccgacatgcacttggtttcctccaataattggagttgacacatcgcataatgcaatggaaaccggaagtgccctaacgttgcacgtcatggccctcctccctcccttagtccaggcgttggcacgttattgggttgagcgctaaatggcaattcacctgtaggccctaaagagggctgaccggtccatgtcccggatccaagcttctcaccattttcgcacccaacatagtgcagatgggaatgggattggcatctctccaaaaaccatgtgcccaactgctctggactaagccatttattgtaacttgagcatattagtagctacaatattcagcactttggctcggccttgggcatcaatttcccggttgggagcatgaacacggacattgtttccgtctgttgcccgagagaaggccgtatacaattgaccgtgggaaaatacttccctttccag

SEQ ID NO: 22882 - DNA, 1676 bp, Heterodera glycines
  misc_feature (1653)..(1653): n is a, c, g, or t
agggcgcaggcggcccatcatgaagtcaatggccaagggcgctggggcccatcgtgaagtcaaaggccaagggcgctggggcccattgtgaagtcaaaggccatgggcgctggggcccctcgtgaagtcaatggtcaagggcgcaagcggcccatcatgaagtcaatggccaagggcgctggggcccatcatgaagtcaatggccaatggcgctggggcccattgtgaagtcaatggccaagggcgctggggcccatcatgaagtcaatggtcaagggcgctggggcccctcgtgaagtcaatggtcaagggcgcaagcggcccatcatgaagtcaatggccaagggcgctggggcccatcgtgaagtcaaaggccaagggcgctggggcccattgtgaagtcaaaggccatgggcgctggggcccctcgtgaagtcaatggtcaagggcgcaagcggcccatcatgaagtcaatggccaagggcgctggggcccatcatgaagtcaaaggccaagggcgctggggcccattgtgaagtcaaaggccaagggcgctggggcccatcgtgaagtcaaaggccaagggcgctggggcccattgtgaagtcaaaggccatgggcgctggggcccatcgtgtagtcaaaggccatgggcgctggggcccatcatgaagtcaaaggccaagggcgctggggcccatcctgaagtcaatggccaagggcgctggggcccatcgtgaagtcaaaggccaaggggcagagtgcccagcagaagtcagaggccaagggcgattacgtgcacacgttggtcaagcgtgggaatgtcgcggctcgaatttagccgcgactgtccgatgatcggacagttgtcgaatggaaagaaatgcggggggagaaggaggaaaaaacaggagaacgggaaattgggcgaagaatgagaaaaaagggggaccgcaagaggggcttttgcatgtgaatggtaagaaagaagaagtgaaaaagcggaccagccccgccgcgcatgtgaatggtgcctaagggcagaaaaagccgatcgagcgatcaacgacgacgaagaagaagaacgaccaatcaacccaaatgatcaccccatcatttttattgtacccgcccattttctgatcctatataagcaacacaaattgtacatttcgatggcttgcgacaaataaagactaaaaacccgtccattttgggggtttcttgggtagtctgggcagcccctctccctctccctccgctttcacccacccccgaaccaatggacgcaaagcgtcccgaagcgatccgcttcatgtggcgctcctgggtggatagtggggtttgttagcaagggaaggggggagtaagtaggccccacgggtttttcgtaacccgtggcgccttgcatttgcgcattgtattttgttttgtatttttgcgccgtagtgccccccccccccgggttttttgtaacccggggcgctttccatttcgcgcgttggccccctgggttgtctgtaacccagggtgcattccattgcgcgccatacggccccttgggtcttttgtgacccgaggcgcctcgccttccgcgcctcgccttcacgcctcttttactcgctcctcaaatatgtatgtgcatgcgcttangcagctagcctatctcgcactca

SEQ ID NO: 22883 - DNA, 825 bp, Heterodera glycines
aattaaaaaacgggcgcgaagcgcccctcttgaggccgcgaagcggccgaatgttccccacaaaattaactttcgggcgcgaagcgaccgtcctgaggccgcgaagcggccgaatgtcccccaaaaaaatttaaaaacgggcgcgaagcgcccgtcctgaggccgcgaagcggccgaatgtcccccaaaaaattaaaaaacgggtgcgaagcgcccgtcctgaggctgcgatgaattgctaaattacatcactttctagcgacgcggcgaagccgcgtcccatagcgcgatagcgctttaaaacttcacactaatgcaattaatgtttgtctgtttaaaataacaaatgagcatgtccattttctcttcatccaaaacccaacggcctacgccgccccagtcaattcccacacgctagtttatattactctacagaaaaagggggtttcgtcttcaaaaacaaaatctcccggccgaaggccgggagcgccctgaaagtagtggaagggtcttacaactttttgaggcgcatctgggaaaactataggttttttgctcccgtggccaactgagtcccggcggccgatttctcacttttgcttgcgtttgatggcccgtaactttttttctaaaactcgaatcaaaaaatgcccgctgcgagggcaccccgccaaagtgtcctctacatgctggtattttttatttttttaatagagccaccccctggcctgcagaaaatggcaactgaagcgtgctcaaaaagtacacttcagtaccaggcgaataccgcgtcggggttttgtctgaggaaaaggtgtccagcag

SEQ ID NO: 22884 - DNA, 1202 bp, Heterodera glycines
ttattattattattattattattattattattattattattattatgattattattatcattatcatcaacaacaccactactacgattattattattatgatgattattattatcatcatcactccgcggatgattattattattattattattataatgataattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattgtgttttcacccatttattgttatcaatcgtaacggctgctgcccattttgaacatttaaacaaggtctacaataataacaataacaataaataataaatcatttaaatgtttaattgcctactgtacctcatttgctgtgccctttaattgttaggctatataaaccttcgattagataacattttctcgccctaactatcatcaccatctgaccataccacaaataattggcgccagaaagaattagacgcatctgtctaactgtcactttgctaatgatccaccaaaacgaacaatattatgacgactaaaatcgaaagataagcattcatttttgacattcaatggcgatatatccttcttaaaataacactaatacatattctctcattccaattctataataaat

SEQ ID NO: 22885 - DNA, 1716 bp, Heterodera glycines
catttttggcgccggatcttataaagtatctttgcataatgcacaatgctaagtcctgatcaggccattggttcctgtataccaaaacaagacgttctgtggtgtagtaacattatttggtgctctcatttttggcgccggatcttataaagtatctttgcataatgcacaatgcttatgtcctgatcaggccaattgttccttgtattaccaaacgaagacgttctgtggtgtagtaacattatttggtgctctcattttttggcgccagatcttataaagtatctttgcataatgcacaatgcttaagtcctgatcaggccaattgttccttgtattaccaaacgaagacgttctgtggtgtagtaacattatttggtgctctcattttttggcgccggatcttataaagtatctttgcataatgcacaatgcttaagtcctgatcaggccaattgttccttgtattaccaaaacaagacgttctgtggtgtagtaacattatttggtgatctcattttttggcgccggatcttataaagtatctttgcataatgcacaatgcttatgtcctgatcaggccaattgttccttgtattaccaaacgacgacgttctgtggtgtagtaacattatttggtgctctcattttttggcgccggatcttataaagtatctttgcataatgcacaatggttatgtcctgatcaggccaattgttccttgtattaccaaaacaagacgttctgtggtgtagtaacattatttggtgctctcattttttggcgccggatcttataaagtatctttgcataatgcacaatgcttaagtcctgatcaggccaattgttccttgtattaccaaacgaagacgttctgtggtgtagtaacattatttggtgctctcattttttggcgccggatcttataaagtatctttgcataatgcacaatggttatgtcctaatcagcactattgttctttgcattgccaacatcatcggcattgaggtggaagtagcagcagatggtgccgaactcattaatgagccggtgccgattgaacttatgccaccgcctaattgattgttggtgccagccggtgacgtcatcatgttcatcattgccccaggtggaattatggccaccaatccactcccgccacccgccggcggtacaccaccaacaccgcccatgcccatcatcatcatcgcttgctgatggctcaacaaaatgcaattgccggaaccaccggcagtgccaccggtggcaaaaacgggacgaaaagctccaccaacaatggcattttgaccaatgaatgtgggaccagcagcgccaacaccaccaccacttcctaattgtttacagcggcacaaatccggcagaataattgcctaatggtttttctatgcttttggcaatgttcgagaatggaaacagaaattgattggttacattgccgggaaacattttgaaaattttcgcaattttcttaaatttttcaaaataaattacacccgaattctataggtttgactttaaaacctcgacaattcccaaagtccggagaattgggaggcgaaatttcacaattaatgttctaaagcatcattgtgctaaaaaaccaaattatcgaacattgccattgcactcagtcgatgagtttgtaccggcatttaaagtggaatttgttgctgttgctcagcagcaacaacaa

SEQ ID NO: 22886 - DNA, 1653 bp, Heterodera glycines
  misc_feature (1606)..(1606): n is a, c, g, or t
tgtgcgacatgttgcggcaatctgtgaaatgtgtgaccgattgatgcgacagcagccgccgaagacgcgtgccccgagggcgaaccaatgcggcacggcagcgacgatcgaatcgattttggcatcgccttcgaatttgcgggtttccgcgttgtacacttcgccactgttagggtaaaccacctaagaaacgagggtagttggaaaaacaagatagcagaaattcaaaaaatcacagagtttcataattctcccccccccattccctccttaattttcccttggccttttactgacaaatatcaaatgaatgctttaacgtcacccaccaatgcctttgaattgttcgcttttttcgcctctgttagcaattcagtgatatgatcgggcgcagtgcaattgataccgatcgctacaatctgtggtgcaattgggtgtgattacgatgggattttacctaattacactaattaccccccttccccccacgccacctttgggtgtccatttgctattttcactgcgtccgcaaatgcgtcgccgctgcgcgtccttttcccgtccttcaaatgcttttgctccttttaatctgcttgtccactttcacctgacatgaacagcaaacccacgcctgcacagtgtcgtccaattggtccatcactttggccacacattcgacttctttcaccgacggaatggtctcgaagttcagcgtggtcactcctgcggcaatcagaggacggcattggaggagataatagtcgatgatggtctgaagggagtgccaaacgaattttgaaacaataatttgccgagagcgaattgcgagcaaagtgaccacctgctcttggaagtcgggctttttcacataagcaccggtgtattccgaggcatccctcaaataggtggcgtaaggaccgacggcaccgacgagggccaccggacgacccgaagcagcaattgcctcacgggcaatcagcacggatttctgagaaaggcatatgaaataggagaaaagggggagggtgagaagggtggcaagtggcaaagttggagcagtacgtggaggatggactcggcctgtcccagcgaaaagccccggctttccatgagtttctgaatgctgacgtggtaactgttcgtctcgattatatccgccccggcatcgataaacctaaaaaaaagaaaaatggcatgagagatgtgggaaaggaaggcttcatcttttggacacggaggtaatcaccagttgagactttgacacattattaatttcgttttcactaatccgtcactttctcttactttttatgacatttggccaaaaggtcgggcgcatcgattattgcttccccactccaaatcaccgagttctgtttgcggtcaaaagtcaaaccccgtcagaaaggcccaaaaatcacattgatgggatagccaagctcctccaattgggaaccaatcccgccatcgagaacaaatgccaaagccaagggtttaagagactgaggagggaaagtgccattgagggaaagcatagcgaaaggggcaaaggacgagaaaagttgaaggaatgcaatggaaatgagagggagagggaggaggaggnggaacagaggggggaggggttatcagcagatcagcagcaggcttttg

SEQ ID NO: 22887 - DNA, 1886 bp, Heterodera glycines
ggactcaattttcctgcatttcaatcgctgggactcaatcttctttcatttcaatcactggggactcaaccctccagcagttcaatcactgggactcaagccaccagcattccagtcactgggactctgtttctcctgcattccaataactgggactcaactaaccagcattccaatcactgggactcaattctcatgcatttcaatcactgggactcaattctcttgcatttcaatcactgggactcaattctcttgcatttcaatcactgggactcaattctcttgcattccaatcactgggacctaacctcacctggtccttcggcatcgcaatcatcgagactcaattctgcgacattccaataactgggactcaactaaccagcattccaatcactgggactcaattctcctgcatttcaatcactgggactcaattctcttgcattccaatcactgggactcaattctccatcattccaattcccgggactcaatcccaccagcattccaatcactaggactaaatccttcacttttcacggattcttcggcatcgtaataaccgaggactcaattctcctgcattccaatcactgggactcaattctccgccattccaatcaccgaggactcaatccttcactattccaaacaatgaactcaattttacggattcatcggcatgtcaatcacgggacttaattcagacctgttcagcataattttggaattttaaaaatgtatttcaattatgaaatacaatttgcgtagaaaatccttttcattataaatacttgttctcttacattttaataatttcttttacataaatatctacatacaaaaaaagaacaaataaactgaccttatatcgttaaaagtaacttctttttgtcaaaacaaacaataagtgcgataaatccatccaattaaaccgtatccagtaaaagaggcataattgacatccgctttaattacaaaaacaaaaaaactccatttcaaagtcaaaacaatttctcgaaccaaaactttttcaatacaatatcaaaactaagtgtaagatcatttccattgactttgcatatacaaaaacaattctttttctttacaaaagtgttaagagcattcatttccaaatgaatatttttaatagcaaaaacaaattacttttcacttaacaaatgcaatagaaagcattaatttctatttctttatgttaataaaacacacaaaatctattttgtcattaaaaaagaaaaacagaaaaaacatttttaaagactgctttttgcaaaactgacaaaacgaaaatgaaaaaaacaaaaccaacatttcttttttttcaaaatcatttttaacgcaaaactcaaacaaaacgccacacaaattcaaacactggacacacacatacacacactcaactttattatataagatttgcaactgtaatcaatgaataaaatgtgtgccttaatttgataataaaacagtaattttaaaattatacccctaaatttggaactttttcgtgcttattttcgcacttatttcgcgattttttcgccattatttaaggccttattttggactttttcacgcttaaaaatcccatcgctaatgatcatataatataaaagttcactcacaaaggagtaggaaaacgaaaagcatcattcaaagcaacacaaaaaaagtcaccacctcttcagtaaaaaacctctttttctaaccaatttaaaaggctaataccaaaatgtcatgtattttttggggtaataaaattttaattggcaaaaaaaatgcgatgatacaaatttgcacagtgcgattttagttttgtattcatcactgagaataaacatgaatatataaatgaggat

SEQ ID NO: 22888 - DNA, 1200 bp, Heterodera glycines
cagaaggaaaattgtaaatagttaataacgtaatgaattctgttcaaataaaaaaatgcgtatttttcaaatgagtaaaaattttaatttaatggttatgtcctaaaataattttactaatttaaacatttatggttttaaattcagaaattaagaaaagaaatgtcacgattatttattttgctcttaccagcggaattaatttttgagatcgtatgcaatattcctaccttatccttatttggtataattataatcgaaagtaaaataaatacttattttagggagaaatggacctccgtgtatcacagggatagtcaacagacaatttgaaacttttagggacttgaaaaaagaaaattttaaaaaattggtaaattatttgcaaaaacttgtaactttttactaatcttctttaattttagaatgatttaattgatatcattagcataaaatgtaagatacaaattacttattggggacacataaaccgaagattttacgtccatgaacatgctgttaaacgagatttggtagacttagtttataatgaacttcattattatgtacgttatggtaggagtgaaaaaaatttattagaaggtgttacatggttttcccccgttaatgaggtaatttatgaaagagaatatagataatattctaatttagaccaacagttttcttgctcttttattcaaaaggacattatatggttttatacaatcggctaatcctttcaccatgagaaaatatatagttttaggcccaattatgtttaatgaattaccgttaatttttgatgaatcggttgacaaaatgataaaatttggtatttatcccggggtaagagacaattacacaggcattttttatgtacgtaataatcactggactgctgaaaacagagtcttaaaaattttttcttattttcatccaaatcctggaactttgtttatatgttttaataaattttaaaaatttaattttttccactgttctagttcaattttactctttttaaaatatcttttcgcttatttttcgcgctctttaatcaaaattttaggaaaatgaatccatttagaataaacatttttttcacttgatgggcacaggagtggactaacaaatatttgtgaccttaacaaaatagaaggtcagaattatgtaacaattctcgggaagattaaaaatgta

SEQ ID NO: 22889 - DNA, 1702 bp, Heterodera glycines
  misc_feature (76)..(76): n is a, c, g, or t
tagaatccgaacagaattcaggtccgggcttcggaattggtcgaaatgggtatcagattcgtgatcagcgaccccngaaaatccccccctagaaatttttatatgtatgatttataatattttttttgtggtctgtaaacggcgtaagtacccgaatatgacaattatttgggcctattccgaacaccgaaaccaaattcgaacaaaaagttgaaaattcgaatttttgaaaatttgcttttatgttagaatctgaataaaaaggatcattttttggtgtttcaatgatttgtgacttctttcagctctttttaatcaattttatggcaacagtgattaaaaaaattcgaatttttgttcaagttcggggccgggatcccgaattgtgtcgaaataaatgccatattcgtgaacagcgacctcgaaaaccaacgggtattcatcattatgtgtaacaaaaaaaatagacaaaatatgaggttattcagtccttcactggtggttatcgtacgaaatccgaagactcaccacggatggccatccacgagtgtccgcttcggtctcatcggatgaggaagaggaacagcaaggaaaagcagaagaggaggaggaggaaatcatcggaggagaacgaatgccaaatcgtagagcacagcaaaccaacaacctttgataaaatagggagattttattaaagatggcatagaaaagtgaagaaaaatcaaaatcagagagaagggcaaaaaattgaataaaaagtgaaattgatggaaataaaattaaataataaaacaaagaaagaaaagcaaacaaaaattaagcacaaagaaaatattcaaaatgcgaaatcccacagagattcgtccccattttgggcatttatttgcgtccgctgttgggcagacaatgcgaaacgacaaagttttgcccgaggcaaaatccgcaattccgtcgccaatcggtattctttgtccttactcaatcctctggaagaaaacgttacgtccttttgtcgacggcggcggaaatcgatagaggcgacacgccctccccacgactcgacccagccctgtcacccgctccccacccctccttttgcaatttacccgttccatttattccttttcttccatctgcccaccactctccggttcatccagcgatgcccacagcctcttccagttcttcctcttttactcaacacgctaaaagaaagtgaagcaaagagaagagagtgggtggacggagaagaggattgagtggagaagaaaaaagagaaacaggaaagggagtgggggaagagaagaaagggtgcacaataaaacaccaaaatttgtgtgagcaagaccaacccttgaggggcaagtaatagaggaggatggattgatggagggagaggggtgtggtggtggacattggtcgtcaaacatacatatccatcatccatcccatcaatttagcaactactcatcagtggataaagggtagcagcatctaatgaaataatctgcagaaaatgaacgatcgatgagtgaaatgaaggggaatggggggggggggatgccggaaaaactatcggaaaatggacaacaaatatgaacctaatctttaatttgaaattctggtacataaatatctatcatatggcccggagcccaaaatggggaaaaggatatatcaatttcagggccggggttcgaaa

SEQ ID NO: 22890 - DNA, 1214 bp, Heterodera glycines
cgcatgtgtcaatgtgcggagcgagaatcaagcggttgagcaactccttgtcattgctaaggagttgttggattgaaaacaggctgtcacctgagcggttaagccttcatgaggcacgaccggcagcgactgtttgaagtcaccgctgaaaatgaccgtttttcctccgaagaggagatccttgtgctggcgaattgccatctctttgcacactcggtcgatgacctcaatcaccgtgttgtgaagcatggtgatctcatcaatgatgatgagttgggcctcacgaatccgacgggcaaagaagctctccagcggaatgcttgggagtttgtctaatgacacttctctacccagacgaaacgtggaatgggctgttttcccatatggcagcaaaatggctgcacacccagtggatgccgtagcaagcactttgtaggtgtatggggcctttcgcaagcgcctaataatttggccaaacaggaatgtctttcctgtgcctccatcgccgtatatgaagaaacggcgggggacagtcgaatcccttgggtccgactgaatagccttaacaacagcatcaaagaccgtttgttggtcgctgttgagtggcggaggagtgatttgctgaggccgaggatttggttggccaggcggcaaattcaaatcatcatcgccaaagaaaaattcatcaattgccgcatttgtatttttggcaattgagtttggcgggtctggcaggctaaaatgcacacagcttaagttaaagcagctgtgcagccgccaatcaatgtcagctagggcttcaagctctgctgcttggcgttgtgccggtgtggtaatgccttgaggaaagtacatttggtctttgtacttgttccataattcgacggcattactgggccggccataaacgaggatgctcatgaagagccacctcatttgatcaggccagcgcgatagagctgcctccgccagagttttgtcccaaattttgtcgtcttcaagaagaccatgcattattgcagcctcagtgaatgaggtacaaagcaacccattaaccatcttaagatgggtctgggtctccaggaaagtgacgcataagtgaatagagcgcgaacctttccgggtctgatggggggtacaggaacaattcgaccaattgggtggtctcttggacaggttatattttccttttgttccatttatcctttgcccat

SEQ ID NO: 22891 - DNA, 2079 bp, Heterodera glycines
  misc_feature (339)..(339): n is a, c, g, or t
aaaggatccaatcgttccaattgctcttatcttatgtcggaatatatgcccgaataaatgaatgattaataaataattaatttgtctttgatcgctccgacgtccgactctcatctcctccgactcgactgactgattggtgggggaaacaattgaacggaaaaggggcggggatttgcggggatttgtgagagttagagaaaagagaaatagtgaataaaatggtgaacggggggaatgtggaaaagatgaataacattgattggccaaaaagggaaatgtgtgaagggttcgtctttgctcatgggtgataattagaatatgttacacctccctccnccaatgaaaatggccccccatttttaattcacaaccaaagcttggatggctgttgctcttttctgtcccttttattttatttttgttttttttttattgtttttttatttttaattttttttttttgatgacattttctttctttttatcatccttccctcttaattattgtccatttgctgtccctctgctcttttttgttgcttcctctttttgttgtccgctgtttcaaatgttgtaattgacggaagagttgctctgttgtcagagttctcttttcgaagctaacttggtgatgctcaaattgtccaaatgtccatcaattgagccgacttttctgaatgacggtccttctgtcgtttctgtctttctcttctgttgtcctttctctctctcttggcgggctgttgaccacaaatggcgatgctgttgatgtttcccgtcgtttgctgtgctgttccgcggtttgtactgctcgaagttgaagaaattgtcgtttggacttacgtgaggggaaaaattttttttttgtttttttttatgggcagtgtccaagagcattggttatggattaaaaataaataaattttgcccgggtaaagaggtgtaagataagttaaaattaaaaaaaaatagagcaaagacgaaatgaaagaaaatgtgaaaatttaaatgaagaaaagtgagggaaagaaagggagaaaatggcagggagttcagtcgtttcgtctgcctcttccatcatttgtgcgattggtccattggcccgggcggcttgatgttggacggggcatgtttggtgatgggctagggcggtcaggacagtcgcgaaggaagtgaccagggcgcagacagtagtggcacagaccagcgggcatgttcggatgtgctgaaccaggttgacgtgctgactgctgctgcctcgaaagtgccagcgaataacatgcgcggaggtctaattgacctaggcagagagggaccatcagaaccttgccaatcatcgtaaaagtcgaatgctttcactgatccgtttgaggtggcaattacgccatccacaaattgcggtttcgggtccatcatcgcatggatatactccggagttacagcaatagccttatccagagctctgcgcaggaatcgccgccaaatgccgtcagctgtccacaacagcttcaagtcgccaacaaccatcatgccgaatttgctgcggctgagtgccacgttaacacgccgttcatcgttccaaaaggcgccgctgttgtcattggagctcaggccggcttttgttgtgacaacgaagacgaattcggcctcgtgcccctggcaaccatcaactgttgttaccattacgttcggcatgttgagcgcagacacttcggttccaatttccttcgcttgaccagcgtaaaagcagacaacgcgaatcaagccgttgaaacatggccgtaggaaagtcaagcacttcatgacagtccgggtttgcattggatttgttgccgaaaatgaggtcgggtcctcctgcattcgatcaatctgatggacaagaatgatgggacactgcggcactggaagtgaaatgggagtttttgatgttaattcgtccatctgcttggtggttcgtccggtggtcaagatttcattttgcgcggcatagactccggcagaaatgcattctgtgatgaatgggtgtgatcgaaagttgacagtcaaagtcgtccgatcaacgcccgctgctgcgtc

SEQ ID NO: 22892 - DNA, 1482 bp, Heterodera glycines
attttttctatccctgatagccgaaatagcattaaaattaaaaaacatagtcttatagtttaataagagcattaattctgttgtttgaataattgctgattttttcaaaaactaactgatgatcaaattatcggtcataaatcatttaatatcatttagttaatgatatttagactatcagggatagaaaaactcaaatttgaacccgactttagacataggcgcaaatgcccgaggcgcaaatgcctggacacgcttttcaaacactttttttttgcggcgcgcttttttcaaaaaactttcaaagtcaaaacgaaaaaagcggtttgtgccaaaaagtggcaaattttgccattttggggtcaaaatttaagtaatttcccattttttggtgtccaagtgaggaataaattaattttttgaaacaattgctggatttaaaaaaaaaaatttccggccacggacggtttttgcttttcaatgctttttttgcgccgcgctttttttaaaaaactttatcaacgccatagcgaaaaagcaggaatttgtagcggttttgtgccaaaaagtgacaaacttcgccattttgggatcaaaatttaaaaatttttccccattttttcttggaaaatttaattgttgttgtttttttcggcatcatttggccctgctcaacgagttgcgctccatcttcgagctggacagtgtggacggcggtggtggcgggaagcaaaaggcacggcacattttggagacggagggcaccgccaaagtgtcgccggcggtggcctaataatttaaaaaatatatgaattttacattgttttattttctaatttttttaacgggcttcgttacaaatttcaaattgtgttttttttttattataaccgaaccaaaaactttttattaaatgcgaaattgttaaaattgcccatatcatcaacaaaaaactttttgtacagcattttttaaacgaatcttttttgtaataattcatatgcaatttattcttgaccttgccctaacggttacaaaaacggatgagaatgataaatgagggcggatgaatgtttatgcaaatgtctcagtcttcattatcacaataataaatctcttcatcgaaaatcctcttgataagcaatgttccttttaccgaaatgtcacagacgtaaaaaaaccataataattccaccgtttcattctgctttttaaacaaataataattttttccccttttttgacttttctgaattgacatttcttcgtccttttgtgaatgcgtcaaatgccagctgaattgcacagtcatttctgtattcaaaaagggacattttaaaatatcagtcaccaattatttggctaaaattaagcattacaccaacgctttttgaaataaggttactctgaaaattaaatgtttcgctttgttgtttgtgtgctccttctcccggaattcgttcatggtttttacgaccttga

SEQ ID NO: 22893 - DNA, 1758 bp, Heterodera glycines
atgtaccgcgcacttctaccccaactcgaaatgttgaacttcccgagcaaataggaccattcccgtttgttgttgaccgccctacagagcaccaaccccacctttaaacatacggcaacaaattttccaccccatcccactgaatgcacaccgcattaaccaagtgtcggttaacgcgcaacgcaacattgacgttcagtacgtaacaaataattgcgttaatgtcccgccaaacgtacagcgtcattgcgacattcagtacaccgctcctaaccctgtcgccgcgccatcaaacgcgcaacaaattcaagcaggaagtagacttattcaaaacattccaatgcaggctcagctttggcagggccctgatggaaaaatgactttggtttacccccaagaccaacagcaacaagtgctgatcgagcaacctaatttttctcaaaatcatcaaaaattcactcgccaggtctttcagattccggaaacgaatcaagagcctagacatttccctacctatccccaaccgaatgttgcgccaagcaacctcgaattcaacttgattttggaaagaattccggatctaaatggaaatgagggtacagattctgtgcgccgctttttcaaaaaatttgatgcatacaccgacggatggccaaacgcgaaacgaatttcggtgttagaaagcaaagttttcaacaaagcagaaagagcttttgaggcagcaaagtcaacgcagccctaccgatacgagcacatccgcaaagatatgattcagcagttggaagaaaccgactcaaagcaactaaatgcttttgatgatcttatgttgggcgttcggagaagacaaaatgagagcattgatgagttggctggaagaatttctcgcctagtaaagagtgcttatccgggtttgaccaacaatctgtgcgacgaatattcgatcaaatttctgatcagatcgatgggaaatcccgatcttgcgttaaatttggaattaatccgcacaccgggaatgactcttgatcattttgtgtcactagcagcaagggctgaatcaacccaacgcgcttcaaaacggttcagtacacacccaaatgatggctttcaacagcgcgagcaacaacccaaatggcgacaaaattttggtggtaactcaagccaaaacatggcgaaggttcaaaattttgctggaaacataaatcagcatccccagcccaaagaagacactagaaatcaatggaaatgttacaattgtgatgaatatggccacctttcacgcaattgttcacgtccaagaacttttatgcaaaaccagccaataaatcagcaaaaaaactttgttgctattggtgcgaaccgaactcaaatccaacccccaaatcagaaccgaaattttcaaacaccaaaaccaaattcagctaatttcctaaagcaaaattgtttggtggtccagcatgaagaagtcttagccgaggcgagggtaaacaaaattgagttggcaccggaagtaagtgaattttatgaaaaattggaacggatcaccgaaagcaaaaatgaaatttttttgccaacaattggaaaggttatgtcgttgaaacttgaagtgtttggcacagaaaccgacgcaatgcttgacggaggcgcacaaatctcattgattagtggtgattttctgcataagttgctgattgagaaagcgattacgctggaaacattgaaaagttcaaaacgaaaacccaaatttttgacgtaaacgga

SEQ ID NO: 22894 - DNA, 2379 bp, Heterodera glycines
  misc_feature (1878)..(1879): n is a, c, g, or t
aacttttaagtcaaattttgaaaatttttgtgtattttggagacccgtgaaaattttttgggatttttacgagatttttcaagaaaaattagaaaatgacaatattttttaatttaaattaaagatcttaattaaaaatggagatttttcgaaaagttatcgtgacatcaatcccgcgggataggtaaaatagtcgggagagatcccgatgaaatcccgatcccgatcaatcccgatgacctaacttttgcgtcaaattttgaaaatttactgtattttggagacccgtgaaaattttttggatcccgattcgggatcccgatgaaatcccgatcccgatcaatcccgatgaattaaaaatcactcaggacggttcctgaggtcaggatcccgaatttaatcccgcgggatcctgaaaaaatcccgcaggatcccgatcccgtccggtctctaattctttgtacaatttatttcctttaattgaatttgtaatttatatgctatgaaactctctttcattttttaaattctccatattattgtaggtgtcttatttttctcttattccgtcatttttcatatgcaattctgtttttcaggcatgtaattaattgacttgatctcgttgaaacgccgaaaagcaaaagttttcggttatacttaatttaattaaatttattttatttattttctaaatttatattgattagttgccgttctttaagcggacaaatattatcatatttaaaatgatttacaaatattattttgaaaaaacaaaaatgaatttgttcattatcattttgttataatttttttctaaaaataatcttttacaataaagtaaatttatattcaattaaatatttaaatattattgatttctaataattttatgtttaaataccattcctagattttccttaaaaaattattctcgcaatacttttaaaacaaaaaatttcagaaattgaaagcaagtttattctaaaataacaatacattagctttatgatttcatctatttttgtttttaaattctcgcatgcacaacatatccatcttgggtttcccgttcaattcttatgtatgtcttaagtttaaaatttgacgccgccactttttgcgggatcccagcgacttcatttactcttcatcgctatccagttcgccggtgacacaccaatcggcgcgcactgctctgcctgtcaacaacgcaaccatgccgatgtaggcggacagtcagccgagaaacgaaagcggaggatggtcagtaaggatggagagccgagaaaagaaagcggaggagagacagtcagccgagggcatggaaaatgtctaaacttttaatgagtataagattgttcatcgaaaattattgcttgaaaaattcatgaaaaacagaaatttgaaataattttttgcttttttataaattttctaaatatcactgaattcgttatctcgttatccacgattaattgtgcatttttctgacaaaaatccttttcccctcaaaatttcgtcggtttaagggtgttttttggtgggggaggtacgtacacgcgacagggtagtcctttcaaaaatttaaaaaaaatcgctgaacttcttgaatttttcataaaaaaatctattgctaaagtgagcggatacttttacccttgtcatccgcgcgaatcggccttcgatgcgcaggccataagcatgttcgagtcgcacattgacacccgcgaactcgccttcaaaatcacacattttttttcattttacatttttgtgaaaagtaccgaaatctggccagttacattcataccagggatgggccaaattgaaaaataaaaagcgaaatgcgaaaagcgaaatttgcgaaactgnnaaatgcgaaatgaaaaaaaagcgaaatgcgaaaagccaaaatatgcgaaaatgcgaaaagcgaaatgcgaaaagcgaaattttttctacaactttttaatagttaaaatcataaagcaaaaatcatttttaaaaattttattccaaatttaaaaatcaataaaacgcttttttgaggcgcgctttttccaaaaaaactttttaaaatttgttgacagattttcaccaaaaaatcatcaaattttgtgatttttgtatcatttttctaatgagaaataagagttttggcgcgccgctgagaacagtttttcatcaaattaccaaattttgcgattttgggccattttctaagaaaaaataggagttttgggggcgcggcggtgccgataggcgccgccggggaaaaaaattgaaaattttgatcatttataaacagtttttcactgaaaattagccaatttataggtaaaattttgaaaaattttatgggaatttaatcaa

SEQ ID NO: 22895 - DNA, 2924 bp, Heterodera glycines
ctctagagtatatttcggtgccccgccctttttcgaaaaaaataagcttgtaaaagaaatcttttttaataaaagtgcgaaattcgaggaattaaaataaattttttgttcgagtccggatttcgaattgaatgtcaatttatgatcagcaatttcaaaagaaatttgggcaagtttgctgagttatattttttaaatttttcatacgatttgcaattccatgacaaataactattttagactccaatttcattcagattgttgccactgtcatcctggtcgtgctctattactaccgattttacaaagtgcaaaaaacattttttttgctcatttcttttatttttcttgtcaagacaatccatgcttggctcatcgtcagcactgttggactgctcaccctgttcagcttctccttcattctgttagtttttttggggcttgggggtaattctgtttatcattcggtccgtcccatcacaaaaacaaaaattttaaaggaatatggacaatttaatttctctaagaatcggcttctctaaataagggagcagcttgtttcatgcccgccggtccccgacctccgaaaattttcaacaaaaaatcgaaacttttagaaaacaaaattttgaatgtttttctggcgactttttcaaaatttctgacgaattattaagtttttctaaaatttttaaattttttctgggtgtggaaacttaatgtactcctacataaggacaattattagcaataaggtcacactcttagaagccctgaaattgaaattaaaaacttttttttcaaataataaacaatttataatttttctcagcgaggtgttcaagaactacaacattccgctggactatccgtctctggccatttttctgtggaactgtatgatttggcttggttttttctttaattttatgaaaatcgaatttcagggtgtatggtcggcatgatttgcatccattggaagggcccactggtgttgcaacaagtattaatttttgcatattttccttaataaattgatcgaaactgattggctccccgccggacccaaatccctaattttctgaaaaatatgctaaaaatggcaaaatttactcatttatcaacaaaatatgtttaccaatcgctttccaaaattgttccaccggcggcactccccatgttccacaaaatttttgaaaaaagtgtttcaatctcccatcgtattggcctgcgagacatcccttgaatatgtttggattttttttgtctaagaaataccagttttgaaggtctaagggaattgaagggacccctcttggggaacaccaaaaattaccgttacaattttccattttttttttgctggtggataatgtgcatgtctagaagcgtaagaatttctttgttgggctaacaaaactgaactaacaaaattttatgtttaaattgccaaaaaatccccccccccctctctctttttagttctatttgatcgtcgtttccgctttgatggcattgcttttcatcaaatatttgccggattggaccgtttggacagtgttggcaattctgtcaatttgggtattttttttcactggcattttttggctgcatgacaataactcagtttttgtttggcaccatttaaaagttcaaattctgcatcgaaaaaccgagtgctgaatttaattaaaaaaaaaaaattcgtttaattgcaggatttggtggccgtcctcagcccaaaaggtccgctgcgaattcttgtggagaccacgcaggagcgaaatgagccaattttgcccgctctcatttattcatgtaaaattttttttcttgttataaaaaaattactaggatttctgacaaattttgtttgaaaattaacaaaaaaattcaaagggcggggggagcagtaatttatccaaggtaataaataaatatttaaatatataacatttttaataaaattcagcaaccgtcactgtcctctactcatatgtgctccatggcgttgtttcttccgcttttattgtcgccgccggggtgggcacaaatggcgatgatgaagacgaacagcaacaacggcaaccacaaccgaatgatggtaggcagcagggatgggccaaatcggaaaataaaacgcgaaatttgtgaaagcaaaaaatgcgaaatgaaaataaatgcgaaacgcgaaatttgcgatagcaaaaaatgcgaaatgaaaataaatgcgaaacgcgaaattttttctacaactttttaaatagtcaaaccataaagaaaaagtcagcatgaaaaagctgggcctagaagcctaaaaccaaggctaccaactgaaaatttccagaatcaacattggcagacaaaaacaaaaatcatcgttttggaaaattctattcgatttaaaaaattaataaaaattaaactttttttttctgcgcacttgtttctatatattaagcataaaaaaggctgtttccacttggtttgaggctcatacgttgtcctttattatgccttttttgcctttttcgggattttcgtgcctaaatgcctttttggcattttgccgttttggtgccttttctggtgttttttccgaaaaattcttactaagaatgcaataaaatcgggaaaacctcctaagaaatgatccgaaaaaatttcagaaaatacacccctaagaattgaaagtttttttcaaaaagtgaccgtccaaatttttttttctaggtaaaaaattataggtttaaaaatttccttttttacaagaaaaaaagtaaataatttattttcaaatcattttataaccggtattaaataacgatttaattgaaattatttattttttattccttatgattatttttaattaatcatttttaattattcatatttttgcattatttctttaatgattagat

SEQ ID NO: 22896 - DNA, 1913 bp, Heterodera glycines
cgtggcgttgctgaaaatcccccccaccctcgcctttcttttcagcacattttattcatgcataaaaaaaatttgatgatcaattggggaggggggaggggtgtcgttgagatggtccaccgttttgacaactcctcaataaagggtgtcgaaaatgcaaaaaaaaaaaaaacatggattttctgggccaataatggccccaggatttaggatattcgtcgcttagcgcttgggatatctggtggaaaaaatgtctttcagctaaattttcggtagaaattttaccatttcttggcggggaggggggcggcgtacgtacccccgtgcacgccccccccccctgggacttcccctggactaaagccctaaattttttgccgggagccaaagaattttgagggtcctgctccggcgtataggacattttcaccaattcgtatcaaatcaaaagcttaatagtttctgcgatgatttttttgtatggaaaatggtgaaataaatttctgaatgtgagaaaaacacataaacataaataataatgggacaggggcgactaattgaggattcccaatttttaaatgcggtggaaaatgagttttccctcaaattatgctgagctcacgggggaccaatgaatgttccgtccagttttgatgtgagaatgacttcacataaacatgcaattaaaattttttaatccgggggttgggggacatttgatatgctaatgagcttattatgtaggggcgggcagctgtccctattttgaaggtcttctccaattttttaaatatctaattaaaccaatgcctagatttttgttccagaaaataaagaggtcaatcagcaggtccaagtatttctcacaatgtgtggactaatgaccgaattcaacaataatgactgacatataacggactctattgtttggattggtctctgacctgttccattcacccgctctcaattaatggtctcgcaattccattgtcaactaaatccgccgcatacactttcaacgaccaaccaataaagacttgtttaattagcaccttaattatttgctgtttgcttttctgtctttgcctaatgcccccccggggaaagataggggcggtgggtcggcttccttttacctcttccactccattgtttaattttgaaaggtttatgaagagaataggggtgtggtcagcagatgaccgactactgatcatgcatgattcttgctcggtctatttgtaatgattatgccattggcggacggctaaatcgctttaaagccataaaaggaaaggatgaatgggatggcctgttgctggtagctcagcagacggtaagaccactggtttgggtgagaagccgatcgctacaccagcagaggatttcgagggttcgattccctcctttaattagcaaacaagaattaaagaaataaataaaagccaaaactttgaggggcggggggggggggacagaagcacggaaatcagttggaccaaagaccaaacagaaaaaggaaacaaataaaaaacatctgcgcaccgcacttcctgcttctgctgcggctccatcaaaattagaaatgagacgacaacaaataatgctaatggtaattgacaataataataatgatgatgatgcagatgagcccagccagcagcagcggaagcaatgcgcgactcaatcaatgatcagtgatcaaatttctgaccgatcagatcaatgcgccgcggtaagatgcggatcactttctgatcaatcagcagaaacggacgagcaccaccaaaaaatgggaaagaacgcacatagcgagagagagtgggagagagagacagagacaaagaggagagagtgtgtgtggggggggagagggtagggaagagataaaagaagtgaaggaggcggtgctg

SEQ ID NO: 22897 - DNA, 981 bp, Heterodera glycines
atgtgataaaaacaggtttatttttttccttttcagtatccctgcaaagttgggggcgcttctgataagtttctgaaaaaaaagttaagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaataaataaaaatttctaaaaatttgatcgtccataaataatttgtaattgatcaggggctcaccaaattttgcagggatacgtatcggaacactacaaatgcttactaattttcctagattttttaaacccggtgaaaattttttgcagacaccaccacttttgcacttaaaaactaaactttttggcatgtttaaaaagcaattaaaaattttattcatctccctttttgatagtaaaagcatcagagagccttatttaacttgtacataaaatttgatgcgtttcagagcactttctgaaaaaatatttatgaattaattttgcaaaaaataataaacagtgaaaaactcagaatttctaaaaaaatttaaaaccaattacaattgtcattttttcaggttaagttagtcctgttccggggagtatgcctataaaatttggtacgattttattgcttattgaaagagctagagccgaagaaaatttttttaatttaagcctaaactttttggcatgtttaaagcaattaaaaattttattcatctccctttttgatagtaaaagcatcagagagccttattcaacttgtaaataaatttggtgcgtttcagaaccctttctgaaaaaaatatttatgaattaattatgcaaaaaacaaataaataatgaactctcttccttaataattttcctgcaccgaaggtactcactcggcctcttcgc

SEQ ID NO: 22898 - DNA, 1777 bp, Heterodera glycines
tccaaaaaattttgttcagtttaaaaaaaatttcgagccaaaaaagttggaaaatctggtttttttgatgaattcttctggccataacttttttgaaccttaacgaaatttttcgaaatttttcaggctaatagaggatacatagggctatcgaattacaccaacaatgttggatttggttggcaaagaaaaaagttatagcaaaaacttgtgctcgtacgaaaacgaccccgaccccatttttcatgcttaactctttgaaataaaccaatgctagatcatttgtgccatttttttccgggtcgttcattaaactatgtatatgcgtaatttcaatggaataatttaatggttaattattttactaaattatttttatgtaaaattaaaccatttaccacttcactggttttcttattggtcattcttttctaaggactttgctcgtcggtgcttacattacattgattggaacgcggactctatgatcggatcaaagaaatttctgcaaattgaccaaaaattgttgtgcgaaatgttggcccgtgttcagttaaagaccaatggcgagataacaatttggaaagcagtaattaaaagccaaaacaaataaatttattttcaaattaatttaaggcccttcgttgggctgacgaaaagtgccgggagaatggcgaggaatgttcggcgaaaaatcagcgagtaaaacttggcccagccttgtacaaaattcgctttactcacatgccaaaagaggaatttgcaaaagaaattggtaattgggcacttaattgagcttaatgagtgttaattgtggacagaaagaacgttgatttgccaaatttccctctgtcagttccgtccggcgtgttgacaatggccgagctgatcagcgtgttgtgttccacgcccaccccaaccgcggcatttccgtgccgtatccgctgaaatttgccacccaacggcgcactctgtccaaacacatcgatgcttacgtttgtcccgtgctgacactgcgagtcgaccatttgtccgcttttgtgcgcgagggcagcgaccgacgcattagcgacgcggtgcacatcaaaggacttccgtggataattttggccgctctggtctccgatccgagtaccaaagagaaattcttaggcttttacctccgatgcggcgaagaaaacggtggcataatgacaaaaagaaaaaaacaatgattttgaattgtaaattaagactcggagtggagctgtttttgttcggcaatgtttcgaattgtttcacaaaaggagagcaaaaaggatttttctcgcaaactttcccacttttttcacgccaattcggcggaccgatgcggcttttacaattttatgacgattgaagtgattaaaagcaattagaaaggcaattaaatttaaaaagcaacgcattaagcgattgatgaaccagcggaatgggtggtacgactcggagaaggattgtgccgttttggaggtcgatattgacttgacgaacgcagcagcgaccaatgggacgcaaaagcgccggtggagcgatgctttttgagaacggaaatttgggctaatttttaatttatcaaaaatcaatcagttaaaatattttaatcaacaaatttcaattgccaacaaacaaaaacattttaaatttgcaaaacgaatcatgttaattgccgcaagaattttaatttattttctaataaataatggtcattatgtatttgtgccctcaagcaatcaccatttgcctgtggatactttcc

SEQ ID NO: 22899 - DNA, 990 bp, Heterodera glycines
gagaaagagagagatcgagagagagaaatttagagaaagagagagagaaagagagagagagagagagagagagagagagcgagagagagagagagcgagagagagagcgagagagaaaacagagaaaagagagagagagaaaaagagagagagagagagagagagacagagagcgagagagaaagagagagagagcgagagagagagaaactgggaagagagagagagagaaagagagggaaagtaagaaaaaagaagtgaaaagaaagagagagagcggtagcgagtgcgatagagagaggaagagagagagagagaaactgggaagagagagagggaaagtaagaaaaaagaagtgaaaagaaagagagagagagagaaagagaaaaataaaagagagggagagagtgagaaagaaagaaatggagagatagagcgcgtagagagcaagagagagatggagagagagagagaaagagagagagaaaaagagagaaagaacgcgtagagagagaatgaaagatacatagagagcggtagagagagagacagaaagagagcgaaagggaaagttagagagagagaaagtaaaagagaaggaagtgaaaaaaagagaaaaagaaaagagggggagagtgagaaagaacgagagggatagagagcgcgagtaaagagagagagagaagagagagatggagggagagagagaaagggggcgagagagagaaaagagaagaaaggatggtggagagtaagagagagagagagagagaaaaaggcagagagagggagagaaagaaagagtgagtgagagagggaaagagggaaagaaataaagagagggagtgagtgagtgagagcgaataaagaaaaagaacgggatgagagatagaaagaaagagagtgagaaaagaaagggagaggagagagagaagaaaatggaaggcgcgatggaaagaagttgtttttacatttttttaataccatttt

SEQ ID NO: 22900 - DNA, 1287 bp, Heterodera glycines
  misc_feature (9)..(10): n is a, c, g, or t
tgcaggtcnncggtaatcatcggttttactggtcccataaaaaaaggaggcaaaaagggggttttgagcaattttgtgttgctttaggcgtgtttttgagtgcgctgaacacgatgacatccatttagacccatttcgaacccctgacaagaattcgaaactaccgatggtactccatccttttttcaattatgcaacaaaacctgctcaaatgcacgcaattcgaatccgagtcaggggttcgaaatgggtcgaaattaatgtcatattcatgatcagcgcccccgaaagtcaccgaaagcacaacaaatttgctaaaaatcccccgtttttgcctctcttttttatgggaccagtaaaaccgatgatgatcgaacaggggcagggacggtcaaaatttgggaaaaaacaaaaatttggatgccaattttgccctcatttattccgtccgttcttaccaaggtcttcacgcatcacgaacagatgcaacggagtgaagccggcattgttccgggcgttcaggtccaactcattgtgcttcagctgaagcaagctcatcaacgaggccttctggttggctgcatgcaaacactgttttggggtggaaattttttgaaaaaattaagaacggatggaagatgcattttttgggcatcggaattccgtaagtcttaaacggtttggcaatcggaaattgtaattgacgactggggaaaaaaaatttttttttttttgccataaaaacgagattttaagttatgtcaactaaatcaaataattttggtcgaaaaagcacacagttgaagaataaattggtttaaatgaagaatgccaaaatgggatcgaaaaaaaaaatcagaatttttaaggcaaccagaaaattttttttttttgcgatttcgtttttaccgtgtttccgtttgtcgggtcccgttcatgcagcaagctgggcgacttttccagcagcacacgaattgcactgtaattttgaattttgatacgataatatacaaaaagaaaaattgtaaaaaacgaacccaaaagagaggtaattaaagaaattgaccattctatacaatatacctaaaaggagcaagcgaaaatcgaattacttaagcaaaaaatgcatgaaacgatagaaatagttaaagggatttcgaaaattttaagagcgttcaatattaatagacttattttggagtcataaaagaaataatttccgcaaaaatttcggtacttttcaagtaacgctgatacttttaacatacatttttaaatgcctataaa

SEQ ID NO: 22901 - DNA, 975 bp, Heterodera glycines
ttggtgctgagtcgttatataaaaaccataataagggcgttatataaaaaaccatcaaatggaaattgtcaaccaaaaactgaccataacttttgataatgtcaacagaattaaacattcttggtatcattcgatagccttaacatttctctattagctcacctaaatttcaaaaaatttggtcaagtttgagcaaagttatggccaaaagtacccaaggcaccgggttttcaaacatttttggccataacttttttgaaacctaacgagattttttgaaattttgcaggctaatagaggacatacactgtgttaatttaaaataaagacaccctgttttttgggagtttgaccacttcccatgaaccgatcgagctgaatttttaactgtacgtagcaattctgaaaatattaagattctaaaaaggagaaggcgaaatgacgatggaaaaaattttatgaattttttcccgaaaaaggggtgttaatttaaaatagagacacttgataaaaacgaatcaaatctcaataactaccaaaaagaaactgataaaataagctaaataagaaagaacaaatcttttttcacatttctatttattttgcagacagaaatctgtcttttaggcggagttgtgttgaattttccaagttttccggagaaattaagggccataaggcttaaatcacctcaaacatttgcccaaccgaatcaaactaacagcaatcagcactaagataacgtacagacatcctttaagcattttttattcattttatgccataaaaaaggcattaaacacaaaatttttgcgggtgaaaaaatacgaaaatctgagtaaattcgaaaaaaaattctagggggttgggagaaattttccatagaagatgaatatgacgaacatacagagcacaaaattctctacaaaatggactttgaatgaatgctctactacctgtatccgcgaaggcgcg

SEQ ID NO: 22902 - DNA, 630 bp, Heterodera glycines
ttcttatttataagaaatgttctgatttcggggtattgttcttattttgttcttatttcttaacagtgccggcctcgatttttcccaaatttcccagatcccgtgaacaaccctccccaagtagaaatgccgtaattaatttggcacaaaaatttttgaaaaatgcggttggctaattgatcaaataatttatggtaaacgaatgaacaaaatgaatgaagcaatgtactgatgctgtatgatgatgccgtgtgatcgatctgtgctgccctccacaaacccaaaaattcgcctccgtttcgggcattcatccaattcagccggggggggggggggggggataaatgaaatgcgaaaaatctcccgctgtttttcgctcttttcaaagtgtgtgcacaaacacaaatttggtgagaatgtgaatgaatgaatgaatgtgtatgaagaaagaaaggcatctcagatttgcgctttgggttgggtatttatttgtccgcttattcaatggatttttcggattttcataacgagaaattttggaaaaattttcatcatccgtccaacttcctccccccccccccttctccctctccagcagggtgtaccccacaatgttgccactataaaacg

SEQ ID NO: 22903 - DNA, 1002 bp, Heterodera glycines
agtcagggtcagggggctggtggtaagtaaccctctccccttcaaaacgcgaaaattttaaaaaactaatgaaaaatgggaaagagttttagaaaagacaggggggcttagagtggccctctctccccctcaaaacccgaaaaattaaaaaattttaaatgaaaaatgaaaaaattatagaaaatataccattttcttaaggatttcgttaaacttgtatgttttatgtggttttaaaatattttaaaagaaaaattcttgaattttctacgaaaatacactaagaactttattaaataattctaaaaaaacataaaaaattttccataattaaaatttaaaactttcacatacaaaacgagttttatccatcccaataaaaatgccccaacccaacataataaatatgtagcccaacaaagtttaggtcgtgcaaatattttgcaaaattttatgggataaaatcgggcggcgtcgcgtcgtctcatccccacccccgcctcgtccaatcgggtcaattgcctcgtcgagatcggatctcgacgacgaggcgcagcgattattgttgttgctattatttggtattaggtgactcacaaattattaatattattattatgattatgaatatatgatatttgctgtgagccacattaaaattggtaattatgcaaaatgtgacactttcgagaaataattcgcccgccggcgaaatgatcggcgcgcggaccgatcgacgaaaagatggtcaaggatgggggtggtgttattattattatatgtttgttgtgatgtgaggtgcataagtaataataaggaaaacattttttaaattgatggacgggaaaatgaaaaatgttttttgattaatttgattccatttttagacaaaaaaaaattgcacataattgatagaaatgtctaaaaataaatatgaaataataaaaaatagatagaatttttttatttattagaaaattcttttaaaatttaggaatttat

SEQ ID NO: 22904 - DNA, 1260 bp, Heterodera glycines
  misc_feature (1166)..(1166): n is a, c, g, or t
  misc_feature (1183)..(1183): n is a, c, g, or t
  misc_feature (1214)..(1214): n is a, c, g, or t
  misc_feature (1221)..(1221): n is a, c, g, or t
cagaaattaaaattactaaaattgaagagggattttctcacctaagtttatttgtccaatggaaaagaagccttgggaaaaactaaaaaaatcaaatgtaaattagagaaaaaacaaaaatcaaaattttttgaaaattgaataacaaaaacttactaaatttgaaaatgcttttttatagttaattttgcctaaattaaaaaaaaacaaattcaaattttagagggaataaacggcgcccccacaaagtgtccaagccacgaaatgtccaaaagagtaaaaacccacgaaatgtccaaaatttttcaaaatttataaaaacaaaatgagtctaatttcgaatttttagggttttcggggtcgctgaatacgaatatatacgaatataccctttatattaccccttgcctaaccttaggcccatctgaataataaaaactcaaattcgagacttggacattttgtgggtcagcggaataaacaataaaattcttaaaaatttattcaaaaactaaagaaaaagaggaaaattatttttcgttaagtgaaactttcttaaaaatgaaatttgattaaatttcctgtgagaattaaataagaaaaaatgaaaaagtgattttattatattggaaatatctggccaataaaaagcaaaaaatagccaatggaattttggccagccaaaaagtaaaacgacagcttaatgggctatcgtttaggcgttaagtgatttattagccaaaagaccgatcgttggccatcaaagcagaggcgagatgagtaattaatgggccgagaattaattggtttttcttttcctgtggcgtatttgtcgagaatttttatttgaatttccgattaaaaattaaaaaaaacgtaaattagtaaaatagaaaaggtacttttgtagactgactgatatttttcgagtgaaaaatcaaagatcgacggtattttgattttcgaaatattgtaaatccgaaattccggaaaacttttttccattggcaaatgcgaatttccgaatcgaatatgattcttccataacatgtgctatcatttaaatttcccattcttcgcattcattttttttttgcaatttcagtgccaaatttcaattaaaattcatgccaaaagacactctcattaaatggtagtggaataanataattttaaaaaattntaaattaaaaaaaaattccttttcccaaacncattggncaataatttgttgtgacatatggcggcggaagggctttt

SEQ ID NO: 22905 - DNA, 1564 bp, Heterodera glycines
cactatttcgacattttttggaaaattccttaacaaaaatgcaataaaaccaaaaaatatacccctaagaatcgacctaaaaaaatttaaaaaaaatatacccctgagaatcgagctaaaatttttcaaaatatactcctatgaaatgaaaaaaataattttcccaaaaatttactttcttggcaaaaatttttaattttaaaaatttttttaggtaactattttgggttttttgatcttaaaaattccagtcctactcatttgcaactgcaatcagtgaataaaaattattttgctcaatttttggctgaaaattatgtcactattcgtcactattttggactttttggcactatttggtcactatttcagcatttttactcactattttagttaactatttcgagattttacgtcactaaaattcccatccctattctcatttcatttttttattgcgcacccccccccccagcaaatttgctgatggcgcgagtcgagagtgttggcgaaagtcgagaaaataaaatttaggacgcctggggggcatttgacccgccgagagagagagcagaaacaagcacaaaaccggtggaaagatgacaaactgctctgattggaagatgggaaagaaatgatattgggagtgatcaatttcgtcggtctctcgcccaatcattttcaatgccatttcattaattgatttgatcacttcgtttgtctgatcagaccggtggaacgcagacaatttgataccaaaaaaattattggtaaaaatattaaaatcaaattttcaatatttatttatttatcttttacgatcaacggaacagcacagtgatcaacaaaaaatacaccacgggtcatgttgctattcgggtagcacccaagagtcaaattcactgaaattcgagaccagcaattcacttccgaagctcaagagccgagtccgataattaacccccatggcttaaaaagcccaataacaatgccgagagacgggaccccccaaaaaagccgagaaattttctagcaccgtttttgaaaactcatttctaatgttgttgtttttgttttcaatttagtgaccccattttcacgcggggaaaagaactcgtcttatcggttttgtcgtcgttgtcaatcgtcgtttttgcccctaccatcgccatcgacggaccatcaatcgtttcgttttcccatctttttcccaaagtttaaacagtcgccattttcgccgatttgatcatttctcctcccccattttcacattttaaaatgtttgctgtttgttggtgggatgttcacacaacgtgatcaaatcgtaagataaattgtcaagaaatgtgagaatgtaaaatgggaatttgttgtacaaattgtcaggcgtgggaagaatgaatggaattctctgtttttggctacctatttttagtgtcggaattcgattaatttcctaattttgtaaaattcaaaaataaattaatttttgcatttttttttttactttttttggattttttatacaatcggcaaatatttgtttttgacaatgaaaaaaaat

SEQ ID NO: 22906 - DNA, 1751 bp, Heterodera glycines
aaattaaacttctattatgatcaatttaaatttccctcccacaacgggtttgctttaaacacgctggccgatgaaaaactggagttttatggatgtcaaattttgggacttttcttcgacgtggccatcagcgggttgtttcgtgacaaaaacaaaccagtttgatgttattcgaatgagctagacgcgctctacattttcaaatgtatcaacaaagggtctaccgccactccctggcgagatatggcctgtcaaagcagaacggggccaataaattgaatttttgttaatcttcggcagttgcctttatttcgagcctactctacttgtgcatcttttcccaatatggcactgcttccgaattattgaactgtttcacgactgattgttgagataatttttttttccgattcctttatctccaagcatgagccttataagtgattgttcatatccttctcttgaaaaaaattgtcagtaaaaaaaacacgttttctgaatattaacaacaaaaatttttagacactttctaaagaggaaggaaaaaaatttttcatttgcctaatatttatttatactgttgaactgttggaaatgcagctgatgccgtcggaaaagctccgattttttggggaagtttttttctttcagtttcaccactgattgttgaggcaatttttttcgccaatttcttttgtctacaaacattatttattgcgtttcatcctgtagtgtgtaaaaaattttcagtaaaaaaaacttgttatctgaatatttacaagcaaaatttaagaccatttccaaagaggaaggaacaaaaatttttgcctaaattttatattatattgttgaattgtttgaaatgcatctgttgtctgccgttttgaaatttttcaacttttcgcgaaaagatttcccagaaaatgcatgggacaaataaaaattaaacttctattatgatcaatttaaatttcctatcagtttcgggtttgctttaaacacgctggcctatgaaaaaatggagttttatggatgtcaaattttgggacttttcttcgacgtggccatcagcgggttgtttcgtgacaaaaacaaaccagtttgatgttattcgaatgagctagacgcgctctacattttcaaatgtatcaacaaagggtctaccgccactccctggcgagatatggcctgtcaaagcagaacggggccaataaatttgaatttttgttaatcttcggcagttgcctttatttcgagcctactctacttgtgcatcttttcccaatatggcactgcttccgaattattgaactgtttcacgactgattgttgagataattttttttccgattcctttatctccaagcatgagccttataagtgattgttcatatccttctcttgaaaaaaattgtcagtaaaaaaaacacgttttctgaatattaacaacaaaaatttttagacactttctaaagaggaaggaaaaaaatttttcatttgcctaatatttatttatactgttgaactgttggaaatgcagctgatgccgtcggaaaagctccgattttttggggaagtttttttctttcagtttcaccactgattgttgaggcaatttttttcgccaatttcttttgtctacaaacattatttattgcgtttcatcctgtagtgtgtaaaaaattttcaataaaaaaacttgttatctgaatatttacaagcaaaatttaagaccatttccaaagaggaag

SEQ ID NO: 22907 - DNA, 1178 bp, Heterodera glycines
atcgaaggatggtgggaaggggaaatgaatggcagtgccacggaagagaagcaaacgagaagcaattgcacaattatgcgggttaagcaccgctaaatacgccgatgccgtgggtcggtccgcccttttagtgtaaattcatcggcggcacttccgtctccgttttcttcgcctttctcttcgccgattttatcttcctcccccctcgctcattttcacttttattagacaattcgcagttaatgctttgattttatcaacagataaaatgctttacaaatggaaatgccaatttttcgaatgttcaaacaatgaatggcatcttttgaaaatgccgtgcctttctctgccccggcatttcctccgtttttcctccgtttcttttcccctcaagtcattcccgcccttgtcaaattgttctgcaacacaatgtcacaagtagcgccaaaaacaaactctgttcaaaatcccattggtttgttttgtttttccaaatgccttttctgaccaaccgatgtttttcgtgtcggtggcatttgtcacgtgcgtgtaaatgtgccgattattctcttccgtgttcacctttaaagcatctgctgatcactgagagatgtttgatttggttgggttcacttacacccaagaacagcttcttcacaaattccacctgttcgtcaattgtgcctttttcagtccgtttcgtttttcccaattccccccccccccaccgcttcggcgtatgcgctgtcactggtaatgtttttggtccgatctaaaaaaggaaatggaaaatgaaagggcacaaaaatcggtcgatttggagcgatttctctgatcagtgaatgaatggacaaaccttcaaaggccgggtagaacctgtgcaacggaacatggcgcaatttgagctcgaaaaggtcctttttattgaggaataaaatgaaggaacactgcgggggaggggagagataaagttggacggatcaacgaaggaaagaaagaccaaagaacgcgaagagagactcactctgatcagaaacggattgaagaacatggcacggaacaggtcgatgctgtcgtccattctgttctgaagcgaccatttcaaaatgaaaaaggaaaatgacctcgaatttgatcagagttaattgtcccattcattcgcccgtccatttactaat

SEQ ID NO: 22908 - DNA, 1056 bp, Heterodera glycines
  misc_feature (48)..(48): n is a, c, g, or t
gtcgatcagcctttagcgcagcacataaaccaaatgatcacaccacanaacatccgatcacttctgctgatccatcacccgaccaacctgatactgaagcgacggaacccaaaagtaatctgtgaaaaggcaaaattaaagtgacagtatacgagtgccaaatgaaatgtggtggtcattacttcgtggacacctgtggtggatgccctggcatggataatgtcaacggcggtgggaagataatttggcatcagaatacgtttggattcggcgaaaaggctgggtcaaattataaggcaattagctaaagaaaatcactaattggtattgtccggcaggtaaaattcgtttaggcgctgacaagccgtggtcaccgagtcgtaagataagaatttgaggatctgaactcgaaaagcaaattaacagtttaatcgatgggtggtcaatcattggcttgccaatttgatcatattgtcatcgtcaaagtcaaggaaccttaaaaggatgtcaaaatgagcggtgaaagacaagaaacgctaaactttgagaaggaatattcaaatttgtcgaccaaatctttttcattggacggcacggcaatttgaagctgagcgatgccgcgggctatgtaatgcaaagagccgatgtaattagtgtgaagcatatacctggggaaaagcaaagtgggcacgggagaaggcccaaaatgagcaagagaagaagcaaccggggcaaacccacctgtagttgaccaactccgtttcactgaacccgtcggtgtgaagaattctgaatttgtccctcaaatggcctttgtccttcttgcccacctcatttgcttcacaattgtggatttgcccgagtcggcactgcccaaaaggagaattttgaccattttccttctaaatcgttttgtttcccctaattaagcctttgccattgccaacccctcaatccgttctttgttcaagtccaactcaattcgattgtttctgtccatcgcttcgtcggatgcttcttctcctttgcacaattttgagcccatccgacgaatgg

SEQ ID NO: 22909 - DNA, 1100 bp, Heterodera glycines
ttcccggtgggaaaaatgggtttgaaaaagtttatggggaaaaaaaagcctttacaaaataaaacccctgggagaagggagtgggaaacatgatttaaaaatttcaaattttttctagtttaatctactcaaaacggttcagaattcaataaaaataacattcacggtgcgaaaaatggggtttgaaaagtttattggggaaaaaaagactacaaaataatacccctgggagaagggagtgggaaacatgatttcaaaattttcaattttttctagtctaatctactcaaaccggttcagaattcaataaaaataacattcacggtgcgaaaaatggggtatgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaagactttacaaaataatacccctgggagaagggagtgggaaacatgatttcaaaattttcaattttttatagtctaatctactcaaaccggttcagaattcaataaaaataacattcacggtgcgaaaaatggggtttgacaagtttattggggaaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattggggaaaaaaagactttacaaaataatacccctgggagaagggagtgggaaacatgatttcaaaattatcaattttttctagtctaatctactcaaaccggttcaga

SEQ ID NO: 22910 - DNA, 1592 bp, Heterodera glycines
tgtacgtcgttgcaacaatattcagggagtttttcctcccccccggaaggttggttgtaattattattgtaccatttgccttatttctgttgatcggggattttcatttgatcaggacagtattgttcacgtggaggaagatgggagagaatgttgtcatagtttgatgatttgttgaacatgtgtggaaaatgttgtttatcttttatatgaagcccaaatgatttgatgaggccagataatttaatgggcataaggttgtagctgtcgtgaagaattgtaagcggtccatgttcattttgattaattttgagttcgtagagtcggttcccttgtttgatgatgtccggattgtgaattccttgcgccaaaacctccttgatgatcatcgtcatgtcgtagcgccccccaaagtgtgcaaaggcaaccgtgggaaattttttgttgtggtcgaagagtagccattggacaaagtcgcgtagcgggtgttgagtgatgattttttggtcgactgttgtctccgtgtagtcaaagggtgaaaaggtgattgagcggtgaggaccgcaaatttggcacttttttccctgaagtgatttgttccagtcgcccattgataatgcaatcggtgcagatgatggtagccgctgcaaagtttacctcgtgttcgaatttattacctacttttttatcctgtgtcgcctcaaaatcgtatgcgatgatcctgtatggtttaagtttatggggttttaggggttggatgaagcagcttttgcaggggttctcgccatcttcctcttttaaatgaaactgcttacatagacgacaaaacctttctccgcattggtggcctacatttccgtgaaccttaacattataaattaccccacaatcttcgcaacgctgaaatttggtgcacaaatccttgtggaggtggcgttcatagcagtcgttgttatagaaatagttgttgcagtgcaaacattttttgaagtagccttgttgggcttcgcaggggtagtcgacgcccacctcccggcaaccgtgacagagcgatgtgcagttcattgaatgttgtggtttattgctgaatgccgattcacaggagaggcaatagtagcgtttgttccaaaattttggcagggttttgatgccgtcaaagtggttgttgttgtggtagagaagaatggggaattggtagtcggtgacatcagatttggtgattggtcgtatctggtaatcgttaaatatgaaaattttgtactcaccgggatatttgacgttccataacccttgcacttgatggatgtacggcatcgcggagtaaaagtagtactttttgacaaagaacagttgtttgattatctttgagccatctaaattgtttccttgaaattactcccctgatatataatgagtagtagcgcatcagttccagtgcataaaaaaggcaatagttgtcattgttgttaattttgaagatgtgtgattgggaagagaagattggaggggcacttcctttgatcactcgtcgacaggttagaccatcagtgttcaagacagagaacggtataacaaaatgggggcccataaaa

SEQ ID NO: 22911 - DNA, 1796 bp, Heterodera glycines
acatagttgatgaaaaatttcttggccctccatttgtaataaatctttttccaattttaattttacaccttctttcttaaagaatttcaacaaaaatgatttaaacattaaaaagcgcaatttattaaaacatttaaaataatttcatattatataaaattatattgcattgctaaaaaataatattaaatactcaaaaaattttaaataatatgctattttcagataaaattgaacaatttccaaaataataatggaaataactaatgaaacaatatgaattttaaaaaaaataaaaataaaacatggtttacttataaattttaatttatttctgcgataaagataaaatttaaaaataattttttggtgacaaaatatttttctaagttatcatatttgatattaatgcaaataaagacttttatttaaataattatatttaacaattctttttttatttaatttggttcattttgtaaagttctttccaatattaagataaaagcacccaaatttcgttttcctcttatattataataacacacatgcccagtggaacgagctgaattaggctttgggatcccaaccctcagaattccaatcatttttatgagggggtcctggggtgatcagtcccacttccctccccaactccaactccattttaagaatggctttattcccggaaaagcatggaaaataaatataaataaataaaataattacataaaatggaatcaaatatttaaatacaatcaaataaaaacataaaatacaaaaattaaataaagttacataaagttacataatcatgattaagtgaatatcaatagagagatcgcagattaaatagacataaatggaaaggggaggagtgtcggatcgatcgctaacgggaaaataaataaattaaaatgaaaatgaaaagagagattaaaatgaatgtgaaatgtgcttaaatgcttcggcaatttatgttaattagcttatgtcttacactaatttaaaaatgaagcaaattatttggtttttttattttgttcaatttgtagagaatttggcaaaatatatgtgagcctatcgacatcgatttttgaatcttttaaatcgacttttaaagagaaaaaaattagtggggaaaagaatactcgcagataaatgtgcgagagattctctttaatcggttaaaatgtccttctaaaattttacaatgggagacggacggtgcacgctaaaaagagatttttaaagatacatattatgcattaattaatgctaatgagtgagtgctgctgtttcgatggtttgatgggtcttgactagagaccggacaagagggtcggtcgaacggtttcggttaaaaaccgaaaaaaaccgaaaccgaaaactcaaaaaattctcggtcgaacggtttcggttaaaaaaccgaaaaaaaccgaaccgaaaaactcaaaaaattctcggtcgaacggtttcggttaaaaaaccgaaaaaaaccgaagaaaaattttcggtataccgtttcggtttttttgaatttttttatcttttcccaaaaaaaacaataaaccatttttatcaatagaaaaagcgaaagatcacctccgagtaaaattgtaggctattgaaacctctattgaatggtgtactataggttgtgagaatgatttaaaaaggcagccaaaaaacatgtgtttgctccttgattctaaaaaacaccagattagtattggcgaattggagccttttttgatgttttttaccgaaaaattgcattaataattaattgaaat

SEQ ID NO: 22912 - DNA, 1804 bp, Heterodera glycines
  misc_feature (1703)..(1703): n is a, c, g, or t
  misc_feature (1705)..(1705): n is a, c, g, or t
  misc_feature (1711)..(1711): n is a, c, g, or t
  misc_feature (1749)..(1749): n is a, c, g, or t
ttttctctattagcccgcaaaataaaaataaaaattgtcccccccccggaaaaagttgtatgaaaataagtactattatctgcctcaacttatgttaaatttggtaacttttttgaaattttccaagctaatagaaaaaaagctgggctatcgaatggtaccaagaatctaaaatttgattgactttaagcaaagttatgccatgttttgtcgaaaaattcctaaaattggctggatttatgaaacgacccagcatggcattcggagataaaagaaatattttaaaatgggataatgcatttttaagagcgatggatcactgctggcggcggcggcggtcgctccatttcgacagagtcacgaaatgagggggatgaagctgcttccgagccggacattgtgcaggacagaatgatcgacttcatgcggcacaaaaaggacagcacaacaacaccgacaccaacaacaacagcgaaaatggaggacggcggcggcagcaggggaagggtactgtagaattgggatgggcttttgtaacagttacatatactgtaagtagctgtctgcaaaatacagtatgggtggccgactctgcaagagcaatttcacacatttcttcctgctggttttataaaaagaatatactgtagctaattggcatacagtaagcggtgggccttttggcaaaagtcgctactggatgtgcgccagtgggaatccagaataataatctgtcagtaaaacaatcagtcggttatggacaatctgtcagtggacaatccgtcaacaaagtatggacgagatgtacttggatgaaacgaattgtccgtcactgatgaattgtccgtcactgatagatattgtcttccgaagattatccactgacggattgtccggaatccggataccgtcagtggttggaccgcaatccgggagtttttgcgccagaattacacattccggcatttatggcttgtaaaatggcatttttaggcgaaagcaaaacattcaactggctcctctgctggtggtggactatcagtgccggcgccaaacaatcggaagaaaacgccaaatcaacaacagcaaaaaggaaacaacgaattgggaggagaaggaagagaaaatggggggaaaagagaggaaaagggaggagaaaaggagcagcagcggaagcagaggaaaaggaaaagaaagttgcagttgaacatcatcaaaaacaacaacaacaaaagcaagaagttcaagcagtacagcagcaacaacaaaagcaaattttggtgggaatggagatgaagatggataacagcaaaaatggagaaacaagggaagaggtggaaaaggaaggaaatagcattggggaaggaggagagacggaagagaaagagaggaaaaggaaaaggaaaaattcggcggaaggaagagaagaaagaggagagaatgaagcagaaaagagagaggaacagcagcaaattgacactttttaaaatattgccggtgctaattgctaacggacgtcgtaaatcccccgtcaaaatcccgaaaattaatgtcacaattttcaagcagagagaaattcatacactcgatagatagcaagccatttttatgcatccgattgatttaccaatcgagaggattttcttcataaattgcatttgatcactgatttaattatgatcagtcggtcattcttctcattnanttcatntcttcttttctctgcgctgatcattgttttttttgtgnttttgtcgtcactcatttcgcccttttgtgatgctttgtcccgcttcttcttctt

SEQ ID NO: 22913 - DNA, 1507 bp, Heterodera glycines
aaaacaaaataaatgttttttttttaaaataatttataagtttttaccattcatttttttgttttcaaaattatgtactaataaccgcgtttgtacacataaatctttgcccaaatctccacaatttataataacacatcttcttctcgctaaccggggcagcagcaaaaagaatgtgtcaaaatttgtgttggtcaaaaacaaattggcacggcacggcgaagaaaaagtgccgatggaaaaggggggagggcggaattggcacgacggatgtgccgttttggacggaccgacccccgggggacaagcaaaagatgatggacgacgacgggaggggggggggggggaaagcgtgccggaagggatttgttgggcgtcggcatttcagggctaatgtaaaaagccaaagtgcgaggaagggggggggaaggagaagcggattttgtgccgaagaggaaaaagcacgcattctaagttcaaattttttatgaagttgaatttgttggggtcagaaaccaaaagggaagagcacaaattatcggtctacgtcagttcgggcccagatagtgttcaatagtccgatatagtgacataattttcatacaaaaattaagcaaaaataatttttattcactgattgcattgcaaatgagtagggctgggatttttaagggcaaaaaaacaaaataggtacataaaaaaataatttttaaaattaaaattcttgccacgaaaatacctttttgagaaaatttcatttcttaggagtgctttttgaaattttttttgtcgattcttaggggtgtattttttttttttttttttttaggtcgattcttaggggtgtattttttggttttattgcatttttgttaaagaattttccaaaaaatgtcgaaatagtgaaaaaatagtgacaaaacgccaaaatagtgatttttaactattttagtgacgaagtcgccaaaatagtgatttctagtgacgaaaagtgacgtccaaatgaaaaaattttaacgcagaaatgcgttttttgagctcctttcttcaaaacaattgagcaaaaaaaaagttttttcactaaaagttgcgaccctaattataagttattatttcttcaaatcgttttttcatgtttattttactaaaataggggtaataatttttatatctttttaatacgaagttcagaactttcctaagagaaggaggagaacatatatcttttgttattttctcatactttttcaatttaaaaacaggttaaaccataaaatatttttatgcttaatttcgagaatttaaatataatatttataaataaaattaataaatctctgactgtttaaattttgacgagaattagggccgtgggtttttccattaattgtaattgttaatgaattttattttattttttccttcggaatggctttttttattaaaaaaaaaatctggcaacggatgggaatattttcaaatttttagtacatttttgtttttaaaa

SEQ ID NO: 22914 - DNA, 1292 bp, Heterodera glycines
gaaaagctaataaaatgccgatttgctccatcggcgacggcacggcactttgttgccaaaagacggtcaactgaggacacggacactggcacccattatttgatggacgaaaattgaattttaaccattaaatgaatggaatggaaatggcgagtgccgaagaccgatgaaaggacaaatgccgttaaatttggcattttaaattggccataaattggggactgtgactaactaattagtaataaaatgataaattgttggcaacggatgtaatttgaattacaattttatgactaaaatgaatgaaatttgatatatcgggccataattagtatagaccggaattttgaaatggccgggacttggaaaatggacccgggcgagatctcgggactgcccggcaaaatcccggcgggccccggtcccgtccggtctctaataattagtattaaataaaaattgaaaataaaaaaatacattaatatcaattattattaatttcaaatttcacaaattaacaatcgaatcaaacaattatttcagctcaaaataaaattaaatttttaaattttaaattaattttatattggattaaaatatttaaatttgatagtcgcaaaaactttccaattgattacaattaatttattttttgaactcaaaattaggagaaaaataacataaatttttttaaatttttatttaatttatttttaattgcattttcattttaattgtaaatatttaatcaaaataaataaatataatttatttaccaaccaaataagttctgtttagggttcggcttagtcagtgaacattgtccagctcatacagtaggctgccgaattcgaattcaagtaaaaaatgggaaattttggagaaattaaaaaaatatatattttttttgccctgcagcgaaatgccgtcactttctacgattatttggacagtaaccaatttgtctgtatgttgaagggcgaatttggggagcagcagggctccggctgtgtacggaaacgttcaggtggaaaaacaaattaattagaaaaattaaaatgttcgaaatccgaaccctaaatcccgaggggtcgattaattttccaaaaatccatttcactaaaatgtgaactcattatttcatctttagcataaggaacaaaaatagtgtaagaaaacatgtaaaaaatggatgaaaaccatggtggaaaaataattagtaaaattaaaatttcattcaaaattcaattgttaatatcggagtaagaaaaatttattcaaaaaaaccaaaa

SEQ ID NO: 22915 - DNA, 1268 bp, Heterodera glycines
  misc_feature (1134)..(1134): n is a, c, g, or t
aaaatcactttccaggattaaaagcgcacaaatgccgcgaatgctctattgcatttgtgtcctctacctcacttgctgtgtgtaaatataaataataaataataataataaacaaatattaaattcaaaaaatgattggaaataaattaagaaacattttaaacggctccaccacggacttaagccgttcgagtgttggttttgcgaccaggagtttgacaaacttgtaagtttttcaatgtgaaataatgacataattaggcattaaaaaattaagtaaattattttgctttaacgaactgtaatgttcatttttatggaaaaagaagccatcgaagaaaaattactgatactttccttgaataaacattttcatagactttttttaacctctcaaatggtatcatacccctaaaatattttgacataaaaaaacagacttttacacgggcctcctgctaagaaactgatcaaaaaaaagaagtcttcaatgcaaacttgatcagatcactcccccataacggcagggggataattttcaaaaaattctttcggggttaggatttttgtccataaagtataatcagtccatcagaaatggccacataacagcaggaacacccaacacactgaaaatcgggataattttttgtccataaaatataaacagtccatcagacagaacacagaatctgcacccgtgtattgctttttgaatggcggattgatgacttatactcaaatgaatttataagtgatcaaaattgactatcaaataaatgaaaaattttcgaccaattttccctgggaatacatcaattttatggaggccaattttaggcacttgtaaacctcattgattatgagccatcgatccgcctttcaaaaaaagcaatacacgagcgcagattctgcgctttttctgataagtaagcattattacattgaataatgaatgatagtttttaacggccgtaaaaatgacgtaaaatgattaatttttgcttcaatcctaaaaacattagtgttcgcttagctttgtctacatgacaatagctgcaaaataaaataaaaactatgttccattttcaaaatcgaaaatcaaaattttgatgatcaagtcgtctgctttanagttgataatttagctaaaccggcggcatcataatggaaacgttccacatggataaataccagaaaaaaagaatggagattatgtttggaagaagaagaaaaaggaaaagccaaaaaacactaaaaatgattag

SEQ ID NO: 22916 - DNA, 1703 bp, Heterodera glycines
  misc_feature (90)..(90): n is a, c, g, or t
gattgtgcggtattggccgtggcatttcttttgtttatgcggtattgaccgtggcatttcttttgtttatgcggtattgaccgtagcatntcatatgattgtgcggtattggccgtggcatttcttttgtttatgcggtattgaccgtgacattacttttgtttatgcggtattgaccgtggcatctcttttgtttatgcggtattgaccgtagcatttcatatgattgtgcggtattggccgtggcattttttgattgtgcggtattgaccgtggcatttcttttgtttatgcggtattgaccgtggcatttcttttgtttatgcggtattgaccgtggcatttcttttaattatgcggtattgaccgtagcatttcatatgattgtgcggtattggccgtggcattacttttgtttatgcggtattgaccgtagcatttcttttgattgtgcggtattgaccgtgacatttttttgtgggtttacccccagtttgttaacagtctttcgccgcatttttatggcagattttgaaaatcttcgtaaataaataaacgccaggccgtgcaaatagcaaatagacactgatgggaaattttctgaaaaagcatgcaaattgttgaaaatttttattacaaaaattgtatttcggtactttcctgttttgcgaacacaaaattattttttaaatcagcaatgcgcacgtattttttcaaaaattttataattatgctttttctcggaaaaataaaatggattatgactaatttttggtaaaggattagtaaataatagccgtcttctctaaaaaagggagtactggttggttttttttgaattaaatttgtcattgtaccttaaggatagactttcgctttcgcaattatgttttttggcacttttgcttctttcgcgattcacatttggcgcgaaacgcgaatttggtgaaaatatgttaacaaaatgcacttaaattttcaaaattttttccgacggcgattaccgttcccgccagtccccctcttcccaaaaatttttggaaaaaaagcgctcctaaaaagttttattgatttttatattcgggatagaattttacaaactgatgatttttgacgccaaatgctgatttttgtcggacaaatgctgatttttgaaaatttacagtaagcagccctattggttctatgaatttgcgtgtcgctatttcacatttcgcatttattttcatttcgtcttttctattttcataattttgcgtttctcgtttctcgtttctcaatttttcgatttgatgatgatgatataattttgattagtaaaaaacgaaaattaaaatagctatcgactttcttaaagaagaggcccatagttcttcaactgagtctgaagccaagtcacagatgacgacagcgataatgatgatgaagaggaggagggggcaaactaactagatcagaataacgcgcaggagggaataaaggaaaagtgcccatcccaaaataatcatctaaaatcagcacttttgttaacaaacatttatttttcacaataactaacaataaaagtttcggaagatgagtagattaggaggattcgtcagttggacgtgaacatatttcaagcagttctaatggaaaataataatgatggtgatttcccccatactgcgcaacacagggcaggaagggaaatctaagacgaa

SEQ ID NO: 22917 - DNA, 1048 bp, Heterodera glycines
ttttccagtacgggtttgtccgtgaaaatttgaacaatatttccaaaaatcccaatcatttttttcgatccttgtggactgagtcgccccttgaaattatatatcagggaacccaatactttcttggaattttccagaacgggtttgtccgggaaaatttgaacaatatttccaaaaatccctatttcttttttctatccttgtggactgagtcggcccttgaaattatatagcagtgaacctaatacttccttggaattttccagaacgggtttgtccgggaaaatttaaaaaatatttccaaaaatccctatttcttttttctatccttgtggactgagtcggccattgaaattttatatcaggaaacccaatacttccttggaatttttcagaccgggtttgtccgggaaaatttgaacaatatttccaaaaatcccaatcattttttttgatccttgtggacgaatcggcccttgaaattatatatcagtgaacccaatacttccttggagttttccagaacgggtttgtccaggaaaatttgaacaatatttccaaaaatcccaatcatttttttcgatccttgtagactgagtcgacccttgaaattatatatcagagaacccaatactttcttggaattttccagtacgggtttgtccgtgaaaatttgaaaaatatttccaaaaatcccaatctcttttttcgatccttgtggactgagtcggcccttgaaattatatagcagtgaacccaatacttccttggaattttccagaacgggtttgtccgggaaaatttgaacaatatttccaaaaatccctatttcttttttctatccttgtggactgagtcggcccttgaaattatatatcagtgaacccaatacttccttggaattttccagcacgggtttgtccgtgaaaatttgaatttccaaaaaatccctatttcttttttctatccttgtggactgagtcggcccttgcaattatatatcagtgaacccaatgattccttggtagttatcagtacgggtttgtcc

SEQ ID NO: 22918 - DNA, 2301 bp, Heterodera glycines
  misc_feature (68)..(68): n is a, c, g, or t
  misc_feature (71)..(74): n is a, c, g, or t
ccccccccccccccccccccccccccccccctttttttttttttttttttatttttttttttttaaanaannnntttcccccccccccccccccacaaaaaaaaaaaaaattttttttttttttttttttttttgtccccccccccccccccccttttttttttttttttttttttttttttaaaaaaaaaaaaaaaaaacaaaaaaagacaaaattttttttttttttttttttttttttttttttaaaaaaaaatataaaaaaaaaaaaaaaaaagcccctttctttttttttttttttttttttttaaataaaaaaaaaaaaaaaaaaaaacccccccccccccccttttttttttttttttttttttttttttttaaaaaaaaaagaactcccccccccccccccttttcttttttttttttttaaaaaaaaaaaaaaaaaaccccccccccgccggggtttttttttttttttaaaaaaaaaaaaaaaaaacctccctcccccgggttttttttttttttaaaaaaaaaaaaaaaaaacccccagccccgggttgtcttttttttaaaaaaaaaaaacaataaacccctagcccgtgcctttttttttttaagaaaaacaagacactcctggcctggcttgtttttttttaaaaaatccaaaaaaactcctagccctggcttgactgttttttctgaaaacccaagaaaactcctagccctggctggactgttttttctgaaaatccaagaaaactcctagccctggctggacctgttttttctgaaaatcgattaaaactcctagccctggctgggcctattttttctgaaaatccaataaaactcctagccctggctggacctgttttttctgaatatccaagaaaactcctagccctggctggacctatttttttttctgaaaatccaataaaactcctagccctggcttgactgttttttctgaaaacccaagaaaactcctagccctggctggactgttttttctgaaaatccaagaaaactcctacccatggctggacctgttttttctgaatatccaagaaaactcctagccctggctgggccttttttctgaaatcaaagaaaactcctagccctggcttgactgttttttctgaaaacccaagaaaactcctagccctggctggactgttttttctgaaaatccaagaaaactccgagccctggctggacctgttttttctgaaaatccaagaaaactcctagccctggctgggcctattttttctgaaaatccaataaaactcctagccctggctggacctgttttttctgaaaatccaagaaaactcctagccctggctggacctgtttttttctgaaaatcgaagaaaactcctagccctggctggacctatttttttctgaaaatccaagaaaactcctagccctggctggactgttttttctgaaaatccaataaaactcatagccttggctggactgttttttctgaatatccaagaaaactcctagccctggctggacctatttttttcctaaaatccaataaaactcctacccatgggttgactgttttttctgaaaacccaagaaaactcctagccctgggtggactgttttttctgaaaatccaagaaaactcctacccatggctggacctgttttttctgaatatccaagaaaactcctagccctggctgggccttttttctgaaatccaagaaaaaacctagccctggcttgactgttttttctgaaaacccaagaaaactcctagccctggctggactggtttttctgaaaatccaagaaaactcctagccctggctggaccgtgttttttctgaaaatccaagaaaacacctagccctgcctgggcctatgttttttgaaaatccaaaaaaaaacctaaccctcgcgtgggcctgttttttctgaaatacaaaaaaaaaacccaaacctgggtggggcctgttttttttttaaaaataaaaaaaaaaaaccccccccccgggctggggtgttttttttttaaataaaaaaaaaaaacccccaaccccgggggggggttgtttttttttaaaaaaaaaaaaaaaaaccccacccccggggggtggttgtttttttttaaaaaaaaaaaaaaaaacccaaccccgggctgggtggtttttttttaaaaaaaaaaaaaaaccaccccccccggggggggggtttttttttttttaaaaaaaaaaaaaaaacaaccccccctcgcgggcggggtttttttttatttttaaaaaaaaa

SEQ ID NO: 22919 - DNA, 835 bp, Heterodera glycines
  misc_feature (5)..(5): n is a, c, g, or t
aattntcggttaaatcttcgtaactttttgaaaaaaacttgagtgagggggagaggaatttgaggaattctctcatctctccaaaatgaaaaaatgaacatttctaaaattaaaaaaatggaaaattgttcccgacgatgtcccaaattccttaaaatttattattttttcgtcaaaatttgatgcaaagcccattcaaaaagcggttttttttcctttcgctaaaattccatttttttgggccacaaattttcttaattttttttttcaaaaatgactcaaaagtcgccttttcaaaactttatgaatacatgccctcatcttcccgtgccataggtgcactgttttacgacccggcaaccgaccaaattgtggccgacggcacgacgacggcacaatttgaggcgcctgcggcggcagcgaacccacggcaaaaccctttggcggcacaccctgtgctaaatgccatcgagcatttgtccgccaaccaacggcagacaacggcacggacagatggacgagaagaggaaggcgaggacgaagtgcccggggcagaattttcggcacaatatttggcaactggtgaaaaaaaatgaaaaatttttaaaatttaaccctcctctttttgttttgccaggattttatgccattttggcgatggaaccgtgcacaatgtgtgagtttattgtttgttttttgcggcggaggtgtaccggggaaagaaatttttgaaaaacaggcttacaaagcaacatcccgaactggtcaccgcccaaatcacttttatctgtagagcataatcaaatttcctattgtaaattttgggtttttggtg

SEQ ID NO: 22920 - DNA, 1606 bp, Heterodera glycines
agtcgatagaataatgtagcgtaagggaagtcggcaaattagattcgtcacttcgggaaaagaattgtctctaaaggtcgggtcagccgggctgttgcgtgaaacaggcggcttttgcccgtggctgcgtgctgttctttcggggatggtgcgtggactagtggtgagagctccctccccccctctcgcaacccaaaaagtaaagacttttcagtcaattcttttgaaattttaggtaactttcttaacataattgcattaaaatgctcaaaaatgttcccgtcggcgcctatcggcaccgccggacccctaaaatacacttctaaaaattgacttaaaaaagaaaaatacacccttaaaaatcgactttttgacttcagccccacccccccccccaaagccaagggtctggctacgcccttgcacataccctctcattgacagtcatgttagtagtggcagcggaagaacagaacaacgtgcaaaacaacaacagggagaactgagaaaaaaccgtttttaatatgtacttgcaacgaatattcacaacaaatttccgtaaattcaatttcgttattcattcttttttcgctcacaaaatttttgcatccaacgcttgtcttcggcccaccaccgcgtgcgaccgtcatgttgtcctcctggcactgcttggactccacctgggccaagctgatacaaatcaggcggtcgccctgtccatcttcgttgtccaacgggaacgaaacgggcacacactgtttgatgtatcggtgatcaaatggttcatagatgaagcgcttgaagcaaatgatctgtggaagaggcaaaaaagggggataactaatcgatgatcaatcaataagtgatcaatgatcaccaaaatgtcgggcaattgagtgaacatcagctgcttgacaagcgttggtggcgcagacggcggtggcgttgcgttgctgcactgtgcacagcgtgagccttcaatgtcttccggtttgatgaaatccgcgagacaatggttgatggagatcagcggcacatccatgggcagttgaccagcgtccgacgctcccataatgtaatgcgattcatcagtgaagcgctaaaaaaagcggcaaagtgtcaaatggggttagggttgtcctcctggtactgcttgaactccacctgggccaggctgatacaaatcatgcggtcgccctgtccatcttcgtccttgtccttgaacaatcgcatgaagcaccaaatgtcaattttgtcgagcggaatgtcgcgcagcgtcttctcgtcggatggttcatcatcgtcgtcctcgtcgaaatcgtcttcatcctcgtcatcattttcttcttcgttttcggaggaatcggcgtttcttgtcgttgcgtcgttgaacatttgtgaaaattcttcctgtaaaaaaaggggtgggaattaattgcatatatcaattaaaaaatgaaaattcgctattttaattgaatttgggtccgcgcttttttcataaattatcatttaaattttccgccttcaaaatggactcaaaaaaacggacaaaatctcaacaaaaatttgtgccgaaaattgaattggtttggtgatggctgta

SEQ ID NO: 22921 - DNA, 1770 bp, Heterodera glycines
cgatgtgttcattcattggtggagcgaatcatacaatcctcccaagcggcagaacaaagaggagggcagaaagggtaaatctttaatttaaaataaataattaacggaccgaaattttgcatactttaaaaaggcgaaaaaattttaacggaccataagcttttacaattttgatcagttacaaattttaaatgaacatatttaattagctgaccaatgccaattattttgaattttcattttctattattcaattggatacatttgtttagcagaggaaaagcagcagaaggaaagtgttggtcaacagaacaaaaacaccgaacagaaattggatggaaaatatgccgtggtggacaaaaacaatgttttgggtgggcacaattggcaaattatttaaaattaaaaattggcgttataaaaaaaatgcattttttgagagaggacaaaaccctcgtattatatcgggattttatacatatttggtacatatttcggacttttttcttacatattttcatttttttacatatttgaggattttttacggaaatttttggaaattctcaaaaaaaatccaaaaatttcggcaaatttttcattttttttacatagctattctgagaatttttgaaaatttttagaaatttcttgtgaaaaaattaaaaaatctttttttaaatgtacccctccaaaaataatttttaaatgttaaaaggtgattttaaacattttggtcattttatggcattttgtgcctatttaacactttatgaaaaaaaattttccaaaaaataacaatttaaaaaaattttatttacatattttcgtacatattttgggcttttatacatatttcttacatatttcgggatttttttttacatatttatgtacatatatgaccactttttgtacatattttttacagccctaattataaatatttaggtgttaaaaaattaatttttctttttaaaatgtatttattgctaatttagttgctttagtgacgtcatcgggcgaccattcgccgccggcggttgtctcagcgaaagttgcaaaggtgggaaggaaaccttaattatttcacaaatgccatttaatttcaggaagtgcctaattcgcagcaacaaaatgattgggatgccaaagtttgccacaaagacatcgaaatcattggggaaaagcaattgacgatcaattgcaagggcaacagatttggtatttaatataaaaattaaaaaatgtaattaattaattactttcttaattaggatggcactctgtttttgcgaaatttccaattacgaacttttgtcgtcccggaattttctacttcgaaatgaaagtgttcaaattgaaaaggtgttcattttgatgatttcttagcgttttatttataattttgaatttattttaacagttttgctgcgattggattcgccacgaaggaagtgccattggacgggtcaattggtcaaattttgaacagttacgggtaccgaagcgatggctcatttggctgtaatggcatcactcggccgtgcaaaatgccaatgtcattatttggttcgtcattttcccccgtggcaatgcaatcggcggacgtggaaatggcatacaaatcatcggagttttccactggtgacgtggtcggatgtggcattttcttggatactcgactgatcttcttgacgaagaatggccaacgaatgggtgggccaaattaaaatgaaaaaacaaattaattaaaatttaatttttaag

SEQ ID NO: 22922 - DNA, 1403 bp, Heterodera glycines
  misc_feature (12)..(12): n is a, c, g, or t
  misc_feature (104)..(104): n is a, c, g, or t
  misc_feature (1288)..(1288): n is a, c, g, or t
tttattaatttntggttttctatattaattaaatgaaaattaactgagtttccattattttaattttattcatcatggactattatctcattttgacatatagngtaaatattttcttatcttatatatttacataattaataatttaattttatctcgagatttaagaaatatttttaaatatctaacgtaaataaatgtatttcaaaatatcttcaatgattttttattaaatttttgtaatttcatctcaattataaagctcaactaataagtttcagaagtgcaaaattccattttttcatcaataaaaatattttagatggcttaattagtatcagagattaatatcaaatgttaactgttccttttttaatttataagtattaaaattttacatcaattcatgagagatatttttgagatttttttttagaattttgttgaaaagttcaaagattgattccataaatttaaaagattttttaactcgttttcttaaattttttattaaatataagtatacttataaactcttggccatgtacgtccaaattcttaattccgagaatttgtatattataatatttttcatacataatatttaatataatcatttttaaaatattttttattaattttttttttgattttaattttattacttttatattttatgttcaaatttagtattctctcgacgtggtcaaaaaattgaaagcggtctagacttgaattcttaattcagtcgtaatcaagaataaacatttaaatgtattcgataatctgccctctagaatttttttcataaattatttttataattttataccatttaaatgttgacatattggaatataaaggcatatatttattgcttattttttgttttttttataaatttaccattaaattaatttttaactatttatttttcatttttggctttattatgtttaatattaattctttaaatatgaatatatttttatatgttagtaattaaaaatatgttttttctttattttttttacggaatagcctctcttttcgcaaattttcactattcttctattaaatttttataatttacatttaaaatttacggaggcaattggacggagcggcgcaattgaacgagtgcggacaagaacgaaggacgaatggcgaaagtggagagaaatgcagcaacgacgaaatttgtaaccggaggaaatttggcaatttccaaaatgtctcgtctctgatttttgctcattgaattctccatttaaataaaaaattttanaattattttaatataaatataacatttctttttattatcacactttcttcctcatgaacagttttttcatttttatcatctatattacaaatttaaagttttttcaattttttga

SEQ ID NO: 22923 - DNA, 1533 bp, Heterodera glycines
  misc_feature (53)..(53): n is a, c, g, or t
  misc_feature (1507)..(1507): n is a, c, g, or t
gtaaaaaaagacattaacaaagcgtaagaaataaattttaaaatgcaaaaagngcagggttctgagctgttctgatttatcagaaatgttcagatttgggtaatggccaaattttgttctgatttcatcataactttgaaatttatggcataatgtcattcttttatcaagaaatttcaggtttgacgcaaaatttggaaattttttgtgcaaaaacctgttaaaaaattggccaaaatttcaacaaaaaaaaaatttgacgcgtctattcgcaccgccagaccctaaaatccttttttttattaaaaaatgactcaaaatcacaaaatttgaacaaaaaacgatttttttagctcaattctgctgaaatattctatttgcttatttcctccccaaaattgttaaaaccgataatgggaggcgattacctaatatctaaaacagtaaaaataactaatttgaagcaattttgcaaaatgttttggtttttgaccccaaaatctgattttttgagccctacgttctcatttttaaaaattttcgatccgaacccgaaatgaaaaaattatgtggcctcaaaaatcgaaattttgattgtattttcacttacaaaatttttcatgtttcacaggtcaaaacatttcatttaaataaataactggactgtgctgcgctgcgctgcggatactatccttgaatttggtacattaacgggattaaatttgaatcgaagatcccaaatgggtaaactgtggcttgtgataaagaacttcgcattaatttttaaaacaattatttttaagtcaaaaatgaatttatatatttttttataaattgctgcccgctctttcataaattgtttcatagtttcccaatttgatttaatgggcaaataatattttttaaataaaacgacttcacttgatatttaatataagctcttcgaattaacttaattctgacataattgttaagaagcatataaattcaagtaaaatttagctttttcattatcttatcttatcatataataaattgttttgattattatttttgatcaatgtttttgaatatatgtatttagaaacgattacattaaaatttcttagaagattttttgcttcactatgtaaaattagaaattttctttattggaataatataaaaaatagtttttctaatatgcaaatacttcaaaatcatatatttgccatatatcatttctgttttttaatcttgtaattactagattttatcttgttgatatggtggaaaattttgtcaatttgatcgtgagaaaaaaaattactttattcaagatactgccttatttaattaaagtttatttatttgttttcttttgttattctaatttattgttgattgattgtcattcatttaattgtacaaaaattgccacatttaaaatgatttgtaaaataaaatttagaaagacaaaaaagaattttaaatattattagtttcacttttacattgttgttccaanttaatatatattttactatatatgct

SEQ ID NO: 22924 - DNA, 875 bp, Heterodera glycines
  misc_feature (431)..(431): n is a, c, g, or t
ggggggggggatttttagatttttagttattttttctgcggtttataattctatgagaaaagacgaaacacatttttaacacaaaaattcttcatttaacgcccctatcttttctgcaagaaaaacaaacgattttttgctttttattcaaaaaaagatgaaattaatgtatgtatattgtcattaaaattgttgaaaagtttttacatcgattttaattttgaaaaaagcacatattttaattttttaacccctatctcgcgattttgattgaatatcaatcgattctaatttagaaaaattgttgggtcaatcttataaattttttgctgagcggcgcaaatttcgcggcgcaattgtcttttttgctgagcggcgcaagtctcgcggcgcaaatagtgcggcgcaaatgtccgcggcacaaaagtcgngctaacccattcactccctcttcctctcccctcacactcattcattcgttctctctttcagtgcgccaattgtgccatccatcacttttctctcaaattaggtatcatcacaataaaaagtcttcgccccgtcatcacttcactctcacttattctgtctctatttttgatcaaatgaattgcgccgccaccgattaaaaagtgatccgtcttttgtggggtcatctgattgagtgagtcagtgagtgagaacaacagacggacggacagatgggaaagtggtcgaaaattgtggctgaatcgaactcaaactaatgaaaaaataatggtatgaacaataatggtaattaggctcattaaatggtataattagcgaaaataatgaatgactccgaagaggggggaacactctgtggaggtcaaaccagtttaagtggggggggg

SEQ ID NO: 22925 - DNA, 1587 bp, Heterodera glycines
tggtggtggttgcggcggagggtgcggtggtggaggcggttgtggtggagggtgcggtggattcagtggacttggattgtttggcggcggaggtggaggcggttgcggaggagggtgtggcggcggtggtggtggttgcggcggagggtgcggcggtggaggcggttgtggtggtggaggcggtttcggagggtgtagtggtggaggcggatgtgtaggtggctgtggaggcggatgcggttgcggaggcgggtgtggtggtggaggaggatgcagtggagggtgcggtgatggaggcggttgcggaggttgtggcagcggaggtggatgtggcggtgggtgtggtggttgcggatgcggttgcggcggagggtgcggtagtggaggcggctgcggagggggatgtggagacggttgtggagggggatgtgggagcggttgtggaggaggttgtagtggtggctgtgatgttggaagcggctgtagtggtggttgcggtggtgggggagacgtctcaaacattgaaggttgctttttaaataaagctgcttaataaatgcaaaaaaatgctttaggacgcagcgatggaactgagcccaaatacgttgttgtctcaccggaaaaaagttccaattctgctgcaggtggagaaaaggaagcggaaggtgaacaagcacaagtaccagctgagcaacagccattaccaggtatttttgcaaaagcgccatatgaagtttcattaatgtgattaaatcagttgcgccagccgcggcggaagctgcttcagccgaaaacgcaccgaccgaaaatgcagcagctgtaccatcctcaggatattctggtggtgaaccggcacaggctcaagctgtagcagtacaaacagtagaacagcagcaagccgcttcagaatccgaacccactggttaaaattgatgttttctcgcttaaaaacattccgagactttaagccattggcacatccaacggcaacaacgagattaacgatgcaaacagcagcagcactgatcagcaaagcgatactgctgatcagccaaagcaacaacaaatggtggaacaaatacaatcgaagcagcggcaacgggtgcacgcgtcaaaggcactgacgccggcgcccggcacatggggatcaatgtgcaacagtgccgagttgcgacaaatgatggacagtcaaatggtgccgggcaatgccaacgcgtcaaagcgacgcatctatgaactgctcaaccgcaagcagttcacggaaggcgtcggcggtgcgcaacggttgctggacgtgatctgcgcgaacagcatgttcagctaccgaattgcaaccgatctgttttgtgagcacacaaaagcaaacgtcacttgttttgtgtaccaacaacagccgtagggaaagagcaatgagcgatgaaaaaaaataatggagttttattttatttattattgcgtatttaatataaatttgttttttgccaaaaaaatagtcgagaatgttaattgtactttaaagagtttaactcaaatgaattgtattgtcatgattctcccgttaaaaaactcgaaattgtagcatctaca

SEQ ID NO: 22926 - DNA, 1800 bp, Heterodera glycines
  misc_feature (1776)..(1776): n is a, c, g, or t
gcacggcaaacattaatgccaatccttccttctcaatctgggcataattgttctccgcagcattgagggatttggatgcgtgtgcaatggcctttatcgttccgtctgggaaacgatgtgcaatgactgctccgatcccatgttcagatgcatcggccgaaacgatgatctccaatttcgggtcataatgtgtgagcagcaaattcgatgttaaaatttacttcaatttttcaaatgctttgcggcaattttctacccaattcgattccgcgtccttcttcagcatgtcgtcgagcggttttctgacgaaccgcatgttttgcacaaattgctggtaatggtttaccattcccagaaaggaccgcaatgtagaaagattcgttggcgcaggcatttcagtaattgccttaatctttgatgcgtccggcctgcgtccgtttttgtcgatgacgaatccaaggtacttaatttcctcatggaaaaatgagcacttcgtcattttgacacggaatccgtatgactgcagccggttgaacacatcttttaaatgctgaatgtgatcagtgaatgatcggcttgcgacgataatatcgtccaaataagccgtggcaaaattcaagcctgcgagcattttgtccataatagactgaaaaatgcttggcgccgattttacgccgaacggtaaacgttccatggcgaaattgcctttgtgtgttgaaagtccgcacaatttcttcgagtcctcatccaattccacctggaagtacgcgtctttgaggtcaatctgcgaaaagaattgtcctccatttaacgtcgcaaaaatatcttcaggaattgggagcgggtgttggtagtcgattaatgcatcattcaaccctgttgaataatcgatgcaaaggcgggcattcccatccgcctttttcaccaccaaaatgggtgcggcccaatccaaatgttcgacttttcgaatgattccgaggccttccagccggtccaattcacgttcgatgacttcttttgaatgatgcggcaccggtctggcctttcggtaaattggcgcgactccttccttcagtttgagttgtgccttttctttgatgcaatggcctagtgcatcttcgaaaacacccggaaattctttccttaattccaaaatgtgctttccaatttgatcggtggctctgcaggaatttatcacatgctcgctgatccgctgcttaatgccatccaaaaatccaaatttgtccattgtttggcggctcaacaaattaagcgaaccacgcttggccacgtaaaatggttcattttcgatcaaaattcctccaaattcaaatgtgccgaagccttttccgatgaaccgaattggcgttccatcgaaggctcttccaatttctctgcacttttcgatcggtgggctcccagcctccacatgtgagtcttcatcaatgacattcacatccgatccagtgtcgagtgcaaatgcgattggcttttggttgaaccgaattttggtcctcagcgaatttgcctcgttcttcggatttaccataccgatttgcaaatgtccaattcgtttgtttccaaacctttttcctttgttcttcaaacgccattgctgcacattttcacattgcttctcaatgtgccctgtgaatttgcactttcggcatttcgctccaatgaatcggcattcgctgccccaatgatcggcagctccacaacggcagcaattcttgttcgcctgccgtttctctggcactttggcaacttgcattnttcgcgaattgttttgctttaccg

SEQ ID NO: 22927 - DNA, 2129 bp, Heterodera glycines
tgagggtataaaatggacatgacaaggttaagccagtcaccgatcttccaattccaaatacgaagaaagaattgcattcccttcttggtttcttcacatattacagaaagtttatttttggatttggagccttagctgcaccgctttttcggcttctgaaaaaagacgtaaaatttgagatgggagacattgagttgggggcgattagtacactaaaaaaaagtatagtggaacacgcagtgttgtattttcctgattttaaagcggcggttggggacccgaaacggcaatttgttatgctaaccgatgcaagcaaaattggtttgtcggctattctttgccaatcagacgaattgggtcagctaagaccaatttactttgcgtcaagacagtgcaatcagcatgaatctcgttattgccccaccgagctcgaagcattagcaatccgattcggtaccaaaaaatatgctcagtttatcacaatgataccaacaagagtgataactgatcaccgtgcacttgtccctatgtttaagagcaaaaaagagacgggtaatagccgagttgataagtggctgctagcaatgaattcccgttttattctacaagtcgaataccaaccaggcaaaatgaatataatccggatcttttgtcccggtcaaaaacgctgttaaaatcggagaatgctgaaaactgaagagtctgacaaaatcgcatttataggccaaattagagaaatacagttagcggaacacgccaaagaaattgaaaatgagcatagaaaagactgggcccaaaaatcaaagaaaagtgaattagggtttgtttatgattttttggataaacgtgtcttgccgaatgatattcgtgaccgccaaaaattgatgtcttatctacacaattataccttaatcgagggattgcttttccgaagtggcaaggaggggaaactacaattgttcgtaccacgagaattccgtgaaaagatgataagagagagacactccggtacttgtgctggacacctcagcggaattaaaatttttcgacaactatccgagctttacttttggccaaatatgttcggagattgcataagagcagcacttcgatgtcgagtttgcgcacacgctcgcaaaccacggtcaaatgctccgtcctttaaatgcaattgagacttcagaaccgttagagttggtatgtatcaacattttgtcaattgggccagcaaattcgtcgaaccattatattttggttacgattgaccatttttcaaaatatttggttgtgaatcccattccgaacaaaaacgctgaaaccgtggcacaaaattttgtaaaaaatttcattttagtgctaggggcgccaaaaaagattcatagcgacaaaggcaaggaatttgtaaacgaaacactgactgaaatttcaaaagttcttaaaattgaaaaatcgaccacttcgggttacgaccctcaggctaatggtgttacagaacgtgcaaatcaaacgattttgggaatgcttaggcgttcgacttattctgcctgggagtgggatgaaagacttccattcattgtttttgcttacaattcaaccccatcagaaattacgaaaaaacgactgagagaagtgtttttcaattgagggcaattgattttttaggcggtacggacgaagcaatggaaaccgaacagcagaaaggaaaggcaaacattgaggaggacacaatttatgtgctgggagaagatgaagccgaaacgccaaaagtgatttcctggagcacgtgttgcactggtgatcagcacaaagactgcgcggaccttttaatggctgatctggatgctgttttggaccgttctggaatggggcttctcaaaatcgacaatccgctgaaggccctgctcgccaatttcctgctcaagtcagaagcggtgaaatcaggatcggccggaaagaagctgattttgcaaattttggaggcagaagtcagttgggagttagccacttactgcagttcgagagaagacgacgtaaaaagtggcgcatttccgtcggaatcggacgtggaaaagacattggaagtgtgggcacgagcactgccaaatcgtgaatgaggaattgaaaatgac

SEQ ID NO: 22928 - DNA, 1406 bp, Heterodera glycines
tgttccttcattcattttattttattaccccgttaaattttgtcataaccacatttcaccttgtccggctcggacatctgcaggcatttgtgctcgtgcctgagtcacagcatcccttgcgggaattggattatcggcctctgcgttttcctttagaattttttgggcatctctgacagattcgtgcttaactggatgattgtgatctcttccaacaattcgccccaatttgtaagcacgcccctgattatcgtggtgccaagctgaactgacatgcactctcccagggcaatacggggggcgattgatacagtgccaaaattcgatccctaatttggggtttggacaaaaaattccaaggtttgcaccttcttgaagtccgctgtccgcttcaaaggcatattcaaaaccgccgcttctgattaactctcggccacgcttgctttctgctcgaaaaaattggacaagaccagctggttcctctgcttcttcaaaggcttcatttgcaaagagttcggccccaatttcaccttcttcgggaccactagaaccagaagacatttttcacagcaattcaaaaatattttcagtaatagttatgaatggcatggtcactcttttttgggccggtcgagaaacggaggtcaaacaaataaattatttattattgataagaaattagtgtactgtcgaaaagtccttcactgtcgaaaagtcctttacagtcgaaaagtccgctgtcgaaaagtccttctgtcgaaaggtccgctgtcgaaaagtcctagcgccttaataaggccgtagattattattatagcgaatagactttatttttaaaacagaaaaatacaattaacaacattggaacattgccactgttcgcgtaccctcgaccgaggccgctcggcaccgaacagctttgctgttcctacacaaaaataacaatattacataaaaaaattaataacaacagaacgcataaaatacaaaattacatgatcacagaatattcggcatttgcttgcagccttcgtttggtcacaaacgaaatgcactttcattatcgtcttcttcccctccaacaccctcttcatcttcatcttcttcttcctcatcttcaccatcccaatcggcggcctcatcttcgtaccattattccttgtttgggtgcagttgttcatatttggaaaaaccaaaaatgcttaaaaaacttttgttttaattcctaacatacaataaatggctcggaattttttttaaaccacgttttggggcccggatcgacgaaatttttgtttgtttgattgtttcaaaccacttttttcacggtgcgttttttcttataatttttggatgaacaggaaaaaattgaagtttttcagcgattttaaaaaatttgaaaaaca

SEQ ID NO: 22929 - DNA, 2373 bp, Heterodera glycines
  misc_feature (15)..(15): n is a, c, g, or t
aaatgagccagcccncacattgacatctttggtcaactccttttaattataagatcaaatgtcgataactgacaagtaaacagaagctatcatgtgccaaaaattttgatcaattttaatccgatcgataacccttgatttaaatctttggctttgatcaatgattaagcattttttttgatcactcaccggttgtgcccggcttgtagatggctttgtccgtctgcacaaaaattgacacgctcttttggctgcactgaaatttcaccaattttttaatggttgaatttatatttggcatgacacaatgccaaaatgccattttttttacctgtactcgggcactgtcctcaaagatcattttcgaagtgatctgaacaattttttatgaaattttcaacaataattaatgggtgaaaattatttaattgggcggttaaatttcgccgtgattaaagcataattgattaattagttgaataattaattaattaccgtttcccctttcacataaacactgtagtcttcctcgggcaaaaagctttcttccgacaaattttccaccaccacagtttgcggcattcctgcgcatatgaaaggattggaatttttaaattttaacaaaatttcccccaccctgcttttcattttagaaattgaaaaaaacctagaaattttttatacactataagaaaattgcaagaaattttttttttagtttttcagcaatttttggaaaatctttgaaagaacttagcaatttatcataaaatttgaaaaattggtcaaaattttaaaaaaaaatttcttattaattttctatgattcatagttgaatttttgtttttaaattccgatttctaaaaccgttatgaaaattctaaaatttcgaatttttcaaattgaaggctttatcacctattgggttaggtttttggttgaaaatttatttgaaaattcgaaatttaaaaaaaaaaaattctcaccggtccgaaaattgctgaccacccgcgcggccatcgtctcatttttgctgtccctgatctccacccggacaatgtggtcgggctccgcactgcgcagaatgttcactgacacggcatagggcagcccgggccgcacaatttttggcgcgatcaccaaataggaggcggaactgtttggggaagaaaatgatcggataatggcactaatttttgtgtaaatggcacactgagaggggggggagtagtgtgccactcatacgtgacagcgatcttatacaatttctaatgatttgtcaatcaattaattgtgtagcagtggcatccgtccactaataattaataagctcgccacgcactaattgcatgacggtaacatccatcattaatgatccattcagtggcatttaattactaatgatcaattaaatggcataatattactaattaacaatgaagtggcattcaatcactaatgatcaattagctaatcaggcactcactaattgcgtggcggcggtgctatacattctctaacaatatgttaattaatgaattttcatagtgatgacatccgaccactaatgatcaattaattatgcgcgagaacactcactaattgcgcggcggtggcattggcgttgtgtccatgggaaacaatggcggcagaccaattgactccttcggtaacagcagctgttgatcagccgttgtggcggcagcggacgattgatcagctgctggcgatggcgcggacgccgctgccgcggttgggctgccgtcgtccgcaagcgttggcaacgcgggcgtcttcgttttgccgtcattattttgtgccaacaaaaatccaccgggagaatagcttatgaagaggaggagaagcggcggcaaaaagtgccaacaaattttgggacggttatactgatgccctgcgggcattttgaagaaaatttttgagacgaaaacttagggcaataaaatgaatgcgctgatctgaataattaatttacaaaagatttgtggttgatgaaaataatcagataattaaacagggaaattagtcaaaattgatagactaattaagaaaaatttaatgattattgatcggcaaattggtggtgatcaatcatcgtcaatcacttttggggctaatcgggcggggctgctgattttggaatgtgaagcgaaagagcattgaaaattctttggaatttaaaattttactctgtcccccatacccattacttatgccgaagtgttctgccccccatgcctaattaggcaaatgtatggcacaaaattatccggcacggggacggaagcggacggaagaaacatttggagaaaatggcaaattatggccgagagcaaatgagaatgaattgcacaa

SEQ ID NO: 22930 - DNA, 1541 bp, Heterodera glycines
ccctccccctccactttccgagcgccgcgaatgccgctgctgcctcctccttatgaggaacgctaccggattggcgaaacacgtcagtgcgtctggacggaccccggctggagtccgatttaaaaaatatataaaataaataaaagcaaaaagaaaaaaaaaaaaaaaaaaaaaaaaaaaaaaccttttagttaagtgccttgttttgcttttatttattatttttatgtgctcacttacattttttttatgtatgtttctacaatgttgttttgcgctttcttttgatttttctctctctccctcttcatctttctttttctatttataatttttgataacctatttccacatttatccctttagttaattctgttatggcttatttaatcgttttattttttatctttctatttgttctctatttttattcattttgtcatatcctttttaattgtttttctttttattttattttttttggccaaaaagaagaaaagaccagggacggtcttctggtcggccgggaggtgtaacgtacagtacccctgtccccccccttacacacagtaacaaaagaaggcggggattaaggatcagcatttcgctgatccttttccccgtagggaaacggaagatcagttagctcccccggtcaattacgagcaaaactccggagaaggattttcttctccgtccccgttttaactctccccagtcccttctccaccttcaggacacatttgtaacgtacagtacccctgtccccccccttacacacagtaacaaaagaaggcggggattaaggatcagcatttcgctgatccttttccccgtagggaaacggaagatcagttagctcccccggtcaattacgagcaaaactccggagaaggattttcttctccgtccccgttttaactctccccagtcccttctccaccttcaggacacatttacgattcaatttccgcaaaaaccattcccataccctccgggcactaaaggaaccgaaatccgttattcctcggtccttccttcctttttggcatcatatttatttcggaattattcagacgatcgatcaattctatttaatcaaacttcgcacactttcatttcacatttaatatttttcttttcaacaaataaattagttatggaatttggacgatttgagagagagagaggaaatggaggattaaacgaggaattaaagaatgaattaaatattaattggaaggggcaaattgggaccaaactccattccacgggacaagtttaaactcggcaattttcgtattcctatttttcgggcccacaccaacttccctttctggtagcaccggatggttgcaaattgcaacctttccatcgtctctctgaggatcggcatttcttccgttttcgccccaattttttttttctccccataattcacatttttctctccctcttctcttccatttctctctctcctcttctccttccgtcttcgtccattttctccctgtttttctctgctaattcaattccgcccg

SEQ ID NO: 22931 - DNA, 1574 bp, Heterodera glycines
  misc_feature (55)..(55): n is a, c, g, or t
  misc_feature (65)..(66): n is a, c, g, or t
  misc_feature (1536)..(1536): n is a, c, g, or t
ggtcatttcctctttcgacgaacaaggcaaaacaaaacaacctttaaaagggatncattttttgnnctgctttcagtttgccatttggtgttcggctcgtggacggtgaaaatgacaaaattaaattattcaaaaattcatttcttttttcattttagtacaacgaaaatgaaattaaaatggaatttgaacaggccgagtgagttgaaacatcgttttacatatttctctattttatacgttattttccatgttttttcagtcaattaattaaatttcccgatcccaatttgccattctctttaaaatcacaatgtttttctgcaattaatctccatttaataattcagctcgatggatctcagcgaatatgccaaaagtgtcagctcaatttgggatgtgatcggtgagcattggtcagaaattgtcaaaacattcattaattgtgcccaatttgattgtccatttttacccttttaaactttgtttcgataacttcattacagtagcaaacgatattttgaactgtagcgataccgtattcccttcagatgctcccgcttcgttggtcaaccgacggtaattcttttctttctttcactttttgccaattttcgccttttctttttgcccatttctttttgctcagttcccgcattgaataccaacttcgaattcgtcgtaaaacgttgttctacaccgttgtgctgatcattcccacgggtttgtccgatttaattggtgcaaaatgccaaaaactgaaaatacaaaaaactaaaattgaaaattccttttatttttgacagttctaatggcctttctcagcatggccgtgttctttctgccgaccgactcgggcgagaaaatgacattggtcaaatctatttgattaaatagtcaattggagggtccttagttggccaattgtcctttcccttgtccttagttggccaattgtccttgctggtgtccttagttggccaattgtccttgcaggtgtccttagttggccaattgtccttgcaggtgtccttagttggccaattgtccttgcaggtgtccttagttggccaattgtcctttcccttgtccttagttggccaattgtccttgcccttgtccttagttggccaattgtccttgcccttgtccttagttggcaaattgtccttgctggtgtccttagttggccaattgtccttgcaggtgtccttagttggtcaattgtccttgctggtgtccttagttggccaattgtccttgctggtgtccttagttggctaattgtctttgctggtgtccttagttggccaattgtccttgctggtgtccttagttggccaattgtccttgcaggtgtccttagttggccaattgtccttgcaggtgtccttagttggccaattgtccttgctggtgtccttagttggccaattgtccttgctggtgtccttagttggctaattgtctttgctggtgtccttagttggccaattgtccttgctggtgtccttagttggccaattgtccttgcangtgtccttagttggccaattgtccttgctggtgtcctt

SEQ ID NO: 22932 - DNA, 993 bp, Heterodera glycines
ttatgcttgcgcggcacattagtgtcgcttgagggcatgttggacaacagaagcatcatcaacagcagcatgggatgaagtgccgatgtgtgatggtggttcttctgccgccgatgaatgcttctcctcctgcgacggcaacgcttatggagaagccaacaaaaaatgctggacgatattgggggcaacattgatggagttgtgaagtttttcgcttgcacaaaaaaatggtagaaatattttaaataattggcgtttcgttccgttgaatttgtcgttgtaaaaatttgaagaggagaggagcgtagtgttgctggaactgtttcggcactgtgccagaagggacgaaagaacataaaagtggtttttttgttggcaattcttttgcgcgtgtgctggctgatttgatgatgaactattttttgacgtcgtttacacgttatgctggtgatgactgtgctcggcttcttgctgctgctgctgctgccagccggtgatcgttgagttttctaccagccgccgttgctttttccgcctctgcttcttcgtcttcttaagtggtgatggtagggggggggggggggttcgccaccactgctgctgagggcacaaaaaggctgatgatgaagcgacgagcgaagaggctaactgcttcttctgctgctggataggcaaacaaaaaatcttgcagaatggagtttgaatggctgatgatgaagctgcatattgacttggggacgaccggggacagggggggcaggggagacgggaaaagcggcgttgagtttttggagagattgaattttgaagaaatttgacggaacgggacgaagagagggggaagcggtgggggagggggtgaagagctgaggatgaagtgcaaaaatttaggacgagacgaacaccaaattgttgttgtgtgtcccgcgtccgcgttgttcttccttccccctcccacgacggcgtcgtcctcttatttaggggggggggggg

SEQ ID NO: 22933 - DNA, 1180 bp, Heterodera glycines
  misc_feature (1162)..(1162): n is a, c, g, or t
gcagcagttgaccatttttacccactatttttctctcactcatcgtctgctcgtctctcctttattataagctattttcctaagccaacgcccttttctccctcttttctgttagtcatttctcattggtgttgacgatccaacattcagtgtacaaatttgttaaacctctcaacattttaaatcaaaatcctaataaaaatttcgttgaatttctccgcctcttatttgtgcaaaattttcgaaaaagtaattttctatttaaaattaaaaaattcagaagcaaattcaagaatttttttatttttaaatgcattttttaccacatgaattatgattaaatttttgcgtttcgaattcattttggaattaagaaaaataaaaattgataatcatttgatcatttttagcgcactttaagcaccgccgttaggcagcgcagttccaaaatttattccatgccacagatattatgggcaggacacgccaagtacctcaaacttgggtaattaaaccgaagaaagaagtgcagtggggaagaatgacgcccaaaatgaaggaaatattcgatgctgtgcgaactctttgtgacccctctctgactctgccaatgcagcagttgaccatttttaccactatttttctctcactcatcgtctgctcgtctctcctttattataagctattttcctaagccaacgcccttttctccctcttttctgttagtcatttctcattggtgttgacgatccaacattcagtgtacaaatttgttaaacctctcaacattttaaatcaaaatcctaataaaaatttcgttgaatttcttcgcctcttatttgtgcaaaattttcgaaaaagtaattttctatttaaaattaaaaaattcagaagcaaattcaagaatttttttatttttaaatgcattttttaccacatgaattatgattaaatttttgcgtttcgaattcattttggaattaagaaaaataaaaattgataatcatttgatcatttttagcgcactttaagcaccgccgttaggcagcgcagttccaaaatttattccatgccacagatattatgggcaggacacgccaagtacctcaaacttgggtaattaaaccgaagaaagaagtgcagtggggaagaatgacgcctnaaaatgaaggaaatattc

SEQ ID NO: 22934 - DNA, 1060 bp, Heterodera glycines
gaaatttttccgaaaaaaaatcccaatcgatagagctcggaaaaactatgttttggaaagtgttctccgtttctgtgggaaaaaatggttaaaaaatcctaaaattcaaaaacccgaaaaccgttttttaggcctaactcgaaaatttttgaaaattttcgaaatttttaaattttgaaaaatcgagctttcaaagctctacaataagttcgctgggcacttttctctcagatcaaacgccgacgcggtattcgcctggtactgaagtgtactttttgagcacgcttcagttgccattttctgcaggccagggggtggctctattaaaaaaataaaaaataccagcatgtagaggaccctttggcggggtgccctcgcagcgggcattttttgatcagagttttagaaaaaaagttatgggccttcaaacgcaagcaaaagtgagaaattagccgccgggactcagttggccaccggagagaaaaacccgtatttttcccagatgcgcctcaaaaagttgtaagacccttccacaactttcagggcgctcccggccttcggccgggagattttgtttttgaagacgaactgcaacgtttctctatagtaatataaactagcgtgttgtggcgcagcaattgctcggtgtagacagtatgcttttggtatatatgggcgggcgctgacatgagcgcttcgcgcaaaggacttcgttgctagtgcatgcgcggttttgaaatgaatttatggatgtgataagggattttggtatataggtatcgcgaggacgcattcataattttgtggaggactttcggccgcttcgcggcctcaaagggcgctccgcaccatttttatatttaaggtttaattcggccgcttcgcggcttcaaagggcgctccgcgcctgacgcattcataattttgtggaggacattcggccgcttcgcggcctcaggacgggcgcttcgcgccattttcataattttatgtgatcattcggccgcttcgcggccggctgttaagcctcaggacgggcgcttcgcgcccgttttttaat

SEQ ID NO: 22935 - DNA, 1331 bp, Heterodera glycines
gctccaatgagcaacatacctgcttctgcacataaaaaactgagctatttcggactttttgcatctatttttacctcttagggtgataaaatttgttcgaaattatataaaaaacatttgactttatagggaagaaagaatttggagtgtacgaacaaaataccaatgataaaataatttgtcaaaatgggaatcaataatacataatatgtcagtgagatttcctgatggatttttcttttggctccgccttcaaacacccgtctttcatcgtccgcttctccgagaccgtcttggccgaacccttacaagtgaaatcatcgagcacaaggctaaaaatggtggacataggacaaataaatgcttattttatcatgaaaaacctaatacaggagcataattcttccttcgagcccttttgatattggcggcatatcatatttcccgactttactcggacaaacaagcacagtcaagatcaaagcaacgcaccccattcttaagcggaactcgctgctctcctcctccaccgtcgttcgctgcttggccaacaacaattcatgcggagcagcagcagttccgtcgtcgttgccctccctcgcgtcgtcctgcgccttcaacgccatgaacaaccgcgtcgactcggactggggctggttggcacattgcgtgtccaatttgttggcatgaagcagcggcaggaaggtgttcagccagtcgtgcatcgcttcgcgcttttcgctcgtcgtctccgcactgttcgccagagtttgcgcttcgtctccggcgttgttgtcattcgccgcttgctccactcgcttctgctccaacggtgtgccgtcgccaatgtgtcggagaccgaacagttcggcctcgcgctgcccctgtgttttttgcacatattttgttgttgataagatttaaatgatgagaaacccagcgtcttgactaaacttggaaggaatgtcttgggaactcctttcaccagggacggctgaaaatttttgattttctttgctgataccccctccaaggcctacctcacccctaatttccaaaaataccgctaaattgtcccgaaaatccacaaaattagcaattttttataggaaaatctgctgaaagtatggaaaaattctcaatttttcccaagacagggccctttttcttataaaattggctcaaaattgcaaaatttgatcattttttggactaaacctttaacaaatcgcattaaattacaaaattcggcggcccctcttgctctccaaaagtttttttggaaaaagcgccgaaaaaagtggtgtgaaaaaaaaggtcgaaagcccggg

SEQ ID NO: 22936 - DNA, 1193 bp, Heterodera glycines
  misc_feature (1139)..(1139): n is a, c, g, or t
gaaaattaatatttccgctccggtgaagaattgcgctgggccaaaagtacgggaccggaaatcttaaaaatctcactccggtaaagaattgcgctgggccaaaagtacgggaccggaaaattaatatttccgctccggtgaagaattgcgctgggccaaaagtacgggaccggaaattaatatttccgctccggtgaagaattgcgctgggccaaaagtacgggaccggaaatcttaaaaatcccgctccggtaaagaattgcgctgggccaaaagtacgggaccggaaatcttaaaaattccgctccggtgaagaattgcgctgggccaaaagtacgggaccggaaatcttaaaaattccgctctggtgaagaattgcgctgggccaaaagtacgggaccggaaatcttaaaaatcccgctccggtaaagaattgcgctgggccaaaagtacgggaccggaaatcttaaaaatcccgctccggtaaagaattgcgctgggccaaaagtacgggaccggaaatcttaaaaatcccgctccggtaaagaattgcgctgggccaaaagtacgggaccggaaaattaatatttccgctccggtgaagaattgcgctgggccaaaagtacgggaccggaaatcttaaaaattccgctctggtgaagaattgcgctgggccaaaagtacgggaccggaaatcttaaaaattccgctctggtgaagaattgcgctgggccaaaagtacgggaccggaaatcttaaaaatcccgctccggtgaagaattgcgctgggccaaaagtacgggaccgaaaatcttaaaaatcccgctctggtgaagaattgcgctgggccaaaagtacgggaccgaaaatcttaaaaatcccgctccgataaagaattgcgctgggccaaaagtacgggaccggaaaattaatatttccgctccggtgaagaattgcgctgggccaaaagtacgggaccggaaaattaatatttccgctccggtgaagaattgcgctgggccaaaagtacgggaccggaaatcttaaaaattccgttctggtgaagaattgcgctgggccaaaagtacgggaccggaaatcttaaaaattccgctctggtgaagaattgcgctgggccnaaagtacgggaccggaaatcttaaaatcccgctccggtgaagaattgcgctggg

SEQ ID NO: 22937 - DNA, 1971 bp, Heterodera glycines
  misc_feature (22)..(22): n is a, c, g, or t
  misc_feature (40)..(40): n is a, c, g, or t
ggctgcaccatttccagtcacntgctaacatcagacattnggatcccaattcggcagcttactcctgacaccatcacacaatttctaaaccgatttaacgacgttgcgcaaagcaaaaagcaggatggagtgacactttggggcgagccctttactgtgtcagtaactacagtcaaccggaatgggctgccagagaaaagacaattaaaagggggagcagcacgtaaactggcaccagttaatcacaaaatacaccaacaatgccttattaaggtgtataattttaggtttttttttttgaaaaaatatttaagatacaaaatgccgataattactgcttgttttacgcgatgcaagcaacaatggttcgcacagtcggtgccatgacacgtcaacatttttacgattatctgcatggaatcaagacaatgatagggaagctgcagagagaaacaacagaaatgatgaatgctgtaaatgcgccgctcaacctcctcaattatgatgcagaaatttatgttccgcgaatcatcgattggtggaatgacgaaaaatttgcgaggcagtggaaattcaaggcgtttattttcggatcagcagggcattacaagccattgtttaaatatggggcggatgactacgatgtgtcaattctgttgtactttgatgagggacactttaatggcgtgcagaaaaatggcaatttgtttggaaagccgtattgcttgagttgtgaagggacttatgatcgaccaaaacggcactccaaaagttgcaaagcccgctgcataaaatggtataaaaaatgtaataacaaaaaatccctattttattagctcacaaatgggaccaattttcccatgtaagccaatcgatgggtttcgtcaaaaatgcagcgactgcaacaaaatgttcttcaaccaagcctgctaccaacaccatctttcgttaaacttttgtaaaacgagcaaggaatgcaaacattgcggtgtggtgtgggacttgaacaacaatacaaaaaatggaagagaggtaggttttgttttttcatcaaatttttttgctttaaggaattgttttttttaagggtcacaaatgcaacgaaagatggtgtgaaaattgtcaaatttttcatgaatttgagcgaggctgctttataagaccgcttgaaccgaaccacaagaaggaaacaatgggatggcgtctggttacttttgacttggaaacacacaacacacgcctatcgacccggattttccgaaaaaaacggaagcatcaagtcaatttcatgaccgcaaaagtcgcgtgtccggattgtatttcatcagggagatggaaagagagtttgcgtggcaaattctgcaacgtttgtggctatcaccgaacagtcacattcagccagatgccttttcatgagacaacagtcgacaaacaaaatattgaccgtcaccctttggttgcatttgtgaaatggatactttacaagctgccaaaacaatacgacactattgcttactcacattttggagggcgattcgacatggtcttggtctttcgagaattattattggaaggattcaacccttcaatgattaaaaagggaaatcgattgttttagataaaacaagttttttttttattgattaacgtaaataatcgtgtatttgtaggtgaaaagcaggaaaaagatgaacccaaatgtgactttccgagactcatggaacttgattccggggccctgggcatcgatggtcccaattggtcgggttttgaatgtgcaggacaagcccttttttcctcacctggcaaaccggcctgaaaaattacggatgcgatctcttccctacaaagctgactacttggcagacggaatgaacatcgcaaagagaaaagaattcgacaaatggtatccagagaacagaaatgcaccctttctgcttgatgaatcattggccaggtaaaaaaagtaaa

SEQ ID NO: 22938 - DNA, 1101 bp, Heterodera glycines
  misc_feature (76)..(76): n is a, c, g, or t
aaaaaaagtaaaaatttttaaaataaacaccattttagctactgcaaaaatgatgtcgatattttgatggctggtntaattgctttccgctctgaatttttggagatgacaaaaagatccgccggggcagatggaaaagctgatcgggctgcatacaccactccacacaacggaattgatccaatacggcactgtattactatcgcttcagcatgtatgcggcattttcggacaaaccacttgaaaccagcacacttggctctcgtaccagaaaagggatatgacagtttcggggataatcaaagcgatttggcactcaattttatggagtggtatgcggaaaagtttgatgttcaaattcaaaatgcatattcagccaatggcgaaaaaaggtagaatttgtcgaaaatacaaaaaatgggcactaattttaagggttggaaatttccgtcttgatggatggattgaatctcagcaaaaggggctcgagatccatgggtgcatttggcacgcatgttccaactgttatccggatgataacgaagtgctgccttgcggcaaaacagcagggcgaattcgcgagaaaaacaaacgacgaatggaaatcattttggaacaagtcccaaacgttgagattttttggcaatgcgagattgagacaatgttggcaaaggacaagcaaatgaggaaaaaattcgacgaatataccggtgacgggggaccaatcgatatccgggcatcattcatgggaggaagaactggggctctgaagctttttcacgaggcagcggaagggcagaaaatcagctattatgacgtcacaagcctctaccctttcataaagtctattaattttcgttttttcctttatcaattttttcagttttacaacggattacccaattggtcatcccactcttcacgtcccgtgtgaagaagttgattggcgacggccagaggacaatccatacccattggccattctcaaagtgttcgtcattccgccccgaaaaattgatgtgccagttttgccggtcaaagttgatgatcgattattaatgacgctgtgtatgaaatgctgcaaaaaattccccgaatggt

SEQ ID NO: 22939 - DNA, 1948 bp, Heterodera glycines
cggcaaatggtgaactcggccaaagagcggagagattcttttgtcagctgatttgacatggcttttaacgaagtgttcgctgccggaagacggtgaataagccagcggagcaaatttgttgacgatttgcacaaagtcgaaaggtgaaggaccaaaaagcgacgaacaagggcaagaaattttgagcggccgtggagaacaaagagcaaatgaaagagcagggcagggaccagcaatagatgattggccatcgacaagggcaacagagaatagggcaaaaagaagggcaccagcatagatccgtagaacgagggggccagagatcgtgagttcgcggccaacaccgatgcggtattcctccgcggcacctcgactcgttgaatcaccatggggcataacgttgatcaccaattctcgggaccggggcggatggtcagttctgtcccagagctcgaagtgagacgggcgggggcggggaagagggcgtgtggacaagccccgtggtgtagaaacttggtcaggggccacgactcggatcatttcgatggggaaaaaatcatggtgtccattcccgccgggctccatcaggcatggagcagaggggtggcgaagagtgatgccatgtcgagagcggtacagctcggagacagttgggccacgggcacttccattgtaggcaccgagacgattcgcaccacttcggctcagctcagatccgtgaagtcgcacatttcgctcacgtgggtgcagatgcctcgtcttgagttcgtagccgcgttcatgcagtccttcaacgattgttcgggcctcgttccaacggctcagcgatgtggtcacggcaagaccaaagcgttccacctcgatgttcattgtgttggcgaggaaagagagcagtgtggccattggaaaaggagggaattgggcttgggtttgaatgtggaaggccgattcgggaatttgtaggaatggtgaatggactggcacagagacggcttttatagcgaagtcaattggcgatttttggtttttggcgagatgaatggtcccgatttgtgcatcaaaaatgtcgagagtctcagtcacacgtcttgacaccgaagaatggccttaaaactgcagctttggtgctgaattttgaatgctgagtagatggctcagccctcccgctgcagaagaatcagtcgtaggccaaagagcaaggaacaaaaggacgattcggcttatggctctccaagatcgaagggcagggttgcaacgcaaaaggacatagacgatgaagagggccagagtgatgattccaatggttcgaagagcattttgtagcccgaagaagtaccaaaagacatcggaaaagtcgaagttccaatctgggcaccaaattaggcatgagttgctgggtttggccttcgaggcaaatgagcttccttcattaggtgtttggaagtgttttggcacatagcggagatgaccattaatcacgaatgggttccgtcctccactgcattcaatggtacaattgatgtcgacctcggcacggttgaatgacaggctggcattcaaaacttctggtgttttgtggcagagggctgtgaattctgtgccatccgaacaacgaacgtagccaagtgcggagccaaagtcggtgtggcattgcaaatggagataagctccattgtggcacgaatagcatccgaaaagacccttggacatggcatggcattttgttaggtcctcttccgtggcgattcgaagcccctcgaattgaatggacaactgaattggcgcgtaggtgatttcggcaaaaatatcccgcttttcgtttcgaataagcaagtttttgagctgaattggcaggcgcttctcaggatcggcgagtgctggttcaagtttgatatctcggcattggcaatagatttttgctgaatcgtggtcaggcaggcacatcgga

SEQ ID NO: 22940 - DNA, 1191 bp, Heterodera glycines
  misc_feature (1172)..(1172): n is a, c, g, or t
cgtgtcacgacatttgcgcctttgtacaaaatcgggtttaaaattaagtttttttcaatccctaatcgcctaaacagctttaaataagcgattgaaaatgattgtatccgatcatttgatcgtcaatgaatttttgaaaaaataataaattttcaaataacaaaataatgcccttaataaactagaagactaggttttcttaattatgatgctgcttaggctatcagtggcttgaataaattcatctttgaatccgattttggacattggcgcaaaagtcgaaatttcaatgaatatcgaaaaaaatgttctaataacccttaaaatttgcaatattggtggttttaacatctatcaaagaatcagctgagtttttgattatttttcaaaaattgtttgaatttttaaggcactaaaaaactacagaactttatgtataaaaaattcggaactttaatattgtataatcagctccatccctgtcgtaaatcataaaatactaaaaataattatttatttttttcttttttttaccgtcataaagcacatcgatggcattgtttccgttcactgcgttcaaattgtccgtataaataaagttcaacatcgttttaaacgcttcaatgtccacgtccgggatttcaatagggttttcatcctcttctgacaatattaaaaatttatattaaaaaataaaattattataaattattttttcaacttttttgctcatcaaatcgaaacattgcgtcgaacacatcggatgaaaccctcaaaatcggtttatgcgctggcaaaagctttaaaataaattataaaattaaaacaaaagatataattaatgcattaaaattagagaccgaaatttcaaatttgcaggtccaactcaaatttttttacgggacggattcccgcgggattaaccccgcattttacaaaaaatgcgggattacgaactgggatcccgcaaaatcacgcgtttctctaaaaatttgtttaatttgaaaatttccttataaatttaaattttttggaaaattagaggtggatttttttccgcatttttttggtaattgcgcgattaatccacaaatccgtccggcaaaaattttgaattccccaatccacctgattcgattttttccgacttgacttttcggtcttatgtatanaattttcagtatccgaact

SEQ ID NO: 22941 - DNA, 753 bp, Heterodera glycines
caatattctgagtgttaaaataatgtaaattattaaaaaaaaaaactcactactccaacaccagaaccacctcgttggggttctcaaagagttcaacgagttcgaccactccgtcatggccagacaccgaccgaagaatgtccacctgaaaggtataatattaagtgatttaaatttattattcgataaaaataggaaaaagcaattaaaaattgcaaatggacgacaaaattatttcatataaattaaaagaaaatatttgtaaaaaatattttcatgtttctattcgttcaaataatctttaattttgttatcatttgtgtcattcatctcagttgcctcccaattcttccatacatctttaatggaaattaataaaaaaaattggttcgatcgatttcttctcgacaaaaattggaatggctacgatacccctaagtaccgtatccaaaccgatctgtgttaagaggaatttatcgttctcgatgttcagactaaatgcttaaaggaactgatcgcaaaacacctcgcgttcgatgtgtgccctgagcacgccctgccgacgtctgctttggttccgaaattttttgatgaatttggcggcgtaaagagtgtccgtggcgatgtgccgaactcggcggacaacggcgaattggccactgccaatttcatccaaaatttcgtagtgctgctcaaacggcgtttcgttgatggacaatgagtgcatctgctgctaatgggttctaaaagaag

SEQ ID NO: 22942 - DNA, 965 bp, Heterodera glycines
  misc_feature (946)..(946): n is a, c, g, or t
gggacggtgacagagaaaaaagggagagggagggggcaatggggggctgatcagacaaaatgagagtgatcagaaaaaggaggagggaaaagggctgactagacaaaaaggtgatcagcaaaataaggatgagtgggggagctgatcagaccaaatgagagtgatcagtagcaaaagtgggagggcaataggggagatgatcagacaaaaaaaatgatcagcaaaaggaggaggatgagtggggggggggagttgatcacaaaagaggcgatgggggacagctgctgaccagactaaactgagacagcaacagcaatagcagattggaagaatttatgtgatgagtgaaaataatacgtcaccaataattggaattaaaaatggagccaaacagacgaaataagtgattagagaaaaaatgtcctcattagaatggtcaaagatttaaacacaaaaaagaaagaaaggaaaaatggagttaaagttaattcaatttgacttaattggtgatcaaaaagaattgatccaattaatgtcagtttaaaaatttttggaatattttacataacaaaattaaaaaaattaaatccaaacgttaattaattagtgttgaattcaaaatatgatgggattaaaaacaaaattagctttatgtgcaaatcgatttttgttgggtaaatacacacgaaatttcgccgaaaactccgcggctttcttctgtgggaccaaaatccagagatgacgaaagttggacgctcaaaaataaatattcgtttgacgtgaattgaattcgcaattttcttctttttgttacgggattaatttttgcgccaaaacgaatcccataaaattttgtttttttcaatcaaacaataaaatgatgattaggatagaaaataaaatgcaaaaaagtgccaagatttacaaacattttttaagccgatgnaattgagcagattagtgat

SEQ ID NO: 22943 - DNA, 2696 bp, Heterodera glycines
tgatatatatattatttatccagaaaactattaacaacctcctatgtgtgttcttgagtgaacgaattcatattaatactctattaacattaagttaatatcagttatttttattaaattaaatattatttatcttcatttaatctttaatttcctatcaaaaaataataagaatttctcggacatgatttatcgaaaaattaaattaaaatagatcaaaaaggaaataaataataatatatttatagatcttcaaataaattaatagcccttcctttttaagtaaatgcctgaaactctgggcacactccggcatttattgtattacgaaatttaaagtatttttatttattaaaataattatttttattttctgaaaaataaaatcaacattttttaataatctctaagtaaccattaaatagctagcataatttattgttagcaccttttaaaaaataaaatatgttatttattttgacttggatgagaaattaaattaaataccttcaaagaataaataaattaattacaatttttttcataaattaatagtaaaatttaaattataaaatctttaaatctttaaaaaatagatatatattttaattttaatactttaattaatttgttaaggataaattcttccatgaatttctttattattatattttatttataaaaatataattcttataaagcttaatttcaaaaaacttttttgtatatcattttttaataatctatgtattttaagctttaatgttttattgtggcgtaaagtctctcgatggagagggagcggacgaagctcagagagacgatcagagccaaggaatagagcgagagacggcacagagagggagagggcaggagggatgtgaaagtacaggtgatcagaggggggggggggcgacaaagaaaagggatttgtttcggtacttgctggttatatgtgggcagattttcaaaaaaaaatttatgtttttggctataacttttttttgcatccaaatccaacattgttggtatcattcgaaagttctttagatgctctgttagatttataaaaaacaaaaaaaaattatttagcctgtaaaaattttattatgaaaaaacttctgaatttcgattttttcgcaattttcatgtataacttttttgtaattgtctgatcgcgaagcgataactagaaatagcttcgaaacatgttaagctttccataacccgcggatttttaaaaggagggtatcgagggtgctgatcacgaatatggggttatcgagggtactgatcacgaatctgacatctcattcgaaatattttaattgtatctattattttcgcagtacctaacatgctaattctttaggtatgataacaatgatattgttaagttaacatttaaatataaattaaaaatgcaatagttgttgattatggatctttttgggacaggaagaagcggacagcagtgccagcgacggcggaagcgggggaggaggaggaagagggggctccgattcgggcactgtggaagacatacgacaaaacgaacggggacacgggggagcgattcgggtgggaattaacacagctaattaggggaaaacgaaaaccctaattaatagtcggaagagaagcgaggaaaagtaaggcgagcacccggacaattagtcaacgaaggtcatttggaacggaagcagcgcaagacatggaaacgatggtgatgagacacagaaacgagacgaggcggctgagaatgagagtgatggaattggagaggaggaacagaataagagatatgcgagagacatagagaaagggagagatagagtggaaatgaagagagagagagaaagagggaagagagaataggagtaagagagataaagagaaagggaaatgggagagatagggaagagagagaaagagggaaggagtaagagaaagaaaaaagtctttttgatcagaaaaaatgcaaaggaggatattagactgatcaaaaagagaaggaaacgaaaagagacacgagctatttaactaagactcacaaccccaaaggaatgtcgagccagtacgcttcctcgcgaaatgtctcggtggcaatgcgtccacgctcaacgccttccgccgccgccggagggacagacgccgcggtcgatgccctacggcgagagaatgagcgacttaaaagagaaaacacaaatttgaacaagtcgctggaaaagcaacgtgaagaagcggaacgaacggcggtacggctgagacggatggaaacccaaagccgcgctaacgcagaagcgtgggaagagcgcaaaagaaacgaacgaagcgcggcacttttgcggaaacggttcgaagaaggcgcggagcgagaacgactgcttcaagagcgattggagaggcgggagagacacattgaacagctgagctgggaacagcagggccgacttggggacacagagcgagttcaggcgacgatggcacagtggcgagcgaaagtggcactattggagcaacgagagggcacattgagccaagagcgagtggtgttgggtgaacggtgcaacgaactgatgcggagactcgaagcaatggcactcgagcacggaaatggcaagaagcgattagccgaattgacaaaggcacaacggggagagaaagcggatgagaagcatagggaggaagaaaaa

SEQ ID NO: 22944 - DNA, 902 bp, Heterodera glycines
tgttcctccaggcaaaattctaagaaaattttaagcatttgtagggttctcagcagtttccctgcaaaatttggtgagcttccgatcagtctagaatgttgggtgataaaatgaaaaaaataattttcgaaaaataatgctggactggtaagtgtgaagaactgtgttcctccaggcaaaaaatttatgaaaatttatatgcatttgtagggttttcagcagtttccctgcaaaattgggttagctttcgatcagtctagaacgttgggtgataaaatgaaaaaaataatttaaaaaaaataatgctggactggtaagtgtgaagaactgtgtacctccaggcaaaaaatttatgaaaatttatatgcatttgtagggttttcagcagtttccctgcaaaattgggttagctttcgatcagtctagaatgttgggtgataaaatgaaaaaaataattttcgaaaaataatgctggactggtaagtgtgaagaactgtgtacctccaggcaaaaaattctatgaaaatttatatgcatttgtagtgttctcagcagtttccctgcaaaatttggtgagctttcgatcagtctagaacgttgggtgataaaatgaaaaaaataattttcgaaaaataatacttgtgtggtaagtgtgaagaactgtgtacctccaggcaaaaaatttatgaaaatttatatgcatttgtagtgttctcagcagtttccctgcaaaattgggttagctttcgatcagtctagaacgttgggtgataaaatgaaaaaaataattaaaaaaaaataatgctggtgtggtaagtgtgaagaactgtgttcctccaggcaaaaaattctgagaaaatttataagcatttgtagtgttctcagcagttcccctgcaaaat

SEQ ID NO: 22945 - DNA, 968 bp, Heterodera glycines
gtgtggtaagtgtgaagaactgtgttcctccaggcaaaaaattctgagaaaatttataagcatttgtagtgttctcagcagtttccctgcaaaattgggttagctttcgatcagtctagaacgttgggtgataaaatgaaaaaaataatttaaaaaaaataatgctggtgtggtaagtgtgaagaactgtgttcctccatgcaaaaaatttatgaaaatttatatgcatttgtagggttttcagcagtttccctgcaaaattgggttagctttcgatcagtctagaacgttgggtgataaaatgaaaaaaacaatttaaaaaaaataatgctggtgtggtaagtgtgaagaactgtgttcctccaggcaaaaaattctgagaaaatttatatgcatttgtagggttttcagcagttcccctgcaaaattgggtgagctttcgatcagtctagaacgttgggtgataaaatgaaaaaaataatttaaaaaaaataatgctggtgtggtaagtgtgaagaactgtgtacctccaggcaaaaaattctatgaaaatttatatgcatttgtagtgttctcagcagtttccctgcaaaatttggtgagctttcgatcagtctagaacgttgggtgataaaatgaaaaaaacaattttcgaaaaataatgctggactggtaagtgtgaagaactgtgtacctccaggcaaaaaattctatgaaaatttatatgcatttgtagtgttctcagcagtttccctgcaaaatttggtgagctttcgatcagtctagaacgttgggtgataaaatgaaaaaaataattttcgaaaaataatacttgtgtggtaagtgtgaagaactgtgtacctccaggcaaaaaatttatgaaaatttatatgcatttgtagtgttctcagcagtttccctgcaaaattgggtgagctttcgatcagtctagaatgttgggtgataaa

SEQ ID NO: 22946 - DNA, 752 bp, Heterodera glycines
  misc_feature (702)..(703): n is a, c, g, or t
gacacaacataatttgccattccttggaatgcccaattaacctaacaaccgggcacacttccaaattaatctcatttttatagacacaaaaacagagaatgatgagagagaaagtgacccagtaccgcatcatttctatgatgctttaggccaatcccgagattcgagaccaaacccgagaattcttgagttgtctctagaccgactcttgtacatctctaattgttaccattattgccatggcaaaacattataaaatttgaccagtctttctcaatgggtttgatattggcaagaaaaatgaatgcctatggatactcaaccaattttaggaaatgaaagtacattttatcacatattcattttatagttctttgtttgaaatttatacagaaaattcatttgttttctgtaaatgttcacaattttatacattttccaatttgacaagcggcaaaaggccaatttaattgtttaattctctcaatttttccaaaagatgattttcgattcgatattattcaacttttcccttccccgcttttccccgttaaattctttccccgccatttgctccccgccttccccaaaatccagcggttaaatggacctaattttcccattttctctttagctacacgattctttgtaatttctcgcactttctttgctccgatcacgacaacgaaaaggtgacaagannagcatcgctgatcagtgatcgcaattctcctccctcgatcacattctct

SEQ ID NO: 22947 - DNA, 830 bp, Heterodera glycines
  misc_feature (819)..(820): n is a, c, g, or t
  misc_feature (822)..(822): n is a, c, g, or t
ttccgcgcattttcaaaaattttttgcttttgtgagcggaagaaaacacagagatttaaaaaaataaagaaatcttcatttttggcataagcatctctgccaaagattgtggattaataaatatattataaggtatgatcatttgtaccgagactctcgagcatcgtcaattgtaaattattaggcacttcgttataaaacgctctaattttgttttcattttcatcgtaatgaatggaagtgattgcttcgataaataattaaattaccaacgctttcaactccatttcttcagctgtttgtcgttttttcgacgacatttccacccgatcattttccattgcttctccccccgcccatcctcaccttttcaccaccttttctttcattcatttcaaaaaacatacacacgcttttttccattttatttatttccattttctcattttatttatttttgtcacccatttcatctgtcctctctcttttttacgcttttactccgtcaaagacaacaaaaaagtgaggggaggggggggcgtgggagttgaagccgcttttcccctcccatccccggtgggagagggagaacgatctgtgatgggcacaaatgtgtgagtgtgtgcatcagcggggtgagacttttgccccgcagggcgacaaactcatcattcccccccccccgctcccctcctcttgcttcacgccccctcccccccaattcccccggcttcattccctcccgcgtccatttgggctcgtaaaccatgtacgagtttgtgttatgtgtgtgctcaacacccattccattcgacctgnncnaggcatgc

SEQ ID NO: 22948 - DNA, 1892 bp, Heterodera glycines
  misc_feature (1880)..(1880): n is a, c, g, or t
cttgaaacgacgcgtaatttcgcagcaattagcaaaactgcctagcataatttaaaaaaattaattatcaattgttttggatccctttatgtatgtattgtgtataatgtccaaagtttggatgtgttaaaatttacacattttgttaggacattcatttggtgaacagtttttgtaagcgacatttgcgcttggtttggtggtttttaaatggacaaaaagcatcatgcgcaaataaataccgattgatcagtcatttcgatgcacaaggaaaaaaagagtgatcagtcgcgcgaccatttccgtctgttggggggggggaatgatgaacaaaacttctcgcgcgagaaaacaagtaaatgttcaatcaatgaaaaggatacttgagcaaaattttgtccaattttggaggaaagaaatatttttttatgattgacggaaaaagaaaattttaaaaaacaattacctaattacttttactttagtattttttcaaaattcagcaagcaattgacatcatcaaaaccggacatttgtatatttggacagacatcacgacaacagatgaaattttcttaccaattaaattttttttccaaatttcttagaacttttgcgactcctccagtgaattaggtttttgttggcttatttcgaaacaattacttctcaaacacaagatctagctttgctaatattcattcaatttacctcagtaacctaagaataaataaataatttagaatttgactagcaaagttatctatttaattatctatgaataaataaaaaaataaaataaaaacttcttttttatcttttaaaaaaaaatctcacacagaaattaagtgtcatttttagttattgagcccatcattagcggtgtatttttcttttgaaaacttgttttaaaggtgctttttcccgaaacttcgccttaaattacccgaagctgaagttcgaggctccctgctccgggagaccaatattcacacataaatcatttatactttggttttcctgattttttcaagattattcatagagagtttcaattcgatccctaattacaattgtttgggttggattcccgaattggccaggaagggccatcaaagtggcatcgcgatacaaagagcagatcaacggatttttggcttgttttttctttgcttttcaatatattttcaagactttgccaatagttttttattttaatcaattgcttttttaattatttggtgataatttttttttttgttaattgctgcattttatttaaatcaacattttcgatattttattattaattatttgatattatcggcgagttgtccccgggacggtgccttcccaaacgccgttttctcaccccgggacaaacttcggctggcaacaaaaatggaaataaattataattaaataaacattgttccaaatgtttcttctaagtttttttttgagaatatagtattatttttttgtaatatttgctatttttacattttcttcttcactttattaatttaacgcttgctaatttgaaggctttcttcagaaaaatctttattttactgaatccaacgaattatccatgcccatgtgtttgattttcttggcatttgcccttttcttcattattatttttttttgattcccatttgatcaagagtttcactcgttggctttttttagctttttattcatttttataataaaatttacattttttatttttactgtaaagtaacaaattttagaagcaatgaaattcgggctttttttccttttgatttgtttcttttttgaaattttcgaggtgaagccaaaccaactcgaactgaatgatcaaaacccgttagtttttatataaaatttanaaaatttatatt

SEQ ID NO: 22949 - DNA, 897 bp, Heterodera glycines
tacctcttctaatcaatcacgttgtacctcttctaatcaaagttgtacctcttctaatcaatcacagttgtacctcttctaatcactgtttacctcttctaatcactgtttacctcttttaatcactgttgtacctcttctgatcactgttgtacctcttctatttacttttgtacctcttttaatcactgttgtaccttaacgggcgcgaagcgcccgtccgactcaacacaatttaaaaaacggccgcgaagcggccgaaaagaacaacaaaaattagaaacgggcgcgaagcgcccgttcgaggccgcaaatcggcctaaaaaggccacaaaaaagggcgcgaagcgcccgtccgactcagcacaatttaaaaaacggcgcgaagcggccgaaaagcacaacaaaaattagaaacgggcgcgaagtgcccgttcgaggacgcaaagcggcctaaaaatcgctaataatttttaaaaattccaaatcttttcacaacccgatagttttttaaaaattcaaaaaaaatctccaaccaattcgatcaatttgaatcgcttcacagcctaggtagcgaagctcccaaagcgcgaagcgctttttcccagctaaatagtcgacggttcacgcacccgctagttactatatatgttatattgacaaggagtttcgtttcaaaaaacaaaatctcccggccgaaggccgggagcgccctgaaagtggtggaagggtcttacaactttttgaggagaatccgggaaaactatagaaaaaaattcagcgcggacgactgagtcccgagaagcgatttctcactttttcttgcagtttttcttctacgaaattttttatttggaccgggatcgcttagctcttgctggtaggattttaagtcag

SEQ ID NO: 22950 - DNA, 1089 bp, Heterodera glycines
  misc_feature (45)..(45): n is a, c, g, or t
  misc_feature (94)..(94): n is a, c, g, or t
  misc_feature (113)..(113): n is a, c, g, or t
ttaaaaaggaataaaaatttttaaaaatttattttcatctccctnttcgatagaaaaagcatcagagtgcctaaactaacatgtaaataaaatntggtgcgtttcagagcatnttctgaaaaaatatttatgaaataaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcagggggactgccccgaaaacccaaaaaaaaatttttttgaataaaaattatttaaatgaactgactagataatatttaaaataggttatttctcttcctttcagtatccctgcaaagtttgctgcgcttctgatcagtttctgaaaaaaagttaagcctaacatcggttcagggggactgccccgaaaacccaaaaaaaaattttttattgaataaattatttaaatgaactgactagataatatttaaaataggttatttctcttcctttcagtatccctgcaaagtttggtgcgcttctgataagtttctgaaaaaaaagttaagcctaaactttttggcttgtttaaaaaggaattaaaaattttttaaaatttattcatctccctttttgatagaaaaagcatcagagtgcctaaactaacatgtaaataaaatttggtgcgtttcagagcattttctgaaaaaaaatatttatgaa

SEQ ID NO: 22951 - DNA, 1008 bp, Heterodera glycines
ataaatgtttttccaggtgaccatggacaccatcatcgacgcaatttgcgcctccaaattgcccgtgtcgcgcattctgtgcgaccagatccgctcggtgggcaagtcgatgctgctggtcgggccggtcgagtcgtccaaatcgcggacaaagtgagtggttttgtgtggcataatggttcatttggttgtctaatgtgaaaaattaagggtgagggttagcaaaaaaaatcaaaaaatgatgcattttgctggatttttgaaccataaaatttgaatgttttgtaagctagtcgtgccaggccgttaaaaaaaataaaattttgtcggttggttaaaagttttgaattttggcggtgaattgggagtagtccggcggtaccaacaaacgggagcagctcgtttcccccccccccccccccccgccgttaaatcttagtaattcaccataaaaatttctcaaaaaattttttcttagaattttcctatgaaaaaactttctaagatttttttcttgaaaaatttctaagttagcaaatttttttttacaaaatttctcgggggggggggggaaacgtagtgcacccccaacaagctgccttcagatatttgctatcctattatgcataaatcgtgttctaatttttgcgccttttttcattgaaaatagcataagaagcaggtttaaaaaactgacaggaaatggatttttgaaaaaatcacaattcttcaaatagtgctttataatattaattttggtttgggttaagccccgctccccaataatttattatctgcggggtcgtcacttaaacctaatttcaattaaattgcccaattttttaggttcaacaattcattggtgattgccgaagtgttgggcattgaggcggcacggggctcaatcatttccgaaattttggccataatgggaaaacacggcatcgagttggacagacagcacgtgttggccgatttgatgatttatcggtgagcacgaggagcatt

SEQ ID NO: 22952 - DNA, 2411 bp, Heterodera glycines
tcagtaaatataaaaattatacaaataaaaacaattattatttaaaaatgaataatgactaaaaaatctaatgaaattatcaattatctagcaggtatgtatgtataaaacaaatgacaataataagcatttaattttttggggggaaaattttttttttttgggggggggggctatattataggaaatatgatatccttataaaaagaataaatagagtgattattcaattgaacaataaaaaataataattgaaataataatgaacacaataggaaatttgctgaattctcacgacgtgaaaaaatattaataacaaaatgatatcaaattaagaaaaaatatagcaaataattttaaattaaaaactatatttaaaagattcaagtttaagcaataattaaaaattttttatcaaatgaaaaaaggtactaacgaattattaaataatagtccatactgataaataattgttgtgactgagccgtagaacatttagccaaatggtctacggctcatgctggtatgcacaatgctaaggataattatccgcagctatagataagcggatagggtagctgcagataaaaaaatctgcagataaaattcgcatgcacaatgctaaggatacttatctgcagctaacgatttttttatctacagctaccaagctgcggataatctctctccattgtctttttttctatatttcttatattatttggtttatttgtaaattgttgatcaaaaatgagattttggattagataaaaataaaatgaataaataatgatgaaaggaataatgacgaaaattgttggcagctaataatgttgttgttattttggtgggtggtgtaaagttatgttgaatgatgaaaatatgtgtgacgatttgttgatggctaatgttgcaatcacaacataaattctcaccacatctccttcggacattattattatttttcgtgcccccccccccaaaaaaatggtatttactccggaaatgacttctcgactgcttgagcttgttcaagcacgaaaagacaacttgtttcctggttctcgtcatgccgaagctggacgaatccaaaaagaggcttggtcgactgttactgaaactttgaattccgaatttccgatcgacgttcccgcgggtggtctgaaggtacaacaagtgcaaacaagatggaaaaatcttcgtcaggccggaaaagaagaagcgcaaaaaataaaaaagtaaaatcattttgaattattcttatgtgcatcggaacactaggcaccgccttggaacgggtggaggaccgcaatcatcggtttctgacacttcgaaaaaagttattgacatgtttggcacatctgctgcttttgccggagtgccaggcggcggggagactagcactgcccgtggtgatattttgcaaatggaaagtgattacctcggtgccgacccatttgttcccggaaaaattttcgaggaagacgacaaggaaattattgaaatgtcgagaatgccaattacgccgttaatcatcaaaaaggcattaaaaacacttcatttataaaaatttagaagagaaaattgataattaattacatttgtcaatttattttattatataataaaaaggcacccgacaggcacgctatgactctccagcttttggccgtggaacaccgatttctcgtgggtcgtcacgccctccttcttcccgtccatcatcatctgacattgcggagcttcaattgaaagtgcttcaaggcgatctcgaacgaattgagcttcaaaaacagctgtgcgaagatgcaaaacaatttttgaaggaaggaagagacttttttgcaaaaggagcaaaattttatgacgagaaaaagggggaaggggaggggtaatgagcgatcagtatttttgatcagaatttatggtgcattttaaacaccaataataattatttttgataattttttatcatctataataacataaattgagatgtcgtttgcctgttttattccacccgcagggcaagattttgaaagcaggcggttgcgtggtgtcttgctgggtaataaaattatttcaattttcttctatcgtcaaatattttttaggtgatagtggttatccctgtaaaaaatggcttttaaccccatttgctaatcccatcaataattcacaacaacagtataacaatgcccacagcaaaacgcgtgtgattattgaacaaacatttggcaggtggaaacgaagatttcattcgcttcaaacaccaataagaattaaattggaaaacattggcatgttcataattgccgcggccattttacataatattgcactcatgaaagggattcccgaatttgatcaagaagaatttgttgatgatcagccggaaaacgatgatcgtg

SEQ ID NO: 22953 - DNA, 1923 bp, Heterodera glycines
atttttgatgcaatggatgtattcgctagcgttcacaatcaaatggacaatgtttatggcgaaaaggcaactgaaattcgcaaaaaattctcgggcattgtggccaagaaccatggaattgaaaaaatatcccaattttgccaaattctgtccggaaaaaacactgaatcagatgttcccccaaatcttatcccattttataaatttgctcctttgacatcttgcgacgtggaacgctctttttccgtttacaaatcaattttggccgataatcgtatgcgttttacccccgaaaattttgaaatgtatcttatttgtaattgcaatcagtgaataaaatttttgccttaattttaaattattttcatataaaaaacagcaattttaataatttcacccctacatttcaaactttttcgcccctatttcgcgaattttttgcccctatttaggtccctattttggacttttcaccaataaaatcctcgccctactgataaatagcgatcgtgtactacctaccccctagtttttacctgcaaaaaaatgcctttgcttttacagtaatcaagtagatcttctcgctgaagaaatgggtgcatttcgcattggacaaccgctggcacatctgtgtccttccttgatcagatgttccacatggtcaggctcaaaattggctgcaccaacagatgcgaatgataccaatttctggacaatgaatttttattagttaattaatcttataatttttagaccaaaattttcttctaagacaccatacacagccgctcggtcttctctgtttttcgagcataagtctgagacttctttaaaaacgtcctttggatagtgaaccatgcacaaatctatgtagctgaaaatttgaaacaatatttgtatagttaataaattgatgaacttctgaaagaaagcaccaacccatggtagggggccggaatattggacgggtgcacttcattcccccccccgtcgtttcccccccgcccccgaaaaattttttttttttaattttcaaacctagaaatttttcataaaaaaattcttaggaaattttttagtcagaaaatttcaagaaaaaaagttttataaaaaaatttcagcgattttttggaaaatttttgaaaaaacttagtagttcatcatgaaatttcgaaaaaatcgctgaaaagccttttaaaaaatttgtttttcttgaaattttcttaataagaaatttcctaagaagttttttatgaggaatgaaaatataaattgggcaacaacaatgggtttatttaaaattacacaacacacaccctcccctccccgggggcgtgccgaaaaaatgacttcattcatcccttctataacaagcaaaacgatgttcatgctcaaatgaaaagctaaattatcatcaccatcaccatcatttagtgttttccacccccgggcacactgtttgtgtgtatgggagggggaggggggggggggggtgggttgacttgaagtcggctggtggcacgtctcaatctgcaaatttgttggatttagaggacgaatgcaccagtccattggaagagccgatgtgtaaggtggcgataattcaccattttcggaaaccagctagagcccagactggatcccgaccctaaaatatgaaccaagagaccaagacttccaaaaaattggaatttgaatcccggtaattatatcccagcctaattcccagtcccggcatttttaaaagtctgggttctaaaacaaacatggattttttttgggtatgaaaacccatcaatttttagaaatgtgccaatgcagtgactgcggagctgaaaagcaattgggtcatttggagaaggaatgcatcccatacaaaaagtcgttggagcatttgtttgcgccggcgtgcggactgtccat

SEQ ID NO: 22954 - DNA, 1526 bp, Heterodera glycines
  misc_feature (70)..(70): n is a, c, g, or t
  misc_feature (1455)..(1455): n is a, c, g, or t
tttcttaacaaattcattaaaaagtccaaaaattttccccggcggcgcctggcggcaccgccgaaccccnaaaattcctatttttcttaaaaaattggctcaaaatcgcaaaaattggccattttttggtgcaaatctgttaacaaattacacccaaagatcaaaaaaattttcccggcggcgcctatcggcaccgccggcccccctgttcccgaaaaattttttggaaaaacgcaccgaaaaaaacggtttttgaaaagcaaaaaaaaaaaaaaaagtcatcggcggccgaccccccttcgcaaatattttttccgacccacccacctttttaatgtatgattttgcaggagaagaagccaaaaacgaaaatggttgagcgtacggtatgggaatggcagaaggtgaacacaatgaagcccatttggatgcgaaagccggcggaagtggaggaagatgagtacaaggagttctacaagtcaatcaccaaggactttgacgagccattggtcagtcagtcacagttttcgaaaaaccgggaaaataatttttgtcacaaatttatttgttgcccgttttttaaggcccatgtgcacttcattgccgaaggtgaggtctccttcaagtccctgctgtacgtgccgaaaacactggccactgacgcattccaaaactatggcaaaacggaggacaacatcaaggtgggttgaagggggggacggggaaacccaaatgaaatttcaattttaaatacaaacctattttaaaatgattattttaattaaaattctatcaatagcacacggcaaaaataaaatttttatgcccaaaaatccacattttgtctaaattttacattttttcccatgattctatttcctggcttggttttcatgcatttgtccttgaatccgtataaactgggtccatggtgtccttaactttatcaatttttaacaccccccccccccaaattttcagctgtacgttcgccgtgtgttcatcaccgacgacttccaagacatgttgcccaagtatttggcattcattcgtggtctcgtcgactcggacgatttgccgctgaatgtgtcgcgtgaaatgttgcagcagcacaaactgttgaaagtgatcaagaagaagttggtgcgcaaggtgttggacatgctgaagaagatttcgcccgaaaagttcgacgagttttggaaggttcgaaatttttttttaaatttttatgcaaattttatacaaaatcatccaaaatgttggcatttcattgatataaaacatatataccaagtttgtaaccggaataggacaaaatttcgctgctgaaacaacgccgggacaaaatttcaccaccaaaatttaaaaaaaatttaaatttcagccggcgaaatttaggggtgaacccatttgtaatcatgtctcctcgggtttggaattttgcataattgngtcatttattttcttgtcaacattttcaggagtactcgaccaacctgaagctgggcgtcatggaggacccg

SEQ ID NO: 22955 - DNA, 1652 bp, Heterodera glycines
ttataataaagattggattttgtttatttattttcaaccataatctgtacacaaattatcaaatgatttttttaatttgtcgtttgattttgtttatatttttgttcaacaacagaatatttttgtgcttttccattaatctcatgactatcagacgtttatccgccatcaagttcaaatcatttattttttaaaactattacaatatttttaaaaaattaattttcaacttattattaagtttcatcataatatgttaaaaactttccattagtttatttagtttattttattctgtttcattaattgacataaatatttgttttttataaaagattatttgaaattcaacaatatttgtacatataatttgagtttttgtcagtttaagggttcgaaaacaaaaaatgggtaataaataaaaatttatatcttggctcaaattgaaccaaattaaaatttcatattatcattcattagctttaattgttctctatcagaatatgattttccaatattttttacttaagtataaaaaagttattgtcataacatttcaaaaaatgttaagtcagcattttttttcagaactttttgaaactcaatgaaattttctaaaatttataaaagtaaatagagaattcttagggctatcgaatatataaattcatttttactctattgcattttaaagactttaaaattttaaatatttatacttatatatgcatgaccattgcaaaaaacataacatgttcaattctctataactctttttatacttaactaaaaaattttgggaaattatatcctgaaagagaacaataaaagctaattgatgataatatgaaattttaatttggttcaatttgagacaagctataatttatatatattacccatttcttgtttttaaacccattggcggatttaagaaacgcgcatgggtggaggaacttaaattgtatttttcgaattaataatatttaagtgcatgttttcatgttcataatctattgcacttagtaaatctgtttcttgctgctctatgtaattacaacataatgtctatttttagtaaatgtaattatatttatcatttaatgatactattttttatgtatctttcgtacacttaagatatttgtaattaaataaatattaataaaagaaaaaattaaatttgattttctttattataattgctttggtttttaatgtttgccttatttaaagccatcagatgacaattgttattttacatggtaagtaccaggggtgtgacttgtctcagaaaagacgagagcgagagtttggcgagaggcgagagtccccaaaaagacgagagcgagagtttggcgagaggcgagagtccccaaaaagacgagagcgagagtttggcgagaggcgagagtccccaaaaacacgagagttggcgagaggacgagaggcgagagtttttcaattttttctgtagccttatttttaatttaaaaaacttcaaaatcgtatattaaattaggggtacgggcctgggtatttgggcaaataccgggtcagggtattgccgggtacagaaagccgggtcagagtcctagtttttaaaccgagtccaagtcatgaaaaatccaaacaaaaaaccttttaaattt

SEQ ID NO: 22956 - DNA, 1188 bp, Heterodera glycines
  misc_feature (12)..(12): n is a, c, g, or t
cacttagaggtnatttggtgaagattcggtgatcgcttttgatgaatgggctgagtggtttactgattatgttggagctgtaggacgaaattggaatgaggatgagaaagttgctcgatttaaaatgtcattaattgggacaccaagacaactttttaaacaattaatccaagcggaggcagctgcccttaactcagcgattactgggattaggcaaaaattggactcaccccaaagacgggaacttactaaaaggacattggcactttgcaaacagagagaaaacgaaactgtttcagaattccttaagcgccttaccccgcttgttgaaatgacaaacccaacattgaatgataatcaaagaaaagagaggacttgtgaagaatttttggatagaattaaacccaatattggatttttgcttcgtttagtcggtctcaattcgaccaaagacttagaccgaataaaggcacaggccgaggagcttgaggctctactcttaactgaaaaaggacaaatctcggataatttggcacacactgttcatgcacttagtggacaacggttcggaaaccgacagactgaacaaaacagagaatccaattatcggggaccaccttttgtttcggaagctaatgcgacaccactcaatgaccgttttgccccgcgtaatttcgacaataacaacagaaataacaacggcaataataataaccgaacacaattcaggcgtaaccagagaccgaacgacagaaggccaaacttttgtcgcaacagacggtctcaatttatcaacaatagacctgacccacaaccaaacagaggcagaaatgggcgcaatgctaattatggcactgtcaattcagttgatgctatcccatcaaatgtttctgtcctcgattccgaccaattaattcgcgccattgctaatttaggcataatgaaccaacagccgcccttgggcaattcagtcaaaagagaagatgctaatgcattgaatgcaattacaactgttaaaagtaaaccaaaaatcgagaccaaaggaattatgaatgactcaaaaaactgcgaaattccagtcattgattcaaaaaatattaaaccaccttcaccccaattgaaagcttcaagctgggagggtattggaccaaaactcacgaaatttttaatgctccttttctttattgt

SEQ ID NO: 22957 - DNA, 1360 bp, Heterodera glycines
  misc_feature (39)..(39): n is a, c, g, or t
  misc_feature (102)..(102): n is a, c, g, or t
  misc_feature (163)..(163): n is a, c, g, or t
  misc_feature (186)..(186): n is a, c, g, or t
cagtagaggcatcatttgatgtcccaattccaaaaaacncaatgatgtgccaaactcaattgaaaggaacagtttgtctcttccatcacctactcaatgtcncactctcttttcaatcaaccgcagggctcacgaaaacaaaccatttggcttgcatcatttntaattaaataataataaattatntaagtaaaaaatagattgggataattccactgatgatcaatcgcgatttttaaatattgcatcataatttaataataataatatatacaaattatatgaagaaaatttataaagtaaaaaattgacttggataattctactgatgattcaattccaatttttaaaaatatataaattatattaagcaaacaaattttgctacgtttataaggctgtatgatttccatctccgttgttcatatttattaaaaacatttttaaattcacttctacgtaaataaattgaaaaaataattaatgggctttaattttatttaagaaaaataatgttttattctttttccataatttcttttattattattatgaatcattttttaattcacattacaactgcaaatccatcggttagataatcaatcagggtaattaattttgtctaatcattttaattagggagacgataaaatgctaattgcatttatgagaaatggtcagcaaatgcaaatcagtgagtattcaaaacaaaaatatgagatacaccttggctttatatattatatgagaatgaattggaaatgtgacaaaattgtgggtgaatttgaagaatttgaacggacagaatgccaaaaatatcgaaaatatttggacattttgtacgaatatttgttcagagaatatctcggaatccccacagtgaagccaatttttgtatttaaagacaaaattgaaattaatgggccaataatttatgcggtgaattgtttggccagaatttcgcaattttattttataaaatgggagggacgactttatgaatataaattaaacgaattgttcaattatcaatttgaaccaaaattattgaataatgagaagagattgaattatgatgaacaaaaattgtcaattaatgaaatgattttggaattggcaattgacacagcgaatgattggcaaacaaatgaaagtttggacgaaataattaaacaaaattgtggagataaatttgaagtgaatttggaggaaatgctcaaaaaagcggatgaatgggaagaagaaaatgaagaaggatggagtgccaatgaaataaattatggcaagcataggataattgtgggatcgaaattcgatgataaatggaaatgggtgagacttaaaattcaatgaaaat

SEQ ID NO: 22958 - DNA, 1485 bp, Heterodera glycines
ctctctctctctccaaatatgtgtctccccctttctgctgtgcctatgtttcggggcttctgacgctctgtttattgtcaataccaatatttgagactcatttgtgtgctaattttcactttcaactgcctctctctctcaatcgctctctgttactctctctctcttagtctctgtctccccctctctctctatcacccttcggtgccttctcgaatgtcctcactctcctcgctgtccgttctgcgcccctagcccctcctccaagagcatccatctcaactggacataacggtgatcacctggacaaacaatacaaaatgaaaattaaattctttggaaggggggaaggatgtggcacctggaacaggtcgttccccaaaaattttttttaaaaatttcaaacagaaattttccaaaaaaaatttttagcaaatttcttaataagaaaattcaagttaaaactttgaaacattttcagcgatttttaaaataatttttttgaaaaaacttagtagttcatcaaaaaaaaatcgctgaagtttttcaaaacacaaaattttcgagggaggaaataacggggagggagggggttggttgaacggctcgcccccgtcgtgccacccacctcggtcatagtagtggcactgggagtggaagttgagcatgtcccgctgtttgttgcgcgtccgcgggtacaccaccgagccggcaagtgtgtccgtcacgtcccattggtacggcgcgcccgacgcattggcggcgccggaggcgttcagtcccggcactttgcaccagtggtccggctacacaactcaacaatgattttgttggaggatctgtttttgtttgggttttataaaatagcaacaatcagtgttcgtttgatcagcagaaagggagcggaagggtagccaacaaattttcaaatccgaaaattttgagatacgctaaatttcgatggaaccagaaaaaaatttaaattttgaaattaaaaaaaaagaatttttttggaaagaaatcgggtttgtaaaaatcttaattgcattttttatttgaaaaaaagcaccaagtaatttaaaaaataaaaaataattcagttttttaaatttttcgggagggaggaataagcgaccatggaattcccaccccaaaaatggaaaaaaatttgttgaagattaattttaggagtaattttttggttcggctaacaggcgtagtcttccttttgtcgaccggtttataaagagcaaaacctcaaaaattaaaataaattgaaaagggaaacacaaatttggcgttttttccaagtttttgttgtgctgctgccccaattggtcccacctggtacatcatgtacaccacgctgaggttgaacatggcgtgcggaatctgctgcaggctgaccaacaggtacacccaaatttgccaccagctgcaaccgccgatgatgttcagaatgcctgaacaaatattggccagtag

SEQ ID NO: 22959 - DNA, 1394 bp, Heterodera glycines
tgggaacacaatcgcttgggttggccatctttgctcggagtgtgcaaccatttgaacacggattgcccagcatttggatttggcccatccaaattgtcatagccccaaatgggcaaaagcaaacgagcatcgattgagttcagccgagtgaaatccggcaaaattgtcggccaagcactgtggcatttgataaagatatcaacgttgagaaattgcaaacgttgaatggttggcgcaaaaatgggcaaaatttctcggatcaaaacatccacaaagggttggaggccgaatttaaaagaaagagtaaaaatgcgcaaattggtgccccttttgtcccaaatttggttgttggcacggagaaaagcgatcacggaatgatcaatgtacctgacaaaattgggctgcttttagccggcgggcggagcaggacaaaacgtcgccggacgaatttttggacttttttatttctcaaccaaattaaacattctcagtattgttcgaaaatagggttgcgccccgacattttcgaggttttacgaaagtcgtcaattgcacttgaaatgggatggaagtgtctttaaatgagtttttaagacttttttgttctggaattttttcttttatctttttcgactttttatagaaatttcggcgctactttgaaagtggccctttttgaaaattttttcaaaaggggggacccttttgttttgcaaaattttttttgtgatagtcataaaaatttattctctggggtttttggggtccccgatcacgaatctttcaattattttgatcaattccaatttcctaaattcaaaatttcgatttttattcgagttcgggttagggattagaaattagtcaaaatacatgtcagattcgtgattagcgacctttaaaaccccggataacaaattatcatggttttttatcttaaaaaatttttgcaaaacaaaaggttccccccccccccttttgtttcaaaaacggccatgtttagaatattcctactataaacatggtcaatggaagattggaatgatgaagggacacagcaaaatgtggagagaacgccgtgaagaaatcttacgctgggacccaaatgccgacctgtggaaatattagagaggaggacgaattggacagacttttcgatcggacttttaggcgccactgatttgatttgttctttaaaaatgataaaaacaattgtttgtgcttttggatacaatgtcctcatcgaaattttggcgattttctttgatttcttaaataaatttgctgactgattccatttctattttttgttcaccaatgcttccgctgacaccagcaaaaagattcgtctccaaaaagcattgtgtcgattcaattcgatggctctctctcca

SEQ ID NO: 22960 - DNA, 1127 bp, Heterodera glycines
cagcttgatgctgaggtcaatcactttttactgttctaaaccataagttttaaacctgatacacggtggagattaatctcccaaaaaagaaaacacacgaatgaaaccaatgaaagtaactcaatttcctaacagaccgaaatcgtttcctttgagccactgtcatgcagccggtcaattagtttctcaaacgcggcaatgttgagcccaacttgcttaataaggtcggcaatccgtttgtcttctttggctgtccacaacgcttcaacttttgcctgaaatttgttggcaaaaacttcctcaaattgttgctacttgtttctgcgaattcagtgccaattcgtgtgccttcaggtttgactcggattctgttatttggttccttagagagtttatttgttcctcaattcgttgtatttccatttcgtgggtttgctgatttggtacaaagggaggaggcccttgcattccaacgggcggaggcggcataaaagggacagtcgccgattgtcgcactaaaacaggcagaatcaaattttaaataggaagaaatcgcacaattttgtatctcgtagagtaaccgatatttgtagaaatcggagccttcgcctgcgaataaaaaagcgaacttcgggttatccctatgttgctgacgagacacttcttcggaagctggtccatttctggccacataagcagcaaatttttcaatcgagtcgcgcaattcagtatcttaatttgtccttattgcaagtcccagtgaaaagttccaaaccggcaggtggacatggaacagcagatgacattgttgaatacaaaaaaaacgctcaattcaaaatggtcagtgattggtgatcacaacaagcaaaaacaacaaatttaaattgcaaaattgtccttatctaaattggaaaattctgcaattcaattttattgtagggattttttatatcagctgattggttgtatttaatccagagctgcgatctttcagccataaaaaatcctcatttgccactaaaatacctcaaaaaatcctcatttgggtaatccttccgaattggtgtccgaaaaaaaaaataataaatattttcttacaaatcactttttctatggtaaaaaattct

SEQ ID NO: 22961 - DNA, 1450 bp, Heterodera glycines
tgtttatcaataaggaaaattttcaacctaaaattatttatcaagaaaaaaaatgaattttgcgttcaattcataaaagtatattctctgaatctccctttataaaagtttggggtgcggccgcatatagtaattcaatttaaaaattttcttgaaatttgttatgaaaatttcgtaaattgaagaaaacaaagcctttatagttttttcactccgtctcccctcccttcaaagtttttatcggttctcaaaatggtaaattactcaatttttaggtcgggttttcatcattttttaatatttttatttgaaattttcaggtttattaaaaaattttatttattttttttttgcatttaccagtagaagaacgcgccgacgagaagaaaagcagcgattggtcagcaaatcgcagtacaaaaggacagcaggtaaacgccgtgctcaattgttcggggggggggggggaaattaatttaagaatatttattccatttaagaaaattttgacagttccgtttttgtcaagttcttgtctcattgtcagtggttatgaacggaaaatattttggaggagattcggctcctttccacgccaacttttaattttttttaagaaaaataattctatttcattaaaaaataaataaattttgaaagatgctttacagaaccctcccaatccctcttctaaaaattgaactttttacacccaatttccgaccgaggaacacgtgggtgttttgattaaattaaatattgattgcttggttgtcaattaataatggttctaattctttattttatattttcacaaattaaacaaacaaaattacgcgcgcacccaaaaaaataatttagtatagaaatgtgtccagcagaatgtcacgaccagaaggcatgctgataaccagaaaaaactcggaggtgaaatcaagaaactcctttttttgctcttacaattaggcgccaaattattttttttaattttagtttttcaaaaaaattctggaacggacttttgtccgtgccatggccacccattgggtggaggccaaagcggcaacgccgctgtccccacttttcctctgctttctgtcctcaacaatgttggtaaaacagaccaacgggggcgaacagcatcatctataaaataacaaaaataaattcaacaaataattaataatattttttcaaaaaataaattatttagggagatggatttgtaattgttatctttccagcggtaattgctctctgtatttttgtttattgaaaagccaaatttgttaatttggctctaaaattttaatgtttaagcgataaatatgggacaattttgaggggaaattctgcaccaaaaacggcgctaatgcactttatgaatccaatcgacttttatgagtccaatcaattgacaatacctgctttttatacaataactttgttc

SEQ ID NO: 22962 - DNA, 1375 bp, Heterodera glycines
tgctttggtggtccccacaaatttttatgaaagagcggggtcattgagatcaatgttgagggcagaaagcccatcaaatgaattgtcattgcgaaatatggggatttgggtcttcaacaacacatgaaaggtggcgtaaacgacaaaagtcccacgaacagagaacctcgggtttttgttgagcagtgagcacagcttaatcgcatcacttcgcttcttcagttcttctcctgtcaacgattcgcgaaggaagacatttggcatttgcgttctcagtgcagagtcctttttgcgcgccatgaggagacatttccgaacatgagcacgggtcggaagaaccaacttcatcggacgtgggcgggtgcccagttttcccattcggtactgtgtaataggaagcgcttcaacatcgcaaaggtccaggatttgcatggccgtacctttgtcggcgctggcacgaccggtgggcgttttctcctgactctccggcaagccaatcaccacgagtgaatgttggcgcctgtcttcctccacagcatcagctgctgcacactgttgttggagaagtgtggtcgtcgaaccgagcagagctgtgagttgtctgatgaacagctttgcatatgccggaatggcgttgtcggcttcgatttcgggaggaatttccagatttgagacgtcgtgaagaagttttttggcggtgactgctgcgataggcgaaaaatgggtcgatggctgcttgcgatatgtgtcgtttgtttgaagtgctccccaacatttttttgtataaatacggccacttttttgactttgccatcattccaattctcatcgtttttttgcattcttcactccctatttttttattccgactattaaaaaataacttcttttatttttagctgtcttttgtttgtcacatacaaattccgtctccgtccaaaaatgcctgagttacttttcaagaccatcacgcagcaatcgttcacaattgaagttgaggaaactgcaacggtgagatgtttagacatccttttcttgtgcctaaatacctaacgatccattccttttcagatcggcgaagtcaaacgaaagatccaacaggtcaaaggcgcagaatacccagcggagaaccaaaagctgatcttcaacgggaggatgctcgaggatgccatgttggtctctgagctgaactttgcggcgccgaaattcattgtcatcatggtcatgcgagtgcgtttttgcctttcgtctgagtcaaatgtaaaagtgccattctcttcagaaacccgcgcaggcatcgtcaactgttcggtcagcaacatcctccgcatcgccacaaaagaacacatcgacagcggacggacaggcgccgaag

SEQ ID NO: 22963 - DNA, 2375 bp, Heterodera glycines
tcaaaaaacgagacatgtgtcaataaatagagagtgcagagaaaaaaaggcgctatttaaaaagagtaaccttttgaaattatcaaaaagcaaaaacaaaagggggcaataacaactgaatgaggggaatgggagggggaagatggcgaagtggcgtggggtcatacacctaatcaataattacttccttctctaacacctcccctcttaaattcgaaacccgtggtttaagcctaaatttttcatctcgatggagagtaaaattgtgtgggtttcttgatacggctcgatcggcggactttcaacgggtaattggctggctgaatttgttggggctgacgaggcggttcgacaaccggcggcggctgttcgacttgaggtgcctcttcttcggcttcgtcttccaaaagatgtcgtcgccttagctgatttgcgtgccgatgaacgagtcgacgcagaacaggcacataaacacgatatgtgggcgatttgtgaagcctctcaacaacttttccttggagccattccgtcttgttgttccgataattgatcagaaggacatgatcgtttggggaaaaattgatcacttttgtcccatgtttccgatcaaaatttcgcgccattttgtcggtgtattttgtctgtccctttttgaatgagttttgatcaaaattttcggctttttctcctttcggatggacgagcgacaattttgtgcgtaattttctgccgaaaaataattgatcgggcgaaaatccattcaaggcgacgtgtggagtggttctgtaggagaatagcatcttttcgatccaatccttttcgctttttgacattttcttcatcgaacgcttgaaggtgtcaacgaagcgttcgacttggccattcgattgaggatgaaatggcggagtgaaagtatgcttaattccaaattctttacaaaatgtggcgaattcggcagatcgaaattgggtcccattgtcggaaacaatttcttctgggattccgagccgaaaaatgattgatcggagtacaaatacggtggcataggcagaaattgtgttcattcggtaaacttctggccactttgaaaatgagtcgatcagaattaaatattggtgaccatctgagcaggggcctgcaaaatcgatgtggacacgctgaaagactttgtccgtcgttggccatggtgaaagaggtgctttggtggggtttttctggcccaattgacactcttcgcaagtgctcacaactttttcgatcgctgagtccattcccggccaatacacgtggcatcgagcaagtgctttcatgcgcacaatgcctgggtgagcgatgtgcaatgcctttaggatccgactgcggagcgatgttgggatgatcactcgatcctcatacaataggcaattgtccacttcaaaaattttgtcccgttttggaaaatatggactaatttcagaatcagcgacttttgctggccatccatttctcaaaaattgaagaaccgtttgaagtggttgatcattggccatttctgctgtaatttcgactgttgtcacggggagctgatccattctgttttcgaaaacagaattaatgtagcaatctgtatcggcacagatgtttgctatcaggatgtcttcctctggacgcgaataattggcaataagccgtgacagaacgtcggcttggccaaatgatgtggtgtttacgtagcgaatttcaaaatcgtaattcgccaaaaccatggaccagcgctggaggcggctcgcggcatagatcggaatgccctttttggagccaaaaattgccaataaaggcttgtggtccgtttgcaaaataaattttctgccgtacaccatgcggtgaaatttctgaacggcgaacacaatggccaatgcctctttttcaatttggctgtaattttgctgcgctgctgttagagtgcaggctgcgtgttccaccgctttttcctttttgtcggggaatgtgtggcttaatgtggcaccgattccatctttggacgcatctgctgatacgacgattgggcgtgccgggtcgtagtgggtcagcaataaatcggatgtcatcatttcttttgctttttcaaaagcattttgctgttcagaagtccaattccaagctacgtccttttggaggagtcggtcgagcggtgcacgcaactcacgcatgcatttgacaaatctgccataataattcaaagcgcctaaaaatgatcggagggtgcttttgtcgatcggtgcgggcattttccgaattgcgtctgaacgcgacgggtcaggacgaattccgtttgctgacacaatatgcccaaggaacaaaagttcgggctgcaaaaatttgcatttgtcgagttg

SEQ ID NO: 22964 - DNA, 2009 bp, Heterodera glycines
  misc_feature (1044)..(1045): n is a, c, g, or t
  misc_feature (1055)..(1055): n is a, c, g, or t
  misc_feature (1110)..(1110): n is a, c, g, or t
tagagtagagcgggaccgggacctggtactgaaaaaactggacaactgagtacctaagtcccggttttgaccgggaccgggactagtcccggttttttcccggttttcccagccaaaaattcccgggttttcaacccgaaaaggtcccggacccggttttgcccaaaattcccggtcccgctctactctacctttttccttttaaatttttcctttgtttattttcctatttttgttgactttttgttaaagagtggctccaatttgagcatttgtgtattgtccagtccatataaattcgtttattcacttccaaatagcgacagagaaatgggctccaatttggtcaattaaattggttggagagaagaagatccaatttctgtcaaaattaaaaaacctccagcaatttcagctccaatcaaagcttcggtgctcccctcaattcaatctggcaaaattttaatgaaaaagaaaaagcctttattggtattccaatttattcgctcttccatttcaggcaataaatttaaaatttaaaaatttgtaagcaaaatttccaaatttcactcattccattcgattccaatcaaatcaaaaaaacatgtgagcattattcattcacatttctgctggacacagctgcagccaaaggacaacggaagccgaagaaatgacgcggggaattcctaattctgtcgaatgggaaagaaatgtgtgtgtgctgagattctgagactaccccccccccccccctcggctcaacagatgaccaaacagcggaaaagaattctcgaccgattgtaattagcattgagtgaaggaatttgggtaaatccccaaaattttgttgagtgagagagacctcatatttagaaatattaaatattttcatccatttctgattttgacatgagcaaagacggattgcctcgaaaggacatctcaaccatttcccggcagaacggaaaatgggataatggaaaagggaagaagaaaaatgactaaagaagcaaagggagggatggggggggggaagttggnnggaaatgacncgtttagtgtttttgaaaaaacattaaaaaaccgataacggtaaaaaccctttcnccagagttttaacatcgataaactcgaaaaaatgtaatttggtcaattaaactgttcaacaagttgaagcatgagcgaatggcattgatgaataaaaaatgcggaataattcatccgattcagcaccttcccattacataacttaaaatccaatgccaattttacgagcggagggggagaattggttggagccgatttgacgaccattcgctggtcacccgactaattgctcctccgtctcccattattcccttcgaaaaccatgccattatttgaaaaacaatttcggcactcacaacaattactaggaatacatgtgtatatgatgatttcttcaattttcaggtgatcaatgactgtttgatcatctgttgttgtcggggggggggggggcgtcggatggaatcgcttacccaacgcaccattcactcattctttcccattactgcccatcctaatcaaaagcacattttcccatgcctttaatttgcgccaaatgaacgacgaggacaaaataagcaatgtttgaacagggaaagggagaaagagaagaaggaggcgaattatggccaaatggaaaaagtgatcgaagataaaaactgacaatttataagctaataaattaaaatgtaaaatttcattttcattttccccctctctccccttctctccttccgttctctctctgtcccctcactcttctttctccgcccctcccccttcccttcccttcccccctcttccttttccccctcttccttttccaatccctccgcctaattccgtcctccccccccccctcagtgctcattcacaacatcctttcgacaggcgatgaccatcaccgatgagcgagcacattcccccgagtgccctgtcatgtccgccccccccctccc

SEQ ID NO: 22965 - DNA, 1869 bp, Heterodera glycines
  misc_feature (86)..(86): n is a, c, g, or t
acactgtcactgcagagacctcgacattgacggggtgtgaaatacccgggaacacgatttgccattggacgtggcacgatgcaccnttcacaatcacggctcttcgatcctagctgaatttcagtattcacccgttcaggtacatatccaactcaagggcctggagctgatcagcgagtacagcaggcagctcacgccgcagtcagcggcgcaaacaactgaagggagtgcttccctggcgtggaggagaggtccacgtcgattgggtcccaactgaacaattggtgtggcgacgacagtccgatctcgacctggaggcatttgaagaaatggacgggccaccggtggaattgggggactcgatcaaaccccgggagcaatcgcccaaatcggactcaacggacacaaaagccgggactcgcccgaacggacccgacccgggggcctagggggaacggtgactcgaattggggccccctctcgtccctctccctcaaatcgtcgaggtcaaatgggagcgttcgccgaagggagtgcctcctccctacaagaacagtgggcaatggctgataacggatgggaaagcaattcaaattttggcgaaatccgatgggaaccgaaaaggaggaagaaaacaatttgcagaacgataacgccgacgaggggacagagggagaggggggaaagacgaaaaaaggagacaaaacaaacaaagatgagtccaaaagtgcaaaaagacagatgtctccctcctcgtttgcaaacgggggattcgatcaaagggagggggaaaacgacgataaacagcataattttgggcgtcattttcaattgacccgcccctccccccaaggaaagggggcattccaccttcattcatctccgcacagcattcagtggccgcacaattcgccaccatcaattgggagattctcccatcttttctcatccactttttcttctagcacatccccaactgatttgtcttcccaatcttcaggaatggcaaaagtcgcaaaccgaaaacgaaatgagcgccgaattcgtgccgtccaagacttggcgcggcacctcaaccaccgaatgaaccgccaccgccgttggcagcgcgacggaaaacgggacccatcggaggaacggcacatccgaatgaccgccgaacgttatgctgatcagctctctcgcctgggagatgaccacattcaccgactgcagcaccaattcccgcaactccccaacccccgccggcgacgatcagaggtggggggcaatctgaaagggggaaagtcccagccaaaattggcatcgatggtggtacgcctgccccagggagagttgctcccttcaaaggatgtcggcggcgcagcaccgggcgcatcggactcccatggccgaaacgagaacgaagaggaaggccgtgagaaggccgagaaggaaagaggcagccgcccgcgggtgctccctccgcctggggacagttttggagaattgctggagaaagaggcgaaagctcgggccgaagtggccgagctcgaagcccgggcaaagaaggcaaaaatggagagggaggaggaggaacagaaactgaaatcggcgaaggaagcgcgccttcgggacttggaaacccaagccgacgacttgcgccaaatgttgggcgatgcgagctggccgtggtcgagaggcaaagacgggaaaaatgggggaggcggtggctccccgcgctgggaaagcggtgggcatgccagcagtgccgatggaggatgatggagtgtcacttgccgattcggaaatggaggtggtgccggccgggggcagtgtcgcagaagcgacgagatgacaaaacgggcgggagggctgctcccgccaaag

SEQ ID NO: 22966 - DNA, 1697 bp, Heterodera glycines
tttgcctttccgtttaccttttttctgtattcgtccactgagaaatccctttgtcggctccgcgtgtgcaaatgcagaaatgtgttggaccgattggtgctcaaattggacggtcgcctgattttgttggccattcccgcccccctaaaattgtcggtcccaaaatccgaaaattgaaaatggaaaaaatcataatttttgtttcaaaactcaaacaatttaacgatattgaattgcatttcgtgaaaatttttatgaaaaaatttcttaagattgttctctgcggggtacatgtcccggcgacgtttcggctggcgacgttttgtcctgctcccttctctgcggcccctatcggcaccgccgggcctcccccaaacaaaaaattttttttttttggggaaaagacgccgcgaaaaaaggggtgaaaagtcgtcagaaaattttgatcgttttttgaatttgggaaacattcagaggtaaaagtcgtcgtcctccaggccccagccccaaaattcgttggacattccgtccacctaaaaatgagaaaatatgcgttcgttcaacaaaaatgccacgaaacaaattaaacctttttaaaatcggccaaagtgatcacgagcacactgccgatgaaatttttgtagtcatacctaaaaaatggggaaattttttaatttatttctcgaattcgtatatttttcatttaaaaattggtatttcgtttcgaattttgacggtgtgtaaatgttttaagttctgaaacattttcccggattttctggggtcccccatttgtcacacaaatctgacaacatccatttcaaccaactcaggcccgttaccagatcagaaaaattttttttggaggtttttttttttttttgctctcccggcccaaaattttttttaagctccgtggaaaaaatgggaatttttagcccaatttcgccaacttttagtcattcccccccccccccccccccccatggttataaataggcctgtggaccaactcagaaaccctaacccaactcggacaaaaaagtcaaaaaacaatttaaaaaagcagttttttaaagggagtcgaaattttttgtcatatttaattggtgaaaatgacaaagtaaaatttgaaactccaccttcggatgggatggtattgaccagctgcaacgtgcattatgtgcccatcctccgggtaatggtagctcaagttcggattaagcggaacttaaattggaaaaatttcggaatcatttggtgacttttttttcaaaactgatccattccccttattcattgtacaaaggtggttcggttcatacatattcccaattgtaagagccccgaaaacccgtatcgaaacaaaaaaattttcagaaaaaagaaattaaaaaaaaaaaaaatttttttggcgtaatcaaatttgctaaaaaatgggtaatttacaatttcaattccattttcactcaattttttgcccaattttctgccgtccatccccatccaaatgcaacaccaatgtccacgtcgtggattgccatgtaatcgcaaccgacgcgttccgcctccaacgctccgatgtttatcgacgcggcgcggttgaagcgcggcgcgtcctcctccgattggttgaccgaagatgtaacggggtggtgggacgatggcctgggtggtgaccaagaaattgtgcaaaa

SEQ ID NO: 22967 - DNA, 2506 bp, Heterodera glycines
actaaaacactcgttgaattcgtttttcagacagacacccggactgggacaatcggactttgctcgaatggttctccgaaaagagatggaccgacgaagataattttccacccttttctgagaagcacttgcaaattattgaccaagccgttgccgaaatgaaactgctcattcgatatgcgcaactttttggcagtgatccgtcgcgcattgtcttccagccgtcgctggcacgcggcttggattactacacgggcatcatttttgaagttgtgatgaaaggtcacattatataactttaacggaaaggacaactgggcgttgaatgcacttcactttccccaagtcgtttctctactgaaaatgatctaatccgtgtttttggctataactcatttcaatgcccaaaatgaacgaatttagtatcatttgaaatctgagctttttcggccatcaaaatttcaattgtaaattatgttaaaaaataaaacctattattcacggaacaggacaaaattgcgccgccggaatttcgccggccgaattttaccgccaacatttttttaattcttgaaaattttcaagaaaaaatcttattgtaaggaaattttttagattttttctagaaaattcgtttaaaacttttttcctaagattttttttttcttgaaaaattgctattttaagtccaatatatctttttaagaattcggtggcgaaatttggggtgcgtccatttttcaatggtagtaaaaaatattgtttaaattggtatgttttagacagtgccggttcgttggcagttggttcagttgcggcagggggacgatatgacaaattggttggcatgttcacggacatgggcagaaataaggacgatggaggggtggcgacagccccaaagaagcggccggaagtgccatgtgttggcatttcgtttgggattgaacgacttttcaccataatggagctgaaggcacgcgcggattcggtaattaaggacgaacagtgcattttatcatgttccgacaattgcgccttggatatttgcgtccatcccaaaaatcggttacaaatgcatgtttttttcaatccgacatagcataataagccgaagtaacaggaaaaaattaatcataatttaaagctttttacaccactttttggattggtgtgttggtgcaaatgcggttaacccatttattccatcccccgaatgtcgttaattgttgcagaatgcggtgaaagtttcgcccactcaagtgtatgtggcatcggtttcggtagcaaaggaagagacagacaaaatgttggaacaacgaatgcgactgtgtgctcagctttggaatgcagagatccgtgcagaaactggttaaaattagctgttatatcggcagggtgatcatttttccatctatcgttagcatttccatggtatttcggcagcgccaactttgaaatgctataacttttctctctgttagtcgtctttagcaaactcatttaaatgtctgtcaattttccttttagttcggactttgcctttgaaatggccaccctgattgtcttacataaatcattttggttatttaggttataaggccaacgtaaaatttttacaacaaattaaattttgtgagactcaacaaatccggtggatgcttatcctcgggccggaagaaattgctaaaaattcggtaaaattgcgttacatcccggccaaagacaaaggagaggaggttcgattgggaattggaaagtaaacaatgtgtttttaattaagcttgtcacaatggacaaactgatcgatgttttgcgtgaaaaactggaaaacgatgatgaaaattaagaaaatgtgaagagtgaaaggcgcatttcccatttatatatgattgttgaattggatgttctatgttttcatttatattgtctcattgacgaacaaattgagcttgtttatatcatttgatagtattaaaaaacctttaaacgttcggttggctaattatgagccgtatttagtttctctattagcagaaaaaataatagtactatgaatttcgatcatgacgattaccatatgagctcatttttgtgtggaaaggttgtccttgaaaacgcaaaatcgtgatggtacgtcaaaaacaaatgcgttttaaaacgaatcctttttgtgctaaaattaatttcaaaataactggattaaatataaatgcaactctggatggtgcagggtcgttacttaaaaaccatcataatggaaatttaaaaattccctgtagaatagaatggccattgctctccgcgcccctctgcccatgctgggaacatttgtatggtacaaaatttctcgcaaaagagagatagccatttttctggcatagagaataaatttaaaaattccctgtacaatagaatggccattgctctctgcgcccctctgcccatgctgagaacattagtatggtacaaaatttctcgcaaaaaagagatagccatttttctg

SEQ ID NO: 22968 - DNA, 2071 bp, Heterodera glycines
acacccctattttcccagcgtcgctggtatgagcaaaaaaaaaaggtcgttcgggcgaagaattttcaaaaatacacccctaagaattgacttttcggatcggtacgggcgaagaattttcaaaaatacacccctaagaatcgggcgaaaaattttcaaaaatacaccccctaagaatcgggcgaaaaattttaaaaaatacacccctaagaattgacttttcggatcggtaccccccccaaagcccaaatcctggatacgtccctgggaacacgggaatttttcgacgattccttatttttactgacattttaaattaaataatattttttgttaatttgataaaatctacgaaacattaaattttgcttttcccaaatttttgtgctgattttactttttttttgtacttctttcatgcttattttataaaaatttcgtgcttaactaataaattaatttttattaaaaaattattcatgacagaattcaaagaaattctaaatttattaatcacagcaatgccgcaaatttgcataatatgatacaaattgtatttgagtcgattgctgtgtgccaaggaggcagaaaccgaaaaccccgctgatttagccttacagggtagtccgaattcaactagatctaaaataagcgaaaattatctagctttattaattcatattaattaatatcatctttaattcataattaaataaaaatagaaatttaatacatttacaaataattatcctttccgatttaccaattgcctttcgaagaacaacgacaagcctttttttcaacgagttttgttgccgtttgaacagtttttttcatttctgtggtattgcaaaaaagtttccaaatcactttgttgacacactgttcgctcgtataataatgcttatctttgtctaaaaggtgatttaatagaattcgatgctattaatcgaaaattcacttcttgtttcccaaaaatatttatcataaatcaattataaaattaccaaaaataatgagtaaaccctaaattccctccaattttagatttccgttcaattcacacaacagctccgcagctgtctggaaaatgcttgctctcagtagaattggagcagtattccacaatactttcatcagcaaaactttgcccatcaattgattcactattccgacatttaagtgctgaattaaaaaaaacaatttattaatgtaagatattctaataaattttcactgaactttcaaaccttttaaattggtagaaagtgcgaggatgtttataatataaaagtaatcatttgaccaaaaaaaaagaatattaggaagtttcttaagattaacaagctttacagaaaattagtcgtattttttatattaagtaacaaatttatgtccctagcacattgaaagtaaaagtaaatttttatctatacccaaatttttaaatgattttgaataatttattatgttaaattggtggtgaaatggaataaaagttaatcggaagtcggtgattcattgggaaagtgctagaattgtgtaataattaaaaaaacaaattaaaatttttcatttgttaatatttaataaatccatattactttttttttaaatttgtgaatggagatttaaaataaacaggaacagaatttaaaaaaccaagaatcaaaagataatgtcaagaataaggcttattacaggtctaatctgggttttattaattcagatattttaaacataataaaattatgacacaaaacagtaattacaacaaaaatttgacacataaaaaacaaacgtgttgccgtttgttttgtcaataaagcccatttttaattaattcaagaaaatttgattatctaatatactagtgtttgctccccgcccccgagctccccgaccccgatcccccgacttaaaaagttaatttcacaacaaaggggagaaaggttgaaaaatttttaaaattttaacaattttctttatattaattaattaaaaatccaaaaaacttttgggccggctcctatcggcacccccggcccccaaaaccccaaatttttttttt

SEQ ID NO: 22969 - DNA, 1348 bp, Heterodera glycines
  misc_feature (1336)..(1336): n is a, c, g, or t
tagatttttggttccgatggttttcagaaaaaatccgtgtgcgaaaacaatatttcacatttcacttcataacttttttgagttcggcagggatcgagacagggataagaccattggaaagaacagctcgagctttacaagaagctatggaaagaaaaaatcgacatttcagggactttttcagaaatcatgtttaattccccaatggggccccattttgggtcctcatccacagccccatgcttctcccaattttaagtcttggatttgtcaaataaattaacgatttcgaattaataataaaaaattctattataaattttttttgtagaggggaaaattctgaaccaaactactatttgaaaacccaatcaaaactgggaaaaatttgaagtcaaaaaattattcgaatttctccaattttgtttccataatttccgaatgttattcggtatcataatgccaaaccaaaacgaattcgttttaaaatattcttttctggacttgacttggtttctcaatatcgaagcttttttctccgcaatttctaaaacgcttataccaaaccctagatttttggttccgatgggtttcagaaaaaatcccgtgtggtgaaaacatatttcacatttcacttcataactttttgagttctgcacggatcgagaccgggataagaccattggaaagagcagctcgagctctacaagaagctatggaaagaaaaaatcgacatttcagggactttttcagaaatcatatttaattccccaatggggccccattttgggtccccagccacagccccatgcttctcccaattgtggcgaaaacaatatttcacatttcacttcataactttttgagttcggcagggatcgagaccgggataagaccattggaaagaacagctcgagctttacaagaagatatggaaagaaaaaatcgacatttcagggactttttcagaaatcatgtttaattccccaatggggccccattttggttcctcagccacagccccatgcttctcccaattttaagtcttggatttgtcaaataaattaacgatttcgaattaataataaaaaattctattataaattttttttgtagaggggaaaattctgaaccaaactactatttgaaaacccaatcaaaactgggaaaaatttgaagtcaaaaaattattcgaatttctccaattttgtttccataatttccgaatgttattcggtatcataatgccaaaccaaaacgaattcgttttaaaatattcttttctggacttgacttggtttctcaatatcgaagcttttttctccgcaatttctanaacgcttatacc

SEQ ID NO: 22970 - DNA, 1568 bp, Heterodera glycines
  misc_feature (77)..(77): n is a, c, g, or t
ttcctcaacaggaattgcgaatgcctttctctcatcctcgattcttcttccttgtttcgtcctcgagatctcttccnatctcttcacaatcaagagacacggcatcgaagtctctgttcatttctgaaatacatgtcacattagttatatcatttattattttcggtggttgttttgcccatttgtagtgatttggggaatttgccttaacaagcgccttattttgaggaagtccctttgcccaattataatgaatttgtttcacaaaactgtgttcctgttgtttaatgccagagtcagaattattggcattttcggctaactctaagggatataagtgcttaatagcacgttcaataattgatttttccgaaattctgactcttgcggttcgttgtgataaaatttcttctattttccccaatttccaacaatttcttggagtttgtggttcagaaatgatcaccacgtccccaagttttggtgcttttcctggcgtgtgtttgttcccttgatgacgttcccttagacccaataaataggaatctttccaattttgccaaaatttttcagccatattcattgccttctggtatctttgcactacattagcagtgtttgaattttccaaaatataatcattgtctgagttctcaacagatctagtgtttatttccaatctattgttaccaatgttgggtaaaattagatcaataggtcttaggggctgaataacttcagattgggaagtgtaagtgattggtctctcattgactattctctccacctctgaaaacaaagtccataattcctcaaaactgaggagtttatttcttatttccctttttaagtggtacttaacagtcccaatcatacgctcatattgccctcctctccaaggggcaaaaggcgaaataaaaacccattcaattttttgttgattcgaaaaattctgcacttcctcgtcctttaaaactttgagccaatgctccttctctttaatgctttgttgaacaatttcggttaaggctttgttgcctaacacgaagttagtgccattgtcagacacaattctctgaggaatcttccatcgtctgacaaatctcgtgaaggccaacaaaaatcttttcgcagtcatatccgtgactaattccaaatgaatcatcctcgtgagagcacatacgaatatcgcaccccaaactttatgtttgccttttccgtctgatgacttaacagtcattgggccgaaataatctaaaccaattgtttcccaaattaaattgccacttaccctgtatgacggcagcggaggagcttcaggatatacgtaagctttggcgtgaaaacgcgcgcagatccaacaacgagtattcggattgattctcagaactgagttcactttgcttcggactgaaggaatccaaaatttgcttctcaatgaagcaaccatattttccattcctgtatgtttcctttctcgatgaatgtccatgataattaaatccacaattggacaatttttattcaaatatagaggatgaatagcataatggtccatgccactattt

SEQ ID NO: 22971 - DNA, 496 bp, Heterodera glycines
aaaagcagggcagccaagtttttttttcaaaaaaaggacaaacgaggctaaaacaaagattttgaccccaaaaaaaagatttttttctaaaaccgatagtagcgcgaaggaaacgcaataaaaacatgaaaaatcgacttaaaacaacattttattagcgtaaaaacatggcctgtcaactgaaaattttcaaaatcagcattttgccgacaaaaaatcatcattctgtaaaatttattcaaaatttaaaaaatcgataaaaatgttttttttttgcggcgcgctttttacaaaaaaaaatttagagtatatgaggccggcggtgccgataggcgagaaatttttgtaatatttaaatgcgatttgctaacagattttgtctaaaaaatgacaaattttgcgatttttagccaggagacgcctttttttgttttaaaaaaacgctttttttgaggcgcgcttttttaaaaaaatttggagataggggggggggggg

SEQ ID NO: 22972 - DNA, 718 bp, Heterodera glycines
aaaaacacaaccttgatcaatgggatggaaatgcgcgccttggccaacttcggaacgcccttgcaaatggctcggtaacggtaaagcagggcgtcattttgcagttgggcctttatctccaactgcttgacctggctcctggttttgggtgtggcaccaaaaattattcgaattctcaaccgccccccccccgggcacttctcagtgacattaaatttgtttttgttcaaaactggcatttgctattcagtcaaatttcgactcacttggcgaaaacgatgacgccactgcagtttttgtccaacgaactgacgagaaacagccggtcaattttgggcgcaatgtgcttctttaggtcctgtgaaaattcaatagattttcttgttagaatacccgatgaaagggttcaattttccgaggtgtcagagtttcaaggccatagcctgacccttggatttgggggggggaaataaaaaatttggcgctatatggaaagtgggcctttttgaaaattttttcaaaaggagggacccttttgttttgcaaaattttttttgtgatagtcataaaaatttattctctggggtttttggggtccccgatcacgaatacttcaattattttgatcaattccgatttcctaatctaaatttgaacaaaaaatcataattttaaaaattcaaaatttcgatttttattcgagttcgggttagggatt

SEQ ID NO: 22973 - DNA, 2610 bp, Heterodera glycines
  misc_feature (76)..(76): n is a, c, g, or t
aagttttattttaatatttaaattttcatttaatttatatatatatttttttttgtatttggaatacattgtcacntcactcgagttcgcgtgtccgcaggtcattagtcgtattttggccacttttcattacttgctgaacaacattgtcagataaaagaacagcttgaaattcctctggcatttccgttcgattaattcgtacaatattttcgtttggttcgccgttgttttgtttaggcaattttcgaggccgttcttctctggactgactttgttcattacccattctctgcataagtataagaaaattgagaaaaacagaaacttctgtaaaaacaatcacttataatgtcaaacattcggctatcaacggataaattttaagtgtttttttgcactcttttaggtactttcctgttttgaaggcacaccccaattttaaaaaatgttttaaaaaatggggtgtgcctaaacaggaaagtaccctcttttagaataaggggtcgaaaaacaaaacgttctaagttttgagttacaatcccgcagcgggatccgcaaatttgaacttacatctgaaagaattctttttttaaataatttttggcgaactgaaaaaaagggcagaggaattaattaagaactagcgcaggcgcgctcgcttcgctcgcgcacctcgcgctagccgagctttgaaaaaatttattatcttctctctctctctcacctctctttctttctccctctcctctttttctctctctctctcttcctcctcttttctatctctctcctcttctctccctccttttttctctctctctccttttttctttctctctctctctctcctcttctctccctcctcttttctctctctctctcctcttttctatctctctcctcttgtctctccttttttctttctctctctcctcttctctccctcctcttctctctctctctctctccattctctcctctctttctttctccctcttctctttttctctcttcctttctctcctcttctctctctctctcctctttctatctctctccttttttctttctctctctctctcctcttctctccctcctcttttctctctctccttttttctttctctctcctctgttctatctctctctctctctcctcttttctatctctctcccccctctctctcgcttctcttatttttatctctctctctcttatttgtctctgtctcattcactcccatactttctctctcttttttcctgtttctctaatcatttctctcctttactctccgctctttgttcctaactgtcttcatctctctctcttcttcactctttcttacaatacaacttatctctattatctctgttttttcacttcatttcttccatccaaataaaaacaatcgcgtcaaaactttatttaaattttttgtttactttgtgacacacacggcaaaattaatatatagaagattaaaaatgaaacgagagctcatggaagcgggtgacacaacgacaacggactcctcacaatcatcaatgagttataagcggcaaagaattgtaaaatttatttattttttaatttgtaactaattgtgccaatttatttttagcaacactcggaaagaatgccaataaaagcggaacagttggatgggatggccgccacaaatgcgcaaccacaaaattttgcagtccgacaacaaagtgccggaaaacggcgggcattagtacttttcaagattttttaaatttctttcaaaaaaggcgaggaaaactcaaagcaaatcaaaaaaagaaatacatgaatatttttctattacttcgataaaagaacgactaattttgaggatttttggcatttaaaaaatgcgataatttcgggtccagcgctgctgaagacaggcgacgtcatggaaaatattgaaattttaacacatggttcagttcatttcaaaattctgttctctaaaatccggggagtatagtgcaatgaaaatgccaaaaacttttggaatttttaattatgacatgaaaatttgcctttaaaatttaattttcacttaaatcctttatatattttttgaaattttatgagttgtaagttcagaaatttaataaaatctttgcgggtgggggggggggaggagaaacgacctgctccgttggaaagaattgaaaatttaacaaaaaaaagggtcacttttagtcccattaacccaattcctggtccatagtcaactcacgggaattaatcaaaattaacaaatttatctttaaaataataaactttttctaatttttccctaaaaaaaattttttttgtcaaagccctcggtttttaaaccaaaatgaaactaaaaatttatattttttaaattgtgtgataagttgtcctatttttagaatcgcgattttgctaccaaattggcatcaattacgctgaccagcggcgagctgtgccggttggacgcgctgttcggcggtgcggttggcacggaccagctggagcagttcaaacgtgccgtgtccggctgtctctgtcgcctgggacggcacaagaagaccaacgtaatgacgtggtcagaggttttt

SEQ ID NO: 22974 - DNA, 2400 bp, Heterodera glycines
gagagagagagcgagaaaaaaagcagaaaggagaggtgaatgagggagagggggagggggagcgagaagaaaagagagagaaaaatgagagagagagaggaggagggaaaaggtggagagagagagcgagagagaaaaaaagcagatagcagagacgaatgagggagagggggagggaaaaagaaaagagagagataaaatgagagagagaggagggggaaaagggtggagagagagagagcgagagagagggagagagagaaaaaaaagcagaaagtagagatgaatgaggcatagggggaaggggagcgagaaaaaaaagatagagacgaatgagagaaagagagagagtaaatatcggggctaggggcaggaaatccaacgcaacatttacccactctatcggcgccccccccgccctgcccctctcaacggcgaggcgtttctgcggcgattaagccccaccactccccttacatgttacatctgttggttggttggttgtacatgtacatttttggtgctatgacgaagcgaaaaaagtatgagtgtgggcgaagcgaaaaaagtatgagtatggggtgatcggagggggcgggtcatttcagtacggaagagttgttctaatgatcaattaattatttaaatttttaatctattaattagctttgttaccataattataatttcgattattattttaatatttcccaaacaaattgcatttttgtgagagaaatacagtgccacaaaaaattcttgactcaaacctgaaaaactatcttatagttcatttaaaaacttgaaataattcatgcatgtataacttttgatgctgatcaaaaaagtctcttacaccaatttgaccagatcactccttcctagtgaccgggacacccaaaatacactgaaaattggggaaattttcgaaatccatagtgggttaggaaattttttctagagaaaatgggcaattttggaaatatttttcaaattttcacggacaaacccgtactggaaaattccaatgaagtataagcacaccgtaataaaataaaattttcacaatttaatttctgacatatgtcattttttggcacttcaaagcaaaatttaacaggatgacaaaaatttggcaaaggctcgtccccgtaataaccggcttttctccaggcaaaattaatccatccattaaaacgttcggcttgaaactggttatggattaacgattgtaatttaataatgttatccctgtcgtgcaaatttattttcacatcataaatcattacaaattccgttatttttctggtaaattgcttccaaattctaaaactattttttattttatttttggcaacaaaactaccggaaaatgtaaacatccaatggttggcatattccagttgcatgttttgggatttgctttacttttaattaacattatccgggagtcgaaaatcattccaaccattccaactatccaccaacaataatgattgttctccagggcgtaaaactgggaccaaaacattgtgaacccaatcgatcattaaatttttggtcataatatcgtccgataaatggaattcttcatcaaatttattgcaattttcaatagttgcggcaaaatttttcgaaatattgatttcgacagaatttattggagtttcatcattattagggttgtaaattatatggattaacatattttttctgcgcatatgctatgaagaaaggggcttaaaaatagcattttttttttgatttggtgaaggtttttagtccatataaatccatattttgggggttttcgggaataaatccatatttcgccatttttgggtttttagtccatattttggccattttttggaaattttcacaagaaaaatgaaaaaaaaacgaaaaatacacccctaaagatcaactttttggaaatttttaaaaattacaccccacaaaacacgaaaaatttgagttttcgtcgtcattttggcattttcaataaatattttcgtcatttttttgcgaacatttctttttttttaatgagaattttttcgaaatttggcaaacttggaggtgtttttgatacaacgaacaacaataaaaaatatgcatttttatgttttaaaccccattttttggttgtttattgtactttttaggtttatttaagcaaatattaaatatgcacacctttttttgggatttttgggggtttacaacatatattttggcattttttatccatattttggtccatatttggccatttttggcctttttagtccatatttcgggcttttttagtccatatttaatgtccatatttcgcgttttttagtccatataatttacaaccctaatcattatatttgtaaaaatatttttttaaaa

SEQ ID NO: 22975 - DNA, 2388 bp, Heterodera glycines
  misc_feature (94)..(94): n is a, c, g, or t
ttttcagaaaatacacccttaagaaatgaaaaattttctcaaaaattgatcgcctaatttcattttttttcttggataaaaaaatttctcggtnttaaaaattttcctttattcgaaaaaccattataaaaatatttaatacccatttaaatgaccaaaaattaagttttttggttaagttttacgtgttttgctcccctaaaaccttagaaaaaatttttttaaatgcctttttcgggattttcgtgctttttttcaattttttcgtgcctattatagtgtctttttcgcgatttttggtgcctttttttgcggtctctaataataatttcatttacaattgaaaatttttatgtgttttgctacctaaagtgttaacaaaaaattttatttgcctatttgaggatttttgtgcctattttgtggctttgttttcccagcctttttaggtgcttatttcgcgattttttgtgcctaaaaatggagtccctatttattatttcattgtatttaagaaacgagtcaattttaattaaaatgagataatattataatactaaagtaaattagtttctttattgcgctttttaaattttcaaaaagttgactcctaacagtttgtgtcatttgtattatttttatggcattgttttataatttcatttttctcataagagatctgaattgatgtaaggctatttttcaattaataaatagaaatgtcagagtaaaaagtggcaagaaaggcgaaataaagtttagatgatcaatcaaaacatatattaatgtgtggaaaatgtttgtgtgcggtgtatctttcatcatcgtcggtgttctttgattttcggttcaaaaatccaattaaaaaaatatttatttgctcggtacaccactcacttcctattcacggaaaaaaacaaaaatggagagggttttcgaaattggagaatgagattcaatagaaattagattgttgtccggaatcaaaagaaaagaaattgagtttgatgttgcattaaatggcgcataaagcaaagcgctccctaattatgttccagtgctttgtggtaaggcggcaaagtgaaacttccattcatcatgccaggttgcgtaacaggcaaaggcggagtggatggcattggcattatgggtggaggcggtcggcgtggtaggacttccagcacttgaatgtcttaaaaattacaatattatacctaattggaattataaagaaaaatgtgaataatcaaaggccatgaaatgcaattagcattgaatttcaattcaaaaaacaataaaaatttttgaaaaattttcagcgatttttttctaaaaatgttctaataatttttttttgaaaaaaaattcgaggggggaactgaagtgcacccaaatgttcatggcaacaacaaaccaaccatcatcatcgtcctcgtccatcgggatggtattatagttgtcattgctgtcgttgtactgattgttgacgaaaggagtagcagctgaagtgttgacaatgggaggagtcggtgccattgctgggtacagcaattggagatgaggcgccgggtcttcaataggggacgacacggtgcgggatgacctcttggacgggggctcgccgttgcacaaagccatgtcgcccttctcccgctcgacagcagcggaactcggcctaaatgaatgaacgcaacaattattatactattgttagcagactcgtatccaggaaaaagtttcgaggagctttttttttgctcttcgggccaaattttttttttgcaccagtgttatttttcttcaacgctggacggagccaaaaagcaggaaatagtagcggttttgcccgaaaaagcacaaattttgcatttttgggttcatgttttcaaaaaaaaaaattttactctccgggccaaacaatttttttttcaggaacaagttttccggacttttttccaaaattttgagccttgaacgaaaaacagtaatttctcgcaccaaaaaaatacattgttttgccatttttgggtctaattttttttattaaataatgattctatagagtccggtgatgccgataggcgacgccgggaaaattttttggaaatttcaatggattggcaaaaattaacccttctttctaatttatttaaagttgcaatttacactgtctgcaaagcccgttgttccagttggacagacagtttgttgatgtgttcgaccgcttccgaaagttcagtgtgtttatgtgcaatacgtttgacctgaaaattcatgattcagtgaggcttctatttctaactatataggtgtgttataactaagttatttttttaatatatatattaaaaaataatatttaaaaatgttaaattggttaaaagatct

SEQ ID NO: 22976 - DNA, 2302 bp, Heterodera glycines
  misc_feature (27)..(28): n is a, c, g, or t
agtcgttgaagataaaaatcttatatnntcgcccgggtgttttatattccataatccttgcacttgatggatgtaaatttccgcgtcatattcagtttctgttgtgggaatccctgcttctcgaagaagaagatggactttttgcctcaaaactgtagtttgtctgtcactaatccaacgccatttgtctctagaaataatattacgtttatacaatgaataatagcgcattaattcaatggcataaaataggcaaaagttgtcattgttgttgattttaaaaatatgggcatatgatgaagaaggagggtgccctttgcctttgattgttcgttggcggtgaattcctccagcgttctccacgacgtaccacgaattggttgagcatcaagatcatgataactgcaaaagcatctaatccctgttctccttcatttttggcgctatcgctattctatcatccacggaattgtgacgtcaacttcaaaacatggacctttccggaacgagaatcatttttgacctagaccagagcatagagctagaatcttcttgactggatgaatcgtcgttagataccgagaccttcttaatgatgtcacgtctgctggaactcgttccggcccctgtccttcgtatcccattctgatcctttcgagttatgtgcctctcgattatatttaccaccttctttgaaaaattgctaccgcctctatgcaattcacttggctgcttcaaatgaaaaatcccatgaaaaattgagccctgagataataaacctcaaaacggagtaatctgttgctgttgctttcctcttcatccaattcgtcatattttgatgcaatgtctgggtccaaagccgcaaagcgcatcgtcctcgccttgacatcttgtcgtaaatcgcgatggtggctcatttggcacgaatatgaatggcaaattcaaattgaaacacgctgctaaaatgaaaaagaatacatgcgataattaaacacaccgtttcaaaaaacgagagatgaaccaataaatagagtgcagataaaaaacctctcattttggcgtactatttcgttatctctgttaatagaaaatcctaattcacttcgtgaactttttttcttggtgttaaaacagggttcggatctgtccttatttataagatttgtccttatttcgggctattgttcttattttgttcttatttcttaaatatattcataatttggaaatttatggccaaatgttcttattttacctataaatttaaaaaaattttccccggcggcgcctatcggcgccaccggacgccccagtccaacctccaaaatttcttggaaaaatgcgccgtaaaaaatttattaaaagtttcattttttttagataaaaattgcactaaagttgctatttttctcaccaaaattgttaaaaataatcatgggaggtgaaaaatataatatttgatacatttttgatcgaataaattgtaaaaatatctgatttgaagcaattttgcgaaatgttcttatttttgaccataaaatcttattttttggccttaatgttcttattttgaaaaaatttcgatccgaaccctgtgttaaaagcgcttcaaattttgcatgccagtagagaaaaatataacacattcagtaatacagtcattttatgttttatacactttttcatgagttattcaaaaacaaaattagaaaaagcttctcctcttcaagagctttcaaatgatgccaaatttgtccaatttggggcaatcgcctagatcattggtcccgaaattttttatttaaattttttctgaaaattcttataacacatttctaggggtgttttgaggcgctgacaatgagcacgaatccggcttccatttcgacctatttgtaaaatcagatccgaattcgaacagagtcgaaatttagaatttttcgatttcgatttaagccgctgaatgaccatcggttccttacttaatcatggctttatagcaaattcaattaaaatgccaaagaaaggcgttttgtgccgcgtacgggcggcggcctgtgcgggacacgttggacggccgcggaggaggcttttcttaaagtttgtgcgcgaagaagcatcggttccttacttaatttgcacagaggtcgattgccggggagttcgggcaggacaaggcgcggctggccaagttggcggcggtcttcacggccgagggcaagaagaaggggtggtccccccggagcctgtagagcattaagaagaaggcgcagcgcctgatttgccatgtgcggtatgagag

SEQ ID NO: 22977 - DNA, 1109 bp, Heterodera glycines
ccccctctgtgccgttgccatgctgtgcgcatggctttgctcacgatgactgtgatccaattgacgtgtcaaacaccgacccaaattatgggtacaaatacggacttatgctttgtcaacatgtctaaataaatttaaaattaatttttaagttaattttatttagttttattgaattttatttttttatttaaaatcttttaattatttttttattttaaaagttcttttttaattattattttttatttcctcacctttcagtccgtttcgtatcagctgcgtccctttcgcgcgtagtttggctgcaccgcatgaaaactgcgcattgggcccacgagagcaggcaaatttggtgtcaagctttttggacgccagtcaaatttacggtaattggagaaaaaagaataaaattattattttaattacttaattaaaaagccttataaatttttgttccaccataacaattataaattaacttaaaggaaagtgtaaagttctgttctcattttctttattttaggatcttttccggaaactctcggcaaattgctggccacgggcgattcgggaaaattgttgaactcaaaagtggccggagagaacgactatttaccattggcaagttttttcaaattacgaaaacttatatatgtatggcctaaagggtccaaaaatgttttatttgcaaaatcccctgggttcgactccgtcattaattaaattttaaattattttcttaacccccccccccccgcccaattttaggacccgcaaggtgaccactactgccaatcggagaatgggcggcgtaaatgctttcttagcggcagtgccgacgtgaatttgttgcccggcatcgcccttttgcacaccgtttggaaccgacagcacaacacagtgacggagaagctcacagtgagtcagaagaggggccggacagctcgagaacaaattcggacaaggattccatcgcactaaaaccagctttttggggacaaaaaacatacctttgccatttgtgacttacaaatggacaaattcaaaagtttgcttttcaaaaacaacgttgttggaatttaacaccaaaagagcaattatctttt

SEQ ID NO: 22978 - DNA, 1085 bp, Heterodera glycines
  misc_feature (24)..(24): n is a, c, g, or t
gaatcgctgatcaggtgactaaanataattgtttaatgatttgaaaatttaaattatcactgacactttcgcctgccctttcagagaattggtcaaccaacccgttgaacggcccgggctgaagctgaacgaacagttccgaggcggctttttgcgctcaaaggtgtcgggcagcaacactttgctgggcttggatttggcagcgattgtactgaagcgcgagagggagcacggcttggcaccgtacaacgcaatgcggggacagtgcggattggccaaggtgatcagagcagtaatgatcagtcaaataatcgaaattaaacgtcgtccttaatttattggccttggtttgattttggcttgacataaaaccgaatgggaagattctcaacacagaatgccaaaaagagaatatctttctcccacttattttaagtcatggcttttgctttttgaattcaatggctttatgtcctttcgttgtatccgatttaagtgatcggatggattccacttctaatcactctcggggaaatgccttgcaaaagggtctgaaaaataaatttaaaaaatatttgcagttcaattcgttctccgatctgcgcaccgaactcatcaacaaaacagtagctgatcggctggcgacactttacgagcacgtggacgacattgacctgctggtcggagtgctggcagaacagcctcgcaaaggcgcttttgtggtacagacaaaacaagccaagcaattagcaaatgcggatttaataattaatgaccccgtcattttcaatttagcatttggcaattattcaattttagtaatacaaagtgtagcggttagtttttttaaaaagtaaaattaattagaaaatgagcaaatgggaatttaaccgagagtgtctgcccggattagagttccgttctcaattccttagaattttcgatctgagcacccatccgtgacagattttgcttgatcagagccaaaatctttacgaatttaaacattaatgcgctttttgctttccagggaccgaccctggcttgtataatcggtcgacaatttcaaaaggttttccaaagtt

SEQ ID NO: 22979 - DNA, 1658 bp, Heterodera glycines
  misc_feature (1619)..(1619): n is a, c, g, or t
atcatcacaaaaattgccatttttgacgaaagtctgtcaataaatcacacccaaattttcaaaattacccggcaccggaccctcctgttcccaaaaattaacattacaacctttcaatctttggactcttctgccaaatgaagacgcttccagcttcatgaaagacttgattagtgctaaatttatgcaaatagttaatagggctttgcccatttttaatttttcatcagatgtttttccgcccttcaaattttgagttgctgcccccaccctttgttggatgagaaacgatctttatttttaaaaaattgaaaattcagtttaatctttttccattacgactacgtatttttccattttagccattatttatttaaattttcgattttttcccgccattattcggtagattccagacgtaatattttttttatagaccgattttcgtgttggtccattccatgctgccaatttcaccatgggttgatgctcgctgttcgaattcacccaacgagtgaagcaaaatggcgattttttcgacggtgttctcttcgtacggttcacatttggccatcatttgattgatgtactatgtataatttaaaaaaaaatttagcaaaaatcgaaaatacctacagtatgccaaggggttcaaaatttctccagtgtgtaaaaaacaataaattaatatattgattaaaactaaaagttctattaaaaatttttattttgtaatttttgacccatggaattttggaaaaattgtagattaaaaaattacagatcctcaaaaaaataacaattgattttttctgatttaacatcaaaatgatcttagggctcatattcaatttaataaacataccttaatgccatctattggttttgacacctcggatttacagtactttgtaaacgttttccagtcagcttcagcacagcagccgtgtggatcaagaatatagatgaagtatggcttgattctgtcgataatcatttgtacattctaaaataaaataactattcttagctatgaataatttaaatgactttcaagtagagtgcagcgggaccgtggctggtacggtaaatacgaggtttctaggttcggatcccggaaattttgaaaagcccggtttttgaattacgtataaaaatgaatttctcgaaatatttcagtttattgaaatttaaaaataactaaaatgacacattttagtaaaaataaaaaaaatcattcatttacatctgactcaaaatatttatattttctaaatttggataaaatcagagttttattttgtaaaaatacatgaaaaaggtaaaggccaacatccaaatcaaaaaatttagtatattagaatatatctattaacaatttcggagtaagcttccaaaaattttgcgcaattttccaataaatttctttttacaaaaattcccggtaccgctgccctctacttttacgtaagtcctaagctagaatttttcaaaataaaaatacttaatatattttttattaaataaaaaacattctacttctaaataagccaggtcaagtgtcagagcagcaatcttttcagcagctttttgaacatgcacatccatctgaatcaaangcggttgttcatcgaattgttcagcagggcgattgcttg

SEQ ID NO: 22980 - DNA, 973 bp, Heterodera glycines
  misc_feature (68)..(69): n is a, c, g, or t
  misc_feature (185)..(185): n is a, c, g, or t
  misc_feature (260)..(260): n is a, c, g, or t
aaaaaaatagtgaaaaactttaaatcttgccctactcatgatatttatcaataaatcaatcttgtacnntcacaggaaaacccaatttttaaccgatgtggcaatcaatgacccgatcggggcccggtgagttttagcattgtcgcagttaacgctgcgactttgttgaactccttcagcaggtncaacgcatggtcccgacgcagtcgccagtgccgccgacaagtcctttacttgcgatataactaaaaaacacaaanaatttgcttaaagatatttaatttttatttattttaaatattccatcgatgaaaagcccccacataaatggactgccaaaaagagaaatttaagaaaattgagtgccaaaagggaaaagccaagaaaaaggaaggcaagcaaaacgtgcaaaataagctaaaactagggcaaaataattaagtttattttgcttaattttgaatttcaacgcaagagccaaccaaaaacagtgagaattaataaattaatattaccatccagacgcccaaaatgtacggtaattagcaggagcaatgcagcgaagatgatctggaaagtttacaaattgaggagaaggttcttggccctggcagaatcatttttgaaaatctctggtaaaaactattttcccctgattttgaatgccactcaaaaaatcctacaggtttcatgctgatggagctgcgcacagccaaacagcagcagatcaaccttttcgcgattaaggaataaatgcccttaaacggatttaaattaaatttaaaacattattaaattcccgattaaatatttttatcattacacatactgagatttggcattaaatagaaaatattttgtgaatctgaatcatttggggaaaatgcgagtaagaagatattcttggaatcacaggactaatgatcgacagggggagcttctacaaagccgtcactcttctacaaatcggcga

SEQ ID NO: 22981 - DNA, 1630 bp, Heterodera glycines
aaacataacaaaacattatcatcatcatcatgatttgtgcagaatgagccacatttggaaaataatcttgtgatagcgcacaaagtaattaattaataattcactgaattattaggtgttttatgaatttcatcatcattatcttgtaaatcatccttacggaaaataatcttgtgatttttgtgcattttttatttttatgattaaaaataattaaatgggccggaaattgtttgaaattgcaaaattagttgttaaaatttgtttaaatttgcaaaacacaccttacatcatccacacttaatccatgacgaaattattaagggcaaacaataaaatggcatatttaagctgagaattttgtaatcatttcatttcaattaaaaaactattaaaaatattttattttgaataaaacaactattatatatttcacaaaaaatcagtccaatccattttattatatagagcaaacatttttattggttttgcattatttattttggaaacaaaatatattttttgcaaatccactttaataaaattaaaagaattcaattaataatttattccttagaaatttcaaaattttccgttccctcaattctcttttacggatttaaatgcttcccatggcgcgctacccattttcaccagcaatggcatctcgctccaggctaacacttttaagctggtgaattgactccaattttggttgagacggcaaatttttcataaagccagggtcccggtagtcgtgttgggtcgtttctaagtgcattttcttaatacctgctggttggactcgatacccggaaccgagaaatttatttttttgcggattttttcaaataaattaaagctgagctttttaaacgatcaattctatctctttctttttgggatataagagagagagagagagaggaagagatagagaatgaaaaaaaaagaaaagaaggagaaagagccagcgataaaaaaaaagtgagagagagagactgcgagagactgagactgtgataaagagagggagaaaaagggaaacaaaaagacagagttatatcgattaaaagaaagaatagagaaaggttattaaagcatatatcatcattttgacaaaaattacaaaaaaccccactaatttaaaaattttgccgagattttcccttgtaaaaactgaagagccgatctcgagttaaaaacttaagttccataaaataaacttggaatcgctagagggggtcaaaatataggcctatacaaaatttcaagaaatttaaacaataggaaaaaattttttacaaggctaaaaattttacaaaattacattcattttcaaggtgcaaatggtactaacacgcaaaaaactgaaaaaataataaattgagtaattctggagtagaagcaagaagaaagcggaaggaatggcgccaggatcgggctcaaaaaggcggttcaacaccaaaaagtgatgaaattttgataaaaatttcatttcaattaaaaatcaagtttttacaggtcctcgacaaaccacagaagctccatcaacaaccggagagggaacatcgaccgagacaatgccatcgacttcgaatgctgagccccgtaagtgcaaaaatcacaa

SEQ ID NO: 22982 - DNA, 1259 bp, Heterodera glycines
aacaattttcgctaagagaaaaatggtgatttgcctttctctacccgggacaatcgcatcgattgcacagcgatccccttgccaaattcatgcgataaaacatgcaaaaatgataaaaaccccaattaaaaataatattttgattttaaatttatactattttaacaaaatattataaaaaaagaatgaaaacacaaaatttaaaaaaaaacaatttttcgttaatttaattcatttgatttgatcataaataagcaaaattatgcataaagtgattataatatattttttaattaaaatccaatttaaatagtccaggaattaacaatgcctctaatggtcgtacaaattttgacacaaattggtccatcaccttcttctgttgttgaaaatcagatgaaaatgattcaatagacatatttacgaaaatgcttaaagagatgaaattaaaaaaacggaaattacaaaattaataattaaataaagcattataataaaaaaatttaaatataactttttatgataggaaaagagaaagaaatatgatgaattcattaaattcacaaatctttctattaaaatatcaaataaaaatatatactttttgaaacgtaaaataataaattattttaattaaatataattattaaaatgctaaaaaaattgtttttaaattattttccaaatggatttgtgtggtggtgtgaataacagaagttcaatcaaactcataaaattggcgacgatttgaatggacgacaaaacgataagaatcgacgactcttcaagaatggagagagaacaaataaacattgagaacaaataaatatacacattaatattataatttgtacgcacaaaatcttgtacataatgtaacaataataaggaataaattataatttttttaaattaattaataattaaatgaaaatctttttataagaaaaaatgaatatttattgtatcaatttactaaattaaatattcaaaaaaggaaattttattttctttgtttaatagatggttgctttcattaaaaattattaattacggatatgcggaaagaaaggattcatttgttttaaaccggctttgactgaggcggcgacaattttataaattgatagccatgggaaaacaaaactttatttttatttttaaattttaaatatgtgtaatgcactgtaaacaaaaactactaaacaaagcctacacattaattgatgatgactcactcccaattttcattatttcat

SEQ ID NO: 22983 - DNA, 1671 bp, Heterodera glycines
  misc_feature (24)..(24): n is a, c, g, or t
tagacttagtttttcataatactntgctaaattttctttgcattttcatactgtttttcctttttttctcaaattccctaaaaggaaaatttctgaccgcaaaacaaaaataacaaagaaaagaatatttattttttattatttagcttgtttttaagtaggggtacgatttctagtgatttaactatttttttgcgcaattattgtgaagaaaggagctcaaaaaaacgtatttctgctttaaaatttttcgtttgaacgtcagttctcgtcacgaatttaatttaatattgtgaattttttaattaatttctattgaaaattcatctgcaaaaaaaacatgagaaaaaatcaaatgattgatttgatggttttttgtgtaatttcctttcttttgaatttttgtcccgtttcgaggtttcaatattgaataatttcgttaaaaaatgacattcgttttgcccaatatcgaattattaaccccaaatcgaacaatttgaaattttaattattcattcctatactgggttcttcaaaattccaaggtgaatgtaagattatattgtctcttttttaaataaggtcggcgtttctgaagcggtgaatctgggaaaaatatttgaatttttatgcaaccttaacagctttttgtgccggtgtctaaagcaaatggttttgcagcttcgtcgtttctcagtttcagttccggttcttctctatcttcacgttcgaatattctaacttggtatattgagatggctcgcattggccaatccgtctatccggatactgtacattcggattccaatagcataaattgatgtcatttttttttaatttttcacattcttcccgtgttgtgagtttgttacattttgcagccgctttattgtattctttcagtttgttttcctttctttgcccatcatcatcgccaccagcgccatgggaagaagaacccttttttcggttgtcatcatttttgtctgtcattaagcaaaatcaattaagcattgaataaaaaatgatcatgaattacatgcacattttcacaatttagttatgattagagaccgcattttgaggcataggctttttttctgtgcactagttcctaatagagaccggcgcgggaccggatcccgcgcgggattttgcgggatcccagtccgcaatcccgcattttttggaaaatgcgggatttgcgggattaatcccgccggatccgctaccgcaaaaaattttgagtcccagtcccgcagcgggatccgctaatttgactttttgtgcgggattctgcgggattttattgattttaaaacgcagtttacacttggttttaggcttctacgttgacttttattacatatgctttttttgcctttttcgggattttcgtgccttaaatgccttttttggcattttgccgttttggtgcattttttttgcgttttcccgaaaaattccattaaaaatgcaataaaatcgggaaaatacaccccttagaaatgagctaaaaattttcagaaaatacatccctaagaatttaaaaattctgccaaaaattgattgccaaaatttcatttttttgataaaaaatttaggtttaaaatttttcttattcgaaaaaaattatataaaacaatttgggggtaataatcaaatgggggg

SEQ ID NO: 22984 - DNA, 2410 bp, Heterodera glycines
  misc_feature (68)..(69): n is a, c, g, or t
  misc_feature (1517)..(1517): n is a, c, g, or t
  misc_feature (1686)..(1686): n is a, c, g, or t
ggaaaactgctggctggcacgggaccatgttttttactgcttctttcacaaattctcactttcctcanngttgattttctgagttgaaatttcgatggatgtaccgtcccatccacttttgttttttcggttgattgcttctaataatctattggattaaaatattttccatcttttttctttggcggaatttcgaatcattttggcttaggccgaattttgacgggcaaagaacgcattttattatcatattgaaaaaaagaaaaccttcgaatgcgtgcgacacgcgacttttcaattcacctgccttttttaattgccttttcttttttgtactttaaaaactgaacacctgggcccggtcaataagaaggtggttaaatgaccgggtcaaatgaccatggttacttgacctggtcgaatgaccacgaagttggtgctaaaccgcatcaataagaaaatgaccacgaagtgccgttttgactaccaacactatcttcttattgacccgggtcatttaactacatgcaattttggggcagattcacataaaaattttgttttttttcttctatttatgtgataatgagggatacgtggtcctattagagggataaaattaatttataattagtttattttaaagaattttaaaaaatgtttaaattggctcaaaaattaccactattgattatcgagaaaaattattttatggaggtgtttttggttaattctttgttattttcgtaaaaattatttgtctctcgaaattttttttgtcgagttttgactacctttgtaaaaagtggttttaaaaatacttaacattaagataaattttttattttggtatcagaagaaagagcacacttcaatctataagaatcttatttttgtttatttttatctcacaattttccgtgtcaaaaggctcatggtaaatatggcaaccatgggtaggatggtggtagcatttctaaccaccaactcccgtcaaatgaccatgaactacgttcttattgacagggtaaaaaagagggtcatggtcatggttaaataaccaccaacttcgtggttgtttgaccaaagttcgtggtagctcttgttgaccgaggtttaccaccaacttcatggttatttaaccattaccaccttcttattgaccgggccctgatttttcactattttaaacaaatgcccccccggcctttttttaaattaaaaattgtgcttttaggcatcgctaaattaaattggactaaaatggctgtccggaatttgtaatgaactgagatggaaccaattttgaatttaaaaaaccgaatcggtttcatctcacaaaatttgtatatttctttaattatcgaaacccttctctgaatagcgctcatttccgagacgatgacgccaaactgtctgtgattcatttgcgagtcgaaaaacagtttagcggcgaagatcaaaataatgcccgggcttaggactgccacccaaatgttatgcgccacatgcaaccnccggtcatactgtaattggtacagtaacttgaatcaaaagctttttttctccctgtccctgtcgatggaagaagacctgtgcttctcgtcagtacggtagcccgcgaatgggttgtaaaaagaaccaaaataaacgctactgtaaacagccggacgaaggaaaaaagcncaatagaaagcgtagagggaacaagccaaattccacaacaatgttctgtggccagcgaacaaaaagtttgaaaaacggggcgagaagaagtcgagacatcggttgaacgccaaaatctatcaacaaaatgacaaaatatgtcttatttatttgtaattttaaatataaaaaatataatgaaaattattgtatttttttgtttttaatttattttatttgaaaagataaatttgattaaaatttagcctaccaaatcagcagtgctttcagccatccaaagggctaaaataattataaaaataaaggagaaaacattattaaataaaatattactaaatttaaatccacttaattttcgatagaaatccctgaccccgagctctcatccccaattcccgacctttttcggtaccttggttcaaaaaactgataatttacttagattttcaacttgtccgaaaattccttaattttggtgagagtttagaaatttaaaaaaagttttgtgcaaaagagggttaggaaaaccaataccaagaccggtagcaaaaactttcatcagtggaaaaggggttaatcagaaaaaacgaactggataaatacgcattttggtgtttattgtcagaaaagctttttttagggtttttagtcaaaatttaaattttaacctaataatggcaaattttcccgagctccctgttattctacctgggaccgcggaccg

SEQ ID NO: 22985 - DNA, 1635 bp, Heterodera glycines
aatatgtgttccataaaattgatggaaaattatttttggatcttaaaaaagtcatgataatatgcataagcggaagttcagaatgcttgcgaatcgtaaatccttcaggcatgccgcgtttcatttgtgtaataaggggcggcgttgcttcggaagtgagggtatgcatacaaacgtggaaacgtcgctaaatagaaatgagtgctgcaattaatagatattttaatatgcaaaaatattttttttatttataaccgagttatttgcacgtgtccatgcgactccccaattgctctggtggtgccttctggccatgtgttgatgtgaaggtgaaagttatgacggctgttgatgaaaaaggacccaaatcactgactatttaacaacttaaaaaatctatatatataaagatgaatgaggctatgtatgtgtctggcgttttgtaattgttttgcgttataaatgaatttgaaaaaaagaaatgtttggttttcgtttttacatatttgtttgtcagtttttgatttttgcaaaagcacagttaaaaatttctttttttttgtttcttatattcatagtttctattgttttgttattagcatatgaaaagtttttgtttctgtttatgtaaaagattaaggaaaagaacagcgtagctttttgttttagtttttctaattttcggatatgattgtatggttgttatttttagtcttcgtttgtttggttttttagttttgtattctttgcatgaaagaagaagttgatgttgttatttgtctatttacatgcattgttttctgttgttgtataatttttgtaatttagctattctgccgcttcggcaatatttttttttgtgatgactgcaggtcagccatcattcaacagcatgctcagactgagtctaaatgcttcatgaaagtttgctgggatgacattgtttgggatttttttttggctttgctgtttctattaagaatatttaatttagaaaagaaatccaatagatgaagaaaggacttattgtatgaacgtgttggattacaattggatgtgatttcattgcgtagttttggaagccattgacttttttcttactctcgaggaatgcactatttcagctttggatggtcgatcatttgtaagtgggttgggaagcgttatgatcagaatttgtttaatattttagcgaattagtgtctgttctgtgactttagtgtgtcatgtctttgataaaacattagtgtttgttgtttgagtttagtgtgacacaattatgtgtgtcatgtctttgataaaacattagtggtttgttctgtgattttcgtgtgagacactaatgtgtgtcatgcttttgataaaacattagtggtttgttctgtgattttcgtgtgagacactaatgtgtgtcgtgcttttgataaaacattagtggtttgttctgtgattttcgtgtgagacactaatgtgtgtcgtgcttttgataaaacattagtggtttgttctgtgactttagtgtgagacactaatgggtgtcatggttttgataaaacattagtggtttggtctgtggctttagtgggagacactaatgggtggcatggttttgataaaacattagtggtttggtct

SEQ ID NO: 22986 - DNA, 1917 bp, Heterodera glycines
  misc_feature (1857)..(1857): n is a, c, g, or t
  misc_feature (1882)..(1882): n is a, c, g, or t
  misc_feature (1888)..(1888): n is a, c, g, or t
  misc_feature (1899)..(1899): n is a, c, g, or t
tccccccccccccgactgactctcaatgggccgggagagagaggaaaggaggaggggggagagttgttgtcgagactctcgagctttttttcagtcgctttctggccttttcacgcctttctcatgcaaaaaaattctggacataagccaattttgtggccttggcagggatgagagggggatgaaactaaaaatatcgacggaatggatgcttaatggcatagccaaggccaagaaaatttacgccaagaaatttcccagagtcgagaccggacgatggatggagcttggggatcggatctttttgagcggggctgaggctaaaatttccgcgaaaaattctaaaaaatttatctaagtcaaaggggtgagccttaaaatgcccccccccccccgaggtttgaaagcgtcagagttaaattgagtgggggctaagaacttacattttgcgctaaaattttttttgtttggccaagtgccctcatggaacccgcttaaataatgccacccgtctccatcgtttttgcctgccgattgttttgccgttcgtttaacggaaaattgagcaaataaaatcttttcctcctcacgggacacggacggcttaaaatttgatcacttttaagcttttgttcgtgggcggaaaatggcagcgaaaaacgctgatttaattttagtttgcttctgcttaaatgcagcaaaatgttatggcaaaattataaataagtttgtagtgttttatatgttgttgttgctgtttgcatttgagatcagttaaattgcttttgatttgatcaaaaaaatagaaaaaatattttatgtttattaatatgttgggaatttttagtggcaaaaaatcccaaaaaattaaataaaaatgctaaaaaaggcaaaaatagtggcgaaaaattgcttaataataaaaagttttaaatccatgcttttttctcaaggaaatgtacaaaaaaaacgcaaaaaattatcaaacggatgagattggatgcgacaacaatgtcgccaaagcgactaagaaagtggagaaaaagaagaaatgatggaaatgagggaaaaagagagagagagagagagagaaatagaaggaaattgaggaagagaaatttaattgagttaatttggataattttgaataattgtgatcaattttatatttctgtgatatttccgtgtttaatatgtgatttctgtgcttagtattagtcactctttcttgttgtttgtcgctctgctaaaattgctccacctacgctttctctctccatataagcatccgcgttttctcacatctcactcacatctttatattatatttattaaataaacttcttttatttattcggaatttattccccccttaattcctcccgcactctctcccattttgcccttgccaaattgccccccctttgccgtccgagccaacgccatattaccaattttttgttgttgaattagagtctttttaaaattttcatggcattttctaagtctaagtcttacctcaaaactcggcgacacgtacagctccaattgttgccggtagtaattgcattggcgtgctgccctattttcatctaccagatggccaagtgcgacttcgttgcgcaaccaatggaaaaatttgacaagcgcagccgagtcgcggatctaataaaaacgaaaatttttaaaatgagggtaagtcatttcatcccaaactcattaaaaaattttctcaccgaatttttaaaaaaatttcaaatgaagattttcgaaaaattgaaatattttgagcgattttttcaaaattatgatggatttacttagtttttttcataaaactttcagaaaaaatgatanagacatttttttgattttttcttangaattntctttttttanaaaaaaattatttttttt

SEQ ID NO: 22987 - DNA, 1881 bp, Heterodera glycines
  misc_feature (78)..(78): n is a, c, g, or t
agtaggattttccattttgccatattaccactatatttttatcacctgtgaatttttaccatttgattgattattttntaatcatttttttattacgatattcattttgtattttttatttgaccaactttatttgttgttttctttttggcaccatataagagcactcatgtgcctttggtttgctcgataaataaataaataaaaaaataaagaacgtaaaaaaaggcccaaaaatcccgaaaaaggcacgaaaaaaaggatttcaaatttttttataaggattttaaggagcaaaatatgtaaaacttaatcaaaaaacttaatttggcatatgtctcaaaatacgttctgtaattatgagtaatttcaatttaattattcaaaatttatatttttcaagttgatttttactcaaaaaaattatttcaaaaaaacccgtgtacgggcccgtgttattcttgaacacgggtttcacgggcacacgggttttccgggtttttagcccgtgagcccgtaacccgtgtcggtgccaagcccgtagcccgtgcccgtgtattgtgaaaattccgatctctagtcaaaatgaccagatttttgggttcggattcgaattctctatggcaaacttttttgcttagggatttacgaaaaaaaacgtaaattttaaagaaccagaaaaataagtactgatcctggttggagttgcgagtgctgatttcctccggtcattaaacataattatattttatttattgtttcccgccgattaagtgcgttcccggcgccttccaacagcttaactgatgacaatttgatggtgaaaattggtgacaaaaaggtgaaaaacagaaagagcacaatgcattcctcactgccccaatttatttaaataagacagatcactgataaaattgggcattcctatgctaagattgttaatccatcccgatcagatcactaataaatcttggtcagaccactagtgaagcccggtcaggtcactgttaattaattttgctgatcagatggctgtgtccgcccattggctgtcgtccgtttccccggtgatcagtcgcatgctcagcgtggagatgaaggagaagcagcagcgaatgatcactttggacgaattgggcgtggacatggaccaattcattgaatttttggaggccatcacttatcagaacggaccttttctgccaaaccgtaattcattgatactgtatttattctactatatcccctgaggggtttaaaatatgatttttttaatattgattcccaatttttagccaaaaatgtggtgatgctgctcaaattggccgactatttccaggtgcgtcctctgggccgcttcagcgcaaacgctctttttttcttttttaaattgctttttaaaaattattatttgaaacgaattttaaatttttaacaattgttattggcttcataaaaaaccatgatatctttctttaaattaaaaacgctttggttttggtttcggttttaaaacctacttacgatacccgcggcgagaacgcaccaaagcattgggtatcattggagctgaggagttatatgatggttaaagggatcaattatatcccgccccatcatacgctgtatcctcctctttaatacagcgattaacttaccattttttgctccaattggtttttgttaaataagaaagggacaaaaaaaaagaagagagcaaaggttcgagtccattgtgctgcatgaaatgtctattacttttttgtcaaaaaaattaaaaaaatacattttcggaaataatttttaatctttttgccaactaaattgaaagatcttggtatgaatcgaaagctcttgatgaaaagaagcttttctaagcaa

SEQ ID NO: 22988 - DNA, 958 bp, Heterodera glycines
  misc_feature (838)..(838): n is a, c, g, or t
  misc_feature (890)..(890): n is a, c, g, or t
  misc_feature (937)..(937): n is a, c, g, or t
ttgaaaaatatgagtttttaaaactcccatttttaacttccaaaatttgggttggatttcgtttccctaaatttaataagaccagaattccgtaagtaaaaaattttttgtgcctccaaagcctaccctgagacctatcgtaatttttatgctattttttgcttgattatattccttttaaatgcattatttatgtgtttgataatatatagattatattttaatgaaattaaaggagcataaagaatcaattgacaacaacaaaatggtgggacaagaacagcaggacgaacagcgattgaccaacggaccaacggagccggagaaggaaataaccgatttgaaagcaaccggttggctcaataattaattttaaaatgaaagcaccaaatttttaaaataagccataagaaaacttaaaaagagggatttttgaaaataaaaagttgaattggtaaaatttcaacttactaataagagaattggcttctggactgacgcacaacagctgatgggacaattcggctgacggacaaatcagccgtagaatgaaatttttatttatataatttttatgaattctcataaagctgagttgtccatcagccgaattatccatcagctgagttatctgtcagctgagttgtccccagctgactgatcctgtcgcgcgagaactcattaattttttaattgaaattataattttgaatgaaaattgcttcaaagatttgcttccacataatctgactggatgggacaacactcagcaattcttggaggcaatgcaccaaattttactgaattacattcgggaagagaacgaccgttccacganaggtaaaattggtgccaatttgtttttttgctaatctattttatttatttanattaatttaaaatgatttagtgcttgattttcaccaacccgaacaantggcacaactcattgacctgc

SEQ ID NO: 22989 - DNA, 1496 bp, Heterodera glycines
  misc_feature (77)..(77): n is a, c, g, or t
aattggttttatttatacaagaaattacattaaaaaatttttaattctaaggacatccgcgcttctttaaccaaatntcgtgcggattggacattgtggcaatggcaggcgaatggctcacggcaacatgcaacacgaatatgtacgataatattttttttaatttatgaaaaataaagataaaaaatgtgtgattatcctttttttacagtatttttttattaacttaaaataataatcactaaaattctttgagaagagataaagtcgttttcgttcttaaatacattcaaatgatgccattcaaaattaaggttcacctacgaaattgcacctgtgttcagtctgatggagaaagaagttacgaagagaatggtaattttcatatttttttaaccagtttaaacatttattgattcaaggggatctgattggagaatttctcaaggccaatcaatgataaattcaggtggaactgatcggctggcaggggggcggtgatgccatcttttcgcccggcggtgccatcgccaatatgtacgcgatgaacgcggcacgccacttccattttccgcgtgcgaagccgctcggcatgacagccggattgcccaccctttgctgcttcacctccgaagatgtgggggatttaggcattattttagcaaaaataaacaattatcaattttgtgggatttataacagtatagaaattaataaactagtgtacattaattaattaactttcagagtcattattccatcaaaagtgccgcagctgtgctcggcattggcgcagacaattggtaaaattgtttttccaatgataccaattttgtctaggtttaaccattttaaaagttaggagtgccacatttattcattttccagcattgaacgggttcaaaaaaaggggtttaaaagcgttgctgcattttttgctttttctatcattttagcacctaagaaaacctacaaaagtgattttgtgtgttgttggctcagtgccttttgtcccatatttacctcaaaaaaatataattattgtttttgtggtaaactacaaactcttgaaaaatgaattccttcttaagaataaattctccgcttgttttcaaaataaataatattaatatacttttatcttttttactttttttatctctgtaaacaaaacacacttttttcagttttaatattcccgtggacagtcaggcccggatgaaccctgaggcgttggaagagtgcataattaaatgcaaagatgaagtgcttaatttttttgttaattattcaaaaaaagattttcaagtatttccttattaaaaatgtcaatttgattgacattatgacgggaatttttcaaaaaatagtcatataattctatattttgatttcaaaatgtataaattttctaaataagttttacttttaacaaaaaaaaaaaaattgaagataaaaggatatgaataaccaataaaaaataaatatatttattg

SEQ ID NO: 22990 - DNA, 1146 bp, Heterodera glycines
  misc_feature (14)..(14): n is a, c, g, or t
tgaaaataacttanttgagaaaattaattacaaaggaattgtatttcattcttttttcgaagcaaaaaaaaaatggggtttctacagaaattctttttttcagttttttgttagtttgtattcttaatcattttttcatatctttgatgaacctattcaatgttaagattttaatggttaaaaaattgaatgtcaatctttgtgactagtaattttttcgaattttcaattagttatttttgtcgatggcttatagttttagtaaaacttattgataatagtggaatttttatgaatataatatttttgacagcgcggcgcaaaagtccatttttgctgggcggcgcaaatgtcgcggcgcaaatggagcggcgcaaatatccgcggcgcaagtgaccactttttctgtgcagcgcaaatgtctcatcacgatttgcgtttattctttttcccatatattagaaccaaaagaagacaacaagaaattcatttaaatttaaataatttagaaatttaagttattttattgaacagtaaaaaccattaaatatttattttaaaaatttattatcttctcaaaaaaatttcctaaaaattctggtcaagagcaagataaaataaataaataaataaagaagcacttaatttggtaaaaaataaaacaataaatccattattaaatattcaactgataaaaaataaaccaaaaattcttatgaaaacataaagaataaataaatattcagctttatgaatgattttttaatatttcattaataatgttaaattaaataaaaaacaattaaatgaaataataagaaactgtacaaaaattttttaatttataggataaacattcatttgcacaaaaatttatttgaaaatataagtcaatagaagctaaatgaataaaatatatctaattttataatcttgatattattcgataatcataaatgttttctattatcctgcaaaattccaaaaaatcgttaagctttaaaaaaagttatggcctgagaaactcaaaaaaaacaatttttcttgaacgttttttatcgtaacattcatgaaacttaatgaaatttttttaaatattgaaatgatatagaaaacacataactctatctaatgattcttattgtt

SEQ ID NO: 22991 - DNA, 1032 bp, Heterodera glycines
aatgtatattgcaagcatcatttgaatagtattttcacaattcaatattcattttgataaatacattttgtgacttttttaattgatttttttttaattattaaaaatttttattaatctaagagtattttttaaataaaaaaaaactattttataaatcgtgatttatcctttgttaaattgataaataaaagttaaaaaaattttctaacaaatatgaccaactttatttggtaataaatatttggttttttcataacattatttaattaaaattatttttttaattcaatttttgtcaattatcaaagaaggttttaaagtgtttttgatttattttatctatgtatttgtgtagaagaatattaaaagctacctatttttaatatttaaagcttttctgattttttcatttttgcgtctagaatattttaaaaattaatacatatttttatatttagtattattgattttaatttttttctaatttttctagattatattttgcataaagctaattaaattacatctcagtatggatgaagttttgacttcttcagggcgccaaattttggtatcatttttctatctgctgctatgtaaataaatttgaaaaaaattattttaaattagagctatatactagggttcggacttcgcccccgcccccggggacgggataggttttttggcctcacctccgcccccgcccccgcgaccttctcccccgcggggcccgggggtgaaaatatacccttaagaatggcatattcgttgataaaattgaaaaattttttatccaattttgaattttttaaccatcgttgattttacaatcaatattatgaaaaaacataaacctggaataagtaataattaaaataaaatttttaaataagttgattaattaattaattgttaaaatattttaaattaaaaacctcaaattaaattgttatacataatataaactgaaatgtataactaaattgacaacaatatctccaactaaggtcgtagccagacccttgg

SEQ ID NO: 22992 - DNA, 1622 bp, Heterodera glycines
  misc_feature (1552)..(1552): n is a, c, g, or t
  misc_feature (1554)..(1555): n is a, c, g, or t
  misc_feature (1585)..(1585): n is a, c, g, or t
tgttcacactttccgtgcggttgctggggttgcccaacagtttagggcattcaaaatttatgtaattattaaaattaactgggaactgcacttacatatattatttatttttctaaatattgccacttttcttcaacccgccccctttttttgcaggttttctcgtctcttttcgtgccaattttccgttggtgccgttttctttggcgccatttgttgtcccttttgcgggttcgccctcgcaattacgcgaattcggaggcaatttggacgaacattcatcagcagcaacaaagcaggggttcatttttttccttttgcattttccactttctttctatttccttttttttccatttgtttctcttcctctgaccatttctctcttttctttctttttctcctctcttttccttcacatttttgcactttctttttctcctttccgcttttctttttcttatttttcctccccctctttcttcagtccctttttcttctcccaatttcgcttcacttttcttttggctgatcgctctcggcggccctttccttctttttaaatgtgtccttcggcttgccgaaagagaggccgaggcgaacaaatggaccaccggacagacggagcattacacggcacaggcaatttttatgattttgttattatttgttcttgctcattcttctcaattgatcctctttttccttctcttatgttaggcattgttcgacttttgcgctgccaatgccaatgaattgtcccttacggcgtttgatgtgattcgcatcgcgccaaagtcggcgcagccgaatgtcaaagattggcttttggccaggtgttataactttgaaatttgacagaccaaaaaattttattttttaagcacattagacggctcaaaagttggccttgtgccgataaattacataaaactgattggaaaatgcaacgacagaaatgcgcaaatcatatgaccagtccgaacattgggttaacggacaattcaattctctttcattttgtcatttcatttaaatgtttccaaattttattactgtaaaactttgtatccgaatttaataaaaataaacgaaaatggcattggcatgggacgcagaaaccgaaaaggggagaacaaatcgccaaataaccaatctgttgaactatccaaagctttcgtttgttttgctctgctccttttttctttggttttctttttaaaaatttccgcaatgaatccgccaacttttgctcctttccgtctcctccgacaacatttcgaccgattggctgtcattttgctcaattcgcccccggcagcggtcgttccctgcggcgattttgcatttccggccgattgggccaaaatttggaacagtgccaacattcgcttgtgcaccgatggggcggcaaatcatttgatgaaactgtgcaggtgaagggaaggaggaaaagatggcatttcctcgttaaaatgccattttactcgcagccaaaacaaaataaaataaagggtcacaaaaactaaaacaaaacgccaaaataattcananntcacatgatatgacatccctcgcctctacnaagcgatgtcctcagcgcttcaaatccatcggcaggg

SEQ ID NO: 22993 - DNA, 1025 bp, Heterodera glycines
gcggcatcaaacgaaaagtggcatctgcgtacacatttttcataatactggtccattccgaagtcgaagaacgagcaaatatcaaaattcttaatatggaaatttgtgaaattaatttttttattgtttttcacctttgcggtccagcctgtccctgaatttgaaaaacgccggtatctgccaacaagaaattctcctcgtcagtctctgttcgattgtacattctgtaagcgggcggcaattccaatgcttccaaactgagtggtgcagcaggtggtacattttcgtcacggcgagcacgttttataacctaaagcaaaggaaaaatcagactggcatattttaaaatttccttatttatgattgacaaaaaaattatttgtcaagagttatgggcgaaaacggcttgccagacgaccccctgactatatttttaaattcagtatttggtccttcaaaaaattatgcaattttcaatttcattatctttttttccgatctgcggccattgtttggcgctatccgcgaccgcggcaatttgagccagcaattagaaactgcggcattttgagtcagcgattcgagaccgatttttgtgtctgcgccccaccccgattcacataatcaaagcaaattctgactataggaatggaataataaaatagcaataataatattgcactgaaaaatacgaaaacgaaatttcttttcgggaattccgcgactgttttcggcacttttttgtgccaatttgtccgtttcaagaaataatgtatgtaagaatgtcgtagtcgccttttggccaagagggcaataacacttttggtccaataatggtgctccaattttttgtcaatcgtgagaaaatgggccagcgaagttatccattggcacaataaccaaacacgacaatggcacatgaatgcatacaaaaaatatggtgccaactttggcattttccaaaaacattgccggcatttacatttttatactttgccaaaaattcgctcctatgaccataaaag

SEQ ID NO: 22994 - DNA, 1584 bp, Heterodera glycines
gtgtcccctggggcggcacacagcgaccattttgcactcactgacgtggctctgacccccagggggacataatttgatttgagtgtaaaatgggaagcattttttaccatgctttttatttgtacattggtctattttaagtgcatagcattctttttaatttcatggcataagcattgatttgagaaatttcgaaataggcaagaaaaaccatcatttttcattttggcatttcatttttgtcaaatccgatcactcccagacaatttttgcttggcatacgactgactgactgggcttctgtttgcaaaaaaagtgtcattgtatcgggtttcttatcagactattagctgtctaattatgtctaactaacgattggacaacgcggcattgcaaccgcaccttatcaaatccttagcctggtcattgttttaggcttttgttttttaccggaaggcttaatccacccaattaaactagaaactgatcatctcgctcccaaataattggtcaaaattgggtgattatgccatgtcttacagatgattcccaattatcttccaccgtttgtcccattatttcggttctcatttcatctcattttcactttccgtcgcagctgggtcaccgcccatttgatgtgatgataaaacacttaattgcccaccccattattatttttttattactattatcagctactgtcatacacctgctgctgtgctgtgctgtccgtttgcccattgcgtcgtccccccggggggtcgttcacgtgaaccaaaaataaaaaataaattaatgtaatcgatacgccgccccccgcccgcccgtaaagtctctccccctccatcctcaccaaatcatcatcgttcaatttcatcatctacgacccccacctgctgctgctgcccaccccgcgcaagtcgtcactaccgccaccataataacacaaattcaattcctccccccccccggccctccgtgtccattgcccggcggctgtcaattagcccctgctccgccccttccccctctcgcgcgccgtctggccaattaacgatttaatgactgcagcatggatggcaaaaaatgtaaaatgaaaatgccctaacgcgccagcgccaccaatgaaaatgtcccaaggcgccaccctccccccaggcgcaataattagtcgatcggctgccggcggcacatttctcttcttcattgtttaaaacggaaccacactggcacacaacaattagctgtttgcctcgcctcattcctaccgtttctgtgctccctctgagttctctcgagactctcgactcatttactcatttgcctgaaggcggcaatttgcacttggtagagggagaagggacattctcattatcaaataaaaataataattaaataatattacataaaaaggacaaaaaaaatagggaagtttttttttattaaagaaaaccttcaaattttcttcttaattaaacaaaaatctgcagccaattaaataaggaagccacaataattgcaaaattattaattattaattattaatagggcccggattctaaggtttaagcacgaaaaaca

SEQ ID NO: 22995 - DNA, 1476 bp, Heterodera glycines
ggggggggggcataacgaaaaagtttcgaaaattccttaaaaaaaactttaaaaaatgatggaagtaagcaggaaaaattcagtgtcccgagagattccatatgatttttctggaattttattaaaaattttaaatcttttttgagcatgaaaaaaccgaaattttttgaatttccataaaaattcagccctttcaaatcgtccggatgtgcatgtgtgctgtcgcagaatgcccgtgccgcccaaccccaacgtggtaactgagggcgcaagtgaaacaaatctgaaaatttttttgaaaattttttttcggatttttcgaacccccctgagccgctgccgaacacggacctgccgccgccgctgcaaaccgagcagccgattgagtccatcacttttcggcctccggtggacgagctcacttgcccggtcggttggagtgcgtacgaggaccaaagggttagccgcataatggaaaaacggaaatttttggaaaaattttttcacaaaattttcagggtgctcaccatttttgccaagatgcactggacatgacatgccctcatggttagaatacaatgttttttgtattattattgtatcactgcttatcaaatccctctgacatagttttttaatgataatcgaacatcatggattcaatggatcagcaatatgaggcataaatatactcttgtatatgcatattaaccaagggatataatgtatctggtatacaaaccataaatatacccgaaatcgattgtaaaggagtaatatacgccaaaacaagtaaatttgtatgtagccataaagatgtgtcataatataccccagataattaatacaatacaagaataatccatggattaaattatcctttacacccttcaggcttttcctgtgcccagtcatctgttagcggcattttcatgtgctgtcgcttggcgtccaccatacagtgcccgcatgagtacaggtaaagtaaaaccatttcaattgtgataaaaaatgacaaaagaagttattgtaaaattatcgaatttgtttgttgtatacagtattctctcacattacaacaacattccaaaatacagtaacaccaattctaatgcttattttattcggcatacagtactctgatggtgaacaacaaccctcgcctttgttcgcttaccgtaatgcgacgctcaacaaccgcgggaagcggacaatcatcagccacagcggcaaatacgctacacgcatgtccaaccgggtaatttggatgtaatagaaaatgtggggaattcatttgtatattcgaaaagcaaattttggcatagtgcctagcaaaacggcaaaagggaaatttttggaatttgattgacaaatgagcggcggcattttgagggggttgtgtacaatttcaaaattagaacctaattttctgctaaataatttttatttctacaagcctgcgcttagttagctcat

SEQ ID NO: 22996 - DNA, 1107 bp, Heterodera glycines
ctttctgaaaaaaatatttatgaaacaaaaaaatcgattttttcaagtgtccatttggggtactcgaacatttatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattccggaaggattcggtctccccataaatctgggcgcatcggttcggggggactgccccgaaaacaaaaaaatcgattttttcaagtgtccgttttggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaag

SEQ ID NO: 22997 - DNA, 1432 bp, Heterodera glycines
tgccattgtcagcattgatttgtatatactgagtcgccctggtgtcaatgcggtccaacgagtaccgtaccgtactaccataaccaatgtcccggtcaacagcgacgacttggccaattggctttgttatgtcgaaagttggtggaagcttaataaaaaaaaatttgtttatttatttaaaatataacaaaattttttggcttgggccacaaaattcgacaaaattttaggccgtaaatgccccaggacgcaaatatattggaactattaggattataaaaacccttgcttttcgtgattcccggaggtttccgattaaacacatacatgccttaaatgtataggcatttttggtgaatgttggcgcaaattcgtcaatgccaaacactcgaatttccaccggcacattggcaacaatttttccctgggagtcattgcaacaaatggtgaagttgaggacgacaaattgttgctgttgttgtgccattgaaatgtttgctgtttccaggtcaatcggagagcttagaatgacatcaccggttgttggctcaacagcaaatgcctgttttagcaaaaaatattgtaatttttactttaaaaacacaatcttagattgacccccctattattatcaggaagacggattttttcggaaaaaattaaatcgtgataactttaaccatgtcaaaagtttgttacgactaatgctgtcgtaatgccaacaactctccaaaggctagctttattggcttgcctcaatcagcgaattgctgacgatgttagccctttttggttgctgtatggcataggtacaattgttttgaatttgtgccatcattccatcatttgtggcattgtgttgttgctgctccaagatgccgtgcctaccgcccgcgtgcacgttgaacagtttggtgcccaccggcctatcctcgggtacaaatttgcgataaattggcacaccgaagtgcggctttgctccattccatttgttcatgtccgacaacaattcgacaacccattcggcactttgtgtaggagtgccattgtcgcgtgccgatattatctagaaattcaaaaaaatcatgtgtgattaagaatttgatcccgcaagtcagggtttattccgtcttttccaatgttagatttatgtattacgaaaagctaaattcgaaaaggaaaaatcggacttttcagggttttaatcgcccggtcgccaatttggtcaaacacctaaaatgaattatattagtaaggctcagattctcccagaaacacggtaaatcattactgtataccgtacaaatcataaacgatacgatgctattgaccaaaaatcaccaattgggttggcaaattgtcaattagtgacaatgcaaaagcatcatcccaatgacaaatgcggagctcccctgaaacgctatcaatgctg

SEQ ID NO: 22998 - DNA, 1133 bp, Heterodera glycines
aaaaaagttttgactaaaattttgtccttattcgaaagaactttaaaacaattgaaatataagcaaatttaagtttttttgattaagtttttacgtgatttgctacctaaaaaacgttaataaaaaaaatttttatttgcctattttagcgcctattcgaggatttttgtgcctatttaatgcctattttgcgattttttgtggctaaaaatcgtatccctaatcattagtgaaagcctgttcactgctggaattttcgaggtcgttaaccgtaaatctggcatccattaaataaagaacacttataaattaggaccaagactgggtttgcgcgttcagttcaccattcacttagcattagagtagagcgggaccgggaattttgggcaaaaccgggaccggaactcgatttttcttcgggaccgggaccaaccgggaaattttaaaaattcaaaaaattttaatttatttcaagtgaaaataatacaaaattacatttattattttttatttaataaaatccaaaagttaaagctaaattaaattaaagaaaattttcaaatcaaaatttcttcaattatttcaagcaattaatcatttgggctaaatggtcgaataatatttgaaatttagatttacttatttcaccacttttttcggtgcgctttttccagaaaacttttggggaaaaaggttgtccggcggtgccgataggcgtcgccgggggaaattttgaaaatttgagtgagatttgttaacagattttcaacaaaaatggcttcttttttggattattaggccaatttgtacggattttcatttaaaaaatgacaattaaaaaatatgaggatgatattttcttgataagaaaaccaatgagtatacaaaaaaaattaagaatattttacttactgtagagggattgaaccaggggaaagaagaaggaaaagtaaaggagactagccactaagccatttgcacaattgtcagtgtcacttttaaagaatatataatatattttttaaatttttccctttaaatctaattttcatctctaatttttcactcagaccccccattcttaccagtgcttgtttttcccggttcccggttgccctaccgggaccgggacc

SEQ ID NO: 22999 - DNA, 908 bp, Heterodera glycines
aaaagcccgattttccagtttttaaatttcgaaaaatttcaaaatttttcgagctaggcctaaaaaacggtgttcgggtttttgaatttagggaattcttaacgaattttcccagaaaaacggagaccactttcaagcaaccgtttttcgagctctatcgattgctgatatttttgaaaaaaattcgattttttcccggaaatagaaaaaaatttttgcctcagcgggacatttgagtcccgggcccataactcgttaggggttggttttagcgaaaaattgccttagagcaaaattgtagagcttttgaaatgctatcgaatggtgtattttatgtttggaaattttcaaaatttttcgagctaggccccctagaaattttcaaaaaatttttttgggtcgaaaaaggatgtcaaaaatatttttctggggtattttgaggtgctgagcacgaatatgatgtttatttttcgtttcaaaatttttggaattttttaaaatttgaaaatattttccaattttttggccatcggaaatttgggctaaaatttgaaaattcatatctagcctaagggttgaccaattttgagcaaataaagctttaaaaatagagaaaaatcaggagaattttatgggatttatttatgttttctaacatcaatatgaaaaaagttattccagaaattctggaaattttagatttttcagaaaaaaattcagaactcccttctgaaaagtcattctgtaaaagtaaaatactacaaaaatccgcaatttttttctctataatataaattttattttacatttttatcacatttttaaaaaaagttataaaaataaaagtgattttgtgattcgctcatgagagaaggtgagcattaggatttttgagttgaaaaattttt

SEQ ID NO: 23000 - DNA, 2222 bp, Heterodera glycines
  misc_feature (2131)..(2131): n is a, c, g, or t
  misc_feature (2176)..(2176): n is a, c, g, or t
aagcaaccccctggcgagttatcgccctggtactgaagtgtacacttttgggtaaaaaaaattagccaaggctacagccttgggcgcccaacgtagggcttaggttttgctggcaaagttgtcggggatagtctgacttaaaatcctaccagcaagagctaagcgatcccggtccaaagaaaaaatttcgtagaagaaaaactgcaagaaaaagtgagaaatcgttccccgggactcagtcgtccgcgctgaatttttttctatagttttcccggattctcctcaaaaagttgtaagacccttccaccactttcagggcgctcccggccttcggccgggagattttgttttttgaaacgaaactccttgtcaatataacgtatatattaactagcgggtgcgtgaaccgtcggatctgggaatgggataaagcgcttcgcgctttgggagcttcgctacctaggctgtgaagcgattcaaattgatcgaattggttggagattttttgaatttttataaaaattattatgggtttttagtccacgtcgaggctcaagacgggcgcttcgcgcccgttttttagcttattaggccgcttcgcggcctcagtctggcgcttcgcgcccgtttttcaaattttgttggccttggacgggcgcttcgcgcccgtttctaaattttgttgaacttggacgggcgcttcgcgcccgtatttaaatgttgttgagctcataagaggtacaaaaattgttggaagatgtgttggaagaggtacaacagtgattataagaggtgcaacagtgattagaagaggtacaacagtgattagaagcggtacaaaagtgattaaaagaggtacaacagtgattagaagaggtacaaaagtgattaaaagtggtacaacagtgattagaagcggtacaaaagtgattaaaaaacgtacaaaagtgattaaaagaggtacaacagtgattagaagaggtacaaaagtgattaaaagtggtacaacagtgattagaagcggtacaaaagtgattaaaaaacgtacaaaagtgattaaaagaggtacaacagtgattagaagcggtacaaaagtgattaaaaaacgtacaaaagtgattacaagaggtgcagcagtgattagaagagtgatctaaagaggtacaaaagtgattagaagaggtacaacagagattgaagaggtacaaatttgataagaggtacaacagtgattaaaagaggtacaacagtgattagaagcggtacaagtgattaaaaaacgtacaaaagtgattacaagaggtgcaacagtgattagaagaggtgtaacagtgattagaagaggtacaaacaatgattagaagaggtacaaaagtgatagaagaggtgtaacagtgattagaagaggtacaacagcgattagaagagtgattagaagaggtacaacagcgattagaagagtgattagaagaggtacagcagtgattagaagaggtgtagcagtgattagaagaggtgcaaaagttattagaagaggtacaaaagtgattaaaagaggtacaacagtgattagaagaggtacaaaagtgattaaaagtggtacaacagtgattagaagcggtacaatggtgattaaaagaggtacaaaagtaattagatgaggtacaacagtgattagaagaggtacaaaagtgattaaaagtggtacaacagtgattagaagcggtacaaaagtgattaaaaaacgtacaaaagtgattacaagaggtgcaacagtgattagaagagtgatctgaagaggtacaactgtgattaaaagaggtacaacagtgattagaagcggtacaaaagtgattaaaaaacgtacaaaagtgattaaaagaggtacaacagtgattagaagcggtacaaaagtgattaaaaaacgtacaaaagtgattaaaagaggtacaacagtgattagaagaggtacaaaagtgattaaaagtggtacaacagtgattagaagcggtacaaaagtgattaaaaaacgtacaaaagtgattaaaagaggtacaacagtgattagaagaggtacaaaagtgattaaaagtggtacaacagtgattagaagcggtacaaaagtgattanaaaacgtacaaaagtgattaaaagaggtacaacagtgattagtanattcattaaattaaaatattttttaccaaatttaatttaaaaaata

SEQ ID NO: 23001 - DNA, 2394 bp, Heterodera glycines
cagtgcggaaaaacggagagggggggcatttgcattggggtaccaaggtctgcggttgtttttttttaggaaaatcactgtcattttagggttccgattcactcgcagaaagggaaggtggttccgctgctccaaccgggactgtgaggcaactgcagcattgagtaaagaaggcggaactaatggtgtgctcggaagaaaagagcacaaccatctgccggacccagcgtgcttccacgcggaggtaaaacgcaacggaattaagacgacaacgatggaaaacccgtgccaaaagccatcaaaagtattggcagaaatccgtgcaaacaccaaggacgaaacctttgtttccatgggcactgacctcgcactggtggcagtaatgagaaggtttttctcttttgatacgtgtattcctctttcactcttatttcaaaatttttaggcagaaaaggaagatttacggcaacatggaccgtgtcaaccctttgagtgttgtcttacccgatgccctgcttattaaggatggcgaaagcacattgttgtatgacagccgagcgcatcgccaaggagaatcggatgtggtcttggtctttgcacacccgaagttaagttcattcatttcatgttcaatttttcgcttttgttttcagctgttggacgttttgaagcgggcgaagaaaatttcagttgatggaacattcaaagtgtcaccagccgcatggacgcagtgtttcgtgatcggcgcttttgtcaaccggcggctcgcattatgtgtgcatgctctgttgcctggaaagcaacgaaaatactacgaagaggcgctcaatgcggtcaaagcggtgatggcacccagcaccccagcacatagtaagtgatcatttctcctaactttatttcatcccaaaatgtaagtcatcagtgactttgaaaccgcaacgattcgggccatgcgagaaacgtttccagcggcccaattgacgggatgtctattccacatgagccaggcagttttcagaaaatggcgcgaaatgggcttggcggaattgtatgccaacgacgaaggagcaattgatcggagatgcattggacgaggcggagtacaacaccgacgaagacgtcatgaacatcctttcactgctgagtctgcagatgcaaggatatgtgggtggcctgcgtgcacgaggggctcaacacgaacatgaggaccgtgaatgattgatcgctttataccattggcaaaaacccttgtcttattccgcacaagtgattggattttaaacctcaatttccgtggttttcaacattttcatttgattcgaactattatttttgatgtttattataataaattttcgatttcagacattcatttacgttgtattgtactaggcaatttgtgaaaactccataaaaatgactttaaaagtttttcgagttcgaacccgggttttagaatttttttggcggagtagacgaataatgtagacgaatcgttgcttttttgctgagtagacgaatcgtcactttttggctgggtagacgaatcgtcgagtagacgaatcgttgaatagacgaatcgttgcttttttgctgagtagacgaatcgtcactttttggctgggtagacgaatcgtcgagtagacgaatcgttgaatagacgaatcgttgagtttttgctgagtagacgaatcgtcactttttggctgggtagacgaatcgtcgagtagacgaatcgttgaatagacgaatcgttgagtagacgaatcgaggggaggcgtaacacaacacccttcaaatcagaacatttctgataaatttagaacagatccgagccctgactttaccagacataaaatttttttttttgtcaattcatataaaatagcttccgggagttttcagcatcgctgattaagaatctggcgttcatttcaactaatttcgtactccagaacccgaaatcgaacttatgatcgaacatcgaaaattttaaaaatcctagtcaaatatggttcaaaaagatgcaatagtgaaaaatcaacaaactcaatgctcgcatacaattttaaagaaaaggaaactttttggttcggactaggctttcttttaaatacgctcttcagcgatgctgaaaactcctggaagctattttacatgaattaagacaacaacaaaaaaattatgtctggtaaagtgcattagtacccgcttccttttggtttctaattcgccaacactcggaggaatgccaaagaaaagaccttctcttgcggtaggtgacatgatttgcttggcaatggtaaagaattgtggtcccggatttattttttattttcggctcaaaactaactttaagcggttttaaagggaggtgagtgctaatctgaactt

SEQ ID NO: 23002 - DNA, 1325 bp, Heterodera glycines
tgcgtttcagaaccctttctgaaaaaatatttaagaattaattttgcaaaaaataaataaaaacgaaagactcagatttcgaaaattttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaattttttaaatgagaattcatgcgagattttctggaaataagcttaatagggcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaaatccaaacatttaaaaatctattaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatccaaacatttaaaaatctattaaaaaaataaaatagtgaagttttaaaaattaataaaaatttttaaattaagagttactggtgttagcatcatagcggtgcttttccttgtctttttgatgcccttgcaaaatctggtgcgcttctgatcagtttatataaaaaaagttaagcctaaactttttggcatgtttaaaaaggaattaaaaatttttaaaatatttattcatctccctttttgataatataagagtcagagtgccttattcaacttgtaaataaattttggtgcgtttcagagcagtttctgtaaaaatacttatgaattaattttgtaaaaaaataaataaataatgaaccctcctccttaataatttttctgcgcccaaggtactcactcggccgcttcgcggcctcgtggggggcctt

SEQ ID NO: 23003 - DNA, 1414 bp, Heterodera glycines
tagtttttttaataaacaaaaaaaaaattttttttttcttggtagcgattaacgacacaacgccggcctccaagccctcactcacccaaattcaaaaaattcgctaaatttttctaaaagtccaaaaagtgtgtggtttatttttgtgaaaatatgttacaaatttccccccccccccccctaatcgttttctacccaaaatttttttacgcaaattttaaattttattttaaaaatgtctaccaaactttttttttagtatttcatttttactgacatttaaagtgcattttatgcaaatgatgttgaatttttgggcaaagaaattgctccaaaagttgaaaattcacaatttcgtaaagtttcccaactcaaaatactccatttttatcggatggtgcttatccatcttcaattttttttttccacttttcccaggtccgtctctttcatacgcccaaattgcgtggcctcctcaaaagtgcgctgcccgaacgaaccaacgaaattgtgggcttacagcacatgaaattcttcgttttcgacgacactgtgctcatcacggggttcgtttttttgctttttttaaaaatagtttagtaaaattttgttgttttcaatttttgtgttttataatggctttttcgaatccaaacgggaaaatttcaatttttgaggcctcataacttttgtttttgtttttacacataacttcgctctatccaatgtagtaagtacccttattagcctaaaagcctacaaaaattgtaagaaataattttccgaaaaatgcgtaaccacaaaacattgcgactcatttggctttatcgaatgacaccaattaattatgtttaagaaaagtgtgagaattcaaaaatttatgccaactcaaatcgagttaggacaacaaaatttttatacgacctaataaattggaattaaaaaatccaaacgtataaatttttcaagaaacaaaaatctttttaaaaattatattttcagcactttttggaaaaacattaatttatcataaactttcaaaaaatcgctaaaaaaattttacaaaaatttttttcggcggcagtaaacaaagttcacccataatatgtagggagaagccattgtaaaaaatagtttttgaattctcattttttaagttttccatcggatttttcaaaaaatctctcccccaatgtttttcagtgccaatttgtccgaccaatactttgtcaaccgtcgtgatcgctatttgctgatcgaagactgtccactgttggccgacttcttcgtcgacctcttccgcctcgtcggagacaattccttccgccttttggcggacggacgcgtcgaattcaccgccgggggaacgctttcgccgacacacccggagacaggtaccaaaatggggcgagga

SEQ ID NO: 23004 - DNA, 1221 bp, Heterodera glycines
tttcaatgtcaaaggcataaaactgcaagaaaaaactttgaattttatttgttgttggacatttttcgggaccacgggctccgatgcttccaccaacgcctctttgcgacaaattgacggcaatttggtggacggattacggcccaaaacggtgtgacattggccgaaaaagaactgctgccggtcaatgcacatgcacatgtcgaagggcaagtcgtactcactgaaagatggagaagggttgggaagagggtggtaaaaattttcgttttttttattgccaacccatgattttatttatggcggagggtgggggaatgaagcgcacctcacatacagctctaatccgtttaaatttgaatgacaacagacaaatagcggagtctctaagctgaaaaagcgtcgttttgtgacgccacgcccccaaacataatccatccaatcagtgggcattgccacttcccccgccacccttgacaacagtgtgcgggggtacacatttccccaccctcacgaaaaatggtttaaaactgaaattccatatttttaattttttatgaaatattttgagtaatgtttttgcttcggctaatttcgaacccctgacccggactcgaacaaaaattcaatatgcaacaaaaccggttcaaacgcacgaaatagtttacatcttgccttcagaattgattctccgtcccagaaaacccatttttttgtgcaataaaagtgatccagccacgataatcaagcgagaaaaaaacaaaacactctaccgtatgccaacaaatcgctccaatgggccgtcgtcgtcaaaaaatgcgccgtcggtcgctaactccacccgataattaccctttaaggcacaagaaaaataaaaataaacaaataacacagtaaacacagaggaaaaaattgccaaataattacaaaattgaacaaccgcttcaattggccctttgtcaacaaaccaaaaaatccttcgaattcgccactcacaatttttgtgttttcggagaccaactttatacaagttggaagcgtatgaaaatatggcctgttttttttaaattttgtatatttcgaattcaattctgatcactgatcacatcattatcattagcatcgttatcatcagaacagatcgtcctcctctccgccgccgcaattcgctcttcgccgcccgtccggtccaccaatccgtccatcacttcgtcctcctcc

SEQ ID NO: 23005 - DNA, 905 bp, Heterodera glycines
  misc_feature (48)..(48): n is a, c, g, or t
  misc_feature (98)..(98): n is a, c, g, or t
aaatcaaaatttctagtagtttgtaataaaacaggagcaacaatacgncaagaaattcggcatttttgccaaaaagataattttttgaatttttcttncgtcgagtggtgcaaattgaaaaaaagagattttgaaaggtttatttcaatttggttagtttaaaactgaccaagaaagtgccattgcccgacctaaggtcgatgatgtatggccgggtcctatgaacgggaaatgcattttcttcttttataagttttcttttttttttttaacattttttggaaaattttttcacagaaatgaatgttttcaaaaaaaaaggaattcaaatttgccccgtccgatcggaggtggaccttgatcagtacgcccttgtacgtgttggtgtccttggctaactttccgctgggcacaaatgacggcttttccttctcctcctccccctcccccgtgcgctgttgttgcttctccgcttctcctcccccctcttcctcctcctttttgaccgtgtcgtcctcccatttcggcttgtcccagccgcccggcggtggctccccctctcctcctcctcctctccgtccacttttccgtcgatgctcatggtggtgttcatggtgatgatggtggtgttgctcccgccgttcccgtcctctgtcccgctcccggcgatcttcgtcagcacgactggtggaaaaaaaatttaaaaaattttgtacgataaagaattttgaaaaatttttgccgctatttaaaaaagtggcagttttaaaaagcaaatggggcatttttggtttacaaaaacttttttaagatgatagatttgtaatcagcaaccccaaaagctcccgggatcaaattttatgactaaatacaaaaaaaaatttttttttcaaacttaaagggta

SEQ ID NO: 23006 - DNA, 2620 bp, Heterodera glycines
cccccctacctgatcatttttccgatcactcattagttgttgtccctttgccccccccctttccctttttgcttctcacttcgtgcgaattcgctctgaattggcactgttcctgctcctcatccgcctgcacttccgcctccgattcgcctccttttgctggcattgtgcacacataaagcgcgccgtccttcaaacagtcggccacgtgtcggtggatgtgtttgtccaacatggccgggcttttggacacgtgtttacagcctaacagagggcatttgcgagaagctgaacagcagaaggaggagtcaattcaaatcagaaattggcaaaatattctaccaattgacgaacatatcaaaacggagtgccatccaattgcccccccccctcccgcccgaaatgtaaattggaaaaaatttaagtaatacggtatatgtacatataatgtctttgaacagagttcgcccgctctattcgattctttttgggttttgttcacttaattttgaccccttttcctattctgtcttaaaatttgttcgtccgtctcccattggttgttaaacttgcccaagtcgatggattccggcagtgcgatttggtgacggtaatatttgtgaaagtgaatgtaccgcgcttctctaaacggaaagacactcttttggcagtattccgctgggcttggcttgcctggtggtgaactgacatccctcctcctcgcaacggatgggcgggttccgatggtaaatggtcacgtggtaactgaccgagttgtagcgaccgtacactttgttgcacaccaaacaccgatagcctaagggaacgatggcgaatttgatggcaatatttaaattggcattgcaatggcaccttttttgactatttgtatgtactttttgttgcggcaccacccttaagtggggaaaagcacattcattcattggtctgatcatttgccaccgatcacttgccttctttgtcgttggatggcaccagcatattgttggcaccacccgctgatgattgggttatgctgtccaacgattccgtgctgttttccagcggatggtccatggacacggaggatgaggacagggaggagggggccccactctctgtcgaatggacgccaattgcggtggaggacgaaagagacgaatccgaaacggcggtcgattggccaaccgaaggagaggctctaaaagaggggaaattaagtgaaaagcattaaattcttttttagagccaaatgattaaaagggcgacgaatgaatggattgtccgaattggcattctttgaattggttggtccttccccccccccccctcccccccctttctccccttcccaatgatctcatgttcttcttcttctgctgttcatcaccacataccttcgttgtcatccacaactttgctcaaatcccttctaattgatgatgagaggcgaaaagtgagcggggattagagcagcacacaaacgcaattgaactttccctcacttttcgcccattttctcatccctttttggttaattgggcaaaagcagcggaggattatgacaaatgactattggttgacttcggctgctcaccttttgctgaacatttgggccaataaggctgacattggggcggcaaagccaacggcggaaggggcggcaccaaagggagccgaaatttgaggatggtgggcaaaatgggccaaatctggtggcatgggatgagcgaagtgctgttgctgttggtggagcaacgattggagttggagataggcttaaaagtgggaccggaagtaagaaaggaacaacccattgggacaaagccaaaggaataaacggtaaaaaggaaaatggcaaaaaattatggcacaaaaaaaggagggaatgccaacgccgggggaaccaatcaggacaaaagacctacccaaatacaatggcaactgattttcgttgtttggcatcggacgaaagttgacggacccggaagaataaatggaagaggaaggggaggacgaagaagtggaggaggatacggcggaggagagggaaagagaggtcggaagggacggcgccgaggagagaaatttgccaaagagtgccgaaacctccaggtcggtgagttcaagcagtttggccaaaaatagcagctgaaactgacaacaattgagcatgccaatcgaggagatcaaaccgaagaagggtcgacccccgggggaagggaaaaggcgccggaggcacaagacgaaacaccgccgtacagaacagtcagaaaggatttgaagcagtccaaggcattgtccagcatagacagatctgtggcattaaattaaccaaatttggccaaaagaggagagtttgttggtgattggttctgatctggtcgcactgctcccctccctcgtccctctttttgcccttccaattgttttcctaattcgaatcaatccctctcgtttccccttcccccctctccccattttccccattttcttacccaatttgacttcgtgcacttccctctgcaccgccgtctgtgtaaatggtatcagcagttcgctgccgtcgttcaacttttgaggggctcactgctgctgttgccgaacatcgcattttgga

SEQ ID NO: 23007 - DNA, 2827 bp, Heterodera glycines
ttgttgtgtttttaattcaaatttccggtgccgttcaaacccgaaaagtgccaatgccataccaaaatgcaataaaaataattaattaataatttgtctgcccaatttttgaaaatcccaaaaaatgttcccaccatacaatcccacatcattcgcgcaatgtccgcgtcatttttctcgtccattgaaatgttgcggaacagcggcgcactgaggcgaaagaacagcgcccgttgttggatgcaaaaagcgccggctcgcagcaccggcaccccttcggtggcagcaaccttttgaggggaaaatggggggaaaatgtcaactttttagagagaaaaaatctaattttccatttttaaatagggaaatttttaatagcaaaaacagaaaaaaacaatgaaaaatttaatttattttccatttttaaattggccaaaaaattgtggaaaaaggtaattaatttgtagggagaaaatcgatgaaacatttttacttttcatttttatatttggaaaaagacattaataaattaaaaaaaaaatttttttttgaaaaatttaagttttcctttaaaaacatttttttgtattgatacaatacagtacctggtcaaccagaatttcaccgatggtccaaaaggcgtttattgaggtgagcggttgggcgatccagttttgcgcaacttcgatataagtgggctggaaattgcattcgaattaatgacactttgtttttaaaaaaaaaccttcaatggagtgggcggaatgacaccggtgccaatgctgagaaagcatccaacgttcacggcattgggaaaattctgaaaaaacgaaaaaaaaaattttaaaaaaatttatttagctgttgttattggtgttttaccttgtacttgtgaagctgtccaaaaattgatttcctggagcagttccaatgacgggttgttcgcaataatgcctgacaaaaaatgagtgagggttatggaaagaaaaaccacatattataatgggatggaatttcattaaaatcaaccaaaaaaattcaaaaaacagaaattcatcatttaaatttcgaaaaaccgcttttttcttgtcaccaaatgcattttaattgtccaccgattaatacaacaacaacaatcaaagcaccactgttcacccacctccatcaatgtatttgttgtccacactggcaaaataggtaggtgctgaaaatttttcgcgaatttattaaaaaaattttttttttttttacccgccgatgaacgcctcaacactttccacagcaacaaatcgtcgggcgtccggtagccgagctcctcattctcctcgtcatttgtcggcagtttgtagttgcgcatcagctccagctgaaccgggaagaactcggcccgcgtggtggtgaacataagtctggaattttttttttaaatgaggaaataatttaaattttcaaattttatcttcccatataaatatttttcggcaacgtccccgaaatttaaaaaaaaaagaagatattttcaagaaattttacaaaaaatttttgctttcaacgacacatatttttcaaaaaaaaaaattccaaggatttttttccgagatttttttcggcgatgctatgtccctgacacattttgggaacaccgaagcaaccttggccatttgaggtcgctgaacattgtctcggcccccatctcctggcgaatgaacttctccagcacctgcgtgttgtgcggcctacggttgtcgaacaccatgtctttgaagcgcaagtacagctgcaaatgcaaacacacaaaaatcagtaaaataaaaattaaaaaatctaaatttttttgagtttttttaattccaaaaatttatatttttcagcgtaaaaaataataataagaagtgtttaaaaacaccaaaaaaaaaaaaaaaaaattttttttttcatgtaagatggacagacaaaattctctgcttggataaataaatttagattttgaattattgcaaaaacatgttgaattgtcaatgcgataaaaatggaaataataaaaaataaataaaataaaacccgctgaatttggtgcagtgtttggcccattgcgagcccggcagtgaccatggcaccggtggaagtgccgccaacccaatcaaagtaggggaaaatcggctcgcccatgatgcgctcaacacagatcagaagctgaaaatatgacggaattagcattaccgatttgaatgccgtggttttgtgagaacatttttaattatatgaagaaggaccggtggcagagtcccaaaaactcaaaaaaaaatcttttttttcaccctaatcgttctaacaatcgtgtcccgacatttgcgcctttgtcaaaatcgggttcaaccctacatttttcaatccctgatcgggagcagcccccaaaatgagggatccccttcgcatcgaggtggggccggcttaagaggtggggggggggggtcgtagagaagggaaagaggggaattaaatttggctataaaccgccggccccccttttcgcaaaatttcttgaaaaaagcgcgccgcaaaaaagtgcttttgaaaagcaaaaaaggtcgtcgatttacatggccgagacccttcgcaaaaattttggttgacccaccccccccccatgacgaaacagaacggcattgtgttcacaccaacctgaatgatgaccagcccacggatgccaccgccatccaacgaaaggacattgatgaaattgtggtcgggcggagtgtcctcatccgaggacacttcgggcaacttgtccaacacctcgtcatatatgtccttaacaacatattgt

SEQ ID NO: 23008 - DNA, 2154 bp, Heterodera glycines
aatcactgggactcaacccaccagcatttcaatcactgggactcactcaacccaccagcattgtaatcactgggactcaattctgcatttcaatcactggcactcaacccaccagcatttcaatcactgggactcaacccaccagcatttcaatcactggcactcaacccaccagcattctaatcactgggactcaattctgcatttcaatcactggcactcaatccaccagcattctaatcactgggactcaattctgcatttcaatcactgggactcaattctcctgcatttcaatcactggcactcaacccaccagcatttcaatcactggcactcaacccaccagcatttcaatcactgggactcaacccaccagcatttcaatcactggcactcaacccaccagcatttcaatcactgggactcaattctgcatttcaatcactggcactcaacccaacagcatttcaatcactgggactcaacccaccagcatttcaatcactgggactcaacccaccagcattctaatcactgggactcaattctgcatttcaatcactggcactcaacccaccagcatttcaatcactgggactcaacccaccagcatttcaatcactgggactcaacccacaagcatttcaatcactccagaattcaatctcaccaattcttcgaaacccaataaccggaaatgaatgataaaaccgacagcggctcgaccgcttagcggcctcgcactcttcttttggcattttcttatggcataacagttcttccttgtttcttgacattttcttacgacacaacatttttcttctatacaaatttttcaaacaaaatctcattcattcatttaaaaacataagcaaaacaatacctttcatatcaaaatcaaatcaatttaaactcaaacaacaaagaaagaaaaagaaacatttttaagactgttttttacacaaactgacaaaagaaaaactgtaaaacaaaaacatttcatttttcaaagcatttatacaacacaacacaatgttaatattataggattttcttactgaataaactaaggagtgtcctctttcttttattaaatattttataaaataaaagatgggatataaataaggaaggggtgctagacaaattcactattgtctctcccttccatttcttttactctcttttcttttccattgcaatttactctctttttttcccactccctccttctcccacacacacgcacgcgtccaacagactgctgctgcacagcagcacgcgtctgttcactgtatgcccctcccacccgccgctgcccgcgtagaaacacagtcagacagtgcactatttcccacctttccctccctctactttttttcaaattcatttttaacgcaaaattcaaacaaaacgccacactaattcaaaacatggacacatccggacagacactcaactttattatataggatcatgtacaatagaatagacactgacaaatgaatgtagcgcgaagtcgaaaacataatcgaaaaatttgatatactttttgtcattttaaaaggaatttgttaatattcacatagtacatttgcgccttaaacagcatgcacaccggttcaaataatcggattggcattcggtcggggagtgccggtgagacattcatcccctttaaaaatgataatattttttcactaatttcagcatcttctgcatcagcgggtgctgtaagtgatgagcagttccgttcgtccttcgaggcggtgccaaatgttcgggtcagtccgtcttggacatgggaaggggcacacacaaacgcaaatttattatgcttccaaaggttttcgggctcgctgatatgaatctgacatttattttaaccataacgaatcacctatctaatatttgtgataaataaacataaatgtttgaaaaatcgtgaatttttgatattttattttttggtacttatacagtttaggccacataataaatttttttggtttttaatgataacaacgtgtttccagaggtattcggggcgtcgaaaaggatgtcatatccgtgatcagtggtcccagaatacaccgtggaactatgatagggattttaaaaacaaaaaattttttatgtggcttaaactat

SEQ ID NO: 23009 - DNA, 1101 bp, Heterodera glycines
  misc_feature (52)..(52): n is a, c, g, or t
gtcgcgcgaggccatcgcctgcaagtcttgaatctcggcgtcgtgcgcacgncggaggaagtcaatctcttccagcagagtctgcacttggtttggtagtcgattcggttcagcgtttccttcaaaatgcctttttgaatgccaaaatcccttcggttgcccccttttctcacctggtccaaatcggtccgggctttttgcatttcgccattcaaatgttggttttcccgtctcaatgctttaaggtcttcgtccaaaatttccagccgtcgcttaagcattgccaattcggcttccaacgaggaaagactctgcaaaagttcttccatcagttttttgtccccttcgtgcgctgtcactgcgttggcattcctttaacattttttataattagcattaatgcatgtatcatttgctcatctctaatggcccacttcttcttcagtgtgtccatttcctcctccatcgctttcgctttcttttccaattcgtctttttggcgttgtgtctcttccaacagtttttttgcttgtcttaagtccgtctcgtacatttcgcgcacattggacgtgtcttttccccatcgtttgttcaaaaagtccaaatccgttgccaattttcggttttgtgcctccagaaaacgtacctaaaaccaaccgattgatacctaattggcctgttaattatcttaattacccactcaccttctctatgtaagtggccaaccgatcgttcagttcgctcatttccttcttttctcgctctcgcgcatcccgaattgcggtggctgtggtggacgcgggataaggcgacaaggggcgactgctgatggaggacgactcgctgaccatcttcagcacacgagtgccacccccgtcggatgagtagcgagtgggcgacaacggccgagggcgggagaagtacgggcgagaggaaatggcgcttcggtagtcgctgctcgccacgctggggggctccatccttaacgcgaaaggacggctttcaccaacagtagcaagtggaaaaaaagaatgattgtgcaaaatgtgtgacgggatgggggagggggcaacggatgagcgcaatcactcgcccccttcc

SEQ ID NO: 23010 - DNA, 1236 bp, Heterodera glycines
  misc_feature (26)..(26): n is a, c, g, or t
agtttttcattttctatgtactttantaagtaaacaataataatcaaacattttctatgatgcaaagcattaaaaaatcataggctttttattttcattatgttttggaaaaggtcaattaaataaacaatttttttttgtaattttattaattgtataaatcttatgcaattttctataagcaatcgatagtgtaacaaatagagaagataagttctgatcaaacacacacctttcattatttccggttaaatatgtgttcatattttaacaaaaagcagtcttgaatgtcgtcgaaatttgtggtaattccatggctatagccccgaccaattgcgctggaattttgccatgaggcttattttttgtgctggtttcgaatttacaggcgcccatgcaattggagcgcattaaattttttgtcgatttttcttcaatacccactttaaacgataagcatttcctcgcacaccgctctatttgctctgttttaaacaacaaaattttcccaagcattcatacctactttcttaattgcactgggatcacatctaaacgactatgctaaaaacggggaactaaactgtattaatatttttaacaaattgcagtccttttcgcctaccctgttaagagaaatcttaatttcactaataatttcccaattttcttctataacagattaactcttctatggtgagtttttcaatttctatgtactttattaagtaaacaataataatcaaacatttttctatgattgcaaagcatttaaaaaatcataggcttgtttattttcattatgttttggaaaaggtcaattaaataaacaatttttttttgtaattttattaattgtataaatcttatgcaattttctataagcaatcgatagtgtaacaaatagagaagataagttctgatcaagcacacacctttcattatttccggttaaatatgtgttcatattttaacaaaaagcagtcttgaatgtcgtcgaaatttgtggtaattccatggctatagccccgaccaattgcgctggaattttgccatgaggcttattttttgggctggtttcgaatttacaggcgcccatgcaattggagctcattaaaatttttttgtcgatttttcttcaatacccactttaaacgataagcatttcctcgcacaccgctctatttgctctgttttaaacaacaaaatttccccagcattcatacctactttctt

SEQ ID NO: 23011 - DNA, 2254 bp, Heterodera glycines
cagggctggagcgcgaccgcgatccgcgatgcgcgatccgcggcgttttttttgcgcgatccgcgatccgcgaccgcggcaatttgaatccgcgatgcgcgatccgcgaccgcgggatttttctgtgcgcggcgcgccgcgcataatttaatttattaaataaaaaaccaaataattttgtattattttcacttgatataaattaaaatttgaatttttttttaaatttttaaaatttttttgaatttttaaaatttcccggttggtcccggttcccggtttttcttgcggtcccggtcccggcttctcaggtcccggcaagttccggtcccggttttggcaaaaattcccggtcccgtggcactctaatttgaaggtataaaattttgaaaacgaccaaaattccaattttctcgcgcatttaaatggaatatgcaatcagaaaatatttatacattcatcgttcattttatagacaattttcctctttgtaatttagaccaaatgaccaacgaaaaagactctatttggttttattttggcaaaattcacaattcttcttattttacaaatgtgcgatccgcggcgttttttgcgcgatccgcgaccgcggcaaattgaatccgcgatgcgcgatccgcgactgcgggattttttttgcgcgatacgcgatccgcgaccgcggcaaattgaatccgcgatgcgcgatccgcgaccgcgggatttttctgtgcgcgccccacccctgttaggcaggtgtgactgattattaatttgctattcttgtcatttttgaactttttaagtgaaaccccgaagataaatttttgaacagccaattcaaatgcatttcgtaaaaaaaatatcgttaaaattacgaaagtgctctaaattttactggaagatttattttgtttattacgaaattatcaagcaaaaaatctcggaaaggggtagagactatgcacatatttctgaatttttcatcaattttcacaaaattttgcaattataagatactcaatttcgcattaatcatgtccataattttttattaataaacgtaaaattcatatttatttgaaattattaaattaaattatttctttgacaatttacccatttttaattatttcacaaaatttcaaaacatcgcccgccacaaaatgaaaaaaatatttcgaaatgttaaatgtttggaagaaatcgtatttcgaaatttttgcgaaattttgctgaaagataaaccaaacaaaacaaacaagcatttaaatggcgcacattcaaacattgaattcattcattcttttgccatttatagcttaatgcctttttttgtaatttttcatcaaatttaaataaatatttttattttaaaataatatcattattttaaattaaaagaaagtaaatttactacaaaaattgattaatttagcttaaaattcaccaaaaatgcagcttttcgtaagaaatctcgtcgggaaaacaattgtcgtcgagactgatcagcagttcggcactgtccgatcgatcaaagaacaaatcgagtaaattgaaggcatcccaacggatgatcagattttggtcagtaatatacaaatcacttcaaaaatttaagcagaaaaactcgaaataattctaattttttaaattattaagtaaaaaacatttacttatttgattttactattaatataattacgatttatttttcgatttttattcttccattttgtgcaattttatttaattttttaaataaaaaatgaaaaataataattttgattttggtttttttaaagtaaaaacacttacttatttgcttttactattaatataattacgatttcgattttttcttcaattttgaggaaatttatttaattttttgaatataaaaatgccaaaaaaagaataatttagatttttgctggacacattctgcacgatgaccagcagttggccagcaattgttcttcttcttctgctggcgatttgtcctctggcagttccattcatttgtctcttcggcttaatggcggcggttcgtacgatcgatgcgacccaaaattggtgcaattggccaaatgttttcgatgggataagctgatttgcaggtacacaaaatgggtattttaatattcaaaatggcttgtggcgcttggccagacaatagagtgccgacggaactttggccaattccgtcccaccaggggagagcatcatttaactatttttaattgtcaaaccc

SEQ ID NO: 23012 - DNA, 2067 bp, Heterodera glycines
  misc_feature (1482)..(1482): n is a, c, g, or t
tgatttttgatgatcattggcgatcaaattggtttctttatcatcacactaaatggttatcaattaggtaattcatcgccgctattcgaaataatttcttttaaattttctcaccgattttttaaatgggcgaagaatgaatagcccggttttccgtctctctctcccgccccctacaaatttttcaaaattaaactacggatataataatttttaattattttaatcccccctccctccgatttttaaaaggagcggagaatggtcccaattttcccgtctcccccccccgccaatttgtcaaaaatcaaataggtaattatggactcattaaaatgggtatatttttttaatctccccccccccctgattttttaaaagaaacggagaatgaatggccccaatcttccctcttcgcccccaaatttgtcaaaaattaaactgctcattatggactcattaagactcactcattaaaaagggtatataattttttaaattttaaacccccccccccatctgatttttgaaagaaacggggaatggcccaattttcccgtctccccctcccgcccccgccaaaactgtcaaaaattaaacaggtaattatcgactcattaagactcattagaaagggtatttcttttttttatgacagtccaatttgttgattagagagagatattattatcatcatttaccatctaattttgcaccattttatcagcattatttttctaaatttaaacaacaaataaaatttattaaaacaaataaaattcgtcgaaaatgttttatggttgggagggggtgggggcaatgaatggtcggtcagcagccgaacacatcccgagttttatgatgagatgcgagaatcactctaatcattcacattcattagggctactaattgattacactcattagttagtaattaaaaatagtaacattttctgtgtaatgaaaaagaaagaaacattttggccaaagggttaaagtgcgaccaaaaattagtttatttatttgtctcatccaaaaaaaagaaagaaatatttttttgtccccattttatgcataatatgtatgtacagggacggtctcaggagtttggcttggaaggaatattcaaattttttttttttttaggagagggggtcttaggggacactactatgaaaaatcaaaaatttctaaaaaaattctagttttgagggccagacaaatttttttttgaaaaaaagttttcgaaactttcccggcgggcctattccctaaaattttagtataatatgaccctagaatccaataaattttaaaggccgataaactttgagtctaagaaaatttgaatttcaaggtcgggtgtactgcatttgaaaaaaaaaatgaaataacttttgcctcccttttttaaattcttccttcgcccctgtaattaacgctaattgccacatattgtaattatctcatctcattaatatntaatggttaattatgtgagtgtaatgaatgcctttacagcaaatgcacaaataggaaaaaacaacaacaaaatattcttattgtatttgttgcccaaattgccatcattagcagcaacaacaaaacgacaacaacagttgcactttttttgttgcaaatttgatcacttttttgacgaacttggcattgaattgtgatcagccgtagtggtgatcactgatcgaaaccactttttcgtgcatttgaaaaaaaattggtaatctacgatttttccgcgatttgtaggcctatttttgcacaaataattgacaattttgtagaattatgtagttagttaattaactatctaattgattaattattgcctatagcttttgaaactaaatttttggtaaaaaaatatataaaaaaaattttcagaaaaaacgaaagtgaaaagataaaacgagtttttcgaaaatataaatttttcattttttacaaaagtttccagggcgttgattttatttgcagaccaatatgtatgagtaaacataagggttcggatgtggatttcataacacttatattgttgtacacatcaaa

SEQ ID NO: 23013 - DNA, 1085 bp, Heterodera glycines
tctcagaagaatagatattctcagaaaatggctatctcttttttctacaccgttgtacatgtgggttttccccaaaaacgcattactatctgcggttgagccctacaaaaggtcggtttgaaaattgctgtctcagaagaatagatattctcagaaaaatggctatctcttttttctacaccgttgtacatgtggggtttccccaaaaacgcattactatctgcggttgagccctacaaaaggtcggtttgaaaattgctgtctcagaagaatagatattctcagaaaaatggctatctctttttttctacaccgttgtacatgtggggtttccccaaaaacgcattactatctgcggttgagccctacaaaaggtcggtttgaaaattgctgtctcagaagaatagatattctcagaaaaatggctatctctttttttctacaccgttgtacatgtggggtttccccaaaaacgcattactatctgcggttgagccctacaaaatgtcgggttgaaaattgctttctcagaagaatagatattctcagaaaatggctatctctttttttctacaccgttgtacatgtggggtttccccaaaaacgcattactatctgcggttgagccctacaaaaggtcggtttgaaaattgctgtctcagaagaatagatattctcagaaaaatggctatctctttttttctacaccgttgtacatgtggggtttccccaaaaacgcattactatctgcggttgagccctacaaaaggtcggtttgaaaattgctgtctcagaagaatagatattctcagaaaatggctatctctttttttctacaccgttgtacatgtgggttttccccaaaaacgcattactatctgcggttgagccctacaaaaggtcggtttgaaaattgctgtctcagaagaatagatattctcagaaaatggctatctctttttttctacaccgttgtacatgtggggtttccccaaaaacgcattactatctgcggttgagccctacaaaatgtcgggttgaaaattgctttctcagaagaatagatattctcagaaaaatggcta

SEQ ID NO: 23014 - DNA, 1647 bp, Heterodera glycines
  misc_feature (1558)..(1558): n is a, c, g, or t
  misc_feature (1564)..(1564): n is a, c, g, or t
  misc_feature (1574)..(1574): n is a, c, g, or t
tacaattccattatgattatttgcgcggcggcggcatcgtggcgtggggagggagggcgttgaggaaatgcaaaaaaaaaaaagcacacgtgcagattttcaaaattcaggataaaaaatcatataaaaaatctcaggatttgagaaaataccccaaaaggtttgggatcaaaaaggaattaattggcaaaagaatttccttcacctgtcactttggtgacaggtggatgattgatgaccttcccgcggcgctgcgcggcgcgggaaaaaaacacccgcaacaatttgggaaatcggatttggtcaggcggcaacttcaaagtggtccaataggttttggttttgaaacaccccccatcgtggatttttgatggggcggcaacttcaaagggctgcgccctcccataggcacgggtttgtgcgggaaacacccgcaaccaacccgcaacattttgacactttatactaataacgtgatgtcccatgatcgaagatattcgagattgcaattattgaaattgataaaatctttgaacgccgcgggaaattctttaactgctgcatcatgcagcggtatattattgatgttgtcgttcgagttgaattttagatataaatcatttttaattaaaattaaacgaaattaatagtacttataaaatttattaattaattaaagtaactaaatttttctttttattaagtattctcattgttctatcttgcattttacatgaatttttataattaattattcgtttttattatcgaattttaagagagataaaattgagttttatcgtaaaatgcatacaagagcacgtctatactgattttataaaagtttttagtgaacggtgtaatttggcttagagtatttgccgatgtgcgacgtttcggtgcgggtgagggagaccggcttatcgaagctgattgccgttaaatcaggcagaacaaatgtgcgattgttcataagccatgactcagcatacaggcacacgaagtacccacaactattaccatcgtgttggaccgtcagattttcgacatcaacaatccatgtcaacactgctgacggcaaaatatccgaaatgatatttttaattttatccgtcattgcggatccaacctgccatatggggtaggcaaagaatcggcaaaatgagtgccaaattgcacatcatggacaatgagagtccaatgtccagggaaatgtacttgcaaaagtataacttctgccggaacattagggtcgtacccaaatgtcatatttttgtaatgcatgactctgtccaggccatttctccataccattgggtcaacaacgaccacttttcgttgtgatacggttgccaagtatgccaaatatgtggcagcaaagccgtcattgagaaactgggtcagatcattccaacaggtctcaatgtatcttgggccagatcttggggcaatcggtgtttcgccatcacgttcgtaaaggccgattgctgcccatttccaaattttacaggcaaaatttcgcgatgtagcgaaattaattgacactgtgctgaagttnatcttntcaggcacangttgacaaagggtcactgatgtggtagcttcagagctctggtccattgacgagctctcgctcatggaatcatt

SEQ ID NO: 23015 - DNA, 1435 bp, Heterodera glycines
tcgcgcccgttttttagcttgttaggctgcttcgcagcctcagtcgggcgcttcgcgcccgtttttcaaaatttgttgaccttatagggattataagaggtacaataaatggtagaagaggtaaaatagtgattagaagaggtacaacagtgatcagaagaggtacaactgtgattaaaaaaggtacaaaagtgattagaagcggtacatcaatgattagaagaggtagaagggtaattagaagaggtacaaaagtgattagaagaggtacatcagtgattagaagaggtagaagggtaattagaagaggtacaaaagtgattagaagaggtacatcagtttaaattttattttttacaaattcaatgtaaattgaaacatgatattctttaattttttattcaaaatttaaaaattatttttaataaaattttcaccaaaaaataatttaattcaaatgaaaaatttttatttattattaataaaattaaaaatattttaaatgaataaaaattgaaaaacagaaaataaatgtgtagaaaattattgtacaccgtccggatccgaacctgccccctcccccctcaaattgatgcctcagaatccccaatcacacagggattctgaggtcttgacgatgtcaaaagtaaaatctgatcacgtattcgtgatcagcggcccaaataacccctaaagacatgtttttggaagatttttgtgaaaaaaattttccagtcaaaaatcctggtcacccccctttggtcccgaatccaaaaatcacttttatttttataataattcttaaaaaagtgataaaaagctaaaataaaatttataaaatagaacaaaaaaatgcggatttttgtagtatttcatatttccagaatgacttttcataaccgagttatggatttttttctgaaaaattgaaaatttccagaatttctggaataactttttttcttttgaggatagaaatcccaaataaacctcataaaattctcccgattttttgccatttttaaagctttaattcacttaaattgaccagtcctccattgagttatgaattttcaaataataaccaaaatttccaaggaccaaaaaaaataaaaatattttcgaatttttaaaaaattccaaaaattctgaaacgtaaaacaaacatcatattcgtgctcagcacctcaaattaccccagaaaaaaaattttcacccccattttggcccacaaaaaaaaatttgaaaatttctaaggggcctagctcgaaaaattttgaaattttccagacttatagtacaccattcgatagagtttcgaaagctctacaattttgccctaaggccattttttgctaaaatcaacccatgacgagttatgggcccgggactcaaatgtcccgctcaggccaaattttttctattcccgggaaaa

SEQ ID NO: 23016 - DNA, 3469 bp, Heterodera glycines
tttgcacgaatagttgtggcattaatccctgctactctccctatccctattctaccagtttccagttttcagcttaccttgggctgtgacatgcggcgccgtcgcaattgttccacgcggcgctgcaccgcttcgttggccgccgcgtactccgcgcagcgcggatggtgccgaatctgagaatgaataaaacaagaaatgctcaaattgggcacttctctgcgcgaatgggacatttcgatgaattggcccggcataaatttcacttgtcgtcgctgattttttgctaaataagtaattagccatacattaattacattttctcttttcaacctcccaattcatttccgtcgtccccattggccataaatgagccgaatgaatcgcggccgacactttggcgctttttgctctgaatgagcaaacttagcttttttttttgtaattaattgtttcaaattttaattaccccttttgcctttagcagacgacttcgctttcgactgatggccaacagcggcggttcgtcggattcggacggatcattccgcggccgattcatcatcagaaaaatgggcaaatagcgcaggaatacggtacgaacctggcacagtaaatttaaaaattcgaatgaaaaatgagtttgattcggcaaaagatggcaatggcacacattactcacccattcgggcattgtgtgagtggtggggccacggaaataaatgttaatgatgatgaccgtgaccaaaatggtgatgatgttcatcactgatgtgagtcaaaggcgtattaattaagctaattgtaagccaattaccaaaagtcatcaaaaggtatttggcaatcagaggaattgtgtcggaagtcggaggcaaaattttggagaccaacagaagaaaacgacaagggccaacagaatgctaattgcctaattagcaaatgagagcaaattaattaaaattaattttttaaatgatttaaaacataatttaaattttataaatgtttgatgcaaatgccggaccaaagtgattttttcgtcagcttcggctggcaaataaaaaacgagcatcgaaaggaaagccatcagtacggtagggatgatcaggattacggtatagaagagagttttccttaaatgggaaaatgtgtttttatttgaattttcaaattcatttttattattttgctctcgctgatcattcatttcccaccgtctgattttgatttgatatgcaattttgcttttctgatggatcagttgccccggcacttccattatgtcccaaattccgctctccgagtaatcgttgagctccgcttgacgcttattgttcaaatagctgatgatcacctaaatgaccaaaccgcaatgagccagaaagttaatcaaacagattatttacataattaatcgcattattaatttttaagttttgtagtccgtcctgattaaatccaaatttccttcaattttgtccccatttgatcatttgccaaataattgatggttttggtcacttcgtctttgttgaaagtccacgatccgaaaatcattgcacaaatttgttcatcgaacgggaaaaactcgacgtcgatgatgcacgaggatttgtatatggccggcggaacccacaacatttccccgttgtgctccaccacgacattggaataaaaggctaattggggggggggggggaaagcatgagagcggtgatcagatcagagacagaaaagggactgatcagataaaagaggaaatcagtgagggaaaaataattagagggaggaaggggaatgataagaagaagatcagtgagggaaaaataattatatcagtgatcagagggagggaggggactgatcaaaggaatgaagaaaatcattagggaaaatgaggtagggagaggactgatcagaggaaaagagaaattagtgagggaaaatgaactgatactgatcaaatggacaataagtagcaaaatgacacttacaaacttcatagttcccatcagcattgttgaagcttaacactcaattttaaaccattatttaactcatgactcacagaacgatgtcgggcagccaaactttgtcgggagggacgcgaattgtgcgaatgtttccgtattcaagcggattcctgttggaaattaaatttaaaataattatatttttaaaatggaatgttggaccattgcatttggtagtcaatccatcgcattgttggccaaacgttcgtttgcataatctgaaaaatattttatttaaattttttaaataattaaaaaataataaaattaatttaattaatgttaattaattatttgattctcaatttgtgcctggtttttctcgtccacattaattagcaaagtgagtgccaacgaaaagcgaatttccaacggcgtcgacgaaacatttggcaccggacggatcagatgattatagccacggaacagatcggcgatcagacgctcttcaacgtcagaagggaacgctgaaaatttattattattctattaatgattaattaaaacaaatttggccccaaaaagtttcgtcggactggcacaacaacgaaaaaaaaaaatttatgaaaaattggccaaaaaattaaagaatttaatcatcatcaaattgtttttcccaacaaattcgatctcatccttcgccttccatttgctgctgcgctcgcgcactgagacggcgcaaaatttcctgttggtcccaaattcaaaaacgtgcggaacactgaacataatgtcaatggtcccgcccaggctaatgcccaaaaaactgaaaaatcacatccctagtgattattttctataagaaactttacacaacaacaacatacggccaatgaccttggaaaagaaaaaaccaaccccccccccccccccaaagggatttaaataaaatggaactttgcaagtttttgaaaaactttttttgctccctcctcccccctctcattttttcccccaaaaaaagaatagatccaatcaaaagcgccaattttttgccccttttttggcccccccttctgagaaaatttattaaattataaaattaaatttttctaaattaaccaaaccccgcgagttttggcccaaaaaatttgcccggttggcccaaaaagggggttaaaattaattataaattattttatttttaaaaaaaaaaaaggaaaagggcaaagggggggcaaaaaggtgcccccctttctcccgtccccccccccccccccccccctcccccccccaattttttcacccccccccccccccccccccccccccccctcccccctccccacaaaaaatttttctcccacccccaccacccccacaccaacaaaaaaaaaaagaaccaacacccccccccccctccccccccctcccccccccccccccccccccccccccaaaaaaaacaaaaaaaaaaaaaaaaaaaaaaaaaaaaa

SEQ ID NO: 23017 - DNA, 1317 bp, Heterodera glycines
atttattattttatacaataaattatatttttataacttctcttacatagatgccaattaatggataattaattattaatttatttttttcatttatcccattgcatgatggtcttctttttaataattgttaattgttaattatttttattttttattttatacaattaatataatctaaaaggattaaattttatacttttaatattaatatttatgtaaaatattattttataaaattataatgatattttgatagaaagaatttgttattcactttttttattattttattcaattattgtaatttaaaagttttaacttttattttttaatattcaaatattttagttaaatgccaaaaatggataattaatgaataattacctaattgtttccatttgccccacccattgcatgccttcgtccctcatttgtgctttttgcccatccctttttttgttgcttatatctaattagtacctgtctgttgtgactttagggatcacgaagcgtttggccatttgcaatgatttgtgtcccctaatgcctcctctcgacgaagaaacagcagaaaacgagaaaagtacaaaatacacataaaacgggagagacagggagagaaacagcacagagagagaaagagagagagagcgcgagaaatagcgagagaaagaggggagagagggaggaagagaagggaaagagagtgggagagagagaaacaccagagggagagaaaagcataaaatgagaaagcgagagagaaataaatataaggcgatgcttatcatgagagaaagagagagagagagagaaacacagagacgaaaaaaatgcttgagaaaaatttaaattcatgcctccacatttctaaggtatttccatcattctatctttgacttttctttctttctctttcccttgtgctctctcatttttctttaatttcttagctttcactattttgtttgacacactctcaatttctttgtttctctgcttctccttccgtttcaacttttcctacactcctcttgctctctgcctctttctttaaatcatttgcttctctattctatgccggcttttccttgtctctgccactggtttcattgctttcgccctgggttctctgaccgtgtccctgcgtctctgatccttggattggccacctgcttacctaagcaagtgcggcgctgcggtgcggcaattggcgtgtcggcattgtttttccaattggccaaccttggtcaaacagtgaaattttatttagagaaacagaaaagcatgaggataaacacatataaacgtcat

SEQ ID NO: 23018 - DNA, 1217 bp, Heterodera glycines
cactttttactttgtccctttctctttctctctctctcacatgtctctctcccctctccctctttcttcactctcttctctttccctctctttttctctctcattgtctctccatttctctgtccctctctctctttctctctccaccctaaatatctctccatttctctgtctcttcccaaatgcttttgctggtgccctgagggcacaacagttcgagcagcggcagcttttgctcggccctttcgttttgccaaaattttgcttttcttcttccttcccttaattttatttagcacaaaaaatatttatttttggcattgtaaaaaatcataaatcaaattaaattcgatttaaaaaaaaacaatttatgtcaatatttttttgatatatttaaaaaatttgaataaaattaattctaaaaatatttccttgctaaaaataatgaatttttttttggaaactattggactattttatatttttaaatattaattaaaatgcaaattttattttttaattaaatcattaaatttaataattattttttcgcattgattgctttgcgcaatttttagattttcttttaattactttcgcgaattcatatgaacacaatgaattgacgacatccaacgagcactactgaatttctattcttatattgtaattgcttttgggcttttcaaaaatctcaaataaatttttaaattaattaatataattttaaataaaaaattttttacaaaaattaattccaaaaatgaatttatattaaaaaataattaaaacaagagcaaattaaaataaaaaaataaattaatggttaaacacaaacgttaaaataattaattttatattaaataatattttctgtttcaatttttaaattttgcattttatttatttttaataaataaataaatattttttttaaataattaatctaatcaatttataatcaaattcccagaaaatatgcaccaacaacaaccgtcgtcatcctcggcagctcacaatggaccacaggtgccgggagcggaagaacaaagaacggcatcattaactgtgccgacacggccaacggatggtcaacaacaacaccaacagcagaatgctgtcgaaataattaatggtaaaaataatgaaaataatttatttaattaaatattttaatattaaaatatttaaaaggtataattaaaaataaaagggaa

SEQ ID NO: 23019 - DNA, 951 bp, Heterodera glycines
ttgaaatgcagtggcaagcacagcgagtcgcttaaatgcacaccctctgacacgtaaaatataccaaaaaaagagatagtgattttttctggattagagcggagagataaaaattatcagctatatgaaatgcagtgggcaagcacagcgagtcgcttaaatgcacaccctttgacacgtaaaatattccaaaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaaga

SEQ ID NO: 23020 - DNA, 265 bp, Heterodera glycines
ctgcggacatctacatttttgaattgaaaaaaattggttttactctttctttttctccatattgaccatcatactcatactccccccacccttttcttcttccgccacccacctcccctgctacgcgccgctcccctccctctcttggtagtttaaactgaaggcgggaaacgacaatctgatccccatcaagctagcttctgcaggtcctgctcgagcggccgcccggggatcgatccccgatctagtaacatagatgacaccg

SEQ ID NO: 23021 - DNA, 1848 bp, Heterodera glycines
  misc_feature (28)..(28): n is a, c, g, or t
  misc_feature (80)..(80): n is a, c, g, or t
  misc_feature (85)..(85): n is a, c, g, or t
attcgccaccatcaattggagattctcncatctttctcatccacttttcttctagcacatccccaaatgatttgtcttcncatcnttcaggaatggcaaaagtcgcaaaccaaaaacgaaatgagcgccgaattcgtgccgtccaagacttggcgcggcacctcaaccaccgaatgaaccgccatcgccgtgggcagcgcgacggaaaacgggacccgtcagaggaacggcacatccgaatgaccaccgaacgttatgcggatcagctctctcgcctgggagatgaccacattcaccgactgcagcaccaattcccgcaactccccaacccccgccggcgtcgatcagaggtggggggcaatctgaaagggggaaagtcccagccaaaattggcatcaatggtggtacgcccgccccagggagagttgctcccttcaaaggatgtcggcggcgcagcaccgggcgcatcgaactcccatggccgaaacgagaacgaagaggaaggccgagaaggaaagaggcagccgcccgagggtgctccctccgccgggggacagttttggagaattgctgaagaaagaggcgaaagctcgggccgaagtggccgagctcgaagcccgggcaaagaaggcgaaaatggagagggaggaggaggaacagaaactgaaatcggcgaaggaagcgcgccttcgggacttggaaacccaagccgacgacttgcgccaaatgttgggcaatgcgagctggccgtggtcgaggggcaaagacgggaaaaatggggaggcggtggctccccgcgctgggaaagcggtagccatgccagcagtgccgatggaggatgatggagtgtcacttgccgattcggaaatggaggtggtgccggccggggcagtgtcgcaagaagcgacgagatgaccaaaacgggcgggaggtctgctcccgccaaaggaggaagccattcatgggaaggttttctagtgttcggagtggacgatggaaagccccgggaactgtcacgggaggagggggactatttcggagggggtgcgctcgatcacccggtggcatttccccgccgggagaagagagggaaaagaaacaagtggtcgaacgggagcacttcccgtcgcaattgagggacagagcgagaggtgtcaagaaaatgatcggaatttgccttttcttcccaattttctctatttttcacctttttcctcccaattttctcaatattctgctatcgtaattttattcaatttgtcgtatttcaattttgcccctttttctcctctttttcacatctgcgtctgctcttccccctttgccccgccgctttgccatttattttttgaattcacctttgtcttcattttggccgacacttcccctccggccttctccgattcttttccgattttccccattttttccctttgttttgttaattcaaactttggaccattcacatttttctattcacaatgtttacgcatttttctatgccagggagccatcttctccccggcatttgactctctttttttttcttatcgcatcgttcattttgctcatttgtccaatttgcatttatctgggcctaacccccggggggggggaaatatttaccaatcacccatccccccccttttcatcactaatttgtccgtcacatcattcattcgttcacttttcttcctcactcccctctagggagaaaaagttgttctttttgccttaatctctcaccacaccactcaatcacggcattcactgttaatccccatttttgccgtttgtcacatttgcccccccccctcctctcacgaggtttaattacccaagtttgag

SEQ ID NO: 23022 - DNA, 1589 bp, Heterodera glycines
aaaaacaatttattacttctgctttttaccttccccccctaatcactttgaacacttttaaacattatcttaaacttaaaatatattttttattattaataatggaattaagctaaataatttttataaagaattattttttgttcattttcatttatgaataacaataaaattgtcatttagatttaaaagcattttatttgccaataattaactttgaatttaaacaaaaatatttttgaaatttgttgttctatttttggtgtctattttcataaaacgctctttaaagccaatttaatagttactaattattaaaataattaaatattaatagatttatacattatgaacgaaaaagagttaagccatgaggcaaaaaaaatatcattaacaaaaatgttttgatatttaaacaagtttcatagcttataaaacatcttaatataaaataaaaataaatataaataatattttcaattatttgtaaatagagcaaacaaaaagactattatctcaaaattagaaaaaagtaactataaaaaatgaatttattaataaaaaaaatgatgccgcacgcaacgagtggaacctctgcacgttaggagaacatgaagataaaataaataataatagtatttcaactccaaaaaaaagattaataaaattattaaaaacaatatcaataaattttatttataatgaaattagagaattcatttttgaataattgcattaatcgtttttaattatataaataattaaatataacaaattatttaataaggcgaaaatatttccaatctattacctttacttcataattattagcagcgctagtcgtgagaatacagtgaaatatatgaaaaacaaatgctaatgaatgtaaaatcgaaaattaaattaaatctatgaaaactatttaattattttaaaagatatacctaacataatttaaattataaaaaacaaaattccttttatatgtcattaattaattctaaatcaaagatatttttgtgaaattatcaaactaaatttaaaaattagaatttttaatggagattttgaaatttacaaaatttcctttccctgtccaacggtgacagtgtagaaaaagaagtgctgatttcagtgcccaaatgtggacactgacaatgagggttctctgtgacccttgaatgacccaacggtggtcaaattaatggtctgtatgaaagggctgctgattgtccctttaacagatttagagaagagctttctcttactctttattcaaatgaacacaaacacaatttgtgttaaatttaattggacagttcctgccccaactgacttgcacaaacatgaacaagtgaagaaaatggagaatgggccggcttttataccctcacaaatcaatggggcggggccaggcacgtgaaaaatgtgcgcaaacaaatagacaaaaatccattaaaaatggtgactcatagcgatgaagagagaaaaaaagatgagtcataaaaagaggaagcgaatgagggaaattgattgacaaattaataaaaattaaatataataaatttcgaagaaatttgtgtcgcttt

SEQ ID NO: 23023 - DNA, 2934 bp, Heterodera glycines
ttttgtcggaatgggcaatttgtttgtttttttctactgaccacaagttagcatcaacagagccccattaaattcgcaaaaatgggtcaattaaaacagtaaatcgtgaaatcattcgaaaaaataacttacttagagaacaaaagtgctaccatttgccaaacaaaatgtactgtagaacagcagaagaatgaaaacactgtaaaacaatttaaaaattgtaagacaaaaaacatttgaaatacaaataaaaatggaaaattgacaattttcatttaataaatcacggaaaattacatgaatttttattgcaatacaaaaatggcacaatgagatgagaatgaataagctaattaagtgtaaactaaggcaggctaatctttagatcgccattattacacaacgcattgagcagtttgggggaatgaaaatcggaacagattggccaattattggttgatcagaatcaaaaagggagggcgagagggtatcaaattgaagggatggcacagacccaattggttgattgattggttgggttttgatcaatcagattatcgattgatcaggaatttgcagttgtgccgtgggcggtgacggattagaaaaagtggcggaacacgcgggcagcgtatttcagccaggcggggatcagacagtcgcggcggaggaacacgctcgggtcgagcagttcagagtgggcgaacagcgaacgcttctcctgattgggtatcatgtaaagtaattaatcgctaattatgccaaaattggaaagagaaaacgaattttttttttgaaaaacgaacgaaaaatagctaaattattttattattttttttctcaaaattctaaaaataaatttgaaaaaatttatgaaaaactgctccttggtcccaagtgcacctatttctgtgcttttgtactgatttttgctacctcagcaatttgctccctcaacgcgtcgttgtccgtcaccagcaaaagttgggcctccaagtcgcggtgggcggaccgaaaaccttggggaaaatgcaatataaaaaagggaaaaaaactatcaccaaaggggagaggcatgctatacacattcttctcggaaattaaaaaaaactgcaaattttaggttttaaaaaaaatgaaatttttttgattttgagtcaaattaaaaaaaaatgggaaaatttgggtaaattttatatagtagaaatttgttaagaaaatgtcacaaaatttcaaaaaatatgtttggcatagttttttgttttagttttttaccaaagtttgacgagcccacaatggttgcaacacgagggccagggcaccaagcagtgtcagcaccgtccgcagcaacagcagcagcagtggcatcattttgtgggcggcgccggtgccattcctccacccaaatgcccttcccatggaatgtccagccgggccgtgtccactcggaaaaagcgatgcgatctgtgcattttttgggggggggggagactcaaaaatgagaaaaaacgaatggcgaaaaacataaaattatttttgaataattttggacattttgggtcaattttgaaaaaaattcacacatttcgacattgttctcgagtaacgtgaactggaaaatatgaatattcaaacagaaacaaaaaagaaattttttaaaattgaattttcaaattcacaattttatagaaatccatctatttaaatggttggttgaaagaccatgtggccttctgctgctgcttctgtttgtagtaaatcacctgtttggttcgcctgcacagcgcgacggacgaagtccaacgcgtagtgttcgtacatggcggggatgtgcccggacagtccgtgcgcaccgaggaaaccgttggcctggcacaaaaaacaacaacaaaattttaacaggtctccgggttcagttacagttttcagaaaaacacaagaacagaacccagactgggaccctggaaattcacatacagtcctgtccgaactctcattggtaagagcgaaatctgagcctatttttttgaaaaatttcgcatttctttttggaaacttttcaatttgattgggccaattgaaaattgcaatcaaaaaacacctgtggcgacgcgaacacaattttgaacgggtcgcggcacttgtgcagaatgaggtcggcgtacgggtcgaacaggttgaagtaggcggagatcagcgtgaactccagccggcggaggtcgtcgtcgccattttgctggaaataaaaaagaaaatttagaaaaaattgggaaaaattaaaatttcgctcctcggaaattttacccaaaatttagaatttttccatttttttttgtacttacgctgctggttgtggtgcagctgctgaacaatttgctgaacaactcaacttcctggttcacgttgaacaggcccatctgcaggaagggcaccacaaaagtggtggtgccgtcggccccgtccggcactaaatttgggaaaaaatacgacggcaaaaaaagttgccggaccaccaattctctcactgggaaataaattcaaaatttagtgcgcttttttgacgtaattttgctactatggcacaccaatttaaacatatttttcatttataaaagacagaggccatccatctcccatcatttgtcccttgccactgctccgcctgccatttcccggtggagcaggacaaaacgtcgccgcaatttttttttttaaattttagaaaaaaatctagaaaaattgtcaaaaatttagttagctaacttaatacgaaaaatttttttcaagttttttttcccggaaattcagcaaatttagtttttattaacacttagattttcaaaaagcttaaatacttttaagtttcttgaaattttgaaaattttttattttttttgcggctacgtttcggcggcgacgttttggggtgtaccc

SEQ ID NO: 23024 - DNA, 1060 bp, Heterodera glycines
cggaacgccgggagaacccggaagtccggggattaccaggacaacccggacatctcactcacggtttgaaagaaaggggaagttttaatgggtgattttgttcttttagcccaccctatccaaggaccaccggtttgttttgcgatttcgccattgaattgtccgctttatccgattcgaactgccacctcccctattcagggcgcatacggaatccccggagagcctggcgagagcggcactccgggaacgcccggattgcccggcgagcaaggcctgcagggataccctggcgacgacggtttcccaggcattgcaggcaaaccgggatctcccggggagcttgggccgcctggcgaccagggcaagcagggcgggtgcgatcactgctcaccgccacggacagcgccgggctattgatggcatttttcgaattttattcattttatgtaaataccaactttttatttcaaattgaaaatcttttggcaataaagatgcattcagttacaatcatattgtaattctgccgatttcattcgctttcttccgattgacctcaacagagtgtctataactaattatttccaatgcttaatcctaattatgttcaattccttaatccataattaacaattattttgaattgctattaaatggtcacgagttttcccgtccaaattggcccaattgagtaattttgttccaacacatttattcctcgaaatgatcgttcaattcgcttttggaccctttgctttcccatttgcccctctttcttatttcatgccaccatttgtgccgtgcgtcctccttcgaaattgctcatcgacgacacttgcgtcgtgtaaatgcgcattgagttaatttggccgagtgtcgggtcgattaggaactgtttgatgctgcgtcggatgtatttgttcatagtgatgtaaatgaccgggatgaggcctaagttagggacaaacaatttaattagccgcaattaagcattaattgactttatgtattttggtattaccctgtgaggcaatccaagtgtagctggcggacatta

SEQ ID NO: 23025 - DNA, 2078 bp, Heterodera glycines
tggaatttcatatttcaaatattttttattcaatccgaaacaagtcactgaacgttagttcgacaaatttaataaaataaaataagtttttttttttttggttttttaaatgttctcataaataaaatttaaaatttttcaacaaaaatttgtttgaaattttttgtgaatccaaaaatatcaatttcaaatgtttatgctttttcacattttgtccaatttcccgaacacaaatttcgttgaaggcacatgccaacgcaaattatccacaaatccgttaatggacttcctgtactcggcaaaatctaatccaagcaatttaaccatcactaaagagttaatatgtagtggaaaaaacccataacaattttctttaaaactttccaatagaaattttaaaaatctaaaatcgcaccgcaaaaattaatttaattctaaaacattctaaaaagaaataaactaacaaattgcgcgatcgaattgaaatattagacaaattaatcgcaaaattataataaaataaataattaaattttttataatttgaaaagttttccaataaattaaagtaattaaatttttaaatctctaaagagttagagattataaaattaaataattaaatatttttgattggaaaagttttacaataaattaaacaataagattttaaatctattaggaatcattctttaacaagttaactcttttttatcctttttataaataaatttattcattaaaaaaatttttaagaaaatgaatcgccaaatgtttttattcttatttttgttgactattgtccaatcgaattttgaatttgttcgtgaaagtgaaggctggagcgcctcggacaacaacataaattcaatttttccacaaaatatcgtaaatttatttgtttaattaattcatttatttaaaaaaaaaacaaatattaattttctttaaaaatgtgaaattacaggcgaatgaatttggcaccacaaaaaatcgtcgagcggctgaaatgaattttggcaaagatgccgaaaaacagcataaacaccacaatcatcatggtaaaagttatccaaaaattttaaattgagattaattaaaaatttcaagaggcttggggctatgatgaccatgacgggcctcataagtggggaaaacaggttggaaattctaattgaaaattttaatttcttttttaaaatttaatttttttttaacacagtgtcaacacggcacgcgccaatcgcccatcgacattcgaacatcaaatgttgtgaaataaattaattattgcttttttttgggacttttgagcaaaaatcctccccccccccctcctccctttccgaatataaaaaaatgatgaaatttaatcaaaattaaaaaaaaatctcatcaatttaattttgacatttaaagaaagctcgaaatttctactatttaaatgattaattcgttcttagcaaatttcctgttagcaattttacttttttaagaaaatttaaaaattctgcagcaaaaacgaattttatgcttttctcatacataaaaataataaataaataataaatctaattatttatacattttaattattttaaaataaattaatgaaaaacacctaaaaataataattgtagttggaatttgccaccatcaatgagctccaatttgtgaattatgacgtgtctggcgctgttgaaatcaaaaacaatgggcacacaggtaaaaaaaaaagtcaaaaatttattaaaatttaaattattgaaatttaatggcacattgggataaaaaagatatttaaaaataaaatttaatttattgcaaatttaagttgttgtaagcggcttcgaaaagtggcaaaaccggcaacggccttacatttacgggggcggtctgaacggcaaatatttgttggcccaattccatttccattgggccgcggaccatgacgacggcagtgagcacaccgtgaacgcattacactatccaattgaagtgagaaatttggaattattttaaaaaatcctatttaaattaattgaaaagcgcaaaatttgtcacttgttggacaaaat

SEQ ID NO: 23026 - DNA, 2013 bp, Heterodera glycines
  misc_feature (1992)..(1992): n is a, c, g, or t
gaaaagaaaaaaatagtcaaatttatgaaccgttaatgattgatttccgatcaactttttaccgtcggatccaatcgaaaaatcttagtcgacccatcagccccttttaatgcatcccgccagcccttaaaaatttatttttcagcattttttgatttttggaaattttttgaatttaattgaaatttttcgattttccaaaatcccgcaatcccgcacgggatcccgcaaattttaaatgcgggatttgcgggattaatcccgcgggattccgtcccgcaaaaaattttgagttccagtcccgcagcgggatccgcaaatttgaaatttccggtctctaattaatattgtgtaaaatatgaaaaaaaacttattttttaaaattattttttgacctcacaaattttatcagaaaagattcttttaaaaagtgaaaaccattaatattattttaaaaaacgtttaaattaagtaggattttttatttacaagaaatcagtagaaaggcacattttaaaaatgcaaatataattaataaaataacatttttataagaaatatattataaatttttttgaaaaattgtgaagaaaatgaaactctgcctattattaattccaattataatattttgggtcattaaaattgaccaaattgattcaacaaataaaaattacaacagaaatcatttgacgaaatatttggagaaaaatgggaagagaaagaagaagaaaaacgaaatgaactcaaaaaaagagaaataattggtaaatattataaaataaaagagaaaattaagcaaaaaggaagaaaatattcaacaaaagaatggaataaaattaactcaaaaatagcgaaaaaattagggacaaatcgaaagagaattatcgaaaatggaaaaactgtaaattactgatcaaaattttatacatcactattaaatataaattagatttcgaccttgacaataatgatttagtttcatggaaccaggtctaatttattttattttatttactaaccttggtttttcctagacctgctggattttcttggattttcccagaatacccatgtccagcaggtccaaacaaccaattttttccggcgcaagtggaacttaatgatttttaaaattaaaaattcgattgactttttttaaacaaatttctacaagcggaggtggagaatgcttgaaccactaattttcatcattttgcaattttttaaacactcactttcggattttcattttacatattttccaaaaaaataattaattattttcctttttttaatcaataaaatagaaaaaaagaaattatttaatagaaaagaaattcttttaaacaaatggtaaggaggaaagaatatattatctttttttcatttttcaaacaattttttgccgaagaccattagagagttgtgattttttcatgtgaataaaaggctcttaattgacttaacttaataatgtgaatttatttaagaaaaaaaaaaacataatatagattcatatttggaagataatcccggagaaatgaaattattgttattattctttttgattttaattctaattgccctaattagccctattggatcaaaagaaaaaaaactacaagaaaaatcatttgacgaaatatttggagaaaaatgggaagaaaaagaagaaaaagcgcaaaatgaacagaagaaacgggaaataataagaaaatattataaaattaaagagaaaattaagcaaaaaggaagaaaatattcaagaaaagaatggaataaaattgatggaaaaataacgaaaaaattgggaacaaataataattatatttataaatggattaaagaattggggctacaaaaaagctataaattgaaaactgatgaagaaaaacgtgaaattgtacaaaaattcattgaaatggcaaatgaatataagcaaaaaagaaaatattcaaccaaagaatggtgccaaaattatgtcgaaangtgcaagaaaattggagtaag

SEQ ID NO: 23027 - DNA, 1729 bp, Heterodera glycines
aatcaagctcattatgctctacaataagtccgctggctcctcctcgctcagatcaaacgctgacgcggtattcacctggtactgaagtggacaaagttggtactgaatttctcctattttctgcagcccttcctactataggtagaggcctggaattttttttgacttttagacaacacttcaacttaggttcctaccagcggaaagtttttgattcgggatttagaaaaaaagttatgggccgtcaaacgcacgaaaaaatgagaaatcagtccctggtactcagttggcccttggaccggaaaacctatatttttcccggatgcgcctcaaaaagttgtaagacccttccactactttcagggcgctcccggccttcggccgggagattttgtttttgcagacgaaactccttgtcaatataacatatatataactagcgggtgtgtgcatgcgagggtggcgcttgggaaagcgctgcgcgcttcttgagcttcgctacctaggcgcgttttagtctgttagggtctttgtgtcagccgacatgcacttggtttcctccaataattggagttgacacatcgcataatgcaatggaaaccggaagtgccctaacgttgcacgtcatggccctcctccctcccttagtccaggcgttggcacgttattgggttgagcgctaaatggcaattcacctgtaggccctaaagagggctgaccggtccatgtcccggatccaagcttctcaccattttcgcacccaacatagtgcagatgggaatgggattggcatctctccaaaaaccatgtgcccaactgctctggactaagccatttattgtaacttgagcatattagtagctacaatattcagcactttggctcggccttgggcatctatttcccggttgggagcatgaacacggacattgtttccgtctgttgcccgagagaaggccgtatacaattgaccgtgggaaaatacttccctttccagatcaatgccgacagtgcggattgtttggccctgacctttttgaatggtcatagcgaatgcaggctttattgggaactgcaaacgctcatattttatgccgccaggcgatttgtcttcatagacatttcgtgttctttcaagaaagaatctcacttggccgccaatagcattgctattgataacacgaccaatgaggcgatcatcgccaagttcttccagaactatgcgtgtgccattgatcagtccttccttatcacttttattgataagaaggacgacgacgcatccgactttaagccggagactgtgcgggggcatgcccgagtctgtgcgccggttcaacgcagccacttcggactcgatctcatcgatgtccagtgggcggtcgtcaaggggcttatccgtggacaagtattcccgcacttgacctggcacattcgccatcatgatctcgttgacttcgtcgcacgtgtcaatgtgcggagcgagaatcaaacgattgagcagctccttgtcattgccaaggagttgttggaagttaggatagacatagtctatcagctcttccttgctcttaacgaggaactgcggaggaatccagaagtgctctccggtttctccgagcccgatttggcggcacatttgcaagtacgcttgctgaccttggcccagtctctggttgatggtcaatttcatcgtggtgaattgaccaaacaacggagacgtttgaaa

SEQ ID NO: 23028 - DNA, 1447 bp, Heterodera glycines
aaaaggaagccctgctggttgtatggcgaaaaatataaagaatgagatttttggaatttttatgcaaaaatacccttggtttttccaatttttaacacatattttgacatttttggggtttttagcacatatttcagcatttttattacatattttattacttatttcaggatttttagcacataaaaatcccatttctacaaattaattatccattccagaaccaacattttttattatttcttaaaacaaaaacaatttcaataaagttcaaaataaaacaaataaattcaatatatggattaaaaaatatatcaatatgagatttcaaatgaggataaaggaattatcattaatcttcaagaacacccaacatggttatgtgttcggcagatttggagctaaaatgtgaattttatttaaataaaatttatggaaaatatattttatgcactaccgtattttgattatttcacgaggcattttcatgttacgtccaattttgtggcaggtattctgtttttctaagaggaatcagtggaattttttatataatttttacaaatttcattaaaaaattccaatgccttttaacatgcgcaaaattgtgggaagaattggatgaacaagcaaatccacgggtttttcttcatcaaatgccatttttctgaatttgtagtcgttgccctatttatagcaaagggacgactttaaaaatataatttttaatgactaattcaaaaaatattagaggctccacagaggagatttttcattacaaaacgaccaaataaacgcaaaaattcgtacgcttctccaactcttcgggcgacacttgcggcacaacagggggcaactgttgcaaagacaaactgtttgttgccaaattctttgcccttttcttcaccaaattggcattggcatgaacaatggaacggatttatatgtgctaaaaaacgccaaatatgtacatattatgtgccaaaaaaacccctaaaatatatgaaaaaacgcaaaaaggccaaaatgtatgccaaaaattaaaaaatgctttaaaaaataaattaaatttttttaaaatctaagtttttatttatcaattttaatagtgtttttctcaaaactttgaaaaaggcatttgtttggcatgcattcgaactctgtgcccgttccatgcggtttatccaccgctttctcgattacaatggctacaaacgcagtcggataaaacaccacagaaatggcaaaaatccaaataaaaaatcctcacattattttttgcaaattgccaaattcattcatggcacaaaatcacaatgctgtgaatgtggctgataagactttagctgaggatggatttttctaaaattaaattttatcttattatttaagtaatataaatttaaaaaataataaaaataaatgttacccttttttcgacattaaa

SEQ ID NO: 23029 - DNA, 2346 bp, Heterodera glycines
ccgttccaatttggcgtctgatcagtacattcgtccctttcggtgtcaacttattctcagatcagttcatatgcatcattccattccgtccaatttcggctctgattagttaattcgcttcactccttttccaatttcggctctgatcagtccattcgtccctttcggtgccaactttttctctgatcagttcatttgcctcattccatttccgttccaatttggcctctgatcagtccagttcgtccctttcgatgtcaattttctctgatcagctcatttgcctcatttcaattccgttccaattttgcctctgatcagtccagttcgtccctttcggtgccaattttttttctttgatcagttcatttgcctcactaatttccgttccaatttcggcaaattttccaatagatttaggcagatatttagctgtttttccgtggcaattacagcaaaaatatcaactgatttcgccattttctgtcaatttcaccctttgatcagtccgatcgtccctttccgttccaattaagcctctgatcagtccattcgtccctttcggtgccacgtttttctcagatcagttttcgggtctgactcatttacatgccaagttccctctgattagcccatttcgctcttccctgtcaatttcggccaatcacaacattcgctcgttcctttccaatttaacccctttgatcacccatttttcccctcgtaccaattttaactgtgatcaatccaaattttgttttatttgagttaatttagttgctgaattttttggcacatttaaaaaactatatggcaaagatccaaaaattacgagaaaggggaaaaattggaaaaggtaattaactaaaaaaattattcgactctgatcaattatgcgtctcctccctttttatgtcaatttcggctctatcagctcatctgactcaccttttttctgttaatttcaccctttgatcattccaattcgcccccttccgtgctagtttcgactctgatcagctcattttgtcacaccctttatctacgtctatttcgggctctgatcgctcatctgtctcatatcttttctatctcatttcggctctgatcagctcatatgtctcaccccttttctttcgactctgatcagctcattttgttacatcctttatctacgtctatttcgggctctgatcgctcatctgtctcatatcttttctatctcatttcggctctgatcagctcatctgtcttaccctttttctatgtcatttctctttcatctgtaccacactttctatgtctatttcggctctgatcaactcatctgcctctctagccctttgatcagcccatttatccctcttccatgccaatttcggctctgatcagctcattttgttaggcctttgatcagcccatttagccccattcggagtcaatttggccctgatcggttattggcattaccctatttcctttgcaatttcacccttggatcaatacgattcgtcactttcgtgctaattccaggtctgattacttcatttgttttacttcatttccgttccaatttcaccctttgatcagtccaatcaaccttccatgccgatttcggctctgattaaatcattttgttagccctttgatcagcccattccgatttcggctcagaacagctctttttcatcccctttcccaacccatttcgcccttttcgcgccaatttttcgggaccgatttcattaacttccgcttcccgcatcttaggaaatggcaatcgtgtatactgaattcactcgggaaggtatagatacgtggttgttttatgctaaattttgaaattcaagaaattgacgaagctattgaggaagcagttttgaaagtgaaaggaggaactgagagagatggcatgcgcgccgccttggaaacgattgtgagcagccctcatctgctgttgaacgatgtggcagcgcgtcacaacatcgactacagaaaagtttctaagtacagaaacagatttaatgtaagtgcttccatgaaataacttcgatataatgtttgggatttagaagattttgtcggaaatgcgggaacagcaacagaggggttcaggagatagccggcatggagtaaacaaataattaatctattggaacaagattaattataggatgatgcgcaacccgcgcgcgagactgaacaccattatggtgattatgagagcgagattctcggatacttcaaaaggcgtcaggtaaaaatggtgcaagtgataataggcaacaaatgattttaaatatctgattttaggctgtgtttcgaccggacaattatcttaaaccg

SEQ ID NO: 23030 - DNA, 1113 bp, Heterodera glycines
  misc_feature (103)..(103): n is a, c, g, or t
  misc_feature (115)..(115): n is a, c, g, or t
  misc_feature (130)..(130): n is a, c, g, or t
  misc_feature (1077)..(1077): n is a, c, g, or t
attaactgtcaaatattttttaaatttcatctaacaatgattatgccaaaattttgcaaaatattgaaagttctattgacaaaaatggacgaggaaggggagngggaaggggggnaagactctcgtaagnccttctctcaacaaatgagtgcaggcagtcaaagaaactctcaccacgatcagcattacggccaacagaatgaacacctttcgccactgatctcgatcagtttcatcctcaacgaacagccaaagcagggcggggcccacgaaaagcgtcaaactcttcacgaattggatgttggccaccacaaagtgcgagtactgcctgaacatgacggcgatggcatttgaataaaattcacattcatttttcaatcattttttttgcctcgagcaaagagtgccgcatttataaaagccgcccccggcggtggacagcagcatcagaatggcggtgaaaatcagcactgtccacatcggccggtccacgggaacgaagccaatggccaaataggcaatggccggcactccgacggcgatggtgttgaacagaatcagcttggtacgctcgggaaggcacctgcgaaaagcggcacaaattggggcggcgcgggaggggatacagttggcaatcaataatggttattcatcgccatactgtacgtattacgcacttgaattggtcgctacagtagccaaacagaaatttgagcggaatgtgcgaaagggaaggcaatgcgcccagaaagcccgtcttttcgataccgtagtgcaacactaaaaccaaaattagggatacggtaataagtatggaaaatagcaactgagaagtgagagacggtgtgcgaagggactacggtagataaaccaatattcgaaccaagaaggatttgttcgattttgtgtctgtttagcattggctatttttgtccgtacagtaacacccgtcagtttttaccgtagttcaggtagctgggaatgtacatgagcagaaagacgcccgagaagaggtcggcaaatgcatttagccacaccacccaaatgagacgactgcgcagaatttgcttaagtggncaacattggaaattggccaaattaaatttttatgaa

SEQ ID NO: 23031 - DNA, 1406 bp, Heterodera glycines
gtatggtaggggattagaggggaaatgccaaagtatggtagggaaaatgccagaatacggtagggtaaatgccaaagtacggtaggggaaatgccaaaatacggtaggggaaatgccaaagtacgatagaggaaatgccaaagtacggtaggggaaatgccaaagtacgataggggaaatgccaaagaacggtaggggaaatgccaaagtccggtaggggaaatgccaaagtatggtaggggattagaggggaaatgccaaagtacggtaggggattagagtggaaatgccaaaatacggtaggggaaatgccaaagtacggtagggaaaatgccagaatacggtagggtaaatgccaaagtacggtaggggaaatgccaaaatacggtaggggaaatgccaaagtccggtaggggaaatgccaaagtccggtaggtaagctgattaaaaagcgcttttgaagagtgtgccaaccatgccggagatggggttggtgatggtggtggacaggggcgagtagcaggtcagcacggaaatgaacagcgcgttctgcttcaggctggcccaccgggaacaaatcatgcccatggcggcaaagtcagctgcataggaaatgccctggaaaagtgggaaaagagtgattgaagaattgcggagaaattcagacaataattgggggagggggaaatttgatcggtatcgtatccttaatactgtgagtcggacatattcgatttaatttcgagaaattttagccgcccaaatgggatggctttccattcggtttccaaatttattctatgtttttttttgcctgcacaaagcgaagtgccaaaaacaggttgaaactgaacgatgtcgcaattggaatcagcgcagtggcaatggcagatgccaatccggcaccgaacagcacgaaacgggcgccgaaacgggtgtacagccaggagaaggggaaagtgccgagcattgagccaaccgcaacggcccacctgaaaagtgccaaggcatgctcataagtgtgaaatcattcttctgctgcttacatcaattggtttttctgctgcggagtgtaagcgacggagtgttgctgaaaatggtaatttatttttaaaaataaaaatgcattttttgattatttcgcccacttcggcaccgcttagatcggtgccattggtcggcaccgaacccatgcaaatcaatgtgaaattcagtgccaacatgttggacgaaattgaggtcagacagagccaactcagaagcaaaatgaaatatctgacaaaggcatgcaaccaaatcttttcaatattttcgattttcttcaatttttacctaaattttccgcaaaaagtgccgcttttgctctactgtttttgccttttggcagtgccattctctgctaccct

SEQ ID NO: 23032 - DNA, 1306 bp, Heterodera glycines
  misc_feature (151)..(151): n is a, c, g, or t
  misc_feature (209)..(209): n is a, c, g, or t
ggcaatataatatccattgcgcaccgctctccctatcatgctgagatcgatttgtgcggtataaaatttatcagataaagatagccatttttctgaaattcctcatagaagccaaaaattctctgggcaatataatatccattgcgcacgnctctccctatcatgctggagatcatttgtgcggtataaaattttcagaaaaagatagnccatttttctggaattcctcttagaagccaaaaattccttctagaaatataatatccattgcgcaccgctctccctatcatgcttgagatcatttgtgcggtataaaatttttcagaaaaagatagccatttttctggaattcctcttagaagccaaaaattctctgggcaatataatatccattgcgcaccgctctccctatcatgcttgagatcatttgtgcggtataaaatttttcagaaaaagatagccatttttctgaaattcctcatagaagccaaaaattctctgggcaatataatatccattgcgcaccgctctccctatcatgcttgagatcatttgtgcggtataaaatttttcagaaaaagatagccatttttctgaaattcctcatagaagccaaaaattctctgggcaatataatatccattgcgcaccgctctccctatcatgcttgagatcatttgtgcggtataaaatttttcagaaaaagatagccatttttctgaaattcctcatagaagccaaaaattctctgggcaatataatatccattgcgcaccgctctccctatcatgcttgagatcatttgtgcggtataaaatttttcagaaaaagatagccatttttctgaaattcctcatagaagccaaaaattctctaggcaatataatatccattgcgcaccgctctccctatcatgcttgagatcatttgtgcggtataaaatttttcagaaaaagatagccatttttctgaaattcctcatagaagccaaaaattctctaggcaatataatatccattgcgcaccgctctccctatcatgcttgagatcatttgtgcggtataaaatttttcagaaaaagatagccatttttctgaaattcctcatagaagccaaaaattctctgggcaatataatatccattgcgcaccgctctccctatcatgcttgagatcatttgtgcgggataaaatttttcagaaaaatagatagacatttttctgaaattcctcttagaagccaaaaattctctgggaaatataatatccattgcgcaccgctctccctatcatgcttgagatcattt

SEQ ID NO: 23033 - DNA, 2025 bp, Heterodera glycines
gggggatttggttcaaaaatgctacccaatgtggtcttctcaatccgtgccttcacccgtcgtgccaacttttcgtcccgctcatcggccaatgccacggtgatgataggcgttgaaatgaagcggaccgcgttgatgattctacacaaatttgtaaatttttaaaaaaatgccaaaaaaatatttttattttttgcttactcttttatcctgggcacgccttgggtgatgttcatggacgcaacgccagcaaagtgaaaggttttcagtgtcatctgagtggagggttcaccttaaaagtatagaatatttatttagtggaaaaaatgctgagcttttctgttaaaaagtttttgtaccccagtggagcggagatggtggttccctcgatgagaaaattttaaaaaatttatcaaaaccgaagaattaaaaaaaaaacttggctttggccagcattcgtcgtgctgcgatagttcctaaattcagccacataattagcgtttcctaaatccatcgcgcggatcttttcattttcatcttttttttggtgcctaaccgtcgccgccaggaatatggaatttaaaggctagacttggactcagcccacccgaaaaaatgacatgaatttgttataaaactgcttaatattgaatattattcacaaaaatgtatgaaaaagtgacgacatatagtgaaatttttttatcaacatttgaaatttttcaaaaaaaaacgtcatttttgagtgtaatatctcttaacagccgacaataattggtcaaacgcatcaaaacgattctttttgacctctctgcgccattgatactctaccaacgtgtcagcaaaccggaaacctgggacgcgccgttcgcggaaccaatcctttgcaggacgccactgagcctcaatacgttgtgtgtgcgtcccatcctcggctaaactttaaaatttagcagattttacttgactttaaaaaaccaatgaaacggtgttcggggtccgagtggttgacaattttgtggagaaacccatgctcatttaatcgagaataagccctccacatgtcagtgtttatttcagtaccaactgcaacgtgtttttggatgatcggaagtagaacatcggcacttctgacattgtccggacacacgacacgaaagtcttcactgtcattctcaatcattccttaaaaaaaatggccgctgtagtcgagtgtgcggcggttttttagcgcaatattattaaacttaaatagctatgacccaatggccttcaattcttctccctctgttgaattttctttttccaaatttgctctcatctaattgcactattgagccgcgccatccgatttgtcctcgctcctgttctctttgcaaaaaatcatcaacaatcatttctcggcagtagtgatacctaatttgataattaatttgattttataatttttttaaaccatgccgcgacactgtccattctaacatcgtgtcattttcactctccattgtttcaataatacattttttgtatttctcttgatgcgtaaatgaatacataatactaaataataattattcataaaatataaaaaatatagttaaaaacaacaaaaaaagaccttaaaatttttgacagtggcatatgtgcattttcaaaccacgaatcaacaaaaagagctttttctgctctacaagtactgcatatgaatgagccggccctgcctctgtttttgtcaaaacgcatttcctttttgtagtgctgtgtcggccgttttccatagcagtaacgcacatttgttaacaagccgttttcaaggctccaatttataactttttgctcatctccaaaaaaatgtaagagcttgcgtctattccaaattgcattttattgctaaaaatacagtattaaatagatgtataacagcatatttcttgataaattcactcaaaaatgacgtttttttgaaaaatttcaaatgttgataaaaaaaaattttcactatatatcgtcactttttcatacatt

SEQ ID NO: 23034 - DNA, 2270 bp, Heterodera glycines
tttcgtagctctccaaatagatatttttacgttttggcctctttgtggcatttaacatttacgaattacactcacgaaaattaattaaaatgtaattttttacaaaaacgaattaattcaaatattcgcttcaaaaaaatgatatgtaattcaaaaaattattcaatttttgcatttttattttcaaatcaaagaataagcacaaaacaaaggaggtcaatccgaggtgtccgtttccttcacttttacctacataccttatttttctgtattattttttgatgtttattaaatatttacatactagtaaatggggggggtcgttttcgcgtggggcgagtttttgaacttaacttttttctttgtcaaccaaatccaataatcttggtatcattcgatagccctaagtgttctctattagcctacaaaatttggaaaaattttgttaaggttcaaaaaagacgcgaaacggcccacgcgaaaacggcctggcccgagtaaatgagtttcgatttaaatgaattaatttttattaaaattttaaaaagaaattttttcaaaaaaataaaaattccatttatcgcccggggggataaatggagacgggggggattattgttcaacctcctcagaaaggacggggggattaatggagacggggcgacaattagagaaatacggtagaaaggcacgccaaaggcgtgccaagggagatttacctttttaattcggttgtaccaccaaaatcagtccgtcccccgccgccattctgtggtgactgatcgaatggaaacgccgcgctgcccgcctctcctcacattttttctcttctcttctcacttttcagtacccaattccatcgattgcatttttgatttaccattttcgttaccatccattttttcctctttcattcttttcaaacaaaaaatgtacccaaaattggtcgatcagattgcgggaggaattgccaaagcagtgcaaaaggccactgacagtcacgcctttcacgagttccccgattgcttatcattggcccacacggaccgactctccatcaaactgaacgctgctcacagtcaaatgtaacagtaatcattttttgagaggaaaaattagacgccgaggaaattaaaaaaaaattatattttcgaattaaaaatgtgaaaaatgtaggcaaaaaaaaaatatttacataaaatgctttagggactatccgtcagaaatttatttaaaaaaaagattattataaaatacataatgattaaaataatttgatatttataaaagtaataataactttttttttaaataaacataatttctataaaatagtaaatttaattaaatttttaaagaaatattgcaaaaaaaaaactgcaactttttttaaatcaaacagattttatgtagcaaggaagtttatcattgagtaaaaaataaaatacatttggctgacggattgtcctccatcactgaatcaatttgtaaagatacctttttatcccctccgccttttgcccccccccacctttttttgtcccatccgtttcccttttttacccttttcagacatcggtcgcttcatcgatcggctaatttgacacagctcgatgcgattagttttaaaattagaaatgaagagcaaaagaagaagttggtcatgacggcagaagtccaaaaggggaacgggctgctgttgaagaatgaggctggcaaagcggtgatgctcgtcagactttccactcacacggccgactcactcggcaaactgatgcacccgtcccaagcgacgctcttcaaggtgggcatggtaacattggcaagcagtgcaccagggatgggccaaattgaaaaataaaaagcgaaatgcgaaaagcgcaatttgcgaaactgaaaaatgcgaaatgaaaaaaaaagcgaaatgcgaaaagtcaaaatatgcgaaaatgcgaaaagcgaaatgcgaaaagcgaaattttttctacaaatttttaatagttaaaatcataaagcaaaaatcattttttaaaattttattccaaatttaaaaatcaataaaacgcttttttgaggcgcgctttttccaaaaaaactttttgggaagagggggcaggcggcgtcagcaggcgccgccgggaaaatttttgaaaatttgattaaaatttgttgacagattttcaccaaaaaatcatcaaattttgtgatttttgtatcatttttctaatgagaaagaagagttttggcgcgccgctgagaacagtttttca

SEQ ID NO: 23035 - DNA, 2291 bp, Heterodera glycines
tgcccggcccaagtgatcagccgcagaattgaatgaccgttttgctgagaagtgatcggtcaatttgaattatggaattggaagttgacaaaaatgctcatagaaattgctcttttttgtttgaatgatcaatattgatttgtggctgttgtatattttaggaataaatttttgtgatttcctgaaaccgaaatccatcggtaaaaatcaaagtaaaattgaaaaattgcagattcgtgatcagcgatctcgaaaaacctctaaaaaatgttatatcactttaaattttatttaaaatattataatttacaaattaaatgagttcatttcaaaagggttttgtcaaaatttgctctgatttgtcagttgatttagtcaacttacaaaaatcattggcttctgttggcaggcgaaaaactgttcaaaatcgttggtcgtcagaaagcctttctcatccgtgtccaattcctgctgtccaaataatagcgcaatttgacaaaaacaccataatgattgtcctaattaggtaattaagggactgaaaacccaggttttttaggatttctcctaatctacaaacaatttcctggagtttctagaatttatctgtttttaggggcacatcgggcctaaactctaggagtttaggttggtctcgcttttaaaaatttcttgttttttttgatgccttggcctaagtttttcggccgagtttcggaatatttcaaactcaaaagccgcgcgaggctttcaattttccgcacgcactttaaacagaaccaatgcgcgctgttcgcttgctgtccgtgccattgcgtcaccgtccgtgccggacgaactccgcgcgcgcccaaaatgcgcaatggcagggccagcggtgggcgcggtgattgccgacgcaaacattgccttaggagggattaattaggggagggggattaattttagattgatccatcaatattcggcagatcagtagtgatcagtacaggtccataaaggggaatttcattgtctctccggaaaaatctcgctgaaattttaaaatttattttttaccgcactgcgcacaatcgttgctttacgcacgagggtggagccgcgtcgttgttgcggtggtgccgacgcaccgccgccagtgccgcccaccagaagagagtcggcttttcgtttccgctcgcattggtcgctgcggccgcgcagcgcaaacaccgcgcggacaaattcgagaaattcctaaacaaaaatgaaaaaagcaatttttaaaaaaagaaaaagtaagttcaaaataatttaaatttctttgcaaaatggtagattttcaaaaaaaaaaacttttgattcaataaaattttatgaattttgcaggcttatagcccttatgcctatgccaaaatattttcccaactatttttttatatctaatgtaaatacataaaaatattaaatatttaacttttcagtttaaaattttaaaatttagaaaaaaaaagattttctttaaattaatgaaggcttaaaaatttctcgcccaattttttatgatcactcttgaacaacgtatatttctctctaacaaataagctgatcaatgatcaccagcaataactaattttaaactgtcaaagattcggcactgatcagacagtgatcaaacagtaaaatgatatacggatttaaatgacattgataaaaaaattgttgataattttcgtacaccaaagctgatctgttgctgaagctgttgtggttgttgttgttgctgtgccgtcggtgccgtcccggcggcgatcagtcgcattgtccactcggcattggcacgcgcattttcatcgcacaagcggtgcaatgtcacaaccaaatcctgtgaattttatttaaaatggatatttaaaatttcagaaaatccgttttctgttcgaccaaaattttggtgtgacccgaaaccaaaactctaaaagcacataaacattaactgttcagatggcacgcagcaaaagcatctcgtatattccaaaattttcgggaccgaaatctcatgatgatgatgatgaatctattagatgacggcattcacatgatattttctctaaggattacataatctttttaacatgataaaacatttgactgtcacaaaacatcgcataataccaaatcagcaaaaaataaaataaaataaattttaaaaatacaataacaatgttctagaaaaggaaatgaatcagatcacaaaaatacaaaaaatggaaaaaatctgcgaagaacggaacattcgtcgaattgataaa

SEQ ID NO: 23036 - DNA, 1502 bp, Heterodera glycines
gctaagcccatactgaaaaagaagttatggcctcccaaaaatcagggcaggacgagacgtcgccggaacttaacgtcaccgtgaaaaaataaaaatatattcgaaaaaaatacaaaaaataatttaaaaaaaaatttcgtttccctgaaaaaaaacattttcaaggaatttttccgttttttcttgaaattaagcaaaatttgattttcagaacatagtggtttttcaaaacacacaacaaaatttaattttaaccaaaactttctttcctaaaatttttttattttttctgagactacagttatttcaatttgtcccgcgccgcgttttgggatccaacgccaaaaatttctggcggtgaaatgcctattgtttcgctgcaactaattgctgactaattgattggccaaaaatccgccaattttaaaaataaataaattatccagcttttgcccattatatccattaccacaaattgtgcggcatttttccaatcaaaaatgccgactcacttcgctacaaaatttgtgcaaatgttttcgctgttcgagtgtttcgcaattgccggcgttgattttggccactaatttccacggcttgtcatgactgtccacgtaatcgtcggcacattcagcaatcgaatttgttgaatttgatgaagcgacggcggcaaaagaattttccccgttttgctcagtgccaattggcggcgtcgctttttgatgttttgccattgatgagaattgctcagaaaggttcagcagaaaatggtccaatgtcggcggatgagaagtgaacggactgtgaaaaaggcgcgcgatttgatggacaaaaaattagtcaaaaatgccatggcaaatcctgggtgagtatagggctatgacaccttttatatggcatggctttgtcgaaaatgcccagcggggatggcaaaactcttattttcttcggcagtgattccgttttcccagttggcggcaaagatgcgtggttatgcatattccggtcgaaaatggcacggcgatccaccacgtaaatggcacggtacggacatttataactaaaggaatgaatgaattgaagtggaagtctttgttcggcggagttatggactcgggactaaatatctcatgagcagaaccgacaaatgtcgaaatatgcacgaaagtccaacaccggcgctggttccgtcccgcaaaaagggatccgcaaattccggtttatatttggcactctctcgtccttatgcaccaacacagacacaaaaaattattaacagtagaaaacaactaacggcacacatacatagaatgccattctctgcaggcgagtgaatgtacacgcaaagtgccgtccccgtaccgtttcatggttctgcgacaaagcccatgcttaagcaattattcaaatgactctaattaatttccatttgaaaagccattttatgtggacttttgacataatttcgttgtgctgaaaagtgtttattctatgatttgatg

SEQ ID NO: 23037 - DNA, 1541 bp, Heterodera glycines
  misc_feature (1490)..(1490): n is a, c, g, or t
aactagagtacaactaaaataaattagggactaccatctatacacatcgacagtcttgccaaagtatcaaattccccatatttcggcactgtgccaacaatgattgttgtcacagcggcagggtagggcgtgaaattcggcacgtctgctgacctttcactttgccgaacgtgccgacgccgagcgtgtcgcgcagaatataatgggcaattttgatctgcggcttcgcctcccgctccattctggtcaactcggtggaagccattcaattggaaatgaaaaaatgtgccaatgctaaaaaagtttggaaaatttgaaaaaaaaattctgaacccctcaattgtggaaaaaattttttttgtgatttatttgtgtggtgggttagaattttatcaaggaattcgaaatgaaatatcgttacagaagccatcatttttaatgttgctttgatttactcttttttaaaattttttgaaccatttttatttccccatttttggcccattttaatgggtttttttccatttttttctctttaaaatatggccttaaatcacagaatagtgcaccgtaaacattcaaaaatcaatagatgagaacatttgggcaaataatcaaataaatgtagaaaaatacatggaaaatattaaaattaaaccattcaaagaaatggattattaatttgacatatttttatatctaaggcttaaaaagccatcgaaaacaaacaaaataaaaaagcgatataccgtatatgctctaattatagcccagtctctattaatcccgcagtctccaattatcccccccccccttttctgaggaggttgaaaaataatcccccatgggctataattagagcatatacggtaggtatattctacatacgaaaatgtgtgatcgatcaccatcaaaccgtcactttgcttcttttccctccgattttcgtccgtcgtccataatttgtttttgtcttttttggtctgatcagatgccctcattgtcggtcaccatttccctttccgccacatagttgtaaacatctcggaccgttttgaatcttaaagttgttacatttaaaattaaaatttgttttttttcattcggatagtgtaatatttttgaccagcaaaattcaaaaaaataaaaaaaataaatttaaaaatttatggttgtaaaaaatctactttttatgaaaatgttggccgtaatctttttttgaatcctaacaattttttttcaaatttttcaggctaatagagaacaattggaactagcaaatggtgccaaattgagtcgatttgaaaatattaaaaggaattgagttacccctgagggtccgataaattgggaccaaatttgccccacttcgccccctgggagcagttcgtttccacgacccgaaaatatttttttcacaacaacaacaacaaaaatttgaaaggatttcttacaattagtgaattttccaaaaattaatgatgaattanacaatttgtttttttatttccaaaaatcactgaaaatttttagacattttt

SEQ ID NO: 23038 - DNA, 1048 bp, Heterodera glycines
aaattttccaaaaaaagagatagtgatttttctggattaggccggagaaataaaattaccagctattgaaatgcagtgggcaagcacagcgagtcgcttaaatgcacaccctttgacacgtaaaatatcacaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatagccaaaaaaagagatagtgattttttctggattaggccggagaaat

SEQ ID NO: 23039 - DNA, 1348 bp, Heterodera glycines
tgacagattttcactaaaaaaagatcaaattttgtgattgttatcattgttataaggagaaataagagttttggcgcgccgctgatcacagtctttcatcaaattagcaaattttgcgattgcggctcattttctaagaaaaaataggagttttgggggcgcggcggtgccgataatcgccgcccggcgaaaaaaatggaaattttgatcatttataaacagtttttcactgaaaattagccaatttataggtaaaattttgaaaaattttatgggaattcaatccaattcttaggggtgtaaaagtcgcatttcgcgccaaaaagcgaaatgcgaaaagcgaaatgcgaaacgccaaaaaatgcgaataatgcgaaaggcgaaatgcgaaaagcgaaacctcggcccatccctggtgctgaccattcattcattttctcacttaataatttattcattttaatttcgttgttattactttgtcaattgcttcataatattacgctgaaatgcttaaaataaattcattttccgagctgccaaatttatttgaaaaaaagccgaaatggaaaagacttaaaaaagcagggaaaacagaagagaagccgttgtgagttaatatgtaaattaattaaatggaattgtttttcaattaatgcgttaattacccaatttcttttagaatcgttcgtccgtccgttgttcgctgtcccaaatgccttttgtcggacgttcgctttttgcaaattcatttgcagacagacgaaaaacaaaagaaatggcaaaaatttgaagtgattggaagggttttggtggatgaaaatggggaagaaagtggccaaaatggagtcaaattggccattcttctcgaaatcgcggacatttcgtccaatgtttgctcggcggcaagctttttgaataattatcactaattgcacccattaactaattactcaatgctttgttcgcctttagctgtcaatcgctttaccgctttggatgggattcgccatcgatttgtcacgcatttttgttgcccttcatgccgatatccgctctaaggaaggaaatgcgcgtcaaattttcgaagttggcgcggacgtactgctcggatctgtcggggccgaaattggcggggcattgggcgtcggaattggcacattaattaaaggcagcaattaatatgcccgaaatattttataatgatattgcaaattctctccttatccaacatcgtttttttcaattttcagttgcgatttgcgcagttttcgcgtgtccctttggcgcggtcggcgctttggtcacttccgtcgctggcgcagccattggttagaccattttttcg

SEQ ID NO: 23040 - DNA, 1708 bp, Heterodera glycines
gtcaaaaatctataaggtttacggagtattcttgcatattacattataaaaaaattttatattttggtatgaaaattaagtaacaaatttattacaaaaaaaacaatttattgacactagttagtgtttgaaatttaaagaccttaaagtggatacatgtaaaaaaataacatttagtccaatattaaacaaataatttgaggaaaaattgcatattcacaaatattgttcaatgttagcgattaaaaaacaatatagtcatttttggcgatatgttttgtcactctttgcttggtgagggagatgatacattttcaaaaatcaaaggagagtttttaaagctataattttcaaaaatatccatgatatcagcggaccggaataagggaaaaattgatttaaaatgaattatgcgtcatggacgcggacaggtagccaattatacaaaatcggacgattccgaattctggtcaatagggctgtaaattaaaaaaatttacataattttcatgatttttggaataaaaattcttagaaaacacaataccgtaaaaacggcctacttaggcttaggataacttttaggtatttaaaaattggttttaataaaataatgttttttcgaacgatacttttcaaggacatataattttgtcatcgaagaacgaataggaaccatgtatttacattttcatccagcaaaaacatcattttagaataattggcgaataatccgatttagatttagttggcaaaatgccatttgtgaaagctaagtctgggtggccggcgacaatttgatacaaagttacaggcacaagacaggaatcgtttgatacatattttagacaacacacattcttatgcattattgcaaaccaaaaggtgcaaggtagggtatttcaagccgagagcagagtgcaccccaattccatattcagccccccccacccctttcccccaccaacttcagcggttggagtgttcggttgcgccattttgtaacagtttgaggacaaagtctgtaataaagttaaagtgtataggcacactctttttgggaaatgaattcttaccaataaaatttggtagctctttaaagcaaggcaaaaggcagcaaataacaggcttaaacaattataaaataagcaaaaaaaatcattaaaatgaaaaataaaagcgcataaaataacgctctaaacaattaaaattaaaaagattgtgcaatttaagggagacgcaattaaacaaagcatttgtttattagcattgaacgcataaaatcatttctgagtgtcgaccaacaacatattgtagtacaatcaaattcgccgtttttgcattgtctgactcaatgttgtgctaaaaaatgcaaaaactggaagagaccgtttacgaagttaataaattattacacttagcttcaaaataacaaaaaaacgcattattgatcaaaaaataaattttgagtaacaaacaaaaaatgacgaaaaagacaaaattaagagaaaagttattaccaacggcgccgacccggtcggtgacaaatgttcccgtttccgctgctcgcggcggcatcgtccgacctttttttaaattggttgttgccgttgccaccgccttttcatcgatgtacatctccaactcctacaaatgtggaaaaaatacaatagttttaaaaaaaaattttataggtaaacattgaaaa

SEQ ID NO: 23041 - DNA, 1278 bp, Heterodera glycines
ttccgaataaaattaaaatgttaaaacgttgatgatcttctcctaaattttattcttcaaataacaagataaattaatattcagatatatcaatttattcataaccaatatataacattaaaataattaataaattttttttgtatttaataatacataatttttggagtttaagtagcaaccttttaattggtttattctttaattaatatttttatttattttttctgttaatttctaacaatattatatattttttgttttttaaagtgtgttttattacgagaaattggcaaatttatcatttgcaaaatatttagctgtctgagtaaagagtttttgcaacaaattgataaatatgatatgattattaatttatcttgtctgcttctccaaaaattgggacataaaaagataaagtttttaatttgtattcttcacttaaataatttaatcaggtgatttatttatgattcttgttgaattaacttcagttttgcttaaatttaaaatatttgctctgagacacttttttttgcaagttaatattttgtgatatcatgtccgattccatacagcttactgatatattaaattatttaatctcttatttttatttaaaattcaatattaatcaaaatattcaaatacgaatatgaacctttcagaaaattctgaatttgttttaagaaatttacgctaatttttagaaattaataactcgcttcagggttggacaatattagtggataaagcttaaaaaataaagaaaaatctgtaattttttgcattacaagaggtatattattttatatttttatctcttttttaaagaaagttttaacattaaaaactcattttgtgattcgggaccaatggggggggggttgcatatgttttttgagtgtaaaattttttacccaaaatcatccaaaaatatgtctttaggtgtattttagggcgctgataaaaaaatctgaaataagcttttggttaggactccgttaaggcctcagaatccctgcataaatggagcttcttaggcatcattctgaaagggggggggtcaggttcggatcccggtgaagtaaatgatttttctgtattatttttcatgtttagtaaacatttaaatgaatttcgattttgaattaataatttttattaaaattttaaagaaattattttttcaaaaagttccatttatccccccggggggataaatggagacggggggattattgttcatcctcctcagaaaggggggataaatggaga

SEQ ID NO: 23042 - DNA, 1767 bp, Heterodera glycines
  misc_feature (673)..(673): n is a, c, g, or t
aacacacgaccccgaaaaccacctagaatgattatatgatttaaaaattattattttttttggctggctacaccatataagtaccaatttttcaaccaaaaaaccggaaataccatttttaaataaaaaatcgagccgttttaccgtagtggcaaataattccaagccattttcatcatcgtggaattgttgttgcattgagtgatggaaatgtgaagtgttggcgccatctttgtcaaaaatgttgccgtgattttgctgctgcttttcggacggacgatgatggccccgttggcgatagcgtgccataatgtgtgtaatccaaaaataagacaaaatagggactgtaaaaaagaaaagaaacgggatttactgcttgtaatggctgatcgaaaatagctgtgggagctcaaattgctgtgggagcaaaaagacaggggccaaaatgaaggaaagatggccccataacaacagtcatccctccagtggtggatgtggtctagtggctaagacaacggatccacgtaaggggccccgagcggcggttcaaatccggccttccaccccaatttttcgcctaaataatactgctccgttttagtgtttaggattctcgaccaaaagaatttaaatttaggcccggaattttgaaatgaacgagaccgaaaccagngagtttagaaatggaccgggacgggggtttatcgagacaaaaaaaacccatttgttagcggcctagtccaggatggtttgcttgcgcgccgggcccccggacccatccaggctgaggtttgttgtaattcaaactttttagaatgaaaatacctaataatagacagtatgttgaacaagagaagggtccgtatcgttttggcgccgacgttttggcgccagggtcgttttggcgccgacgttttggcgccaagccataataaaaaaaagaaaaacacccaaatttaaaaattttcgaaaaattttgtaaaacaagaaaaaaaacgtatttttcgcgaaggtaatactgccgatggttgttggttgcccccctttttgaagaaaatttttttgttttcaaaagtcacaagtactattcaattaaaggaataataaatattttttcaatttttaagatcatcaaacgcgctcgacacgaagtcaatgcaccacctgctgtccctcaaaacattgaacaactgattgttcctccggcttaccggacatatgaaccaactgatgggaacgaagagcagttcctgttgggtgactctggtgtgtttttcgagcccggaaacgaaaacccacaacggtaattgttaaaaggaatgtttagattcaactttttttcaaggattctgctgtttgggcgcgaatctttcggccggtgggctgatcgaatgaaagaatgtttcggagacggcacattctcattggcacctccaatgttctaccaaatctacacaattttggccaagtgctgttttaatttgatttcacgtgaaaattgttttaaggcgtgggtcgtgggttatcgtcgtgtgccattgcttgctgacgtccaagtcgcaagcgtcctacgagaggatgtttggacttctccgtcaagcttggtcgacattctcgcctgcctcgttcaaaatggacttcgagaccgctgcgcgcaacgccgctgttgccacgtttcctgcatgcgaaatcaaattttgcttcttccatttcgcgcggaatttgcaaaaaaaaatcaaggaacaaaatctctgggaggtcagtaag

SEQ ID NO: 23043 - DNA, 1669 bp, Heterodera glycines
caggccagggggtggctctattaaaaaaataaaaaatccttgcatgtagaggacactttggcggggtgccctcgcagcgggcattttttgattcgagttttagaaaaaaagttacgggccttcaaacgcaagcaaaagtgagaaattagccgccgggactcagttggccaccggagcggaatgccgatagttttcctgaatgcgcctcaaaaagttgtaagacccttccaccactttcagacccctcccgacagccgttcgactcaaattagtttttaagacgaaaccccctttttctctatggtaatataaactagcgtgtggcgcagtagttgctcggtgtagacagtatgctttgcacagtaattgctcggtgtagacagtatacttttggtatatatgggcgggcgctgacatgagcgcttcgcgcaaaagacttcgttgctagtgcatgcgcgattttgaaatgaatttatggatgtgataaggaattttcagtctacagtcatcgcgaggacgcattcataattttgtggaggaccttcggccgcttcgcggactcaaagggcgctccgcgccctttttatatttaaggtttaattcggccgcctcgcggcctcaaagggcgctccgcgccctttttatatttaaggtttaattcggccgcttcgcggcctcaggacgggcgcttcgcgccattttcataattttatgtgatcattctagacagtatacttttggtagatatgggcgggcgctgacatgagcgcttcgcgcaaaggacttcgttgctagtgcatgcgcgtttgataagtgatgagcaagtgcattcggccgcttcgcggcctcagacgggcgctttgcgcttctaaatattgtggactcagattagaagagtgattagaagaggtactttaattcggccgcttcgcggactcaaaggcgctccgcgcctttttttaattttgtgggagggatccggccgcttcgcggccgcagaacgggcgcttcgcgcccgtttttagactttgtggggccagacgggcgcttcgcgcccgtttcttaattttgttgggcttggacgggcgctttgcacccgatttaaattctgttggggccaaacgggcgcttcgcgcccgttttttaattttgtaggaatcattcagcagtttcgtggccttaggacgggcgcttcgcgcccgttttttaattttggtggatattcggccgcttcgcggcctcaggacgggcgcttcgcgcccgttttcaaactttgtagggaaattaggacccttcgtctttttttctttagaagatagaaatcccataaaaagaggtagaacagtgattagaagaggtagaacagtgattagaagaggtacaaaagtgatagaagaggtacaacagtgattagaagaggaagaacagtgatagaagaggtacaacagtgaaagtgactgcttttttatggtttatttttcaaggattttttgttgaaaattcaaattaaataaaaaatgaattctttaatttaaaaataaattaattaattaattgcattaaaaatttattcatcaaaaaataatttatataaatacacgaaattctttatttaaaaaatagtaattaatttttaaattaaacttttattcatcaaaaaataatttat

SEQ ID NO: 23044 - DNA, 1636 bp, Heterodera glycines
gatgtcatgaaaaatataaatagtttccaaaaaattaaaacaagaaaaaatgcagcatacaaagcgctattggttagtccccgaagagatttatcagagtttggcagcaccgccaccatctgacggaacacccaattgggctggtccgtacccgaaattaaacaaataaaaaatgatgacgccataaatgaggcggaaagggcagtcaaatatgagcaggaagttaagcgtctcaacaagctcacaaaggacgaagatgaacgtcccgtgggtgttaaattagaaaatttgagtgatgtggttgacgccatgccaaaaccagtcaacgttacaaggccaattgttgtttctacgcgtcgccatcttaaagttgggcgtgcgcgaaaagaaaatgttgaacaattagaagatactgatgatgatgatgattatcaaaacccacggtcgtcaagttaaaataaacgacaacccacacaaacggaaatcttaaaattaatttataaaaacgcccaatctctaggggtgtcggaggaagggcaagttttgagagccggtgggcgtccatttataaccagcagtgttgatgacattgttagtcacctgttgaacaaggacaagcgtggccaaaataaagagccaacggcattcaaagaaaaaaaatgcagcatacaaagcgctatttgttagtccccaaagagatttatcagagtttggcagcaccgccaccatctgacggaacaccaattgggctggtccgtacccgaattaaacaaataaaaaatgatgacgccataaatgaggcggaaagggcagtcaaatatgagcaggaacttaagcgtctcaacaagctcacaaaggacgaagatgaacgtcccgtgggtgttaaattagaaaatttgagtgatgtggttgacgccatgccagaatcatccactgtcggatggtccattactaacggattgtccttccctgacggattgtgccctgacggattagccactgtcggatatccactggcggattgtccggacccctaatatccgggtttgggccagaatcgggtgggtaaccagcatgccccgtatgcgcatattcaataaaaaaataaataaaacgggcaatctctaggggtgtcgccaggcagggcaagttttgagatcacggtgggccttcatgcatcccatcgagtgttgacaccatgtgtagtcacaaaatcaacaagcccaacacagtccacggggggcagtccccgtcataggctcctccctcggcccagcaacagcagcagaagttccgaattattctggcctctaaatgtgcgctcatcggtaaccccttttatacaaccgcccccccccaccgtccggtgcaccccaagaacgtcgtcggaagactttttggaccataaatttgttcgctgtcaatcaaattaagaattgttggtgttgttcgatatctctatgtgtttattattaatttgcaaaatctcaaaaattttggttaagtttcaaaaaagttatggccagaaggaactcaaaaacccagtaattcgaacttttttttgctctgatttttttgtaaaagaaataaacaatttttgacaaatttgcagtgcctagatagcgatgactctaga

SEQ ID NO: 23045 - DNA, 1695 bp, Heterodera glycines
  misc_feature (67)..(67): n is a, c, g, or t
agcgcgcctcgttctgctcaaggcaatgcagaaggccccccaggaccggggtcggatttggtgtaantggtaagtccctctaccaaaaaaaatttttgtgcacaaacatttattttagacactgacagcctcatcctcgtccacccggaggagcggtgcccgctgaaaactggcccccacttgggccagttcaccgacgaataccccgaccacgacattgtggaattttgcagtggcggagcaaaacaagtgaattttcagttcatttttgtttacttttgaattttaccacgctttagtacggtctttgtctgcgacgcaagggcgcggaggcgggagcccaattggaacatgtgctcaaagtgcgcgggctgacgctaaattatgatgtgatcaacaatcaagggatgcgctatgagaacttcaaagaggaggtggtccggtacgcgacaagtggtgaatacgagccgataaccatcacataccccaacttccttcgtccaaacatcagggagggaggtcgggtggtttccatgcctatgcaaaaatgctatcgcccatttgtggaaaagggaatcatcggagtcaatttcaatgtgctgaattttggacacacattgtaatttgtgcattatctatcacacacacacacaccacacacatatgactgtttcttttgtacctcaaattgtgtacattttatgccattttattagtttttaataaaaatttgtgcattattagtgaatggaagatgcaattatgaaataattaagcattagaagatgtcatttttaggtagaaaaagtgcataattaagctaaagaagacacaatttttgaaaaattaaggaatggaaaatgcaatttcaaattaatagatggaagtggtcattttaaggaagaaaaatgcataattagtgagcaaaaacaaaactaatataacggtacagtactctgtgagcattcattgcgtctgctgtcttcatcgatgtctccctcaaatactaggcgcattgttgtgtcggatgagtttgacgacgattgtttgtcgtcaatttcagtgaaaagacggcccagccaatgctcgttgttgttgatgtccatgtccatgttgttatcaatcagctcaagaagttccattggatagtgccggtcctcccctccccccgaaaagcgttcaattatgcacggtgcatacgggaagtgaagctttatgcggtgccgtgcataaaaatgcgcccccacattgatgttgaatgggttgcgcaattgcccatatgcgggaagaaaggcggcgccgtgcaccgaaattccagtgacgaagaaagttttggtcaatccattacggtcgttgtatgtggtgcgtgctttgcgcccaatgatgtgtttaagcacaagcgcccgatcctctgggtggttgagccggtcgcgcaatgatttgacagggcagttgagcagctgagcgcaaaatgcgcttacaagaaccatagcaggagaatgaaagtgggatgaggttgaagaatttcacttttatatgcgcaaaagtgtggccacgcctacaccatttgaaaagagtcacggttttagacacgcccactcacagtcaaaacagtttgtctgccaaaaccccaaaatcattttaacaatttttgtcaaaatgaaaagatgcgttgctcctcttactactgctgct

SEQ ID NO: 23046 - DNA, 1702 bp, Heterodera glycines
ttgagtctgagctggaaatgcggacaatgcgtagctttgtgtcctatgaattcacatgaaattcaaattgaaaattcaaaaatgcacctctttcgtggcaattatgacaagtgaccgcatagtttggacgaaaattcaacttgggagcaggttctggcattggcaaattgaaggacggatgtgagaatttgcagactgggccatcggtgcaaaagccaagcaagtagaattggcatagaacacgtcgacgatgcctgtttttgcaaaacggtcctaaaaaataagtgctaaaaagatgtagcggaaccgaaatcataccatgtctgcaaaaaccgcggtcgtaccatggacaatccttgattttgctctccgggtcaatgtgtctaaatgggcattccctgttgctgcaagccactaaaatgaaactatccgataattttcgctgagaataaacaaacagtattttgagaaaaaaaagcattcgggcattcgactcagatcgtattcgtggagaaattcgcattggtcgccttttttgcaaagtccgcgtaaccaatgcttgcacacaacttgtttgtccttgatgatgtgtcggagaggacataatgcgccaaacatgcacgctttgacttcgtttttaaggcagacaccgcgtccactcttatccatgccgggaaagggcaacttaaaaggtcggcagtattcattttcttacaattagacaacaaacgaacttaacctccctaactcctcgctgttcgattagcatctcttcaacatctgtcaaatgttttggtggctccgcaagtgccatgtccatggtgagcggttgttgtatttcagaattatcatcagaaatataaggccccatttgcttaagtgttttgttagaaaataaagtaacattgcagattatggcattctctttgggggcccgaatcaacacgtccgaaacaaatttttcaaaatatttttaagctcgaacctgcattgaatgactattttttcccatgacatttatgtaatgcgtcccataaatgatcatcctcagtttctttggccataacttttttcgaaaagctgaatatggcctaaggatttcattagagcccggaattttgaaatggccgggaccgggacttggaaaatggaccgggacgggatcccgggactcccgttttttcgggactcccggtcccggtggtttgtccaaaaaagccgggacctcccggtcacagtttttgggccgggaccgggactttttcaaaatttctgaaattttgataataaaatttcaaaaaaaattgtcatcttctattttagcttggattgttttcaaagcacttttttagggcacgctttcttcaaaaaaaaaattaggcagcaaaatggggggggggggggggggccccttaaacagaaagccaaaaatatcccgcataaaaaaggaaaactgaaattttatagggcagcaaagcaatctatcaaaatcagtgccaaatgtcatgacggtagccttagagaagaattaatgttgattcaaacgacaaactcttactgcatttatgtgtagaaacaggtgaccttccccgccctcccccctccggcggtgtccctccccgtccccggctttagagtcgagatcaggtgcggggtttcggggatatgttgtgactcatcattaggagtgatctttgatcat

SEQ ID NO: 23047 - DNA, 2598 bp, Heterodera glycines
tacagcccagacatcagcccgtgtgactactatctgcttcgatccatggagcacttcttgagagggaaagaatttgctgatcaaaacgaggtcgaaaatgcattggatgaattttttggatcgaaaaatgatcagttttataaaaaggggattgaaatgttgcccgaacgatgggggaagatcattgattaaaatggtgagtacatcattgattgaacatttgttttttgtgaaataaaaaattgtttaatgttgaagtgcttaaagggtcagaactttttcatcaacccaatattttaggaccgacgatttttaataaaacatcaaaaaattgacaaattgtcaccagtgccgaagttgcagttcatttttatgtgtgttcgtttcgttgttcattttgtcgtttttccgatgccgtccattccaaaattaaattttggtgctcggcaactcagcgtacttataaaagatttgggaagaaaattgcaaaaattgatcaatgattcaaattatgttgaagaatatgatccgaaaaagagagcagaactgaaatggaagcttgaagaagatctatttttagacggtaaatcgaatataatttacaatttttaactaaattgtattaatattggccgaatggaaattaaatatgccaaaagttcttagtattttcggtggataattttaaaattaaatttttcaaaaaagaaaacctctttcttcctgaaaatttgccaaaatttttgataaaaatttggtgctaaaacaatttaatttaagatactgatgaggataaactgctaagaattttggacgagcttgataaaatgaaaaatgaggaagaaaagaaaaaacatgaattgaaacacaattcggctgaaacaaaaacaaagcaaaaaacaaaaatggaaaagaacagaaaagaaagtgagaaaatgggagcaaaattgaacattttacagagtaattaataataaataaataattttaaataaatgcattattttaaatatatttcattttaattttttttaggacatgcaattcaactaaaaatattagaatttctattgacaagcgatgaattgttccgaataaatcatcgttttgatgaaagggtgacaaagggaaatactttacaacattcataatagcttatgacattttgaattatgggcaaaaagttaatttaaaaacttttaataaaaaatgaaaaataaaatttaggaaaaaatatttttgacgaaaatattggccattttaatgcgcaagtgatttgtataatgctaacaaaagtgtttctgctattccctggcaatgtttctgtgccatttttgttagaaaattttttcctaatttattcaatttggtaatttgaaaagatcggttaaaatataattaattaaataatattttatgaataatttttttaaataaattattaaaatatttctaatggtttatttaaaacttttgatttatttgccatttttaaatttgaatatatttatatttattaattttctatgaatatgaaatgatattttcaaaaaaatgcaggaattggcctttaccattgcaattgactgacattaaacataaaatggcagaccaatttttgagttggtcaacaacgacaatttctgctgaattgactaaaaaatatattaatttggaccaaaaaaattctgtggaaatgccaatcattgcaccgatatttcctgaacaaaatgttatgaatctgatcaatgcgagtgatgcgagaaaaattaaaaacgaattttgaatggtaaaatatttaagaaatcaattttttattatttaaataatgcaaaatttttagcatttaaaacaattaggtcaatgaaagaaaatgaagattttgttgcatttttggagggaaaataattgttttttttatgaaaatattttatttataatttaattcgatgctctttttatgaaattgtctaaaatgaaaattttctgaatgagattaaatttcaatgctctgataaaatgtgataagacaatttattcattaaatcccaaaagcaaaaatgtaaaaaaaaaattgaatgattaatattttgaatgtcatacacacaaaaaaaataaataaattcaaaaagtgccaaagaaaaaaaattaacaaatattgcaatggaattgcggcaacaaattcacaaagcaaaaattaaagaaaattatagcaaaaataaaaaaataaataataaatgctaacaaataagcattaagcaaccaagcctagtaaaattaagcatgcacgaaaaacttcatctagaagcctcaaaccacgttgtaatgcgttttcatgctacctgtcttatttgtttgaattacacagtttaatttttaatttgttttttttaaaataagcatgtgattacattgttggatttgctccaaatgtcattattaaattggtttcgctcaaaagactttttataaagttcactgttatttaatattcaatttaatatcgaactcaaaaaagcctcaaaccacgttataaatgcgctttcatgcttctatgcaaatgtaaggttagcataaatttgtgcatatgcttcagaa

SEQ ID NO: 23048 - DNA, 1632 bp, Heterodera glycines
aggtacaacagtgatcagaagaggctcaacagtgaatagaagagtacaacagttaatagtagttacatttactcgcaggttttgtacataatagtttaaaatggttaaatcatggtttcataatcatattattaaggacattgttttatagcaaatataaataacactgaaatgtgttaataatttcttaaacatgataaaataaattaacacgtattgacatgtttttggcagtgaattgttaaaaaaatgttttctttcaaaaatcctgtctatcgccgtttgtaacaacccccaaactcattcaagaattctggaacgtttatcaaaatggttataacaatgactactaaaatttatatgattgagtaaacatttccgtctttagggtggcattggctgtgccgtgctcgcctcgcttggccttgtgccaaccggtttcggcgctccgcttctgaactcgtcgcttttacttccgttggacggcggaggctccgccacaagcgcaacaatcacaccacgaaatgccaattcggacagaagaagcaatgagaatatgagcgacattttgccaacatttcaaatggtcagtgccaacaatggacaatttcctaatgcaaaaacaaatgacaatttgccatcagttggaaatgcatccgactcagcctttgtaccgtttggtttggatgtcaatgaagcgcaagttgcgcaagccggactatctgccaggtattgggggtgatcaatgattagaatgtctgatcaacagaaatgataaaaatgccatgtggtgaccagaatgcctgatcaggagaaattatagaattccatgttgatccatgcctgatcagcagaaatttaaaaaatgccaccatcagcaaataatgccatcagtgatttttagcagcttttgaataaataccatctcattttgacgtgacttatcagttgatcactctcggacccttttaagcattcccgcccccctatttttctcctttaatttttaatttggctaatttcccaattttcagctcgcatcgattggtacgcccgcgtttggatgcccattggttttgcggtgttcaatgtgtgctattggagcgtttgtctgaccatggcttccaaccaaatatccgacaaaagaaattgatgacaacacagaattaattctttttttattttaaatattgccaatttattttattttccaattattatattttatgttttatttttattagtcgtaggatttatcaaagaaatgtatgtaaaaacggtttaatacatatcatatgtacatatttataaaataaaacaaaacattaaataatttgttcgtttttattaggttcggatgaaaggttacaaaaaataaataaatttaaacttcgaattaatagctattaatattaattaatatatttactattaatgattgttgctctgttaatccttatttggccttggaaaatcattttttgaatttgtcttaacattcggtggaaaatcctccaaaaaagcaaaggcgaaggtttaaaagaacctgattaaaagcactccctttcttcaaaatgctttttcgtcgttaacaaaacgattcattattctgtcctcggggcgaatgaaatg

SEQ ID NO: 23049 - DNA, 1421 bp, Heterodera glycines
cgttaattagaatcatttttaagttaatgcctttttggcgtcaaaattcaatttgtgtgtcggtcgtccgaatgatttaattatcttttgcccaatgccgacgccacacgcgtcggattcgacatttctttgatttgtcctttttgctgtttgtcaatcgtaattgctttgattaattaattatttgattaatttgggttcccaaaatggcaatgttaattttttgtacatttaaaaataaattttatttgactttccattcattggcctaatttattcatgaatttggtatcgattttcactgtttccgccgcctctcatctcattatttattcggcatctccccccccccccaaattaatggcggcactctctcccccgagggcattcattttttgttgattatttgtgctcccattattctctttctcccccccccccccattacgcgcaattcattgctattattttcttatttgtgctattttaattttgctaagcatttttttggacaaaaatctcttctccgtccctccattggcatttaatttattattataaaatggcaattcaattcaaaaaatgcgtcccttttccctcctccattttttccaaattaaaaacaaaaactttttggcctcgtcatttattcctttgttttcatgaaatatcattcatttgtaattattttcgtttcgttttgctatttccgcccccccccccttttgtccctaattgacgcaattccgcccacagcgttgtgatttattgtgcattttgtaccctccgcctccaaattctctcacccgcgggggaaatgcgcgccttttttggtgcttagaattagcaaaaaaaaaggaatgaaacgaaagaatgaatgcatacatatgcattgagaaaggccatgaatatttcacggaattgtccaaaaaaagtgagcacaaaaaaacggaaattcaaaaaaaaatgcatggaaaaagaggggaaacgaacaccacaaaatggaaatggacagatgaaaagtgtcttaatcacagttcgaagagtttgtacagcgtcaaaaaaaaattttttgaaaattgaaatttggcactaaaaactcatcgaaaccctcgaaaataatatttaaaaataagatgcaccgaaataaatttttattattatttctttttcatttaaatttcaaatttaaccaacaaattaagcacgtgctcatttgaattattaatcatttttccgagtcaaactaatgaaaacactgcgcttttttcggttcccccgggtccaattacatttgggcaatcgatctccgacaaacaatacaatgacagctaataaaaaataatttccatcgactccgctttgtatgtgcatcggaaaaaaagaatgaaagtggtcgttttcgtcattgggacagaacg

SEQ ID NO: 23050 - DNA, 1133 bp, Heterodera glycines
ggccgaaaaatcattttttagagcatacaaactgatgacagccactgtcatgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattatcagattgccaaaaaaagagatagccattttttttggatcggtcatacctcacatatactcaaacggccgaaaatcatttttagagcataacaactgatga

SEQ ID NO: 23051 - DNA, 2058 bp, Heterodera glycines
acataatggagtctctaactacttcaaaaaacagccaaataattttgtaatgaaattaactgaatatgcattatcggacgcattgaataacaatgaagtgaagaaaatttattttggcgaagaaattctcgaagctttggcaagtttcgatgctgacaaacgccgggcatacattttgatggaaaaattacggccgatgtctgtgaaggtaaagtcgggaaaatgcatcaattgtgagcttaaaaagtctcagtttcaattttcaaattcttaaaataattttataaattcatttatgcaaattcagaatcacattatttgggcagaggacggagaagaaagcagtggagaagactttttagaagacgtgaccccggaattgggaatttttggcactttgctcggcaacattgtcaacggtgaagtattgtacaatgcgcaatttggccatcagctgaagaccaaattggccagcgaaaatgcgcgtggcataacaactggaaattgtgcttttgatacggcatatttggtggactgattttttgaagggaaaaaggagaaaggaaggatgaagaaattaggataaatataaagcattcattgtttgatatataatcaaaatgtttcactttgataaaccaaataagctctttcttctttggactttataaaaagtcagaaaattattaattttaagtttgttatgaaatatttcttgttacttcttttctaaattatcaaaattgtttacaaacaatttttgatttagcgagattttagcacctaaaaacatctaaaacgggggttagcatctgttttggcattttcaaattttagaacctattttggtattttccagatgattttttttgacgcaatgaaatttttagcgacgtgtttaaaataattacaaaaattttagacaaataaatctatagaaaaataatctcccccttctccatttgtccccccatatctaattattcccccccccctttctgaggaggttgaaaaataatcccaccccggggcgataattagagaaagtacggaaaatgtatacgtaaattttcatctatcccattcatcgatttcaataaattttcctcttttcccccttcgctggcgaccccctccccccgaattaaattactggattttcggctcattgtaagaactacggtagaaaaccgttaactcccggcaatgaaaatttatcaactaaaaagatccgcggggggcttctactaggataaattgcggaaattttatttaaaaagtttcagcgattttttcaatagaaaattttgaaaaacagtaactcatttaaaaaacttcgaaacccaatgaagaattaataaaattttgatttcgcatcattctcattcaaaataaataataaagaatttttgaaaatatttattcaaatataaaagtccaaaagaagggacaaaggccgcttatacttttggaggaatgtgatggtcaaggaaacctgatgaatgtcagatctccaacatgaaattaatcttttttatattttttactttttttaaaggaagcacagaatttgatatcgaagtatcggatgttttgcaaatttcttataaatcttttgtggttctattaataaaggagtgttcggttttggttgttttttgtttgttagtaaaatagaaaaaggtgaccttttcctgtttgaaaattttttaagtatttctcgaaagcctcgctgggaaaaaatccggggctggaatcccgaaaaaatcacggcgggccacggtgaaagatgaaaatttggtaaaaatagtttaaaaaatttgtaaaactggaaaatgttaaagaaaactatgaaatacaattcaaaatgctttttatttatcgatgacgtgtattggcttttgtttgcacaaacatacaaaatgtttatttttcattcatttctacacattcccttttggtggcggcgtggcgcagttggtaaagcttctccttatgtctcgatgaaacttatgagttaaagtccgcttgccttctgttcaaagggtcaagaccgag

SEQ ID NO: 23052 - DNA, 1237 bp, Heterodera glycines
taataataaaaaattctattataattttttttgtagaggggaaattctgaaccaaactactatttgaaaacccaatcaaaactgggaaaaatttgaagtcaaaaaattattcgaatttctccaattttgtttccataatttccgaatgttattcggtatcataatgccaaaccaaaacgaattcgttttaaaatattcttttctggacttgacttggtttctcaatatcgaagcttttttctccgcaatttctaaaacgcttataccaaaccctagatttttggttccgatgggtttcagaaaaaatcccgtgtggtgcaaacatatttcacatttcacttcataactttttgagttctgcacggatcgagaccgggataagaccattggaaagagcagctcgagctctacaagaagctatggaaagaaaaaatcgacatttcagggactttttcagaaatcatatttaattccccaatggggccccattttgggtccccagccacagccccatgcttctcccaattgtggcgaaaacaatatttcacatttcacttcataactttttgagttcggcagggatcgagaccgggataagaccattggaaagaacagctcgagctttacaagaagatatggaaagaaaaaatcgacatttcagggactttttcagaaatcatgtttaattccccaatggggccccattttggttcctcagccacagccccatgcttctcccaattttaagtcttggatttgtcaaataaattaacgatttcgaattaataataaaaaattctattataaattttttttgtagaggggaaaattctgaaccaaactactatttgaaaacccaatcaaaactgggaaaaatttgaagtcaaaaaattattcgaatttctccaattttgtttccataatttccgaatgttattcggtatcataatgccaaaccaaaacgaattcgttttaaaatattcttttctggacttgacttggtttctcaatatcgaagcttttttctccgcaatttctaaaacgcttataccaaaccctagatttttggttccgatgggtttcagaaaaaatccagtgtggtgaaaacatatttcacatttcacttcataactttttgagttctgcacggatcgagaccgggataagaccattggaaagagcagctcgagctctacaagaaggtaggaaagaaaaaatcgacatttcagggactttt

SEQ ID NO: 23053 - DNA, 2147 bp, Heterodera glycines
  misc_feature (23)..(23): n is a, c, g, or t
tcagtgtaaatgatgaatatcanaactggtttattcaataatccttcttcgtctcgctcctcacaccaatccattcttcataagaacaaaaacagggcatagcagtacgcgtcgaaaagaaatgggttaatgagtgcggtggccatgttttcagtcggatgcgttccgcgaatgggcactgtggaatttgccgtgtcgattaagcaactactcgaaagccatttttctcggcgaatcaaaacaaagtttcgataaagggaaaaattgctcagttggttgtgcaaagcccaattaacttcgctgaaaaccgtgggcaggtctttgttgcttgcgtgccaattgctgagaatttggcagaaaattaactttttgagttcgaatgcgcgaaaggtctgataaaacccagtttcgcaaatgaacaaaaagtgcaaatttggcgatggaaaaagtgcaaatttgctaaattttgctttttttcatcgcaaaatttgcatttttagccatcggtccgatttgcactttttatccctcccttgccttacataattgcattgctgatttcgcccttgtttcgactaaaccattcgtttgaacgctgggcacggttggtatcttgttcaaaatcaaatcgcgtgatcacaacatgcacaccacggacggctcgtaacaccttaaattacccaaacatttaaatttgtatttattagggatcgtgtttttggtttttacttagtttttctgcggctttaattcgacgaaaaaacactttttttggccatggggagctcagaaaaataggtaaaacctaaaaatacaatttgccgtggtcgcggatcgcacaaaaataaatccggcagtcgcgcatcgcggtcgcgcattaaaaactcaaaatttccaattttttttttgttatttttaaaagaaaattaaagattttggtcggcgccgactggggaaattggaattttgaaggatatttgcattttgcaaatctctttgattttcataaacagaaatttacttttaaataatttaaatatataaaacaatcgcttcaataaaaaatttatttttgaaattttatcaaaaattgccgcggagtcccaaattccgcggatcgtggattcaaattgccgcagtcgcgaatcgcggaaaaaaatgacgcgaatcgcgtatcacgctcgcgctcctccaacacacaaaatctctcagattctgttcttcgtcatgagacctataatatttttctgttttaattaattgctgatttaaaaatcttaaaaatatattttttttgaaggacagagtttctatttccaaaaattttaacttaacattttaactaaaaaattaagaacccccatccttccgttcgtttctaaaaaatcaaaaatcacgcgcataaaaatggcaatttttgttgcaaaatttgttaacaaatcacaaaccacctcctaattaaaaaaattgggcctaaaaaagggccctaaaaatgcaaaattgaccatttttcggtcccggacctaatcattacacataccacacagtttgcttccgaacaattttcgataaatgaccacctgccaccatcgagttcgatgtcctcaacgattaacacccgattgctgtatcttaataaaacaaaaatttacaaataattattaagctaagagttggggaaagaaacatacaatataataatcaaaaaacgaaatgaacatttacagtgcatggcataccaattttgtataataattactcttttaatgattattaaatgcataattttttgcattttcttttttttattttaacaaattaattatgatgtggacgatgagttgcccttaccgctgtaagcccatttcgtcggaaagatgtcgaattttcaaggcgacagtggccatttcacctggccctactatttcagttgaacggtgtaaaagttgaagaacgtgctcctcagtcaattttggccatgtttttgtctgaaaatattcaacattacaaaaaaatagtaagtacaatttttttgtatttgcgttcaaaaatggatacttttatttacatatattcgggatttttcgagtagaaatgtgcatgtttttctgaatgttttggagtttgacacatatttaaagattttg

SEQ ID NO: 23054 - DNA, 1205 bp, Heterodera glycines
  misc_feature (11)..(11): n is a, c, g, or t
ttaattgaaanttagcttaaaaaatatttaatactgatcattaattttacaatatttaaaaaccattcaggtagggggtaattttcgttttaaagcattattgttaaggaaattctccaaaagcataacttaatggaaaaaaatggcaaaacgccaaatcggggcttataatatttattttttggcatttttcggagggtattacggttactgcaaaaaaagctataagatatataaaaatttatttttccctcgtaaaaattgttgaataataattacataatgttcaatttttccccacaaattaaaatatgctatacggtatgcaccgtaatttgattttgctaaacaaaatttttttttttttgcataaaattattaaatttttttccaagatcgtcatcacactgatggagacaatggcagaagtcatgcaagacgggatcatcatcatcaccagcatcgtcataactatgaaaaggaggaatatgaggagatggagaatttcgcaacaacaaaacattttgccaaatttcaattggcccttttattattggcaacatttattagcataatcagtgccagattattattttaatatactgtatgtctgcttagactttgtaaacagtttaaattagcgggatttttcgcgtaaaaaaatgaaagtcgagccaaaagccaaaaaggggtaaggcaaaactatgtataaatataaaaattagttttattaatttttaccaatttaaacatattaaatttgtttattttcctattaaattgaatggaactagttgtgcatttttgagaaaaaaaaatgcctatcctgaacaatttttggcattttccatcgcatttttagcacatggtttagcactcggtagcttagtttatgttttgaggttctttagcacatataaatcaataattgcttatttaaaaataagagaaattccagaatatctccgggattttcattaattacggcagagaaattttggaatttcatgaattcggaaaaaagaaatttcggattctacttgctttcatcccattacaatttaaatttgcgcaaatttttgtattgtgtggcgccttggaacagaatcggcaaagttgacgaagaatttttttttttatttgctatcttgcagtctaagtatagctggtttttcttattcatatttttgatacaaatttgcaaa

SEQ ID NO: 23055 - DNA, 1472 bp, Heterodera glycines
atcagatggggtgcgtcacatcctaaaaattcctcttttcgtctaaccatccctccctttttgtgcactatttcgtttcaacattttatcaattttttgttgtcttttgaaataaattgtgaaaaaatatacgaaaattattttcgcttttaattatgatgtacaatgcttttaagccccgccgtgaggcggcttctttttgtgcactattttcgtttttaaaattggatccggattttttggcttttttaaataaattgtgaaaaattcaaaacaataaacttttttattgcgctacaaatgcttttaagccccgccgtgaggcgggacagttccaaaatttgcaccacattttactgtggaaagtccaagtaccttaattggacaactacgtgtcaatgagcacagtcgccgttggccagttgtgaaacagaaaaatgggaatatcagatggggtgcgtcccatcctaaaaattcctcttttcgtctaaccatccctccctttttgtgcactatttcgtttcaacattttatcaattttttgttgtcttttgaaataaattgtgaaaaaatatacgaaaattattttcgcttttaattatgatgtacaatgcttttaagccccgccgtgaggcggctcctttttgtgcactattttcgtttttaaaattggatccggattttttggcttttttaaataaattgtgaaaaattcaaaacaataaacttttttattgcgctacaaatgcttttaagccccgccgtgaggcgggacagttccaaaatttgcaccacattttactgtggaaagtccaagtaccttaattggacaactacgtgtcaatgagcacagtcgccgttggccagttgtgaaacagaaaaatgggaatatcagatggggtgcgtcccatcctaaaaattcctcttttcgtctaaccatccctccctttttgtgcactatttcgttttaaaaattgggaacatttttttgtttgtttttttgaaactaaaatgtaaaaatttaatagaattatttttgattttaaataatgcttctgtttcgaatcttttgactctaagaaattaaactataaaatttagaacaattaattctctgaagtttttaacttggctttaccatgcttttaagccccgccgtgaggcgggacagttccaaaatttgcaccacattttactgtggaaagtccaagtaccttaattggacaactacgtgtcaatgagcacagtcgcctttggcctcttatggagcagaaaaggggaaatatcagatgggggtgcgatcctttcaaaaaattactcttttcgtctaaccatccctccctttttgtgcactatttcgttttaaaaattgagaacatttttgtgtttgtttttttgaaactaaaatgtaaaaatttaatagaattatttttgattataaataatgcttctgtttcgaatcttttgactct

SEQ ID NO: 23056 - DNA, 1090 bp, Heterodera glycines
catttaatttctcagagaattttaaatttatcttatatccaagaaaaatgactatctctttattttgagaaattttatacgttacaaatgctctcgagcatgataggaagggcggtgcgcaatcgccatttaatttctcagagaatttttaaatttatcttatatccaagaaaaatgactatctcttattttgagaaattttatacgttacaaatgctctcgagcatgataggaagggcggtgcgcaatcgccatttaatttctcagagaatttttaaatttatcttatatccaagaaaaatgactatctcttattttgagaaattttatacgttacaaatgctctcgagcatgataggaagggcggtgcgcaatcgccatttaatttctcagagaatttttaaatttatcttatatccaagaaaaatgactatctcttattttgagaaattttatacgttacaaatgctctcgagcatgataggaggggcggtgcgcaatcgccatttaatttctcagagaatttttaaatttatcttatatccaagaaaaatgactatctcttattttgagaaattttatacgttacaaatgctctcgagcatgataggaagggcggtgcgcaatcgccatttaatttctcagagaatttttaaatttatcttatatccaagaaaaatgactatctcttattttgagaaattttatacgttacaaatgctctcgagcatgataggaagggcggtgcgcaatcgccatttaatttctcagagaatttttaaatttatcttatatccaagaaaaatgactatctcttattttgagaaattttatacgttacaaatgctctcgagcatgataggaagggcggtgcgcaatcgccatttaatttctcagagaatttttaaatttatcttatatccaagaaaaatgactatctcttattttgagaaattttatacgttacaaaagcgctcgagcgtgagaggaagggcggtgcgcaatcgccatttaatttctcagagaatttttaaatttatcttatatccaagaaaaaatgactatctcttatttttgagaaattttatac

SEQ ID NO: 23057 - DNA, 1017 bp, Heterodera glycines
attgtctatctcttttaaaaattggaaaatttttctgctcacagtaataggaattccaaccgcattctcagaataattacgccgatactaattgttctggaatttgtttctcggcgcgtttgtttgggaaaaatttggaaaattggctatctcattttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaaccgcattctcagaataattacgccgatactaattgttctggaatttaaaagtcggcgcgtttgtttgggaaaaattggaaaat

SEQ ID NO: 23058 - DNA, 2137 bp, Heterodera glycines
  misc_feature (33)..(33): n is a, c, g, or t
ctgagcaatgatatcttgagggctgaaacttgnagtaattagggacaaagaatgattttgcaatttttaaatttgagggaaaaaactaaactatttaaaaaacatacggttcgcataacaaaactggcaaagcggcttcttgaatcttggacggctgaacaaatcccatcatgtgaagcgctttgactaattcgggttttctaacaaaaaaaaaagttgaaaattattttaaaaaagtgggaaaattgcatattatgtacattctgagctcctcaaaagtgtgtgctgaatagagaggtgaatttgggtcacgttgcaatttggacacttccggagtgccctcgttcaatttgttcagtttgtcattgagcactttgttcagcagcgaagtttcggcgtcaggaactgctgaaatttagacgaagaaattggttaaataaacgaaaatagcaaagtaataattactcttttcatcagactgcgaccaaaaattgccaacattcgattcagaattttccataatgatgggcaaaggattgagattcgactaaagtggtattattttgatacaatatacataaatatttgaaattaaaaaaaggaaaaaagcattgttaaaatcaagaatgaaatgcaaatgcaccaattcccgaccaaacattacgccaagaaaaaaaaaaaagaactaacttgagaagacccactaattcttcgtcgagtgtatgacatgatctgctgacgaacttgtacagatattttcagacttcttaagaaaattaaatggttaaattcacaaaaagaattattttcttcgattaaaaaagaatggcacttcaaatgtgataataattagaacggtccggacccaaatccggtttttccgggagccttagcaagtaacccgtattttttcgaccgatgtctttttacgtactacaggtgctaacaatccttcgctcgctcgggcgcccctctatttgtgtcgtcatcgcatgcttgttattcgcccgaacaaaagttgaaagtaaattttcaactaagttcactttatgcaccaaaaaaggctatttttcgtgcaattttttaaacttacaatttcgaagctatctaacgcagccataaaattaaaaaaacaaagtgattgaagacacaattttatttattttgggtactaaattgaattttttttaaatgaatttttgaattttgtcaaagtccgggctcggagtttgaaatgagtgaaattggatgtctgaaaacgaatttttgcaaccccgaaaaccacattaaagttttttctctaaaatatggaaatttttgaaaaatctaaattttggcataatgttgtaaattttcgaaaaattttaaattttctctgaaatttattgcgttttatttttttgcgtaggatggcagaggatggtgttctaaaatcggtgatcggacttcgcattgaacgggtggcagagctggacggggttgcaaagttttccccagacaaacgcatcgccaaattgccatggtaaaaagcaaagggaaattcgggcaaaaggcccgcccgatgaggaaattcatttaacctcgaaacaggcgtcttgaagtacggaaaagtgcgggcggaggacagcactcgccgcccactttggctgtttatgtttggtgcaattgggccaacaaatcgcagtgttggcgctgcaaggccatcgtcaaatttgtcatcaaatcacgcgaggtatccacatttgtgaagcctttactcagtgccattgagaattcaagccgtgccaatgttttcggattaaatcgaatggcattcgatttctttaatttcgatgaatttggtttttcccatttagttggattttgtccgcaactttgagcacattttctgcgctcgtcagccatttgtgaattggacacgtctgttggagtccaccgcagcgaacagtctgagacgggccgaggacacactcgaaatcgaggcacagatcagtgtcaccgaaatcgtcggatacgggtgagagtgagaagggtgtggtgaactgatagatcgcctcgcgaaacaatttttatagatcaatatttttgaatttttaaaaaattaaaaaacgagattttctttttacacagattttga

SEQ ID NO: 23059 - DNA, 1751 bp, Heterodera glycines
ctgtaatcattcataacgcttttgaaacagtcaattaattgtaaaaaacattattctgaaacaaaaaagttataaaaaattcatattacatttaattttatttattatagtataaaaattattcataaagcaaatattttgcgatgaatttttttggtgctagcgcgtttgttaaaaactgccacccatgcgcgtttgttaaaactgccacccatgcgcgtttgttaaaactgccacccatgcgcgtttgttaaaactgccacccatgcgcgtttgttaaaactgccacccatgcgcgtttgttaaaactgccacccatgcgcgtttgttaaaactgccacccatgcgcgtttgttaaaactgccacccatgcgcgtttgttaaaactgccacccatgcgcgtttgttaaaactgccacccatgcgcgtttgttaaaactgccacccatgcgcgtttgttaaaaactgccacccatgcgcgtttgttaaaactggcacccatgcgcgtttgttaaaactggcgcccatgcgcgtttgttaaaactgccagaacgataaaaatataatttatatattttacattttaaaatattaattttaattaatattatatttaagactgacgtattataataaaaaaaaatatgaaaatatttgccaacattaaattatagccaaagcgaaaatatttgccaacattaaattatttatacatttaaaaacgattggtaaatgaaaattttatctaaaacatatatcccatctttaataaaaaatattttagcaatttcttttaaaaatgaggatgcaaatatatttattaactatattattatgttcatgcttcaaatttttaaattgcatcgacttcgaattttcgaacttataattaagaattttttgtttcttctgagtacgtacccggtgaagttatcagtaaaactataatttctagaggaaattaatgttggaaagcaaatcctcattaaaatgatatttatcaagaatattcgtaaaaatcttctttaaggtaaaaattatcaaataaaagcaaaaaaggaaagcaggagataaagggctttccaacaaattaatattgataagctaaagtcctagaaacgacttttaaattccgaattattttctttaaaggaatttctgaagtatataaaaacaaataattaaagtcttacaaaattctagaggaaattaatgttggaaagcaaatcctcattaaaatgatatttatcaagacgattcgtaaaaatcttctttaagggaaaaattatcaaataaaagcaaaaaaggaaagcaggagataaagggcgttccaacaaattaatattgataagctaaattcctagaaacgacttgtaaattccgaattattttctttaaaggaatttctgaagtatataaaaacaattaattaaagtcttacaaaattctagaggaaattaatgttggaaagcaaatcctcattaaaatgatatttatcaagacgattcgtaaaaatcttctttaagggaaaaattatcaaataaaagcaaaaaaggaaagcaggagataaagggcgttccaacaaattaatattgataagctaaagtcctagaaacgacttgtaaattccgaattattttctttaaaggaatttctgaagtatataaaaacaaataattaaagtcttacaaaattctagaggaaattaatatggaaagcaaatcctcattaaaatgatatttatcaagacg

SEQ ID NO: 23060 - DNA, 1718 bp, Heterodera glycines
ttttttgatcagcaccaaaagttatgttaacttaaattatttcagatattttggccataaaatattgactttttcttcggtaaatttaatgggacaacacttttgaccacctaaaaatggggttggcacataaaatcgaatagaattcgggcaccaaattttatcttgactaatgattggtttcattgaaaagcccataaaaaatcttatcagaaagtgtgcttcttttttcgcagaatgcaaaacatcaatttttacttcctataatatttctcaaaaaaagatgagacaacacttttgaccacgactgtaattgatttgataatattttatttttatttgtctctttttcggaatttttacaacttttttctaaattttcagatgtcttcagaaattttttgttcgcctcggcgaaagcccaacgacatgtccaaagtgtcggtcgcacacttcgctgatggaaaacatttcactgtcctcttccaacgcgcaaacaccagcaaatgaaacggattcaaacagtaagtgatgagagacgaggagaaatgccgaattaagtgcaaaattaccgacaaaaatggcatttttgtgttggtttcggtcaaaatacggcattttcagttgccgagttcgccgtctgtcctcttccgaccgatccgtgcacttccgctgcttcgacttcggcacaaattcagcagccgccgcccattcccgcggttgtactttgtgaacgcaattttgtacgtcctcaattaccaaaactcattggaataattggcattttcttaaaggatgactcgcgatggaaggcgaattcgcattttggcgccgtcccttcgccctcctccgccaccactgaaatggcatcggcagagcgtcggatttgtctgtcaacttccaccgtttcttccacctgttcaacttcaatgcgacaaaaggggggaaaagagagcgatgacggaacgccaaaaaatggacaaaatgggaggggacaaaagaggcgggaggagaaacaacgaaggacggcacagccaatcacaacactttcgacattcgcaacccaaaaaggtgagagaaacggacgaagaccgatcgatggtgaccactgatcagcagaagtgatcagcgcaaattcaattgatcagaaaaggggaggaagaggaaagagactgatcagaaataatcacaagagagagacactgatcatcaatcttttcgaaaaataataatcagggaaagcgatcagcgcaaagcaattgattataaaggggaggaggaaacaggctgatcagaatttcttacaagagagaggcattgatcagcagttatttctaaaaatgaagatcagggaaagcggtctaagagatgtctgcttttattaccggagacttattttatgccggatatcatttttgcgaattggtgaccaattttagtttgacggcggctatttattgtccattagaggagctaatgttggaccaccaaaatttaataaaagttttgcctcatttcagagaatgcccttacaactggccggaacaacggcacggactgttcggtgtggcacagcgaatttgaggcggacgatgcgaacattgcgctgccgctgagttcgttggacggtggtgccaaacagaaaacgcagcccaaccatttggcacgccgaaggcggacgaagaagcgacggcaccgtcgtcaacgaaaggactttt

SEQ ID NO: 23061 - DNA, 1301 bp, Heterodera glycines
  misc_feature (1270)..(1270): n is a, c, g, or t
ttgaatattatacaattgtgctttttgctctctatcaatttattataaaaaaattcacttcccttcgaaattgaaggcagaatgctcatttgaagctacgcaaatataaattaatatttgctataataactgactatttagtcaacagaaaacaaataaatcataaaattagaacaaaaaatgattttattttagaatgcacactgaagatgcataataagctaatatattcgaatttattttgaaataactgttcaacagattattagttgtttctaagaaataatgataggaagcttatctgaaatgtgtgctcacccaggttggaatttgtcatttcctgcaataaatgttttcatataaaggtttaaaaaatttgatcgggtttaggaacattcaacaaatgcatagataaattttttgaatattatacaattgtgctttttgctctctatcaatttattataaaaaaattcagttcccttcgaaattgaaggcagaatgctcatttgaagctacgcaaatataaattaatatttgctataagaagcgactatttagtcaacagaaaacaaataaatcataaaattagaacaaaaaatgattttattttagaatgcacactgaagatgcataataagctaatatattcgaatttattttgaaataactgttcaacagattattagttgtttctaagaaataatgataggaagcttatctgaaatgtgtgctcacccaggttggaatttgtcatttcctgcaataaatgttttcatataaaggtttaaaaaattcgatcgggtttagaaacgttcaacaaatgcatagataaattttttgaatattatacaatcgtgctttttgctctctatcaatttattataaaaaaattcacttcccttcgaaattgaaggcagaatgctcatttgaagctacgcaaatataaattaatatttgctataagaactgactatttagtcaacagaaaataaataaatcataaaattagaacaaaaaatgattttattttagaatgcacactgaagatgcataataagctaatatattcgaatttattttgaaataactgttcaacagattattagttgtttataagaaataatgataggaagcttatctgaaatgtgtgctcacccaggttggaatttgtcatttcctgcaataaatgttttcatataaaggtttaaaaaatttgatcaggtttaggaacattcaacaaatgcatagataaattttttgaatattnatacaatgtgcttttttgctctctatcaatt

SEQ ID NO: 23062 - DNA, 1217 bp, Heterodera glycines
gccagttgtgaaacagaaaaaatgggaatatcagatggggtgcgtcccatcctaaaaattcctcttttcgtctaaccatccctcccttttttgtgcactatttcgtttcaacattttatcaattttttgttgtcttttgaaataaattgtgaaaaaatatacgaaaattattttcgcttttaattatgatgtacaatgcttttaagccccgccgtgaggcggctcctttttgtgcactattttcgtttttaaaattggatccggattttttggcttttttaaataaattgtgaaaaattcaaaacaaaaaacttttattgcgctacaaatgcttttaagccccgccgtgaggcgggacagttccaaaatttgcaccacattttactgtggaaagtccaagtaccttaattggacaactacgtgtcaatgagcacagtcgccgttgaccagttgtggagcagaaaagggggaatatcagatggggtgcgtcccatcctaaaaattcctcttttcgtctaaccatccctccctttttgtgcactatttcgtttcaacattttatcaattttttgttgtcttttgaaataaattgtgaaaaaatatacgaaaattattttcgcttttaattatgatgtacaatgcttttaagccccgccgtgaggcggcttctttttgtgcactattttcgtttttaaaattggatccggattttttggcttttttaaataaattgtgaaaaattcaaaacaaaaaacttttattgcgctacaaatgcttttaagccccgccgtgaggcgggacagttccaaaatttgcaccacattttactgtggaaagtccaagtaccttaattggacaactacgtgtcaatgagcacagtcgccgttggccagttgtgaaacagaaaaatgggaatatcagatggggtgcgtcccatcctaaaaattcctcttttcgtctaaccatccctccctttttgtgcactatttcgtttcaacattttatcaattttttgttgtcttttgaaataaattgtgaaaaaatatacgaaaattattttcgcttttaattatgatgtacaatgcttttaagccccgccgtgaggcggcttctttttgtgcactattttcgtttttaaaattggatccggattttttggcttttttaaataaattgtaagaaattcaaaacaaaaaacttttattgcgctacaaatg

SEQ ID NO: 23063 - DNA, 1882 bp, Heterodera glycines
ctatctttacacaattggataagtggtggaagaaccccacaccccgcgttcatcaattaatttgtcgctttttggtgagctatttgttaatggtgcaggtgttgtactgacaatggcagtggtacgtttgaataaagacaatcttcttaaatattccgagtatgaataatctggctcgtgttgatgtcgagatagagtcaaattttttagataatcagagtatatgttttcggtatgttgttctcgcaatgatgatgatgatgatgatgaaacaatgggaagagaaactcggagcaagaataaaataagacccaattttttagagaacattttatttattttatggaacaaaatgatatgacaagcggactttaaatagtggtgtctgtgcttattgatcggtttttgtccagcatcaccagtgagtcacattctcccatcacaacaagcattattcctccgtcgggcactgggtgattaaattttatgctcaccgctgtggtcccattctttatcagatcaaacaatgccgcctgatcgtccccgctattggtcaaattgaaaacgtaaatgcaatgtgttttaccgtattgggcaaaagttatcccgttgctctccgatgagatagcgaacccaaccgcttcgttcatgtcattgaacgggcgaacatatttcctacttgggtaatccaggtcatagggcgcttgggcgtacgatcgtccattagcaacaatggaaatttcgcgcacattaaatggttgaaagttgaacgggctgcgcctaattgtcccaacatagtcagcattggccaccagacccattgtcacacgacgggggatttggtccatgaacagattggatgtaaactcataacggccctgactgataaacattgatttcatcattgtcttccttactgcataacgggcaggcttcacctccaactttctcgcaatgtccagcgccaacccatccatcagagacacctttttcacatataatttcagtccagtccaagaatctcgaaatggtagcggggtgcacccgcgataggcgaaattaacataaagtcgttgtcgttgggcaaaatttcaatgtccaattcacaaaaattgatcagatacaatggctgattgaataggtcagtgtctattttggcaatgaattgagctacgttgctacccgcaaacaaatctcgtcgcgctgtgcatccgcctcccatctccaatgtatcatccgtgtcccgataatagcccatggcattcagatgggagtcttttgctgtcgttgaataggagagctcatgcgagaaatatgttttgtaggccattaaagcgttggcattgaaaatttcgcgtccattaatactcatttttacgttgcggatgaaggtttgtccgatcatttgaattggcgcaatatttatatcatcagcatttaggttaatgagttgtccattagcgttttccttccggattcgaaactcagtgagcaaatagcatttggagaggtcaatgtaattttgacttgaatgaagtttgaagtggtagggtgtgtcggtcagcggattgctgggcagaagctcgaacactttcgatgacgacacactcacattggtcggcggaatacggaaaaagtccaaagcattggtgattgagttcacggagtcgttgtcgattttgtgaaatgccattatttaataaagtccaaaggcgtccgatcgaatacgctttttcccctgctttacaattggtcgaccaattagggtttgatgagcaggcagatatgctctctttctttttatacccttttttccgcttccaaactgttttggtaatcctcctttgtcgagtacggtatcaatccctttctttccttcact

SEQ ID NO: 23064 - DNA, 1170 bp, Heterodera glycines
  misc_feature (1125)..(1125): n is a, c, g, or t
ctgcattgaatgctgcagtcgccgctgctgtacgcccttccgttgctgagttagggtcgagagcggcatgaaaaaagacaaaaaggaggaaaatgaaacaaattcgcggctttgccctcgcgttggagaaagcaatgcgcagaataactggggagacttagggttagcgcatcaattatttttttcagaatgtgatcggggtacaaaaaatacgggtccaaaaatgggtgtaactccgcttggagatgcgttagaaaagaaagaaaaatatgttcggacagcttttgaagagctgcattgaatgctgcagtcgccgctgctgtacgcccacccgttgctgagttagggtcgagagcggcatgaaaaaagacaaaaaggaggaaaatgaaacaaattcgcggctttgccctcgcgttggagaaagcaatgcgcagaataactggggagacttagggttagcgcatcaattatttttttcagaatgtgatcggggtacaaaaaatacgggtccaaaaatgggtgtaactccgcttggagatgcgttagaaaagaaagaaaaatatgttcggacagcttttgaagagctgcattgaatgctgcagtcgccgctgctgtacgcccacgcgttgctgagttagggtcgagagcggcatgaaaaaagacaaaaaggaggaaaatgaaacaaattcgcggctttgccctcgcgttggagaaagcaatgcgcagaataactggggagacttagggttagcgcatcaattatttttttcagaatgtgatcggggtacaaaaaatacgggtccaaaaatgggtgtaaatccgcttggagatgcgttagaaaagaaagaaaaatatgttcggacagcttttgaagagctgcattgaatgctgcagtcgccgctgctgtacgcccacgcgttgctgagttagggtcgagagcggcatgaaaaaagacaaaaaggaggaaaatgaaacaaattcgcggctttgccctcgcgttggagaaagcaatgcgcagaataactggggagacttagggtagcgcatcaattatttttttcagaatgtgatcggggtacaaaaaatacgggtccaaaaatgggtgtaactccgcttggagatgcngtagaaaagaagaaaaatatgttcggacagcttttgaagagctgc

SEQ ID NO: 23065 - DNA, 909 bp, Heterodera glycines
aaatttcctatttcactacagttttatttggtgttagagccaaaaacggacaactgctaattacatgtatgaccgcaccatacacaaaatggggggggaggcaccagattttttgaattgttctggggctcaaggggatcagcggtcaattttgtgaggcgtctgaattccgactctgaccgccttttttttgcttttcaaaatctgattttcatacagaattttgtccaaaaatctaacctattgggtcgaagggcgcgcttttaaaatacttgggatgcggtgtcgaagcaccgcgatgtcttcgacctcctacaatatcaacagtacgcaaataaaaaattttgtttttatcggcacaaaaatttttgtccattacaaggcgtgggaaaggggaagagtaaatagaggcaagagtgaaacacttcgaaatcctgctctcctttatattgtgaatttgttcgcactggcaattcggcgaacaatgaatgcgcataattggtccggagaacggctcaaagaggaagagaggcgtgtaagcggcggttggggggggggaggggatttgccaaaagattaattaccatttctgacagaagagagtaaatgtatgtgttaaagggcacataataacgaaacattttgttgttatgcccactagcaaaattgatttacatattgttttgtgcaaaaatctgtctaatctgaccaagattaatcactattgtcctcgccccaaataacgacgaaatacttcgcttacgaaatgcgaccaaaagcataggctgattgtccattgttcttttgtgaccgatttttggccttaaacagacaaacaatatgctaatcagccgcacaaaatttaacaggatttgaccacaagattgatgaccatatttgtattgtcat

SEQ ID NO: 23066 - DNA, 1242 bp, Heterodera glycines
  misc_feature (1206)..(1206): n is a, c, g, or t
ctcttttcaaatatgcgaaatatttatggcaatacattctttccatattttccttaattaattggttgggcattttttcgaatctcgaaaatctctggctcggtaggcatgggactcaaaattttttttttcataatttgccataaaacattaaaaaaaattataattttcactttccagatttttattttattttattatatttattttaattatcatttataatttttaatgtgtccgcgccttcggagcaggtcgaaaaatatgcccataatttgtttttatgaatgttgtcttttttctattctttttggtctttgatgtttcaattaatttctttttcttttattatattttgctttctcgcccgttttcaaattttaattttttattggtttttaagaagtataaattaaaaattaaatacctgaattttttacatcacccggctatagcaaataaagaaaaataaagccatttttagagaaaagatggaattaagcgaaaatttttaattttatgttcccgtccttccctgtaggtcgatgctatttttttcatttgttccttcattactcgaagctattaaaaaataacttactatattacattttttcggttttatttattcaaaaaatgaaatatttaatggagaaaaaaagggggaaatagtacagaacagggctggagcgcgcacagaaaaaaaccgcggccgcgcatcgcgcatcgcgcattcaaattgccgcggccgcgaccgcgcatcgcgcaaaaaaaaaaaccgcggccgcgcaccgcgcatcgcgcattcaaattgccgcggccgcggaccgcgcatttaaaaacaaaattttcaatttaatcaataaaattttcccaagtgaaagtttttttgaaaaaaaatttgaaaatttgactgcactttgttacgaaaattgcctatattaaaatatgtactcattgggggaggcattcgaagaatttttccattatatagaaatttttttttaaattttcatgcgggggggggggaatcttggattttctgagtcccaaaattctggattttttttgaataaattaacaatctattaattttttaaatcgcgtttttgtgggcggttccaaaaaactttttgggaacattgtgggggggggggggcggcggtgccgataggcgccgccggaatattttgatattttcagcgnagattagttaacataatttgtcaaaaaataccaagg

SEQ ID NO: 23067 - DNA, 2534 bp, Heterodera glycines
  misc_feature (8)..(8): n is a, c, g, or t
tcaaatantggacaccccatttttctacagctcctatcggtatcgccatccacaaaacccgtacaatatgaactaccaaatttgtatattatttagttgtctttgtttgcctttcactggtctctccaccgttcccatgtccatcactgtgcgcagccatcgttgaaaaagacgttcattcgtaaaaaggaatttgtcaaaaacattcactaattgtcgtaaaaagtcctaccacaattggatatttccatcccaattgagacaacactttgtcagtgtttgagcgcaaaaagtgactttgtgtgaagtgaaatttgccatcactttgaagggaaaatgaataaaataaaatcggtaaattatggcaaattataaaaccatcgaaaggcgcccaacggattaacttggattttctggtaccgtaattggattgacttggtaccccaaggtccgtgaatgtttggttgggttttcttcagtgttcactctgttcactcaactcaaacccaccggaagatattttccaccaatttttggagttgtgccaatttcggattgttgctcaattcgatcctttgcgcagatggaaattatcacacaaaactgaaattcgctcacattttgacccattccgaagttcgcatttgctccaactcgaagcccatccgacgcaaccaatccatcacttcggaccatcggagagtgttctgagaagcgatcaaatggaaaattttgccagaactttcgttgaacaactcgcaaagcacacggacaacgaaacgagccgaaaagtccacgggggtcagctccaactgaacataaagcgtagaggaggaggtcaaacagtccaatttgacctgccagtccaaatcgggcgttttgccagtgcaaatcactcccagaagcatcaaataagtgaagtctctgtcattccaattgccgtcgcaattggacggagccgactgattgccgagtcggtaacaaacgccgggcagtccacgagtgagcgacctaagggcaacggacacaaaaaatgccatggaaataattgtgttggtcgtggagagtgccgatcacacacctggtcaccagctgttccgccacgtatttgctctgtccgtacccatctgtcagctgatgacagtgattttgcggtgggaagtgttcgtcaacgccgcgcaaatcagcggggaacacccgcgtcggtactgaacggaaccaaagagaaaatgggcacaaaagagcaaatgccgcggttttttggtcgatttgtaagcaattaattatttatgagacaaatacttcaaatatacggctgacctgatgtaatgcagcggttttaacttattcttcaggcagaagtcaagcacattgcgcgtgccgagcacattaatgccatgcaaagccttgggaaaagcgagcgaatctcagcaaaagaaatgctgtgactgacttggtacggatagatcagattcacataagcagctgcatgaagcacaacatcgatgtcataggacaggaaatggtaatcctcatcagagagaccgaattggaaaagggcgatgtctccggcgacgacgcgaacgcggtccctgggaaggaaaagatcgacggacatggcgaagagaccagcgactgaactgacctggtcaagttgcggagatggtcggtcaacagtccattggcacgcaacgaattgaaaagacgctgcagaacactctcagcaggcgacgattcgcggactgacaaagcgacgaggcgaactaacccttaaaagaggcactcactcagacaagtcagccgagtgtccgtggtcagcaacagttcgaccagcaaatgagagccgagatagccggtgacacctgaaaaggttggacgccgggaaaaggtcggaatggacaccggtgaggaacacgttggagttggtgaagcgcctcttccaaaaccccgtggcacgccaaaatgccctcaggtgcaggtcctccagcaggcattgattggttaagcgaaatgacccaaatgaaaggcatcgccaaccatgacgttgtcgtgcaggtcgtggttgtccacctgctgctccaagtccacttcctcctccggactcgccctttccgcgccgtcgagcagtttggccatcgcgtaaactgtgggggccgcaaaaaggtcgcgcatgaccaattgggcgctgaattcggtgttgacccggttcagaagacgggccgccaacagagagtgcctaagggcgacgaatcgtaatattggcaagcgaacgcttcgattaccctccgaggtcgaagaaactctcttgaatgtccaaattgaccaaatggagaacttcgccccatatttttgctaatttctgtaagtttgtgtgttgtgcgtttcctttggttacaatttggcacttgttctgtttgcgtttggggaagtgcttccgcttcgacgacgtcgcgctcgaagtccacgggaggcagagaccttaattagcaaaaggagcacaatcatacggtgttacagtatccacaactttttgt

SEQ ID NO: 23068 - DNA, 2305 bp, Heterodera glycines
tgacattcaattttttaaccattaaaatcttaacattgaataggttcatcaaagatatgaaaaaatgattaagagtacaaactaacaaaaaactgaaaaaaaagaattttctgtagaaaccccaattatttttttggcttcgaaaaaagaatgaaattcaattcctttgtaattaattttctcaataagttattttcatcgattttaatttaatttcattgaaaaacgcgctgattttcaaattttcgctcctattttaccatttttcgcattatttcgcaatttttatgcccttatttatttacctatttttttcgcttaaaatccgccgcttaatgatcaggcaatacgaaggcttgttatcgcatatggtcccaatgaaaaccaaaatgatcaagatttgatcaatcattacgtgcacttcaatatggaattgacatgaaaggcttcgaaaaaggaattaattatgaatatctatcaattcttattctataaagcacataaatttatttcaatcagagcgcaaatgtcttttttcgctgtacggcgcaaatgtcgcggcgcaaatgtcgtttttattaggcggcgcaagtgtcgcggcgcaaatggcacggcgcaaatgtccgcggcgcaagagtcttttttgctgagcggcgcaagtgtcgcggcgcaaatggcgcggcgcaaatgtctgaggcgcaaaagacattaacgctataatttaagaaaattaataataattggatttagtaatctaattggtatattatatttgtttttaatttttaatattctcaattcataattatttatatcctttttatgcatttgttaaatttcatttagatgtatttttatttcatatattaaattaccgtttaaattattaatgtattctcttttttagtattcttaaatgcattcgaactggtgacataattgacttaacaggacatttcacttgtttatagaaaatatatgttagatataatgaattaatgagcttatctgttcaaagatctatgtaattattgagaaagtttttaattaaagcttcattccgtcctctcttttgtgaaatatatttatgggcttttacatgacataaactatctctcaaccaataattctgttgttcctttatggaatcaaaaccttcacttgatgatatattttttggaaaaaattcgtatagggtgtaatacgctaaaatgtgataaaaatgacctaaatattcttagaataatattgcctttgatatctcttttttaagaaacgattttttcgaggtatattttcaaaacttttagttttaaaaagaaattttacaaaatactcaaaatatataaaaaatgaaatatgtataaaattacataatttagaatttttggagtatttaataaaaaacacgattataaggagaatttttttttttgcaatttttcgaaaagttagtcctttttttgtggttcttagaatagatcattcacacaaataattttgttaagcgcttaatactaactcataataattttgcaagaaaaatgttttctgaagtaattgtttggttaaataattatttattttgtataatattattttactaaattcaatttgttatattttaatcgagtattatattttcatattgctttttatactattgtgttggttttttcgctaaattattttaattgctctcgcgtgtcaatatgtcttgttgcttttgccagacgtaaaaattttgttgcgcgaaattcactttcaatccatttcgttaataaatcaattatttaacattggaatatctttttttttattaattatttaaatattgcatttgactaaagtgtgacctaacgattttttggatatcttctcattctaagaagcttgagatttgtgattaaataattattattttatataatattttataaacaaatatttttatttaagttggaatattttagtcgattattaaatcatcttttttttctcgggtaaacttgttattttatttctcttttctcgagtcagatatttaagttgagcgtcggttcgaacatgttttaaatttttaattctgtgccgaatttatgatttactttgttattattaaatcattaaattttatttttaatttgatagttaataaaaacaaaatatgattattataataacaatctatttaaattatacataattttaaacatgccttaagcgcactcaaatattttcttatcgctccctttgaacaaagtcttgagtttcttcatttaaaaattttactaaggcattttgt

SEQ ID NO: 23069 - DNA, 2406 bp, Heterodera glycines
ataatgaaaagaaagaaagcgggagaattcagtgtgttggtcggatgacatttagtgatgttcgagacggaaaaattttccgagactcgagaccgagacccaaaaagcacgagactgggcgctacacgaatatgacatctatttccagcagatttcgagtagataacccgaacttgaataaaaatcgaaaattcaagtttctcgttcaaaatctttgttcaattttagctagaaagtcggaattgattaaaacaaaatgtcatgctcgtgatctaaaaaaccctccgggaacaaatttttattttttatttggcgaccgggaaaatgcgtcagtttagtcagtttatcagtgaatcagtgtatttattgaaaacgagatatgtgtatattataatagttagaaattttaagcgatatgggaacgaacttacagcaacccatttaccagaatattacattttatggtttttgaattttttttaatttattaaagtctatgagtttcctaaaaacggaattgttaaattcagaattaggctcctaaacaattttaacccttttattatgccaacaatagtcaatttaggacaatatttatttactcgacctaatactatatgtaaaacaatatgctgctacagaattttatttttttttataattcggtatactgacgcattttcacattgttatacatatatacgcagaagatcatttttggatttcttcgtgtttctatttgttatattttttggataaatttggtgaaaaaaaattttaacagaaacatatattttaatgcgtaattagctaattgtttaattaaagacggtttgaaaatttacattcactaaaagtttcaaaaaagaagcaaaaacactaaaaaacatttaaaaaaatataaaaatttgtatgaattttgcaaaatgttcatcattagggatgcgatttttaggcaaatgcctaaaatttctacgtacttaatacgcacagataagcacgaaaatatttcgccatttccggcgcctttttcaggattttggggaaaaatccttaaaaaatgaaaaatacacccctacgaatcgacagacatgaaaaaatttcaggaaatagacccctaagaattgaaaaaattttcacaaaaattatcccctaaatttaattattttttcttgctaaaatttttggtttaaaaattgtccttattcgaaaaagccttaaaacaattgaaatatacgaaaaattaagttttttgattattttgtgttttgctacctaaaagcgttataaaaatttttttgcctatttaatacctattttgcgcttttttgtgcctaaaatggaagccctaataataatacataagaaggaatgcaaatttaacaaattccaatcaacaagtgaacatctcttttcctcttcatcattcttcatttgaattcaaaggattattaaaaattccaaaatttaactaatttaaaatagtaaaaatttgttaaattttgcgattttgggtcattctttaagaaaaataagaagttttttaagtcttatttattagtcaaaataaagcagaatttatatcaaaaactatttttgcacaaaaaaattctaaagaaatatatttttttggacggaattatgaccccaaaaatctcagaaagcggaattgcgtgccgtccctgtacctactttttgctttccaaatcttgtcgatgaatgccgcgaattgaatgtggtcctcgtcctccaatgaaaggttatactcatttctagacgtgtcgtcaaacacaattggcttcaaattcattcgcaaaaggcaaacatttaccagtagagcccggatttttatgttttaacatatttttttgcggcttagttatgagtagggccgctatttttagtgaaaaactatttttttttttttgctcaattgatttgaagaaaggagctcaaaaaacgcatttttgcattaaaattttttgattctgatgtcactatgggtcactagaaatcactattttggcctttcgtcactaaaatagttgaaattcactattttggcattttatcgctatttttttcactattcgacatttttcagagattttattagcaaaaatgcaataaaatcaaaaaatacacccctaagaatcgatttaaaaaaatttcaaaaaaataaacccctaagaaacgatctaaaaaatttcaaaaaaaatacaccactaagaattggaaaattttttcaaaaatttttcccccaaattttttttcttgacaaaatttttgatttaaaaaatgtcaatatttgctaaagagaactttataaaggaaatgtagctcatttgcaactgcaaccagtgaataaatttatttttgcttaatttttggcttaaaattaggtca

SEQ ID NO: 23070 - DNA, 1119 bp, Heterodera glycines
ttccttcgggggaccgtgccgggtgccgcggggtaagcagtgctggttcgtttcatcacggcaccgaaccttttggctagtcagcaatcgttgcttaacttgccagatcggacgggtgcgcatgactttctgaaaaaaatatttatgaaacaaaaaaatcgattttttcaagaaaatttttcaatgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaagattcggtctccccataaatctgggcgcatcggttcggggggactgccccgaaaacaaaaataaatcgattttttcaagtgtccgtttggggtactcaaaacattatggggagcaaaaatccaacccagaatttaaagtacgggctattagggaagtttttcccgaaaggattcggtcttccccctaaatct

SEQ ID NO: 23071 - DNA, 1540 bp, Heterodera glycines
tgccgagtaccaacaacaacagcggcacggtggcagcaattctagtgccgaaaacaatggcacgggtggtggtgccaaaatgcagccaagacaaagtaaatggatcaaaaatgcttttcttaggtctgtaaaatgccatggccatgccaccgaattttggttaatttaatttttggtaaaaggtgtccaaaatttatgaggaaaaataattttggatttttttggggaggggggggggcgggggaaatacggccaaattttcggggattttctaattggaattgtataccctaatattgacaggacggaaagtgcccgagggtgagctgtgtgccgtgtgttccgacagggccaccggttatcattatggtcagttttctgttgcaaaaccccccagggggatttccatggcatatttctgggacaattccctgacaaaactccaccaatttttttttctccgataaaaattagagcacagaacttcgaagccacaattttcaataaacaaattctcgattttaaaaagacaccgaaaaacgccgccgggaaaattgcaaattgtgaaaatttacaaaaaaaaaaaaatttcatataaaatctctcatccattttcctaaaaattttctgtcaaataaacgagattgggagcatgagccaagtttctttcttgaagctaatcatttttttagcattttttttacgaaatttttttttaaaaatatatttaacgcccatttttaggggtggcaagctgcaacggatgcaaaacattcttcaggcgaaccattgtctctgaacacagttttggtatttgttcacattctccatttttaaattttgttctattttggagaggaattccaaaatttttagtcaggaaatttcatttttacaattttaaccgtccgtttttttgaaccctatgcgaaaaattctaaaaaaaaatttaatcaggtataagccagccattttttgtataatttttttgcacaaaaaatctcaatccgttgtccaatttttatttagtgtgccagtacagtggcaattgcgacgtgacaaagagtgggttttccgcgtgtttaattttggcatttttcaaaaaaaaaaaattcccattttttcaagacgttcgctgcgcgtgccgacactgtcgctttgcaaagtgagtatagtgccatcccatttttcgacaaaattttgccattttttgcagatgtgttgcggtcggcatggacgcaaaagccattcaaaatgatcgggacaggtacaattttcgacatttatcgaacaaaaaatggcacacaccgacaaattgcttgttattatgttgtggttttaaatcgaatgatttttttttgatgtgaaaaaacatcgacatttcgaaaggtacccacccagaaattgcagttaaataatttcattgtaaaatggtttttttttaaattttttaaatgggtgtttaaaattaaagtttgactcaaattttctaaattttttccccagtgtaaaatttcattggttttcccgaggcatcgaa

SEQ ID NO: 23072 - DNA, 1642 bp, Heterodera glycines
  misc_feature (1465)..(1465): n is a, c, g, or t
  misc_feature (1523)..(1523): n is a, c, g, or t
  misc_feature (1545)..(1545): n is a, c, g, or t
  misc_feature (1603)..(1604): n is a, c, g, or t
  misc_feature (1613)..(1615): n is a, c, g, or t
cattttggtggaagctgcaaaaaaagagacagaaagagcatggcgggatgtggctgcgctaacggatgaagtaagcgattttgccaaatcttctcgcgaaacacttaatcgggcaataagatctagggaaaaagctcctcatgctaacggtgttcgggaattgtatcttaaaatgtcagattcaatttagggaaatcttcacaatcctggacaaaatcaatttggagtcagaaaaagccgaatctacgtggcgtgacttcgagagatgcaaaacttttgaccaggccacaaagctcgaggaacaatcgcaaaattcattaatggaagcccgaagattacatttcgagtcccggagggtgcagagccaaatgttaaattatgaaaataggctccaaacaattgtttgggagcatatgggtatataagaacgaaaaataatgatatagcaaaatggaaaattgtgtcataattgagacatattgtcataaggacttaaaatttggctttaaaaaacacaaaaccaaattttattttgtcaatccattttttgttaatgctgagcaaaaatttaaactaatactcacatcgctaatcgatgaaatttataaaaaggaacagggaaaatttaaaagcattttgaagctttcttttggttttgaatcattttattaccctcttaaatgtcctagcgaaaacacagccgaggctttgttccaacatgtcctattaaaagaagaattatagcctttggcggccctgaagtgctgaagtggcacacaatgggggctgaagatgtcattggcgctggttttctcgaagggcgcccattttttactctgaaccgggaacttttccgtaaaattttcacccgttttttaaattgaattttttcttaggcattgacgaggtctgcgtggaacccggccgctttgccgcatttccaactgtttcaatgattggcgaagggtcttccgcgggcgtgaatatgggacccatattcatgtttaatttgaaaaaattgttcatgccgtagccaaacaaaccaaaattttttaaaggcgcaaaaatggatgagcatttggccctgttcggtaggctaattgttttttcattgggaaaatgacaatgggtgagctaaaaagaaggcaaaagatcactgaacaaaaacaaaaaaggttgcaaaattcttcatatttatttttagtgtgctgaaagtgaaaaaacccggtaaaatccaaaaaatatatacactatgcaagaaagcggcaataatagtttttcctaaaaattgcaagaattatgtaaaaaacgaaaaatgaaaacaacggctaaatactaaaaattgatcgttataaaatatttacgtttttcttgtaaaaatttaccaaaaccgtttcaaaaaacgaaatgtctaccaataaagagagtgcagagaaaaaacagctctcactttggcgaactatcntctgtttttcgacaaaaaaccgaatttacttcactctatagaacttttttcccactanattttgcacaccgacacagaanaatattctgcatcgaatattctataaacatgcaaatctttttgggactgagaggcaannactgaacgnnngtgtaaatatatgctcaaaaacccaaa

SEQ ID NO: 23073 - DNA, 1504 bp, Heterodera glycines
ataaaatttctcaaaataagagatagtcatttttcttggatataagataaatgtaaaaattctctgtgaaattaaatggcgattgcgcaccgcacttcctatcatgctcgagagcatttgtaacgtataaaatttctcaaaataagagatagtcatttttcttggatataagataaatttaaaaattctctgagaaattaaatggtgattgcgcaccgcactccctctcacgctcgagcgcttttgtaacgtataaaatttctcaaaataagagatagtcatttttcttggatataagataaatttaaaaattctctgtgaaattaaatggcgattgcgcaccgcccttcgtatcatgctcgagagcatttgtaacgtataaagtttctcaaaagaagagatagtcatttttcttggatataagataaatttaaaaattctctgtgaaattaaatggcgatcgcgccccgcaattcctatcatgctagagagcattggtaatgtatggaatttatcaatataagcgatagtccaaagtcaagtaggtagcaaatattgagatttattaaatggacttacacaaagtttccagaaaacttttcccatccccctagagatcttttttgaaatataccccttgttcccatccaaaatgggctgatcagatcgccatgaaggagtgatctgatcaacttggtgttgctaccttttttgatcagcatccaaagttatgcttacctgaatttttttagatttttttaatgctgatccagagaagcaatattttaaaaatgaaatgggacaacacttttgaccacctatattttgatcaaattgtgaatatggtaaaataaatcaaataaatgtttatgtcacaaatgcaaatatggtatcattggaaagggaaccgcccaactcgccgcggccatctcgccgcgagaaactcgccgccgggccaactcgccgcgcgctttttcgccgcggggccaactcgccgcggccaactcgccgcgccttgttttttggctatctcgccgccagatttttcgttgaaaaaatgcattaaaagcaaaaattctttaacagttaattgtattcaatgtgttatatttcagcaaagtttctctccaatttaatatgcttcaaattgaaagttaacgcaggaaggaaaaattgcagaacgatatattcctctatattttccacaaatttaaagagcaatcatgtcgatcattggtcccgaaattttttttttaattttttctgggaattctttaacaagtttctttgggtattttgtggtgctgagcattagagaccggcgcgggacggggtccccttgggattttgcgggatcctagtcccaatcacacattttttgcaaaatgcgggattaatcccgcgggatcccgtcccgcaaagaatttttagttccaatcccgcagcgggatccgcaaatttgaaattccggtctctactgagcactccatttgaacctatttat

SEQ ID NO: 23074 - DNA, 2462 bp, Heterodera glycines
tttctctctctcacctttctctctctatttctttatctttctgtctctctttctccctctttctctctccatttgctctctctctctttttctctctatccatctttctctctttatttctttctttctttctccctctttctctctctctctttactctctctctctctttactctctctctcactgctcgctttttttctctctctctctctctctctctctctctcgatctcttcctctccctcttttcttcttcttcttctctctctttctctatcctttggctctctctctgctctctctctgcactctctctctctccacttttctctctctccctctctctttcttgctttctccctctttctctctctctctctttgctctctctctcactgctcgattttctttctctttctctcactatttctctctccccttagctctctctctctctctcttctctctatatttcattttctctctctcccttagcccgctttctttctctctctctatcccgtcgctctctctttctctctctctctatttctttctctcccttctctctttctctgctctctcttccaccctctcactttttctctctctctctcttcgctctacctctcactgcttctctcttctctttctttctttctctttttttctttatcttttccttctctctttttctctctcttctctcccatcctctcacctctctcttagctctttctcttctctatctctctctttgctttctcattctctctcccttctctctttttctctctccctgctctctctctgtctctctcccatcctctcatctctctctctttctctctctctctctgtcatctctcagtcttcccactctttttctatcgttaccatttccccattctcaatcgctatttatcttccgctttctctttaattgtcctcttgctttttctcctttatcttctctttatccctatctcttcttctctttctctctcagtcctctctttctccccttcctttagaatctcttcattctgtacactctctcgcttcctttttcatctctctctattgttttcctcttcttctctacctccttattcccaagcactcctacacactcatcacacacataaacaaactcgcacgcattcaatcctgcgtgacaaccgcacgcgttacccactctacccctcccatccgcgccgacagagaaacatacactgcactctctcttctacccatcctttctctattaatctccaattatattttttaattttctgtttctttttcctattacaacaaaacagcatttaaccgccaattcaaaaataggggcggggcttcggctgacttagtatatagttaagggattccaacattaattaaatttccgtaaaaatttggaattttcttcaaaattaaaaaaaataaagttccataccacatctaatgaccagggattctttttttatgtaaatacatatttttttcctggattctccatatcgatcgatgcgtcaaactttgggaatcaaaaactttttcctcttgttgttcggttttttacaaaagataatggtattgaaacccgtgtgattgacttggagtcacttccgggtgaaacgtcatttgaagtgagatcaattttttgcatttttaattgcaataaaaggtgcaccaatggatcaacaaaataatggaaaaatacgatttgaatgtatcaaatttgacggcactttcggcggacaacacaaaagccaatttcggtggagaagagcgcgcaggagagaacaatgtatttttccgtctaagacaacaaaatgaacgattgattggtgtgggatgtgtgtgccatgttttgcataacgcggcaaaaaaggcaacggataatttgagaattgaagggagagcaatggacattgaggcagtgatttgtttgacaatgttagcgaagcaaaccaaatactgaattcttttccaaatgatgaatttcaaaaattaacccccgaacagaagtggaagaagctatttgaagcaaattttccgcatctgctcaagctggtcagcattgttctttccattccggtctcgaatgcatttgtcgagagagtgttttctctttgcggctcacaatggactgatgttcgaaattcgttgcaagtcgaaacagtcaaggcgttggtccaaacgaaagccaattttgatctttcttgcccacaaatgtaccaaatgcaaatttccaatcacaaattgttggagaaaatcggcggatgggaaaaatacttttgataatcactttcaattgtttttgcgctaataaaatgttgttttaagtcgttttttcatgctttttattgcgtatccttcgcgctactatcagttttagaaaaaatcttagggggagtccgaatcttagttttagcctccatctgtctcttattt

SEQ ID NO: 23075 - DNA, 1835 bp, Heterodera glycines
ccctcaaatgatttgtctatcatttctttggaaatctcctaccatgatcggtgtatccagtcaagtaccacgtgaagagctggtgccttcggggttgcccgccaatgtaaactccttttccgactcattttacatccaaatgctgtagaagtgtcgaattcgctcctataacggctttttccacgagacatcgggagccttgtgcaagaaaaattaatttcattgagaaggatgatttggtacctggatgaatttggtgcaaccgccagggataaaaaccgtttccactcgcaatcccttcaccaccttcgtcgttctttcgctcttgtggctgccaaacgcatcccaaaccaagaggcgttcgccaacgaacagctttgcctcaatgattttgtgcaggtagtcctccgttgtgtcatcattcatccatatcgacccagcgaaattgatcaccaattttccagcaaattggttgacaatttgcggcaccggtcgctttctgttgaccagcacgtacggcttgagtttttgtccgttattccatgctgtaagacaacgtcacccgcattttgtcatatcctgtgatcgcaactgtcacctaattcgttagaataagttcattttatccaaaaaaaacttacatcctttgcgcctttattgtcgatgcatcggttgtccggacaatcgaaccaaacggccgtctcgtccattgcgaagatgccgccgggaaagttgttcatcaccttgcgcctttgttcaacaaaactgatgaacttgggtaccgcttcagcatagttggacgggggtttctgacaaaccgatgtctttttgcgcagcatgaaattgtgcctactcagaaatttttgcagccatccaattgatgcctgaacaaaattttttatttttgtagcttaatacttttttcactttgatatcagtgtccatgaacagcgcagccgccctctgtcgaatgatgttccttgactcaggctgtttattttttctttttttggcgatccattctgccagttcagtgtcgatgtccggacggtgaactgggagacctgctccgtcgagtctcattcgttcagttgttgcacacgacttttccgccgaagccttcgttttcaactccgctaaaatcgccacagaatgtgtggcacggcaatttgcagacataacagctgtgaattcctccataaattgctttacaaacagcaaaacgattccatattttctgaacttttcattaaaaattcccatttttatgcataccggaagcaaaaaataacatttttgccatttttggtgtcaattttcagaagttctttaacaaaaatgcaataaatatgattttttttgacgcgatgacattttttggcgacatgttcaaaaaaatttcaaaaattttccactaaataaatcagccgaaaaataatctcttagtctccattagtctaccagtctccaattatctacccctttctgaggatattgaaaaataatataccatggcatataaatagagtaaatacggtaggtacactgtgttaatttaaaataaagacaccctgttttttgggagtttgaccacttcccatgaaccgatcgagctgaatttttaactgtacgtagcaattctgaaaatattaagattctgaaagtgagaaaccgaaatgatgacggaaaaaagttttacgatttttttttcaaaaatggggtgttaatttaaaatagagacaattgataaaaacgaacaaaatctcaacaactaccaaaaataaacagataaaacaaactaaataagaaagaataaatcttttttcacatttctg

SEQ ID NO: 23076 - DNA, 2279 bp, Heterodera glycines
  misc_feature (24)..(24): n is a, c, g, or t
  misc_feature (65)..(65): n is a, c, g, or t
  misc_feature (137)..(137): n is a, c, g, or t
ccttgaaaatttctctttttttcnttcgcatttttttatattgtgttacgactgtttttgggtgnatatacggaagcaaggtaattaaaaaataaaaatgacgtttctaaaatactgaaaaataatttattaagatntaaaaagcctaacggagcctaaatcatattttatcaatcacttcggatacaactttcaaaaaggtatgaataattaataaatgtagtttataaattaaatcttattgaaagcaaaatgaatttaaggtaaaatttacgaaaaatttcgaaaaaatgaaattgaaaaactaaagcaaaagaaaatgcgaaaagaaatggacagtgaggaagtgaagaagcataatgaggaaaaggagaaggtgaagaaactgttggcagaatataagcaaaaggtgaacaaacaaatggaaaagaatgtcgaggaaatggagaaggacgaaaagctaaaggaagtgctgagggaaattgaagaagcgcaagcgaaacacccgggggagaagagaaaagcggcgaaatccatcacagagataaatgagaagcattgggacgaattgtaccagggggacattgagttgagcgtggaacaggcacagtatttgctggatactgtaacaaaaaccgaaaacagagcgttgatgagagcgaagcgaggggcagccaggaatgctagaaaatttcccaatcacaaatggcctattcttgtcccattctcttttgacggctcaatttgtaagtttcaattaagagctgaatcaacatttaaatacctccgtgtttcctcgattattggcccctccattagaacccctactcccacttccattaaagccctcagaggggttgaaaagagaaccttcgggactcgaataaaagaaaatggtactatgattatagaaataaataaacgatcaattttttaagccagcgaaatgaaagcgcatatatatgaagctgtaaaattatggaacgataacacatgcttgaatattgttgaggatgacgaagtttctcctagaatccaattcacaaatattaagggcatgggatgcctttcaaacgttggaatgcaatcctcggatacataccaagaaattaaacttgaatacccaagttgttaccgagtaattaggaaatcatttacaacaataatctttaatattttcaaaagcttggagcaattgcgcatgaaattggacacgctttgggattttttcatgagcatgagagatatgatagggattcctttgttacgttttacgctgataatgttgaccccaaaaattattacgctttcgaaaaagaaacgattgagacgacagacaattatcaagttccttatgaccttggctcagtgatgcactataacgcaagtaagcacaaattaaaaaaaacatgttttatgccgagacctattttgcagaaacattctcaatcaatggtgagtatacattggtgcctcgagtgggtgcttcgtatataaacacaattggacaagaatatggtcccagcctcagtgattatattgttataaacaaacattactgtggattagagtttctcccggatggatcaaccataaacacaggcatttacaaatttgtttattgtacattgtttttgtaattaagaagcgtgtcatgttacaatgaactgtgacaatgatgggttccagaacccggacacttgtacaacatgcatttgcccacagggttatatcggagcgaaatgccaagatgttgacattggtggttatgcccctgccagcattgcaaatacttgtgaagggaatattttatttgcaacatcaaattggcaaaatgtaagcatattttatggtgcaccatttttgacttttcactgatttctatgtcccggtcgctaaaagctttaatttggcgaacccaaagaatcaatgacataaacatttaataaaattattaaattatttcaagctaaacagattttatgaaatgttaagaaaatgaaaacaaagaaagaaaacatgcattcactagcaacaagtcctatgtgcaaatcctatatttttaaacttctcacattttattatttcaatttgtcatcacttaggggcttcctatttgtcctatttgtaatgtagtagtagaactctcgatccatttcgttttatttcacatttctcttagataaatggacaaattggatccagtaacttgaactccaaaatcgattatgcctactgtcatttggcaatatttcctgacattggcaagactatcctca

SEQ ID NO: 23077 - DNA, 2294 bp, Heterodera glycines
  misc_feature (2241)..(2242): n is a, c, g, or t
  misc_feature (2283)..(2283): n is a, c, g, or t
atcttcgaagcagcgggcatgaaactccgagaattctatggaagcaacatcgaagagctaaaaaagctgcaaccagacgacttggcaaaggacctcgaagacaacaaagtgctcggcattcgatggaaaccaaaacacaatcgactcatattcaaattgccaatcttcgaaggaaaaatcacaaaacggacaattctgtcgcaaattgccaaagtctattacccgctcggactcatgtcacccgtgctactgccagccaagctcattcttcaagaagtgcaaaacttgaacccaaaatgggacgacgaaatgccagcaaacatcaacaagtactggctcaaattgatggcacagtggctcgacagaggcgaagcaatcacgatcgaatttccaggcacatccaagccatcgactcagtggaattccactgcttctgcgacgccagcatatacggcatgggaattgccgtgtaccaaaaggccaaaacaataatcagaaaggatgaatgcaacctaatctacgcaaaaagccttgtcaaaccaatcaaagtggcagtgcacgacggcacaattccaaagttggaacttcaagcactgactctcggagtaaaagcagtcaaattcatccaagctcaaatcaaattcgccgatcatcaagtcatcatgtggacagacagtcaatgctcagtcgaacgacttcgagaaaacaagcgccaagatcgatttgtggcaaatcgattacaaaaaatccgagaagcgaattttcaagtcagacacgtcagaaccgactcaaacccggcggatatggcatccagaggcgcagatccccaatgccttcgaacatcactgctttggcgctttggcccgatttggctttcaaaagcagacaaatggccagaatccaacgtcatctaccgacccggagatgaattcaaagaagtggaaaagccaccaatcgttgatattccagcgcaaccaattcaagaagtgcacagcttcatcgcatcggtcatggacgactcagtttctcttgccggcagcgacgacgaaagtcaacaaccacgcccaaagaaaaagttcaaaattccgaaacgacgctcagcactgttacgacccatcggtcagcagcaaagtccattgcaaggacaacacaaacgccgcaagcaactacaagactcaggcttacgcaagttatttcaagccatctcggaccaacaaggaagcagcaaggccaccacaaaggtcatcgaagaaagccgagaaatgcagaaggcaccacgtcatgaacagatcgagcacgaacaacgaatggtgaggaaaagtcaacaagaagcaaatcgacatcttcaaccgaaaaagcggcagcaaaaagaaattcaagaagtgccacattcaacaacagaagagcaacaacgagaaaccaaacgccaacaaatcgaaagataacaaaatgacgaacagcgtgccatcaatcaacaaacacgcagtaaggcttggcaagaattggcacgacaatttgactacgatctgatggatcagccggatccaacagagaaacaaccggaagaaacggatcagccaacgaaatcaaagcaacaatcaacaaagaacaaagaggacaaagagctggaacgacatcgcatcggcagaaaaaagacaatcgacatgcaagaaaaacggcaacggtcaagagacgaatggccagaggaaaacgaaacgctgctcagctacgttcaacgcatttacggaccggagaattggacgtcagcatggcaaagaggacgtgttctccgagaactccatgaactggaagatcaagggcgatggatgattcatcacaaatccgatcgcctacaactcagcgtctcgcgaatgtatggaggaaaacgaccatttgccgagttccgcttcgtggaaggcagatactactcacacatggtgccagaagatgtgatcttcctccaagcagtaccaaccgaagaacagccggagatcataacaatcacgacacaacggcaccggcaacaaatacggaacaaaagaagcacccaacaaaaccgcaacgaccacaatcgccaaaactcgaagaataccgcatggccgactccaaaacgaacacgcacagccaattcaacctgttcgagccatgcgacaacacgcacacaacttgcgccaaaacagcgacttacggttccaccgcgggcaaccgattttcaatggaagaattccaaacttccgtgcnncacatttcttcgaggcattgctctttcactggctaacacgncacatgaactt

SEQ ID NO: 23078 - DNA, 1251 bp, Heterodera glycines
  misc_feature (1081)..(1081): n is a, c, g, or t
  misc_feature (1161)..(1161): n is a, c, g, or t
aatttttacagaaaataaatagacgctgactaattagctaacatttataaagaaagtagaaatttgattaaatgcataggctagtgatttaaaatattatctttgacttaaatttgtataaagctttaaggttttgtctttgactttgcttttttttccatttatttcaatcggctagtgctttaaggttttgtctttgactttgcttcggctagtgctttaaggttttgtctttgactttgctttttttccatttatttcaatcggctagtgctttaaggttttgtctttgactttgcttttttgtccatttatttcaatcggctagtgctttaaggttttgtctttgactttgcttttttttccatttatttcaatcggctagtgctttaaggttttgtgttttgactttgcttttttttccatttattccaatcgaccacgttaattcattctctatacatttagtgtcttatttcatgaaattatattaatttaattttaaataaagaggcaaatttttacagaaaataaatagacgctgactaattagctaacatttataaagaaagtagaaatttgattaaatgcatatacaatatacaaaatattacttttttaaatttgtataaagttcctagtttgtctttgactttgcttttttttccgtttatttcaatcggctagtgctttaaggttattgtctttgactttgcttttttgtccatttatttcaatcggctagtgctttaaggtcttgtgttttgctttgcttttttttgaacggttatttcaatctgctagtgctttaaggttttgtctttgactcagcttcgctagcgctttaaggtgttgaaatgactttgcatgcagctcgtctgtgtgttaaagaaatttggcgagttaattgaatcggctaaagtgctttaaggttcaatgctgtgggactcagcactgggtatgctgatattaaagctggaaaaaagaagcgatttcgctgtgcgagtgagtggcgtattgccatggtttaagtgcttgcttgcgcttgtgctcggcattgaacggtgatggctgctgctgnggtgccacctttgtcgtggcctcagtttctccagcgattggcagctgtcgaaatgaataaacatgcagctcgtctgtgtngtaaagaatttggcgagtaattgacttgtgtaaatgttgcctagggcacaatgctgtggggactcagcactggggatgctgaacctaaag

SEQ ID NO: 23079 - DNA, 1639 bp, Heterodera glycines
gcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggaggggggggggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatatttttgctaattgagcagaagcgtaccaaactttgcagggatactccccggtaaaggactaacttacactgaaatgagcgccgagctagctggctcaaaaaaatttttcgaaaatctgagtctttcgtttttatttatttgcaaaattaattcataaatattttttcagaaagggttctgaaacgcaccaaattttatttacatgttagtttaggcactctgatgctttttctatcaataatggaggtgaataaaattttaattgctttttaactttgggaaaaagtttaggcttaactttttagtgaaagtttgatcactcatatttttttagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcaataaaaataacattcacggtgcgaaaaatggggtatgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtatgaaaagtttattggggaaaaaaagactttacaaaataatacccctgggagaagggagtgggaaacatgatttcaaaattttcaat

SEQ ID NO: 23080 - DNA, 2376 bp, Heterodera glycines
  misc_feature (2329)..(2329): n is a, c, g, or t
  misc_feature (2343)..(2343): n is a, c, g, or t
tcttccttcgctggtcctttcccttctcatttacaacattttatgctctcactcacccaaattctgctgatgatcacaacattcaaatctgcgatacatttttctgacttttctcttttcgtatctcaaaaagtctgtcctccgcgaatatttttcggtcgatgctcattttttaaacatttttcaatataactctatcaaaaataaataatttgatccaattaaaaaaattttttggttcttttgcaaatctaaattaaaaaacaaacaaatggatcgaattaaaccgcataattttaaataattaatgttatccttccgtcaatccgtccgaaaatgttttgtaatttcccgatcaatgtgccttagttgatctctccactttcaatgctctcaaaaatggcggaactttctctgtactgcttcacatcgcctgtcaaatgcgtccgtctcttttgttttgctaggctcgagaaattacaaaataaataaatgatttattcaaacaaagggcaattggattttgattttcactatttgaatttgtctcgagtaaaaacgttgtcggtggaatggcctaaggccaaaacaatggatgttcttcggactttaagagagggttgcacgggttcgcttatttgggaaagaccgggcttgggtattgccgggtccgagttttacaacatggaaaagggtccaaccgaatcctgaaattattcgtaattaaatttttccaaattaaagtttttttgttgatttttgtgaggaatttaaaatttatcagaatttgaagtccagcgtaaactaaacatattatacacagcggcccaattttgggctctcagtgcaaataggtttattatttatttagtaatcagaacgccaaaactttgcaaaacttaaaatttttttgggattttcccttgtaaaattagaagagccgatctcgagttaaaagcttaagtttttacaagggcaaacatttcaatactttaattcttttttagccaagtccacaatttaaggccaaaccaaataaaatttacaatattctccagaattttcccttcaaaatgagcataaaatggttttatttgctctagtattcaccaagttataagctaaaaaaatttcataaaattgtcgatgttgtacgtaaccaacgcttttcgaatatgattttttattgccacgaaaacttttattaatgaaaaaataattctgccttctttaagaagaaattgaaatcaacacacaacataaggaggacttgaacctgggaccccccttttggtgactaactcacagaccactaagacggaaaatccaacttaattgtacaaggagcccaaaattgaatggccgtgtaaatttacattttatccggcggtgccaatatgcggcgtttttctccagcgactaattcttaaaattttttcacaggtcgaattctattaatattgtggaatttagaaatcatttaattaaataaagagtgaaacagaaaatttttattgaacgaagcaaatacttggttacgattaaaaggaaattagcagccatgtgacaaaaattaaaaccatacataactgtgaatttgagaaaataaatgcttacaatgaaaatgattgctaagagtgctaaacagaaataaatattgctgaagaacattctggcacatttgtttaaagaaaaactgaaaaatcaaaggccacaaaagaaaatcggtaaagagaaaagaaatgaaacaatcggacggacgctaacaaaaaggactaaaaatccttcatttcaatttaaactgtcccacgggctgtttgacttgttccacgtaatttgccggtagcattccccagctgaaagttgaatgggacgaccaaccaattgaaaaataataaatatttatctattcattgttcatacagtaaagtcctctgcactgtccctgtcatccatccgtcgtccactttttggcagttcacaatgacgtcgccctccttgaagctgacctattcaaattggaaaatgtatcgccaaggaacaaatgctttccgaaatgtgttcttttccctcctttcactcacttcgtctttgtccgcggccgtgtaatcgtacaatgccttcacagtgaaaccgcccccattcgctttaggcgccgcagcgccagcggctggggccttctgttgctgcttttcggcagccaaagggtcgtagtcggcgattgagcccacgggtttttcaacatttgtggcatcaacttaaaaggaaaatttaaaaaacaaaagaaaaaacgggaaaatggggagaagcgaacagaatgcacacaaancgcaaattgaaggngtcaatattttaattgtgttcaaacagcaacaa

SEQ ID NO: 23081 - DNA, 2700 bp, Heterodera glycines
  misc_feature (2585)..(2585): n is a, c, g, or t
  misc_feature (2625)..(2625): n is a, c, g, or t
  misc_feature (2636)..(2636): n is a, c, g, or t
  misc_feature (2642)..(2642): n is a, c, g, or t
aatgctttacaattaatgtattaaaattttttttatttcaacccgtaattatgccatttaaaattttcatttaattatttttatatatcaaaaattaataattctttctgttaaagttttaattaagaatcattttataaaaatgattagtttttaaaatctcttgtctcgtgtgcggttgttttgctaatctcctgtattttttatgcttttttaattttcattattttgatttaaattcaatataaagtttatttgattgttcgaagggctaagatattaacttatttgaatttttgcctctactcacttttggtaaattattaatagtttattatttattacttttacttttatgcaaattatttcttacttttaaattattttaaatttaggtttctaataattttcatcggtttattgtcttccttgaatttatggttttaaagtcggagtaagacaaaacgtcgtcggacgaatttttcgaccataactttttttcttggtattattcgaaagcattcgaaaaatgctattagcctgcaaattttcaaattttttattcaagcacaaaaaaatcagagcaaaaaaaaagtttaaaatactaggttttcgagttccttctggccataactttttttaaacttaacgaaaatttttgaaattttgcaaattaataataaacacatagagctatcgaacaacaccaacaatacttaatttgatttacaatgaacaaagttatggtccaaaaagtcttccggcgacgtttcggccggcgacgttttggggtgccccataataggcaccaaacaattgaaaaaaggcatgaaaaggcactaaaatcccgaaaaaggcattaaaaaggcatttaaaatttttttattaaggatttttagtgactgaaaatattaagattctaaaagtgagaagacgaaatgacgacggaaaaaagatttacgaatttttttcccaaattggggtgttgcattagaatagggacacctgggaaaatcggattaaatctcaacaactatcaaaaataaattgataaaataagctaaataacaaaaagcaaataattgttcatatttttgtttgttttgcagacaaaaatatgccttttaggcagagttgtattgaattttccaagtttttcagagaaatcaaggcctatgagacttaaatcgcctctatcatttgacccactgaattaaactggaagcaactaacactaaaataacttatatacatcccttaagcattttctattcactttatgtaagaaaaaattcattaaacacaaaatttttgtgggcgaaaaaatgtgaaaatttgggtaaattcgtaaaaaaatttctagggggttggtgaaaattttccgtgtaagatgaatatgatcaacagaaagagcacaaaattcaaaatcggtcgtttcgcctactaacccaaattctgacctttcgcatacttgacatctataacagacgctatttttgcaacaaaaccattgtttcattagacgtttcagatgacaacgatttaaaagtcgaagtaagtaatgatgaagaaaatttttggcttgtatatttccaaaataactactaaatactgatcaatttggaatatatatatatatatatttggtgaaattcgttttcgaaatatccattttaagatagtagaacaaaaatattctagacaaaacgtccgattttggcttagtaggcgaaatgtccgcacacctttttttatattaaaagggataaagaaatgggacgccaaaataagagatatatttttctctgcactctctatttattggttcatctctcgttttgggactgtgaaaaagcacttgaatttgtcgaattttggactgaatacttaaatattttttaaaaaaattttttcattaaaatccccaaatgtcgtgatccccaaaagtgggctagcctaattatgatggtaggtagaccaatatattaattgaatggaaacatattttatttttgaccctttattgtaaaattttaaatttcacatagaaattattattattcacccgtagcttgcttcaacagcacgcatggacggactgaaacatttgagcgactctgtgcaagcctaaattgcagaaaaaatggcatgtttccaagactaattatcaagtagttgaaataaatcaattataattagtctgccatttttaggcaaatgcctataatttctgagcacttgatacgcacagataagcacaagaactttgttttcagcttagtttggggtttttacgataacttttctaatgcctattttggaatttttatgcttaatgcctaagcgcctattttttatgcccatttcgtcatttttggtgcctatttgatccccaaattttgattgttttattcttgataaaaatttttggtttaaaaattgccttatccgaaccttttttttaattttcataatttcatttaggtgctaataactcgaaaagtagcttaacaacccccaaaaaaatatgtttttcatgcatttcgaccatagggagctcaggaaaaaagtaggtaaaacctaanaattgcatcactattcctaaaaaaggagtgaattatacgncgaattcattnaatttncctgactgtgattttgataaaatgcaccaaatctaaaaataatatataaatttaaaaa

SEQ ID NO: 23082 - DNA, 1233 bp, Heterodera glycines
gccgccgggaaaaatttgtaatttttaatgcgatttgtttacaggtttttgtccaaaaatgaccaaaatttgcgattttgggctaattttttaagaaaaaagtaactttatgcaataaaatttcaaaaaattctcaatcatgagaaaaaaattacattttattcacgaaagattcctaataccatattaataatcttatataataaagttgagtgtttgtgctatgtctgtatgtaacattgtttgaatgtggcgttttgtatttgctgtgaggagagattgaaaagaaaaagagatgaaaagaaatagttttgaaaaagaagaaggtaaaagaaatagtataggaaaagaaaaaagcaaaagaaatagttaaagcaaaaagatttctcttggaatgccggagatttgagtcccagagattgaaaaactggtgggttgagttccagagattggaatgtcattgaaagttggtgggttgagtcccagtgtttggaatgccggagaattgagtcccagagattgaattgctggtgggttgagtcccagagattggagaaaagccaagaaaatgatgcgagggcgcgaagcggccgagccagtcgattttatcattcataattctataacacaatcgtactgcctagcgggggatgcgccgaaggcgctgaccccgctagtaataaaaaataataattctcaactatgagcaaaaaattgacataatgccataatttaatatccaaatatgttataaattcaaaaatttaccaaatttcctttgattattttttccacttttccaaatgctcattttcaaggacgtccttgcatccaaggacattttttattttcaagaaagagggcccaatttcaaggacgtccttgccattcaaggacggatcccatccctgatttgatatcattcgacaaccctaggtgttttttatctggacctgccaaagttcgaataatttcgttattttacaaaaagttagaaccaaaaaattaggacaactatgaaatgagttatacccaaaaaaccgggggggggggggttatcaccaagttgtcccatacccaaaaaccgagttggctacctatttatgggtagcccaataaatttcaattgcccaaaacgatgaattaaattttactattatgtcttctttgaatgtgaaaaagatttttatgtcagttaaaattgaaaaaatttgaactaaacccatttaatca

SEQ ID NO: 23083 - DNA, 1797 bp, Heterodera glycines
  misc_feature (1687)..(1687): n is a, c, g, or t
ttttttttgattttacacataattggctattttcaataatattatcttatgaaagtactaattggtttaaattttttacaaattatttttggttgatagtaccactggtggtacccctttttcgaaaaaaatttcgagattaataagctgaaaaattaaggttttcgaggttgtttgtcacgaattgactgtgtcctaaatgatattgctctaagatatcgatggggttttctgctgctgctttctgctcaaataagcaaaaatctgacgcaaaatgctgtcttgatcaacattgagggatttgcgcctaacaagtaagactttagagatttacctaattccatttgcagcgcatttaagcaacgaaatttggtaattttatgaaaataaaacggaaactaagtccgcaatttgtgagaaagccaatggcaagtatataaaaagatataaaataaaattttcgatatttagccaatattaaaaaatatatatttctcagtcgaaatgaactgtgaagaattgaacagtgacgaaatgatcggccaccgttattatcttcacgattaattcaatgagaagaatttatgatagagttctctttttatacataaaagcacctatgttgggatttgtttaaccaagcaaaattttttgttttttatattcttgtgtcttattttgtgtgaaaaactcccaagtgtttaaattgtacatgacgaaaaatggcaaaaattgtcaaaattggctattttataaaaaagattttgtggtttatcagaacaaaaatattttatgcatgaatagaaatgatatcacttttacaaaggttagctcaggaaaataaggaaaatatagaaatgattgtgtagatttagtgatccagttcaaaacctaaaaccccgataatcttttcatttgatagcatttaatcagctattttcttgccttttcaatgtaaaattgatttctgctgtgttccgtccatctttaccgaaacttaattaaattattaaatttctctaagataaggttcttttactgttattaatttccttgtctttatgcgtgtcgctttttggttgattggtgtattttatatgattcccaacaaactctactccatttaattatgacaatttggtgagctcaggcaactgatcccgaaattcatcgtcaaggtcaactatttttgacttatcactgttattgttatcataaagattgtcattttcggggtgatcattgttcccatttgcatgtaattaaacgagttggtgatttgcataaagctgatcaagctgattatcatccgaatcaccatcaactccattagcatgatgatgttggtcatgttgattagcatcacaattggtattagttccattattatgattatgatcgaatttgttactatctcgattagcattacgatgttgttgattaatttgagcatcctcaggttgaagattagatttatcagaatatagatcagatttatgcgctttactattaccaatgctcgtatggtctttatccttttctttgtcattactaatcacataacatattaaaacaataattatcatggctttaagcaacatcaagactaccattttgttcactcttctgtaatgaaataatagatgaaattcactcactttcaaaaaatagattttttatattttangagtattagctgaaattaagtcgaactaatattttcagaggcgtaaacccaaaaatataaaaagtataaaataaaaagagatatatatatataaagattttatataaaaa

SEQ ID NO: 23084 - DNA, 1954 bp, Heterodera glycines
taattctgtagtttgcccccccccccacctttttggcaaaaaaaattttcaaacatttttttgccctaaaaacaagatttccaggggtttttggggtcgctgaacacgaatccggcatccatttcggccaatttcgattcccggacccgaattcgaacaaaagtcgaaaactcaaattctcgaatttcacatttttggtctaaacatgacttaaatgatcttttattatggcgagagaagctcaaaatagcattttctccaaacaatttttggtttagagcgacttacaaaaacataggtatcataaaatgtacttacgtatttcagaatttgcgcgagatgctttagtataatagggcgtgtgtttttccttttgctgccatttctcctttccattgtcttcctttccctctattattacgctgcacactcgtcgtccaattgtgctgccatcagtttcattgccccccatggtgcatttttttgttcatttttgtacattgcctttctaattcgctttcccctgtttaattaaggctgatgatgttgctcctcccgctccttccgttgccgtcgatgactttgcgcagcgcaccggccaattcttcgacttcatccgccagggaaacatcgaccgattgcgtgcgctgatcgattcgctgagcgtcgatgagctgaacaccttgctgcagatgagatacaacgaacaacaatttgcgctgctggtcgcagttatggaaggacaccccgaaattgctgcacttttggtggacacaattttcaggggcaacaaataaacgacaataaattttgcccatttttcagttggacaaaggcgcggacgtgcatcagaccaccgttggccgagtgaacaatgtgaccatgggtgagcaattcggtttgcggaccgaccgattgtgctgtttgctaattcattttttcgccccattttcagccgttatgcccctgtggattgctgtcaatatgcgccacttggagatgtgccgtgtgctgatcgctcatggtgccgacgtggacttgggaagcgattcctcctttacaccgctactgctcgcatgtgccaaaggcagcacagcaatcggtgaagcaatcatcctgaataatttctcaaatttccctattttcagtcacccttctcgtggagagtggcgccaacgtcaatctcggggacagcgaaggagtaacgccgataatgatcacttctcgtttcggaagggtgaaaaaagcaaaacttggaaaaacttggcattttttgtttgttcaggtcgaacctgtgcacttcttactttctcacggtgcaaacgttgaacagatggattacagcggtggctttttgccaatttctaaataattatcgcgctaattaatgtcttttcaatttcagggatgcgatttgctcttttggacgccgccgctgatggccatttggaggtgtgccgtttactggtggacgattgggcagctgacgtcaaccagcaagcgatcgacggtaccacgcctttgatgggcgcgtgcagcttcgggcactttgaaattagtaagaagcaactggtgcataattcgactcaactttctgccccaattttcagcggtttttctcatcgaacacggcgccgacattgaccacgctgacatggacgggtacaacgcgttgatgtgggcagtgaagtacgagaaggctggtgtggcgcaacatttgctggcgatcggcgcgaacgcagaccaagtgggaattgacggtgggtgggcccaaaaagggcttaattgtaatgctccaactgattgactgctctccccctcccccatttaaggcaaaagggcgatagatttggcccaagaaggcagacgtgccgaaatgatcgacctttttcgaaccacagctaacaatgagcagcgggaggatggcaatgcgaaagaaaaaaaaagaatttcc

SEQ ID NO: 23085 - DNA, 1260 bp, Heterodera glycines
ttcgtcaaatgtccgatcatcggacagtcgcggctaaattccagtcgcgacattcccacgcttgaccaacgtgtgcacgtaatcgcacttggcctctgacttctgctgggccccagcgcccatggcctttgacttcacaatgggccccagcgcccttggcctttgacttcatgatgggccccagcgcccttggcctttgacttcatgatgggccccagcgcccttggccattgacttcacgatgggccccagcgcccttggcctttgacttcgtgatgggccccagcgcccttggcctttgatttcatgatgggccccagcgcccttggccattgacttcgtgatgggccccagcgcccatggcctttgacttcacaatgggccccagcgcccttggcctttgacttcgtgatgggccccagcgcccttggcctttgacttcacaatgggccccagcgcccttggcctttgacttcacaatgggccccagcgcccttggcctttgacttcacaactgtccgatcatcggacagtcgcggctgaattcgagccgcgacagtctattttttctttccatatcttcttgtaaagctcgagctgttctttccaatggtcttatcccggtctcgatccctgccgaactcaaaaagttatgaagtgaaatgtgaaatattgttttcgccacaattgggagaagcatggggctgtggctggggacccaaaatggggccccattggggaattaaatatgatttctgaaaaagtccctgaaatgtcgattttttctttccatagcttcttgtagagctcgagctgctctttccaatggtcttatcccggtctcgatccgtgcagaactcaaaaagttatgaagtgaaatgtgaaataggttttcaccacacgggattttttctgaaacccatcggaaccaaaaatctagggtttggtataagcgttttagaaattgcggagaaaaaagcttcgatattgagaaaccaagtcaagtccagaaaagaatattttaaaacgaattcgttttggtttggcattatgataccgaataacattcggaaattatggaaacaaaattggagaaattcgaataattttttgacttcaaatttttcccagttttgattgggttttcaaatagtagtttggttcagaattttcccctctacaaaaaaaatttataatagaattttttattattaattcagaaagcgttaatttatttgacaaatccaagacttaaaattg

SEQ ID NO: 23086 - DNA, 1720 bp, Heterodera glycines
  misc_feature (1586)..(1586): n is a, c, g, or t
gaggaaggtgaatttgcataagaaatgccatccggaaaaaaacatttttataaattacacatttttatatttcctttgtttgcttttatgaattatttttgagaatttttttaacaaaatcccttttgacgaagtgaagcattggatgatgagaggatggtattgaattttgtgaaatggactttttcaaaacactgtaaaaccgggaaaagtaaatcccgtctcaacatgcaaccgcgtcgtcaaaccgaaacagcggacagtggaaattgtatgaaacagcagcaaaaataggcagccaaccagaatgaacttagttcttgacttaatggtgacggatttcgactctcatttcctgcagcggtaactccggctgtggaaatttaaatcatttaaaaaaataaaaagaaaaaaataacataaaaaaggaataaaaaaatagaattaatcttttcaatttgaacaccaaaaatagtcacaaaaattccgctttggtcaatgcgcgcttctccggctggtggaagtggcggcgatcctttatttttttatttttttatttattcgtgaataaaaagtcatcagaagggcaaaaaaccacttactctgacgactgttcagatagtatgtcgtagagtaagtgatataatatatatggatgatcaaaaaataaaatcaaaatatatgaataaaatgaggtcaaagtcaattgagatcgataacacaaatgtcaaatcacttaaaaaattaattctgtttttgcttttccggttattaccctaatgaatttttaagttttgttttaaattgatttaaagaatttgtttttattagttctttatcaagttgattccataattttgttaccctcccggcaaagggaatgaattttttgcctattttatattttgtgttaaatctgtaaaaggggatgttaaagcgtgtcgatggattaaaaattgaaaatagtttcagatctgttcggccataaacaattttatgcgccatgaacagatcaaatagctttcgcctattctcaagtgtcggcagttgcaggtattctaatcgattttggtatggaattggtggaaggctgcatttaaaaaatacccgtttggtgaaatatttttgacacttttctatttttttaatatttttttgaagagacggattccaaacctccggagcgtattccaataaaggcctaatataagttttatataacgtaatccaaatcttagatgatttggatttaattattcgaaacaaggaacgcatacgtaaatacgcattccttgttattttgtttacatgatcggaaaattgtaatttattatcaatgtttactcctaaatccctaaaattttgctcattggcaaatgtccactttatgctttccatctccttttaatttaaacgtaatttaagcggtttcgattcaaagccaaactcataaaatctgaattaaatatttttgaattttcggcacttttttcctaagaccaaataaaagctgcacaaaaaattgatttattttacatatttttgtgataattcctccatttttcgtgcaattcccaccgaaatanacaaaagtgtgaagggaatgaccaaatggacgcaaaaaagaagcgggagattcagttattaaattaaatatgacaattttattattgtataatttaaatgaaaaatatttttacgcctttttcaaattattttt

SEQ ID NO: 23087 - DNA, 1896 bp, Heterodera glycines
aagccaacacggcttctggcggaagtgaggcgttcaaccgcggacgagacatatgtggcgatgggctcagacaacgcgctcagctgcatgatgagacgtcagaagaagaaaatcctgggaaacgtcgattgcgtcaacccaatggccttcgtgatccccgacaaattgcgcatgaaaaatggcgaggacattgtgctctacgacagtcgcaatgtccgaattggtgaaaaagacgtggtgcttgtttttgggagtgaacgggtaatcgatcaggatgaaattgtgattaaaatgctcattttagactttgggcattttgagccaaaacaatgagtgtgaatgaatcataattaatttgctaaatgccttctgttatgtcccatcatttcaatgatttccccaaccgattgattcattttataaaaataagtgaataatttattctaatttaggctaaagagctgctctttttctgtatagtgaaagcaaaaacaataaaaatgttatttttatttattgcatttttaatttttcctattttatattattttccaaatttcaatcattttgaaatcaaatgtcggcttcatcgtccctttttttggccgtttctttgtcatgtttggcgatgtctgcaaacagtgagttgatggcaacttaggattagactcgtaaaatgaaggaaaaatgcgcgcttttgtataaatattaaaaaataaataaaatttattgtgtttataaaaatattcaaaattatagttattttatttttggaatttagcattttaatagtcaaaaaaattgaatttaattttggttttcttaagaaaaccatggttttttgaaaacaaaatattgaaatgattaaggcagtacttaatttagcactgaaatgttgggtgggcactgatcgcattgaacagatgccaaagaatgaagtacagtgcgaatctgggggacaccctcgtttcggagccgctcgtttcggcgccagcccagtttttggactataacttttttctttttccaccaaatctaacattattggtatcattcgaaagctctaagtgttctctattagcctgctaagtttcaaaaaatttcgttaatgctcaaaaaattatgactagaagaattcaaaaaaccaggccacatgtgtacttttggccataactttgttcaaaattgatcaaattttttggaattatgcaaaataatagagcatcagaagggctctcgaatgataccaacaatgttagatttgttggaaaaagaaaaagttatagtccaaaaactaggctggcgtcgaaacgaacggcgccgaaacgatgtggacccctctccacccccctctccctctatttccttccattttacctccatgtacctttccttttccttaccccaccctatcctcgaattatcatgtaaactactatgattttccatctaccaattcctttcttttttgaaaaaaaagagattattacctattttattattataatttccatattcttcaatctttattgccattttttctgtaaaaatatctatgtcaagcaatttgctgggccactatatgctgatgacgatcacagtcacatgggatgcacgataactctttgtcttgacagaacaaggaattgattcgaacccataatagctgattaatcacagggaccgttctaatagtgtcaactccacggaagaaaatcatggatatgcattgcatttatgacaaaaaaaaaaaccaaattttttgccatttttctggtcaaattttagtaaaatgaggccccaaacggcgcttccccgccaggggaatgtttataatttaattgaatcctttatcctcatttttttaaattttgaaaaagttcccatttctaatcc

SEQ ID NO: 23088 - DNA, 1381 bp, Heterodera glycines
  misc_feature (1210)..(1210): n is a, c, g, or t
  misc_feature (1305)..(1306): n is a, c, g, or t
ttttcgatcacttggctcagtgccggatcgttcgcttttatgctcataaaacgttcatatttttctccaagtcccatccgatcatcgtttttcttctcctttacgctctttcgttttgaaaaaactcgcgcaagcattcctttgaattcctaatttagaataaattttaaatgccatcatttatttaattataataataattttggcattaccccttcagcagtttttggtttgctgaacacagcaaaacttatctgttcagtttccttcaaatccaacaataattggtcaaattcgtcgtccttgatttcttccatcttcaacagttctcccaattttcctttagttttctccgggttttccttctctttccgtcgttccttggccaacaaatcggccaatgtctcatgcttttcctcgcttattaaatctcccaaatttttctttttttgcttttcctctgcttgtaaattctccgctttatctttgccttccttggtcatcagttggcccaatgtttctccccgtttcttcgcttctacggatttccccgtttttgtcccatcgacgaaaaattggtgcttcaaaaacagcagaaagagaataaaagcaaaaaagtaagtcaaaatagaatttttcatctatatacatattaaaattcaaattatataatttatgtgataaaaaaagtgagaagtgcttcgtttaaatcctggccatgcttttgtcattgccagccaataggcattaatttacagtatgtaattcaatttaagattttttacatcagagtaattaaatgaaaaactgtatttttaccataattttttctttacttccttttagttgtcggaataaataaataaataatgaatattgagtttttacgtggtgagctgaagcgaaaaaagtatgcgtgtggcgaagcgaaaaaagtatgagtgcggggtgatcggaagaggcgggtcatttcagtacggaataaatgattttaattaattaataatataatattttaatcaattaattagatttgctgaccataattataatttcgatttattattttaatatttcacaaacaaattacatttttatgaattgaaatataatcccccagaaaagttttgactcagacctgaaaaactatcttatagttcatttaaaaacttgaaataattcatgtttgcataacttttggtgctgatcnaaaaagtctcttacaccaacttgatcagatcactccttccttgtgaccgtgacacccaaaataaactgaaaattggggaaattttcatccctaanngggctggaaattttttctagagaaaatgggcaagcccactggaaacgagcaaaaatttgctaccgaattgctttt

SEQ ID NO: 23089 - DNA, 118 bp, Heterodera glycines
ataccatgaatgcttaatttggatgcttctagaaaaagatatggtgcataaatttgtcaaattattctatggtcgtgtctttttttatggtcgtgtaaactgaaatagagcccaaata

SEQ ID NO: 23090 - DNA, 1192 bp, Heterodera glycines
atgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttaaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttataaaatattcctttctggacttaacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaa

SEQ ID NO: 23091 - DNA, 1298 bp, Heterodera glycines
attaaaaatttttagattttttattcatctccctttttgatattgaaagcatctgagtgcctaaaataacttgtaaataaaatttgatgcgtttcagagcagtttctgaaaaaatatttatgaattaattttgctaaaaaaataaaatagtgaagctttaaaaattaataaaaaattttaaattcagaattactggagttagcatcatagcagtgcttttccttgtctttttgatgctctcgcaaaatctggttcgcttctgatcagtttataaaaaaaaagttaagcctaaaatttttcgcaaatttaaaaagcaattaaaaatttttagattttttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcagtttctgaaaaaatatttatgaattgattttgctaaaaaaataaaatagtgaagctttaaaaattaataaaaaattttaaattcagaattactggagttagcatcatagcagtgcttttccttgtctttttgatgctctcgcaaaatctggttcgcttctgaccagtttataaaaaaaaagttaagcctaaaatttttcgcatattaaaaag

SEQ ID NO: 23092 - DNA, 1168 bp, Heterodera glycines
  misc_feature (123)..(123): n is a, c, g, or t
  misc_feature (162)..(162): n is a, c, g, or t
  misc_feature (178)..(178): n is a, c, g, or t
  misc_feature (1107)..(1107): n is a, c, g, or t
  misc_feature (1117)..(1117): n is a, c, g, or t
  misc_feature (1136)..(1136): n is a, c, g, or t
  misc_feature (1139)..(1140): n is a, c, g, or t
atttacataaaaatgctgcaaagtgattataatgtttattatttaatatattttaataaataaaatgattttacaatttgcttgcttctttctttgcttctttcttatgcaatttgtggaaanaatggtaatatttaaatttaaaaattgtttattattctntaaaaacaaataaatntagacaaaaagaagacgaaaaattctgtcccaacaatgacaaaagcttttcgaatgttaacaaaaattttagctgcggtaatttattttatttaagattaatttacattttttttttgcattttagcaaagtgtcattggcttggctaatggttcttctcccccttggcaacctcctacaaatgatgcagaacaaaaagcgtattacaatcctgtagaccaaataatgagtaaacgtaaattttctttgaaaaaattctcaaaaatgagtttttatatttataagacaaaatatatttgctgaaatcataattgatggaaaagtacaaaatttttttattaatatgaaaaaaagggcgaagaaatttttgcgggtttttaacaaaattaccaattttgagaaaattcttttaaattgtttttttaattttccaatcacaataatattctgttcaccatgaaaaaatagtaaaagaaatattatttttttatttgtattttttcataataactttgacaaagaaagaaataattttttggtaaatttaaagctccatctcaatcagccgatattgtttctgattatgcaccggtggtttcaaacccaccaatacacaataacaaaaacaattgaaagaaaaattggaattggatgctgctcttcaattttctgttattttagtatttctgatggcggaataattgttaaaatttttgcacgttgtcaaaatatacatttatcaattagcttaaagcaaaaataaataacgtggaatttaattagttttatttacggaaaatcacttaagaatggacgaatttgaagcaagaaaattcccaaaatcagatccaggtattcaaatttgggcgcttaacataaaagtgcaaaaatcaaaaattggatttttactgtgatttttttattaattntttattcatnaatatgtcaagattaattnaanntatttttatactcattcttctcctaatt

SEQ ID NO: 23093 - DNA, 1022 bp, Heterodera glycines
  misc_feature (29)..(29): n is a, c, g, or t
  misc_feature (56)..(56): n is a, c, g, or t
  misc_feature (60)..(60): n is a, c, g, or t
aaaaaaaaaaataaaaatacccaaaaganaaggcatgtgccagccacttacacttntgcnggaaatgagtgaaatggaaagtagtgataaaagataattgaaattttgaatggaaaagcagaaattagaaaagtcagacctccaaaaaagggaaaattgttgtttttttaggggttttagaagaggaaaaaaatttttttattttttttgagtaaaatttttagagaaagtttgagggatattttatttgaagaaattgttggaggtctggtagaactatttgttgaaaagatgagggtattgttttttgagcgattgaatttggtgaacaattttgtcggtgggtggaaatgagtttagtgcttcataacagacgaggattgtttggtcaaaaacctccggcggtttggaaatgtcgtcgctggcctccttctggttaggtccatcttcgacaacgggggtcggggcatttgtctgtgagcttgccggtgccattggagttggtgtctgttgacgttttcggaggcgctcttcgtattccttcttgagttgttctttggtcagcgcagggcggacgaacagacgggccatgttctgttgagaacggagtcgagcacgctcgcgcttccatcccccgagtgccacgcgttgatgtgtagctgttggcatgaccaccttgagcggacgaggtgttgttcgctgggggtcgaaccggccaagtcgaaagacggcggttggttcggcctcaacttcaagatggtccaagattttggtagtggcttccctgtcttcctgaacgcgctccgatgggcgaacggcattgctttccgggaggccaatgaagaccaatgtgcgttggcgttcttgctctgcgagtgcgacagtgtttgggtccaggtccagtgggggtgccattgaacgttttgcgcgaggcggagtgatgtttgatgcgttggttcgcttcatgtcgaataattagcaagaaataattgttttttgcgatcttaaggactacagaagag

SEQ ID NO: 23094 - DNA, 773 bp, Heterodera glycines
ctccatcactgttctctctctacctctgatcactttcctctccctagctgtcctctctctacctctgatcactttcccctctatcactgtccttctctctctacctctgatcactcactgtcgtcttctctctccctttccctctaatcactcccctccatcactgtccttctctctctacctctgatcactttcccctccatcactgtccttctctctctacctctgatcactttcccctccatcactgtccttctctctctacctctgatcactttcccctccatcactgtccttctctctctacctctgatcactcactgtcactcttctctctccctctacctctaatcactcccctccatcactgtcctctctctacctctgatcactcactgtcgtcttctctctccctttacctctaatcactcccctccatcactgtcctctctctacctctgatcactcactgtcatcacttctctctccctttccctctaatcactcccctccatcactgtccttctctctctacctctgatcactttcccctccatcactgtccttctctctctacctctgatcactttcccctccatcactgtccttctctctctacctctgatcactttcccctccatcactgttcttctctctctacctctgatcactttcccctccgtcactgttcttctctctctacctctgatcactttccccttcatcactgttcttctctcactacctctgatcactttctcctccatcactgt

SEQ ID NO: 23095 - DNA, 1567 bp, Heterodera glycines
  misc_feature (1545)..(1546): n is a, c, g, or t
gatccctttcccctccatcactgtccttctctctctacctctgctgttcctttccccttcatcactccttttctctccccctcccctttcagttgtctctctccccaaatgagtctctctccctccgatggcgtcgtgtcgcctttctctccttcgcttttgtcattttcgtcgtcggtgttcccatttggtggctgaccacaacgccttaccgggcttcgcttgctgtgctcgacccaactgagtacgaaacggcgctggaaaaggtgaccaatccgacgaagaaagcaatcgatagaaatccaccagcagaggaaaaaaaacaaattggaaagggtaggcgaaaaaaccgaaccaaagtctgaaatggtcgaattaattggattgattgtgcaaggggggggggcgaccatccgcccgagggaatgcatttaattggataaaaccccgaggaaaaaaggagggcaaattaagtgggggcaaaaggcgtttaagtaaaaaggaccatggtaatgcctttggataattttagacttttgatttgcttttagcattttcccgccccctctttggctgagaatggcggcgacgtttggcactctcttcggcctcagtccgaatattcagtccatttcgtttttgtccatcagaaagcgactcgaaattccattgaattttcacgctcaatcgaacggaaattgggcaattttgcgcaggaacatttaaagggaattggcatcgaaggtgccgacagtccgtccccttctcttttgaccccccccccttaagttctgctcagtgccgaacatttgttcgacttttccctctctcccttcgtttcctcctcccccctccgtccgttgcccatcgattcgtccgatcaacaattgcccgcctctctttgctccgaattggaccgtctgatgggttcggctccgctcggtaaagagtcgctgctcaaattggccgtctttttgccccaatttgacggacggacgcaaacggaaattcgactaacacaaaacggcgtaattcttcgaagattattgtgtgtgacagtttctgatcagtgacgtctttccctccctaatcacttgcatagtatccatttctgatcagtgccatctttcattcactgctgatccgtgccatttctcctcagttgcccaccgttggtttggctgtcgcctcatggggtggccttttcattccgccacaatctgtcaacggaaatgccgactacgccgctcttctcaatgccattttgtccgttttgcacctccaatttgccattgtccgtcctcctcctaaggaaggagaagaaacggcacagcaaatgctcaacaaaacatttattggacacaaaaagcgattagtcgtcgagaatttggtgcaaactctgcgcactttgaacgctcttcacaaatgcgagttttagcgggggcggagggattaataattagggatttactaatgactcaaaagtcttatccgccctccaattcagtggccgaaaaccaggtaaggtttggtaattcccgacgnnaagtagcgcgtctttcaatgg

SEQ ID NO: 23096 - DNA, 1778 bp, Heterodera glycines
tctaagaacttgagcaagagaaatttggtgtaaaaaaaattgaaaattggttcaaataagaattgatgaaaaaaataattattaaatattacttcaaaaatgcattgaaatatgaagataaaagaactatttgaaaaaataaggttgaaatttatacagaaggtttcaatttatcaaattaaattaaataatcaaagtttgacaaaatacaggaatttgacattccttcactaaaacttgaagttgtttcttgagttattataacaattaaagttattttttatattattttttcttgctttgcatatattaacaaaatataatcgatttcttttttaaaaaatttttaataaatatttttgaatctttaaatacaattaaaaataataaataaccagataaatgatccgaaacataaatcggtatcgcgacgaagaaaatcttggatatgaatagataaattaaatttaatcatcttaaaataaaaacacaaattttttacgtttgaaaattagaacatgaacaatgaaattaatttaaaaaattttttttttatatgcagattttatttaattgaatttatctagcatcaataaatttaatacacatttactgaatgaaaaaatataaaaacaaaatcttcttttcacatatcacttaaatttaaaatagtttatggatttattaaaatacgataataattgaaaaattaaatcaaaaatcaaattgcttaaatcaagtattaaaccatccaaatggcgcggcgcaagatgcaatgcaaactattaattaaaattttattttttcctaacaattataattattgtcatctaattaatttttcaaaattttatgaatgaaattattattagaaataattaaaataagcgtatgaaagcaaaaaaatataataatctattcaattaatatgaaatttctattagtctaatatgaaaagttaattacaaatggaaaagctatgaaacttattagattaatttgctaatttactaatttcaataaaatttgaaggtaaagatcaaaaattgatttttgcttgatttattcaaacatcatttgtaatttttgctgtttaatgtaattcggctattttaaacaataatggactatatttacatttaaaaagaaaacacatctgatcctctgctattaaaaatcattttcaaaaaaaaaattatataaaaaattaactttgaaaaaaattaaaaatgatcttttaatgtttttctttctaattaaatattatcaatgtaattctatacaaaaagccatttggggttgaagatacaaatttttcagtatcttttaaactacaaatgcatctattaataatttattttatacaattaatatttattttttttaatatttcattaatttttagtttatttttttaatagtaatcccaaaaatcagcatttttattgaaaatctgttaacaaattgcacttaaatttgtcgactagggcggtggtattcccacgaagaaaaaaattctgggaccgtcatctcgcggtcttggtcagtagaatatattcatacataaattatcgattttttgccaatcaagtcaatcgatctgattggcaaaccagaagatgtgggttttgtccaaaagcctattgctacatgcgggtgccgtgcctcacacgctgactccgccccctttatcatgatgcaatcaactgactccgcccccttagcataacccaatcaactgtctccacctcatgacgtcattagctgacccccccccc

SEQ ID NO: 23097 - DNA, 1215 bp, Heterodera glycines
tttcttttagacaattcctacgcccaaatggtcgcgtgtatgcgcgcgttggcccgtcgccacccaaaactcgtccagttcattaccatcggcaaaacgcacgaaggccgcagcatcgacggcttagaggtgcagaccaagccaaatttacgatcatagaaatccacttccttaaatgtcgtcccgttgagttacatagatcggcagtcgcggctttcggaaacgcgccttttggatcgacggaggcattcacgcgagagaagtgccaaagggtggggggaatcgaaggggtcgagggcaaacaatggaggaccactgaccgaagggcgggggcgggggcgacggaggcgtggacaatgccaatgccatcgtttctcactcattcggctcatttgtcgccctttcatttgccttttcagtgggctgctcctcacactgcgctttatttcatccatttggtgaaccaatgaaaaaagcaattaaaattgcttccttttgaatttccaaattcctttcagctcacttcccgctacggaaaagatgcggaaatcactcgccttttggatgagttgacttgggtcgttgtgcctctgctgaaccccgacggttctccccacttttggcatttgcctaattcactttggcactttgtcccctttcttttcgcccaggctacgaattcacgcgttcttccactcatccaaatgtaattgcctatttgagcaataattgctcatttctccacttttctgtttttaggtccgtctttggcgcaaaaatcgttctccgacgcattgtgtgcgtgaccaatggggccgaaatcggtgctgcaagggcgtagacttgaacaggaatttcgatttccatttcaaaggtgttttggtggttttcccaactccaacgatattttcggttttcagagagtggctcaagtgacgacccatgctccgaaatttaccaaggcatttccgcattttcggagcccgagtcaaggccaacgcatttccaactttatttttcattttattactcatttcccaattcaatgatcaatttaatttccctttttccttccgcattttctctgctcagttcgccgtttgtttcagatcagttcgcgacgcggtgctgtccaaccgttaccgcggccgcatcgacggcttcatcactttgcacacgtactcccaaatttggatccatccctacggacacaaa

SEQ ID NO: 23098 - DNA, 1034 bp, Heterodera glycines
gcaatacagaccagcagcgacggacggcccaaataattcggaaccgatgaaaatggaacaaaaaatgcattcattgccaagggagggccagcggaacgcggaaagtggagaattcaattgcaaagacagacatcgctcgtgcaaaagtgggcgaatcggaaaaagcaattaaagggtcaaatgataatgtcttgttgaaaaagcgtttcattttcactttctttcgtcctttttgctcatcccttcgttaagggtgggtgttggaaggagaatcgctctgtcagactgtgcccgttttcatgggcgatcagtgcgctttttcctgcgggttttgctgatcgactgatcgacgctccgattagcgatgctttaccccgtcccttgcacaatcccccgactttatctgctgttttcaaaataaatatgcattaatccgctctctctcaacacattttatttatctgtgtctctttaatccgtcagtttcccttagcattaaattaaaatttaaaaagtttttattacattcatacacatttcacacaacattcgttctttgatgaattaaatttggctgagttttggtccattttaagtggcgaatgaattgaattcccttttcgtttctttccttttttgtgttgtgcgtattctttggtctttgtacgcatttcatttgattctttttgtttacagtaaatgtttagtaatcaaattgtcaaaacaaaaatgattaatcaacaaaaaattatgagatggataatggaaaattttggcagagttattatgaattttaaattaataattgtataaattaataaaataattattagacgattaggtaattagttaaatgatcatttttctgtcggctcctcgtgtgtaattaatatgtatgtaattagttaattcttcagacgttcttttgcctattagtcattcgcaaagaaaggaaatgttcactctttcgttgtttggtttcgtttcgttttgtgctcgttttatttgtcatatggtgtggttagtaatttgcg

SEQ ID NO: 23099 - DNA, 1327 bp, Heterodera glycines
ctgtcccgcctcacggtggggacttaaaaacatggttaagctttgttcgaaacttcagaggagaattttaagttttgaatttttacaatttaatttcttagagtcaaaaaatttcggaaccaattttttaaacgaaacagtgcacaaaaagagagggagggtagaagacgagagtaattttttgaaaggatcgcaccccatcgaatatttccttatttcttttacataactgtccaaaggtgactgctgtaattggctcttctgtagtccttaaggtacttggactttccacagtaaaatgtggtacaaattttggaactgtcccgcctcacggtgggacttaaaagcaggatagagccaagtttaaaacttcagaggagaatttaagttttgaatttttacaatttaatttcttagagtcaaaaaatttcggaaccaattttttaaacgaaacagtgcacaaaaagagagggagggttagacgaaaagagaaatttttaggaagggacgcaccccatctgatattcacccttttctgttccataagaggccagaggcgactgtgttcgttgacaagtaattgtccaattaaggtacttggacattccacagtaaaatgtggtacaaatttttgaactgtccctcctcacggtgggacttaaaaacattgaaaagccaagttcaaaacttcagaggagaatttaagttttgaatttttacaatttaatttcttagagtcaaaaaatttcggaaccaatttttaaaacgaaacagtgcacaaaaagagagggagggttagacgaaaagagaaatttttaggaagggacgcaccccatctgataattccccttttctgttccataagaggccagaggcgactgtgttcgttgacaagtaattgtccaattaaggtacttggactttccacagttaaatgtggtacaaatttttgaactgtcccgcctcacggtgggacttaaaaacatggttaagccaagttcgaaacttcagaggagaattttaagttttgaatttttacaatttaatttcttagagtcaaaaaatttcggaaccaatttttaaaacgaaacagtgcacaaaaagagagggagggttagacgaaaagagaaatttttaggaagggacgcaccccatctgataattccccttttctgttccataagaggccagaggcgactgtgttcgttgacaagtaattgtccaattaaggtacttggactttccacagtaaaatgtggtacaaatttttgaactgtccctcctcacggtgggacttaaaaactttgaaaagcctaagttcaaaact

SEQ ID NO: 23100 - DNA, 2119 bp, Heterodera glycines
aattttttaaatattttgaacacctaatttttaagttttttttgtgcatatttggtgaaccctattttgcgattttcatgcatatttggcgcatatttggcaattttatttgcatatttagatgcatattttggtcatttttcgtgcatattttttgcagccctgttcattaataacatgacaataaaatttggtgcgtttcaggcactttttcaaaaaatattttatgaattaatgttgcaaaaaaatattggaaactcagaatttcgaacaaattttttcaatcaatatgcgttgaaatattttcaggataagttagttctgtaccggggagtatatctgtaaaatttagtgcgatttttctaattataaaaagttaagttcgataaaaccgtaccagctgttttcgacagtgattggtttcgacagtactttttaattgattttctacttgatttattgtacatatgaattactattaatatacaatttgcatatacaaaatttagaattgagtaagtggtaataataaagatgcgtatgattatttttattaaaaaatcttatatacgattctcgaatcgtgtgggaaaatatgctaacaaatgctggcgttgagtgccaagatgcaaatatctacaagctctttcttatagcagaattcgaaaatcgcaaaccccgctgcaatgtaaagagcctgtccttatgattttaatttttcaaaatttatcgaaactttaccatatagagcaagtttttaaaaacaaactttactgtcgagatcaccactgtcgaaaactaacagcaccgatggaacgacgagttgtcgaccctacactggacaacactgaactggccgctctcaacagctaaaattgctcaatttccagaaaaataattaaaattttaaaaaaaaaaagaaaaaaaatgccaccagggtgggcacaaaataagaatcattttttattcgtaaaataattgaaggaaaaatggcgggaaaaaaaattcttctactttcttagaacaattcttctccaaattgtttcttccattttgaaattgtcgttctatcaattttcaatatttttgcaatttctttgtcactcattttcggattttctctttttattttccagtaaattttcattttttccaatttttccttctgcgttataaatttactcattccaaattgtttcttccatttgataattgtccctttgcttactccaattttcttacaaatttccgcataattttggtgccattcttttgctgaatattttcttttttgcttatattcattttttattccaataaatttttgtacaatttctaatttttcttcatcagttgttgatttatagcttttctgtattcgttgattaagtcctaattctttaatccattgattagttttatttcgatttgtccccaattttttcgctatttttgagttaattttattccattcttttgctgtgtattttcttcccttttgcttgattttttcttttattttataatattttccaattatttctcttttttcttccaatttttcttcttctttttcttcccatttttctccaaatatttcgtcaaatgacttttgttgttgcaattttttattttcggattcactttgatttaattggaaaattgaaaataaaagaaaatataataataatattttcatttatcaaaaattctcaaaattatttttaaaaaatacaaaattctttcttttgattattgatggccatttatttatacatttatttattcataaatgaaataaaattaccataaaaacaatttttcaaataaaataaactacaaaatattaaaaaatattcatctgatctctccggaaaaaaaattaattttaaacagaaaattgtattttgttatttggtattttttttattcaaatgacgcaataataaagtattaaaaattttaatattgtgcctcaatcaaaatcttaaaaacaaaatccaagtcattgtcgttacatcatatttttttaggtgttttttctcgaaaaatataataggaaaataattttataaaaaattggaaatttatgcagaaataagtcaaaaatggaaaattt

SEQ ID NO: 23101 - DNA, 1652 bp, Heterodera glycines
  misc_feature (66)..(66): n is a, c, g, or t
gcatcacaacacacaaaacagatcatatctttattatcctaatttccaattctaatcattacaatnttgtttgtttattttcatttttatgacagaaataatttaattttttgtagttccatagttttgttccgtcccagtcttattgttagaagagcaatttatacattctgctgtagcaaataaaaacatttttcatgtttctttctttttttgtctatccattaaaatttcttttgaaatgttgtaaataaaaacatggtaaatgcggcgacgtgcgttgtttctttcatttttatgtttttaaatagaaattatttctttaagaaaattctctaattattacactttattaaaatttcgaatatcgcattccttcctatacagggtctccaataaaattttttaagttcaaatctataaagaatgaatatttctttagcatgactgatttttgctttatttaattaggacaatgcgaaatttgttagatttcgaatccggatttgaaatgtccaaaatgaatgccatcttcatgtcagcgatccagaaaacccccggaaaaataatgacttattttgtaaaaaatgggcggcaccgaccaaagcattccccgaagtgtcccggtcccataggaggggaaagaatttttttttacataatacgctcgctacgcatgagaattttgaaaatttttataatatggcatcgttgatgttggaaagtaaaacaatttctcagaatgtcaacaaatgcattttaccgaaatgaatttggataaaaagcataggaaaaaagtggaaacaccaccattgttcttcattcttcttcagggcggccaagtgtccttatttgtaagatttgtccttattttggcacgacctccttgctttgtgcttattcatggatttgaaaataaaaatgcaaaaatttaatattttttacttattgttttttattgaagcgaatatttgaattaattcctttttgtaaaaaatttcatttttatttttctttagtgtaaattcgttaattttaaatgcccaaaatgcccccaaaacgtaaaaataatctcttttaaaatggtcaaaatttttatttttcctccgacggcgcctatcggcaccgtcgggccccaaaaacttattttttcataaaaatgggctcaaaatctcaaaattggtcatttttttggtgaaattctgttaacaaatttcattttaatttgaaaaaaaaaatttcaaaaattttcccggcggcgcctatcggcaccgtctggtcccccaattcccaaaagttttttggaaaaagcacgcagcaaaaacattattaatttttcaaattttgaataaaatttttcaaaatgctgatttacaagattttcagttgacagggcttcgtttttatgctattaaaattttgatttaagtacctatattacatgtcttaattgcgattacatcatgctactatcacctatacaaaaaatcttattcttgggctactaagcttaattttatcctcatctgtccctattatcacaagaaaaacttggtcgccttgataaagactgaaataacatttctctcgcaaagcagagcctgattaatactccccgatatgatctaggggtttgttatctagcaaaaatg

SEQ ID NO: 23102 - DNA, 1333 bp, Heterodera glycines
tcacaacacttttattcaattaaattgaatattgttatttatacacattctatttaaaacgatgggccagttaatttgtgaatttttgttactgtaattcgataaaaactgataaaaatgttggaaaacaaacacgaaccaaaaatttgatttttttttccttggagatgcctaaaaacaacccaagatacaacaagaccaagatctctggaaatgcataaaatttttaccatgacggttatttttgtcaaattccgtgttctccgtccattttctgttgcacagggaacacaatttgctgcattttcctgttgcggcataattgctgctgctgatcactaagggcaaccaattatatccgtcaaaatttgcaaaataagcgcataaaattgtgcaaaatatgttcataattttttccaaattaagggtaacatttctcaaaagttcgtcaaatttaagctaaaaatctcgaaaatagctaaatatggtgtgaaccgattcacaagaattggaacaaattaccaattgttccaattcaggcagataaggcaaatcaattcagggcattgctaaaagctatgtatgagttctaagggatttattgacatttgcattgacattcattccattttattttattttactttacatttcatattgttgtattttttgacattatttattttgattttttttttatgcgccacataagagcactaatgtgcctgtggtttgctcaataaatataattttgggcgtgtatgtgtacttttgtaccagggatgggccaaatcgaaaaataaaatgcgaaatgaaagtaaatagaaacgcaaaattgtgaaaatttttctacaactttttaatagtaaaaaattagggttgagtccgacccctcggggggggggggggacaaatgccggaggtcgggtttaaccctaataaaaattataagcaaaaatcagcatgaaaaagctggacctagaagcctggaaaacaaaagacatgaatggaaaaagaaaaacaaataagttaaataattaaacaattaccaagtttattcataccatcattaattgacttcgtaatggaaaaacccgtgactaattgatcccactaattgaccgtccacttgcaatctctgctttgtatcgccagttagcatcaaaaattgagcaaaaaatggccctaattactctttttaatataaaaatgtgatttttgtttagacaccattaaggaaatttttgaaatttaaatacatttttaaggaaaaaatcagaaaaatttctgaaattgagaagtccaaatttaaaaagaaaattaaaattatatt

SEQ ID NO: 23103 - DNA, 1606 bp, Heterodera glycines
agatttgtgtgccgtgttggaagagcgctgacggcagacaatcgcaatgtggccttgccggttgcatttgttgcaaaatgcgttagaaaatttgcagtccgatcgccagtgatcggtgcttccacaggatgcacatgggtgcggtggatggcctcggtttgctttgttgtctgatttttgcttaggcgaaggcacatgatgcggcgatttgggtgccggttcatgttgtggccatttgggtgccggttttgccttgtgtttgcctttgctggtctcttgccattgctgaggtcgcaattggatggcgctggttgagaccggttgagtgagcagagaaagagcactttccttgacgatttgaatcgccttcaattcctcttcgactttttggagagtgatgtccgtgccggtcttttctgcgtcctccagcattttgagacacttttgcctcaggtcgtggtgctcgtcgttgagtgcaatgaccaggatatgcactttagctgttctttggtcggactcaaattggcgttttcgcaggacgcattgatatgagcgaccagcgatgagatgtcctggctcggttgctgacgaattttgaaacattcgtagcgccggacaaatagtgaacgcgtttcggcatataatcctttcagcttggtgatcgagtccacccaagtgactttgtcgggctgggtcggactgatgctgtcgcggtatttgccgtactcatcgtcgccgagtttgccgaggagtagtctgacttttgttgactcggggaggtccttaccatcttcctcaatcaaaactccaaaccgtttgaaccactgttcgaaagtgttaccggtttcggcgtcgtaattgaattttgaaattcggccgtcgatggaacttgccaaatttgcctggttcagactcgctgacgcggcgttttgcggtgcttggcccattagctgttggatggcatccgattgcacacgcatggcctcaaggaattgcttaatttggtccgcgctcatgccgaaatgtttgccggtgccgaatttgagagtccaaagttgaaaaaccgcttattgcggaaccgcaacctttcttaggtctgttggtttttcggcgaattaactgcaatatatgcagacctcacccgcctagggactattatttttgtggtgtgcagtccgtcttgttggttgaagacgactgctgactgcgccaaatttgttgtgtattgtccgagtgaataaaaccaacaaatatttatttaccaagagacaataataataaaattataaaaaatggcgaatggtcggtggagagaataatgaatgaaaataataaagtgaagaaagaagaagtgaacatcggggaagagtccacgcctttaaatagacaatgtgagggggaaggaacggacgagagaatggacaaatgtaaagatcaataatcgatgattaaacatgagcaaactacatttgctttttctccaacagaaatgaataaatttgtcaattaaatcgttatataaactacaatgaaaaaaactaaattttatacgatatttgaaataattgaagtactaattaaaataaaataaaaaaaatgaaacaaa

SEQ ID NO: 23104 - DNA, 1068 bp, Heterodera glycines
  misc_feature (14)..(14): n is a, c, g, or t
ttgacggattaacncgggggattatggcttttaatcctaatttttagaactaatttgcataaaatgtttacgccgaatggaaatttttttagttattcaattggtacatagcatgacagagtgtgaacaaaaatctgtatttggaactgaaattgatttttaacctacaacccctaagtatgttctttaaaaaaatttggtgtccaatatttcgctgtcgaatttcccactgctggtgtcaaccagcgtagtccaattttcatgcccctattccataaaaatgtataaagcatcagaccatttcttccattttgtttaccaaccgctgcttttttcattgtcatttattaacacattagccattaactaattgcatccaaaattagaagcatgctttttggctctattaatacttcttatttttctttgaactcgctaatgaaatcggatcaattcttggtgtgacattatgagattttataaaagcagttttctccacaatattgtataaaatctagaaacactcatttttgtacgttttacgtgtaaggatatttcgtctacaggatatctcgattactgggcgtttcgccttcaaaccaggggtggagcacggatagtaaaatcctgcgtcgcggaacgcgccaggcgaaatgtcggaaaatattgatcatagtccccaaactcaaaaaatgcttaattatttatgtaggagcactgatctattgatagttgtgagcagttactacttagtaattgtggatgagcgctgtggcgatggcgcgtacggcgatgtgtgcctgtctcagctgcatatcatcgcttgttcccatattgatttgcttttgctgctgggcatacatagcattatacccgtagtatattctaaatatacacacagctttttacgacgacgaaacgcagcggtggccagcagcggggcggacgtgcggcaaaacgagcgcaggagaacgagcaacacaggcgtcgatttcaccaatccaacaagggtccaattaacacaacaactcgggcgagcgttagcgccgcgagcgggggggggggggg

SEQ ID NO: 23105 - DNA, 1495 bp, Heterodera glycines
  misc_feature (88)..(88): n is a, c, g, or t
  misc_feature (99)..(99): n is a, c, g, or t
  misc_feature (156)..(156): n is a, c, g, or t
  misc_feature (1485)..(1485): n is a, c, g, or t
tgagtaagaaatatttaataaataaaacaaatatttcaagaaaaacataaaaaaaattaattctaaatacattactaaattatatttntaaggctgatntagcggaacatgaagtcatttacaaacatttttgtgggcaaaagaaaaaaatttccnaatgaatccgacgggtaaatcataataataataataataatgatgttgaaagctcttcgagagggaaagcagcatgttgcaccgcattacgagcacaaattcgaaatgaaaagaaaagtaaattttcgatttataaaaattttatttaaataaataaaatattttttaaaattatttttaaggcattagcaatggacatcaaaaagtgccaatgaagagtaacaatgcaagcaaaaatttaccacaacttccagttgcttgcaaacgataccgtaatgaattgttgaaactgatccattcctactgtaaacatacgcaaaaaatatacggtaaattaaattttttaataaattaactctattttttttagcttccaataatgccatcaaaaaaggcactcgtcgtattgaacacaaaattgtaaacattgagcagcaacaaaacagtcgcacatcaaaccagcacaaaaattcaaacagtaaactgttttgttactataaatatgcaaaaaaaaacaaaaaaaactttcctatgtcatgaaaaggatttttagtgcctgcaatttcagtccccgacttttggcgcttttccggtgacggactctaatgtccggcgcttggatttaaacatgattgaaatccctccatttttagtctaagattttgtaaaaaattcggcatttagggacaataaacgggtttttatgccatatctttaaatattattttccaaatttagaaatgccgactcgcccaaaacccgaagtgaacatcaattctcttcagccataaacggtggtgccacgctggataaatcaaaagcggacggaaatgacgaaaaggctaactaaatttaatcggaatgagggattgtgttttgaatttgttatgatgacaatgattgtggcattttcagtgttcattaactttatttttcatttttatttttaaaccatatttaaatttgaattagcgtatcaaaattgtggcacaaatcaatgagcgtctatttatatacctaatccaccatagcttttccattaatcagaattttttaaatttgtttttactgatgcccataaataatctgtgatacgacgcgctttcacatttaacctatttacaagttcaatattattaggaagattcattttgcaatttttatttatttttttatttaaaaatatcaattttattttaccattaatgtgagttaaaatttagtacatacataattaatcaatttaaaataaaaattatgagaaggaaaaactatgaataaaattagaaatttttaaattaaaaatttatttacatttttctcgaaatnttttccatat

SEQ ID NO: 23106 - DNA, 1493 bp, Heterodera glycines
tatgttagatccacaggaaattttgcatatcgttagagaaaaaaattctgcatcgattaatgctgaatttatttttgttaatgctctatttcaaaagttataagaaaaacaaaattttaaagcctcataaattttctctggtacaccaaatcgcttagcatttgcttagaaaaagcttctcattatcaagagctttcgaaagataccaagattatccaatttggttggcaaaaaccttcaaaaataattcccaaatatcgtgattttttaatattttggacaaaaataaatgaaaatattcatgttacacaacggactcgaaccaccaccctttgtccctttactatcttacaaaaaccactgagccacacatgcaaatcttttctggtacaggagctcatttcccgggcccgtgccaaaagaatgaggtaggggttaacctaccctcagctgcgggtagacctacccgttacccgcactaaaagaactacccttagttgagggtaacttaacccggttaacttaccctcagctgcgggtaacttttctaccctgacccataccagggtaacaatatgagcatgttttttaaaaaattccgaaaaaatttaaaaagatgacattaaaaaatttccttttgctaaattgtactaaaaagtctgctctatccaatgatataattttggttaaaaaattttttggatttcactgagctagagtatcgtcaaaaattttgtaaatttttactaatttttttgttggtttcttgtctattttacttttaccggttcaaaattatgattattcgattctagacaaagttattctccttttttgaaaaaatattcgccctttggaacatgaaatacacacaaaaattcactatgtttaacgtttaataactttctttataagtaatataattaaacaacttagtataattcgatagctctctaagtttcctcactaattctataaaatttcatagaatttaattaagtattgaaagagttctgattagaaaagtcaaacatctctttttgtaaggcaatttcctggtctacgccacgggttttcactattgcaccaatttcgaaccccggacccgaattcgaacaaaaagtcgaaaattttctaaattctcactttggttcctaaattgaccaaaaaatctaaatttggtcataaaccattgcaacaccaaaacatgatccttcggtgtgtggacatttcgccaactgacacttagccaactgacatctcgccaactaagccaaattcggacgtttcgccaactcacccaaaaaatgacatttcgccaactaagccaaattcggacgtttcgccaactaagataaattcgtacgtttcgccaactgacattttgccacgccaaatagccataatattaacatatgagaaaaaaaataaacgaaactgtttctttttcatcaaacatatcattccctgtcacttccttttttgtgttaaag

SEQ ID NO: 23107 - DNA, 1226 bp, Heterodera glycines
cttgttaagcaatgccgagattgatgcatgagatctgctcattgagactgatcaattggacaagctgctcgagctggtcaaggagcccaaatttgcggacatggattacggacgcatttgcctctatctgctgaggtttgtttttttggggctggtacaacaggtcgaatatgttcagagtcttacaatccgggccgaattccgggttagaactcccgttttcaccccaactcgtattattaatgtttttcgaaaaataccgggtcccagggttccgtaaaaatgctgacaaagtctacgggtctcattttcttggccagtcactctctttttttttggctattttattattcgccccaaaatttcctatttatttctttattttttcagttgcgtgccgttcatgcccgacccggagaacaccaagctgatcaaagtggccaaggagttgtacttgaactacgggaagcaaattgaggcacttcgttgtgccatgaaaatgaacgacgtcggcgctgtcagtgccatttttggagaatgcaaggatcggtgcgtgtggttttttcttttatgccctctctttttttcgctttggccttacatttttgaacgtttaaaatcattatggtaatttgttcgaaaagaaggtcgggtggcgcgtgtcgatgaatgggtgttaatggagtaggaaatttttttttaatttgaaaaaaatacaatttttttgttggaattcaatgaattttttttaagtaaagccttggttttgaaaaaaactaaatgttttaaaagtttttcttaaatttttattttttatttacggcaaagttttgggctgtatcggagtgttgatacctgatcctcgggactatccaatttctatttatattttcagtaccctcaaaatgcaaatggccatgatgctcggacggcaacaaattttcctcgagctgccggatggtgaagacggtctgctgggggagctgaacgcgaactcgcacctgcacaaacacttcctggcgttggcccgcgagttggacataatgacgcccaaatcgccggacgatgtgtacaaaatgcacttggagcaggcgcgtccgttcacgcaccaggtgggcaccacagcacgggtatactcatccatttttaacacattttatgaaaatttatattgagtttttcttcccgattcgaaaaaattaaaaaaggaatgtatgtatgtatat

SEQ ID NO: 23108 - DNA, 885 bp, Heterodera glycines
tgtacatattttaacaaattgaagaaagttgcactatgaaatattgtaaaaaaaacacaacaaataaccataaaattgcaactaattacttccttatttttgagaaaaaagcaattttagaaattgtaaattcaaaaataattataaattaaaaaaaaaaaagttttataaatattcaaagttcaaaacaaaataaccaactgcgacttatttgttaggtatgtatttttgttattttctttgaacttgcaaacaaaaagaaaaaaattctttttactttcgcaacataacgccaagtaaaaaaattcgccgtttaaattttaaatggctattttgcatttggtcactttttgctgcgctgctgctgctaaagcaacttccttccctcctttgctttgctgctgcaaattctcgacacattttagcgcccggcagggagaaaccgcaattttggggtattattcggtgattttgtttacagtatgtttggtgaggagaagagagggaaaggagggcacatcatggaaacggaaaatgggggagagaatttggggatcgaaaattggggggggggggggagcaaaagttaatcagcggggaatttggggaggaaagaattttagaaggggcgggggactgggggaggggctgatcatcgccagatttctgcccaagattttcgctcttatcaccacctcatctcccctcatcacatcatcccccccatccccccaaatttgtcacgggaaaacgcatacaaaaatcagtcaactctctcgccgaattgggacatcgcaccgcacatacaataaagaatcagtgaagagtgacaatgagataggcgagagagtgcactaggcagagagagtgggtaaaatggagggt

SEQ ID NO: 23109 - DNA, 1137 bp, Heterodera glycines
gtgcccctccccgtccccctcgtccgtcgagggtctctcctcttcctcttcttaacacaaagccggggtgcttgggagggggagggacctgcgggaagacaaaaacattttttggttgggccagactggaaccatcttcccctgcccccgtcctttcctggcttggtcgggtccaacccaattaatgtttttgcttgatcggcgaagaggggggggggggggtgcgcaatgctcgaaatgatcagtgtgtgatcatcgaggctcgtaaatggtgatgctcaactgtggccccggacgagaaaagtgatcaacaaaaagtgggcgctgggagggaagcttttaatgaacttttgggaggggcatattacaacagtcgaagcgtaaatggtgaggcagggggcgggtgatcgggagcaagggaagagatgaactgaaactatactgctggaaccacacacaatcagccaattgagttgaggagagaagagcggaagcacacaaagagagatatatgcttttgtttgctcatcactcactaccgtaggagcaacaagcaaaaggaaaaaccaaagcggacagaatatggtatcagataaatgagaaaagaaatgaaaatgaaaatttatggaccaatttgaggctttaaatgacccgccagagagagtgagaaagtttgaggattggggagtggggagtgggcgggaactcggtgatgattgagatggggagggtgatcaagtggtgatgctccattttatgatcatcatgatgatcacctttgggatagggttgggccggatgatcggttttgtcttctgttggtctgcccgccactgaacaacaaacaacaaacaattgcttgctgttgcgcggctgagggaggaggagaggggaggaggaggacaacaatgcaaatgctatgcgacggaatgaaagtgaaagccatgggtgaacgaacacaacaacaaaacaacagcggacaactacaacaaaaatgaaagcccccgtgggtcgtcgccccgcccatcgcgcccccggggcgaggcgatttggccccacggggcagggacaagccatgaggaagctgatgggctatgtagggtgtgggtgaggggagaaagcaagcaggaataaaag

SEQ ID NO: 23110 - DNA, 1146 bp, Heterodera glycines
tttttccagataaaaatattgtttcagatcaataaaaataaaagaagttttttctgagttattttagaatgtgagagtttttgtatacggttcagagccttcctaaaatgaagaacaaaatgaaggaccagaggggagattgttgcgcaaaggcactttttatgtgttggttcatatgggactattttttacagacaaaattattggtttcagaacaattaaaattaaaagctgttttaactgagttattttagaatgtgagagtttttgtatacggttcagtgccttcctaaaatgaaggacaccagaggggagattgttgcgcaaaagcactttttatgtcttggttcatatgggactattttctacagataaaattattggtttcagaacaattaaaattaaaagctgttttaactgagttattttagaatgtgagagtttttgtatacggttcagtgcctttctaaaatgaaggacaccagaggggagattgttgcgcaaaagcactttttatgtcttggttcatatgggactattttctacagataaaattattggtttcagaacaattaaaattaaaagctgttttaactgagttattttagaatgtgagagtttttgtatacggttcagtgcctttctaaaatgaaggacaccagaggggagattgttgcgcaaaggcactttttatgtcttggttcatatgggactattttctacagataaaattattggtttcagaacaattaaaattaaaagctgttttaactgagttattttagaatgtgagagtttttgtatacggttcagtgcctttctaaaatgaaggacaccagaggggagattgttgcgcaaaagcactttttatgtcttggttcatatgggactattttttacagataaaattattggtttcagaacaattaaaattaaaagctgttttaactgagttattttagaatgtgagagtttttgtatacggttcagtgcctttctaaaatgaaggacaccagaggagagattgttgcgcaaaagcactttttatgtcttggttcatatgggactattttctacagataaaattattggtttcagaacaattaaattaaaagctgttttactgagttatttagaatgggagag

SEQ ID NO: 23111 - DNA, 2565 bp, Heterodera glycines
tagggttgtaaattatatggactaaaaaacgcgaaatatggacattaaatatggactaaaaaagcccgaaatatggactaaaaaggacaaaaatggccaaatatggaccaaaatatggataaaaaatgccaaaatatatgttgtaaacccccaaaaatcccaaaaaaggtgtgcatatttaatatttgcttaaataaacctaaaaagtacaataaacaaccaaaaaatggggtttaaaacttaaaaatgcatattttttattgttgttcgttatatcaaaaacacctccaagtttgccaaatttcgaaaaaattctcattaaaaaaaaagaaatgttcgcaaaaaaatgacgaaaatatttattgaaaatgccaaaatgacgacgaaaactcaaatttttcgtgttttgtatgttgtaatttttaaaaatttccaaaaagttgatctttaggggtgtatttttcgtttttttttcatttttcttgtgaaaatttccaaaatggccaaaatatggactaaaaacccaaaaatggcgaaatatggatttattcccgaaaacccccaaaatatggatttatatggactaaaaaacttcaccaaatcaaaaaattttaacgcagaaatgctatttttaagcccctttcttcatagcatatgcgcagaaaaaatatgttaatccatataatttacaaccctaacaattacgaacgacaaacgacaaatttggcattttgtccccacatttgtcattacgtcaaaaaattaagtcgtttttcgtcactttgcttttgggtattgggtatgagttttttgaaaaaacgggatccgctccagaaaagccgggcttataggaattcctggtgacaagcccaactcaatcattttgaatcaatttggaactaataaagaatttgaacatttcattcaaacacgcaaaacttcgtcttcgcttacgatttcgggtcggtgatgcattatccagctgggggcaatcatgaacagtaagaaaaatctcggattttaataacctaaaattggaattaaaggggcttatacgacctgatcactttgccacggttttatcaacaaacgattggtcaacgagaacgaatctcttttaaagacgcggccataattaaccgaatttattgcgaaggcaaaattggtcgaaaatttcgaataaattttaatttgtttagactcatgcaaaggccatgaggacaagtgtcaaaacgggggctatttgaagccaaatgattgcacaaaatgcaattgtccggacggatacggtggtcaaaactgtaaagaactcgaagagagtgagaattaattccatcaattaaaacaaattatataaattaattgaagatttgaattgtgaggatttgagtggaattgcaagagaattggtggccaataagtcagcagtgtttttgaagacgaaggccaaatgtggggggaattggccgtgccgatgccattggcgaattaaggcaataaaataatgtttagaaaattataaaattattttgagtgttattaatgcaaattttaattgctttcagcctgaagcggggaaaaaggcgcgaattcagttcaaaagtttgaacaatttgtttgaatgcacatacaactgctcatcggcgtatgttgaggtcaaataacgagccgacgaaagggcccaaggcaaaaataaataaacaattaactaattagttacaattattaatgattatcaaaatattgctcattaaggtgccaagctttgttgtgccgcatcactcactgatctgaacgcaaatgaatataaaaattggattgcggctgaaaagccagacatggacattgtcatatccgcgcgcctttcaccaaaatggaccgtaccatctaccgtattcgagctgacgtatgaatcaggcaaggaaaattgtgaaataaatttttatatattttcaatttttctataattaatttattttaaattgaaaattgtctttatttcaatggctttcgtaaatcaaaaccattacacaattaaaactgttcaaaaatgttaaggcaaagtcaaactcataaattcgaacaaatgcgtaaataccgataatttgtttgccgagaaaaggaaccccggcaccggcggtttgaaatgttatgacgagatcaagcaccaatcttatgactgctcctgtcacggtgataagaaatgccttgctgaagaaaaatgggctcacgacgcctttctttgtccaataataaaggtaattaattaatttattattattaattaatgccaaaagacaccgccaagacaaattcatataatataggcaatttaatttttaagtagagtgaagcgggaccgggacctggtagcggacaactgagtaccaaggtttcggttttgacatggacctggactagtcccggttttcccagccaaaaattaacggttcttcaactcgaaaaggtcccggtccggttttacccaaattcccggttccgcttaactctatttttttttctatcaaaaaaccggaaataataaaaaaatagggacgataaact

SEQ ID NO: 23112 - DNA, 1202 bp, Heterodera glycines
caaaccaaaatgaaatggtcttaaaatattcctttctggacttgactgggaagtcttgatatcgaagctgttttctgcggctaaaaacggttataccaaaccccagatttttgaatccggttttcagaaaaaatgccttggtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgcc

SEQ ID NO: 23113 - DNA, 2167 bp, Heterodera glycines
tatggtttcaggtgcaaaattcggccatttttggacaattagttgaagcatccgtgtgtaaatcatttcacattttgaagtgagaaggcagtacgcaatcggaaaaacccatttatcacgtctaaaaagacaacaacaaaaaacgtgaaaacataggcttttactttgcgagaagaacataaatttgactgaacaaaggcggcgccaaactgaaagtgccatctgcgtacacatttttcataataccggcccattccgaagtcgcagcgcgagcaaatatcaaaattcttaacacggaattttttaaaaattaatggttttattttttttacctttgcggtccagcctgtccctgaatttgaaaaacgccggtgtccgccaataagaaattctcctcgtcagtctctgttcgtttgtacattctgtacgctggcggcaattccaatgcttccaaactgagtggtgcagcaggtggtacattttcgtcatggcgaacacgttttataacctaaaataaatgaacaaagcatactttggcagaaaaattcgtaaaagttgacctgttttgtcgcagctttggtcggaaaagcagccaacacgggggttgcagtgttctgcaatacttgcgcacggattgtagccggcgcttcgcacgtctcaactgcacgccgcttgagctgggttatacgtcgctgacactccacatgtgcggcgctcatgtcgcatgtgtggcttccaattattttgaggacattaccattaatgtcagtgtgaaggcgccctgaatttgaaaaatagtttttattttattttatgcatttacctttgcatttgtcgttagctccgaaaaactcgcatcgccaatacttccgaagtccatcgtcactgagtttgtgaagaacataaagtgaaccctcatgttccagcttctccttgtttcgctttgtctttatttcctgattggtagggcccggatttttatgtgctaaaaatcctgaaatatgtaataaaatatgtgctaaaaaatgctgaaatatgtgctaaaaacccccaaaaatgccaaaatatgtgctaaaatatgtgttaaaaattgaaaaaataagtgtgtttttgcataaaaattcccaaaaatctcattctttatcatttttagcccatacaacgcaaatcaaatacatttcgaagtgtttggggtaaaattgtctttttttgataaatcatttctataaattgaaagttccagcagagaacttcgaaatccaatgacgaattaatgaattcgagatttcattactactgattgggctgttccatttgtattgtagctaaacatagatattataagtttttccttctttataattgacaaaaaaaacatttgtaacagttatggacaaaaatagcttgccgtactaaaccgaccctcgtactaaaccggccgtactaaaccgaccccgaccgcaaatatcaacgtaaatttttaaaattgcgataatttttaaaatttgtttgagtggcttatcattttatgtagagagataacgcaaaaatgagagagtgctgaatttcagtcccagtcatatagagagtgcattgggaagagaattcacttcccttcttcgctgattcttttggtaatagacgccgattcactatgggtacgcgccagtgtcagacaaaattgctcataacgccaaatagcgcatttggcgtaaatttttgcgcgttaattcaaaagatactgatcactgccttttttgaagaccaattaacattaataaactttattcaattgactaaactctttatttaataatattatagaaagcggaaaagatgtgttcaacataatattcagatagtggaaatgtgaaatggtgaaaatgtttggaaaaatgaaatttgatcaaaagtttgggtatttgtttccattttcttgattgttttcgacacctcgatcgtgaagggcattcagcagtgtcacgtgtttcaccaacttctcaacaaccttctctggagtgccgagatgagcataacgaccgacctggatttataattttaatgggaaaaattattcattaaaccaaattgttgcacattctgtgcatgtgttccattccttgttcactgatcagcccccaccaaagatgagagcgcgcaaaaggga

SEQ ID NO: 23114 - DNA, 2193 bp, Heterodera glycines
  misc_feature (27)..(27): n is a, c, g, or t
tttttgcgctatcaccgtcctcaccgncctcagattgcgctgtgtcgccaccaaaaatcgaatcctgcaatttgcttttattttttttaaattttcgacgtttttctttttaccggcacaacatcctccattgcccccccaattgtaacaaatttattggggacaggcaaatgggctccactctccagatattcaattcgggtttaaattcttctctttcttttgcaaaaagagcgatgaactctttttggttctgaaattttaattttggattttttaaatttaaattatctcacaatgttatctgcttccaccatagtccacccaacgaccaacccccaattctctgagctaaattgccatgtcacaatatagaataaaaacgtctcgttgcagacgccgcatttcatctaaaaaggccctaaaatttattccttttttaaattttatttttgaacccccccccatttactttttcgattacagatttaattcttcggtaggcactttaaccccatttgggtttcggtccttaagctttcgcatatccgggtgcaaatggtccccggggcacgcggtaattgcgttattcaatttagtgtgctcgacaattcatttttgcggctgcactcgtcgcaagtgcgcacttacaaataggttttttggtggcatattttttattatctattataaaaaaaatttcattgaaaaaataaagtgagtttttttggtaactgcatttctattattcgtacgcctctccctcattccttcacccattttgccgttcactcatttacctgcctttcccaatattcaaattattttattgtttacaattattacgtttttagatttatgcaaactcaatttattcatttcgataaatgcatgcaattctcgacgaggatacgcaccccatacaatggaatttgtgttctgcttttcaattcatctcatttctattgaattcattcattcattttgttgactaattaggaccattcagccgggctacaggacaacgcttaacggcgaaatcctgttatgatgctaatgctaatacgctttttagtttagttcggtttggataactggttcgacgcttaacggcgaagaccatgtttggtgctaaggacgtcggcattctcttttgtcttcattcattcatttagttgactaattaggaccattcagccgggctacaggacaacgcttaacggcgaaatcctgttatgatgctaatggtaatactctttttagcttagtgtcatgtctcggtttggataactggttagacgcttaacggcaaagaccatgtttggtgctaatgacttcgccattctcttttgtgttcattcattcattcatttatctgatgaaattttttgataaaaaaatgaattaataagaaattttcaatcattcacatcatttatcaaacattcaacgaacgaacgcgtaaattccgttcaccggtgcacggcagagtatgcatgttgctattttgcgcagcacgcagtttaccgcacacgttgagcaaagcacacatggccgcaaccgcggttataaaagttcgctagtgactccgtgcagatcatgcactctcgctcccagtacaattgtgccggcggtaccacaagggacgaagcggcaccgctgctgggctttcacgcaattgcagccgcacgtttcgctcatacagctcatgcagcatgatttggcgttgctgttgttgctgctgctctgcaggatcctggttttcatcgttctcagcttccagtatttgttcatgcaatgatccgcctcgtccagctgctcgcgtatgtgctgttgtctagccgcttgctctcgctgttgctgctgcgcctgctgcagaagatactgatgctgatgttcgatttgctgctgaagtgcgcgatggactatttcgtagcgaaccatgcggaccctcgcacgattcatatggactccaaaattcctccttggcctacaataaaaattaatcttttattgtttatataaatttgtgataaaatatgatttaaaaaatatatatggaataatcataagtaaatataaggttaaatggctattaaaaaattagcacaatagttaaattaaaattgcgatatatgccacaacagccacaacagggcttaaataaatacattatgactgacaaattaaaag

SEQ ID NO: 23115 - DNA, 1064 bp, Heterodera glycines
ttagcttattatgcatcttcagtttgcattctaaaacaattcattttttgttctaattttatgatttatttgttttctgttgactaaatagtcagttcttatagcaaatattaatttatgtttgcgtagcttcaaatgagcattctgccttcaatttcgaagggaagtgaatttttttataataaattgatagagagcaaaaagcacaatgtataatattcaaaaaatttatctatgcatttgttgaatgttcctaaacccgatcaaattttttaaacctttatatgaaaacatttattgcaggaaatgacaaattaacctgggtgagcacacatttcagataagcttcctatcattatttcttagaaacaactaataatctgttgaacagttatttcaaaataaattcgaatatattagcttattatgcatcttcagtttgcattctaaaataaaatcattttttgttctaattttatgatttatttgttttctgttgactaaatagtcagttcttatagcaaatattaatttatgtttgcgtagcttcaaatgagcattctgccttcaatttcgaagggaagtgaatttttttataataaattgatagagagcaaaatgcacaattgtataatattcaaaaaatttatctatgcatttgttgaatgttcctaaacccgatcaaattttttaaacctttatatgaaaacatttattgcaggaaatgacaaattccaacctgggtgagcaccagggatgggccgaggtttcgcttttcgcatttcgcctttcgcattattcgcattttttggcgtttcgcatttcgcttttcgcatttcgctttttggcgcgaaaagcgacttttacacccctaagaattggattaaattcccataaaatttttcaaaattttacctataaattggctaattttcagtgaaaaactgcttataagtgatcaaaatttccaatttttttccccggcggcgcctatcggcaccgccgcgcccccaaaactcctattttttcttagaaaatggcccaaaatcgcaaaatttggtaat

SEQ ID NO: 23116 - DNA, 1702 bp, Heterodera glycines
  misc_feature (1661)..(1661): n is a, c, g, or t
tatcaaaaaaaaacaataatatttattcgagaaataataatatttattcgagattagactcacaaagcattttgctattagagagaataaagagagatgttggtgcaagattcaatggttaatttcttcatttaaatcaaaaataatattaaataatacattcttcaactaatatcgaatttaaaaataaattgaatcattataatttttaagaatttttgaatcaaaataaatgtgatagttttttaatttattcaacaaaagttgcatttttaaaaaagaaaattgagcccatttttgaagttagcgcgctaaaaaattagaatgggtttttattcaaactatttattttaagtcgctcccccctttttttgcttaaccggatcaacgaatatgaatgaccgtcgtccgataaatttcttccgtaaaatgtacgacggcatttatttttttgtttttgttgacactttatcattcccgcagggaatgaatgcattgacggagtgaaaagaaagaaatgggacatttatgagtgtcggagacgataaaaaagcgacgggttgataattaaaaaaaaaatgaaataacaataaattaattagtaagggggtgaacccgtgggcggggagtgaattccgtcgaagacattctcgcccggacggctgacctaccgatcgcggaagggcaatgctcgcttcagtcgtcgcattcccatgttagtttgttaaaaaagtgcttttcaaaaattaattttactataaaaatttaaatttttgctttttctggcgtaatgaataactgttttctggttttgaatcccaggaaactgatgtaaatgaccggctgctccaccttagtccccaggccgaatgcaatggattttaaattggcacctgttggcattttgttcctactttatcgcggtgccttcattacagtaattggtattattattacagttatttgtcgtgagtttgccactttcccttttgattagagggcgctcctccgagtgatggccatcaaatgatggacgcagaaatggccaagttcaaaatgttgcgagtgtcgtcaccggaaagttatgacaaactgaaaagcactcatgagaatttgtattatggggcggtgaaggcactgatgggacagctggggaagaatatgtacaaaagactgtccaaaggcaaaccaaaacaatggcatttgacaaaatggatggtgaccgtccttttaggagagcagcgacggttggccaaatgtttggaccgaattgagaaccggttcgacctgaagtcgtcggcaatttgcctggtggaaagcaaacggcgatggatggagacggaacggatgaagagcaacgaattgttggcatttgtccaggaagagggtacggtaatgtgggaacgggaattagtacggtaggtgcaatgatcggaaatggccgtttagaaaagcaccaaagcgacagtcatcgcaaaggagtggcatttatgcaagacagtaagggagttacggtagaagatactcacaaaatggtacggtatttggaggaaaatggacatgctcagcggaaggtgaaccacagaatggagggcagaaaaaacaacgaattcaatcagttcagcttcagaacagtcacctgctggaaaaagatgaaaggngaccaaaacggacagaatcggcgcggctgattcggtacggc

SEQ ID NO: 23117 - DNA, 1347 bp, Heterodera glycines
tcttacgatatttgaacgcaaacaaaaaaaatttctgaccaaaaatagctatctctttttctcattttttaccgcaaacttgtaccaacagttgcattctcttgtctggccctatcaaacaatcttacgatattgaaaacgcaaacaaaaaaaattaacttgaccaaaaaatagctatctcttttttctcatttttttaccgcaaacttggtaccaacagttgccttctcttgtctggccctatcaaacaatcttacgatatttgaaacgcaaacaaaaaaaattcttgaccaaaaaatggttatctcttttttctcatttttttaccgcaaaattggtaccaacagttgccttctcttgtctggccctatcaaacaatcttacgatatttgaaacgcaacaaaaaaaattcttgaccaaaaaatagctatctcttttttctcatttttttaccgcaaacttggtaccaacagttgccttcttttgtctggccctatcaaacaatcttacgatatttgaaacgcaaacaaaaaaaattcttgaccaaaaaatggctatctcttttttctcatttttttaccgcaaacttggtaccaacagttgccttctcttgtctggccctatcaaacaatcttacgatatttgaaacgcaaacaaaaaaaattcttgaccaaaaaatagctatctcttttttctcatttttttaccgcaaacttggtaccaacagttgccttctcttgtctggccctatcaaacaatcttacgatatttgaaacgcaaacaaaaaaaattcttgaccaaaaaatggctatctcttttttctcatttttttaccgcaaacttggtaccaacagttgccttctcttgtctggccctatcaaacaatcttacgatatttgaaacgcaaacaaaaaaaattcttgaccaaaaaatggctatctcttttttctcatttttttaccgcaaacttggtaccaacagttgccttctcttgtctggccctatcaaacaatcttacgatatttgaaacgcaaacaaaaaaaattcttgaccaaaaaatggttatctcttttttctcattttttacggcaaaattggtaccaacagttgccttctcttgtctggccctatcaaacatcttacgatatttgaaacgcaacaaaaaaaattcttgaccaaaaaaaagttatctcttttttttccttttttttaccgcaaaatttgggaaccacaagttgccttctttttgtttggcccctatcaaaaaatctttaccaaattttgaaacgcaaaccaaaaaaaattttgggccaaaaaaggggtatttcttttttttttctttttttt

SEQ ID NO: 23118 - DNA, 1897 bp, Heterodera glycines
aaaaaaacaaaaaaaaaaaaaatgttttttacggcacgcgtttcctattttggaaacagggggccggcggcatcggcaggcgccgctgagaaaaattttaatgccattgttaattagagttgaccaaaaatgatcaattttgcgattttgagctaatttatatgaaaaaattagtaaattttaagtaaattttgaaaacttttcggtaacagttttacatagaaatggccatttttggtgagttttttctaaaaatcagcataaatcagcaaatttcctcaaaaaattcagcaaaatactgataaattgtgatagtgaaatgcgttcatatggtccagggaatgaatcatttttgaatcaaattacaattgttgcttaatgattcactaagaaatgctttgtgttgacttttacacacataattaacggattattgaaaactaacaaattctaattcttttcaatttttaaataattgctatttcttagattaatgaatgattaaataatttgatatcattacatcgttagtatcaatttccttcctcaatacggacatttgggcacacattttttcgttttgtcgcggaacaatcccttcacacagtcgcatgaacagtcacaaaagcgcgcagtgcaaatctccggcttcggattgtcacaacttggctcacatccgttgcaactcttttggcccggctcctcattttcggggcactaaaatttgttaatttattgaatttattatttttttttataaaaaagggatgttgctcattttaactgaaacattaaaaataaattaattagctattaaagtttaaattgaaatggattatttaaatagcgacattcaaaagaataaaatgtgcagaataaaataatgacgacaaataatgcatttatatggaatgatttgacacaaattaaacttgttctttagtccaattagttatgatttattaaatgtcttatgaaaaacatcattatgtcatagggaaaacgggtgagaggagcacaattaattgccatgtttttaagaaaaattatttagtaagggagctaaaaaacaaacgaaaattaaaagggaatacaattaattaacaaagatttttaaattgttaatcgtagaatggttatgaaggaaataagcgaataatattataaaattaaaattatattataaaatacaatttaaattaaaatgtgaattaaattatttcttcctttcattgtctggtgataaggttgggcttattagtgttttcccagttctttctttgcacagccacgagcagcaaaataattatttttttaatagcaaattggaaaaaaaattaaaataacccgggaacattatcttattttttaaaataatttttttcactcaaacagttatgctgttattttttacggttgatttttagtggagttgcacggcattgagatcccgactgatttttggtcggaatcccgactttttcggaagcagatctcgatttcgacaccggttttcaaaactccaatctcgatcttgacttttaaatccgaatgggaactatagattgaaaataacacacatttctaagacttggtctgacaatgagcttaaatttaggaaaaagcatttcttttgttgttataatggcctagaggtggttagtagaggtcaggagtggagcgcgaccgcgatccacgaccgcggcaaattgaatccgcgatgcgccatccgcgaccgcgggatttttctgtccgcgctccagcatgagtagaggtgtgccgtgattgaaaaaaacctgtgcatcgtgaatcgtaaccgtaaccatgatccaaaaccgtgaattcacggttttctgatcgtgacatgaattcagagttgagttttgtggatccgcgg

SEQ ID NO: 23119 - DNA, 961 bp, Heterodera glycines
ttgaaaaaaattggatttttttttttcgggggcagtccccccgggaccgatgcgccaagttttatggggagaccgaatccttcgggaatagcttccctatagcctgtactttaattctgcgttggatttttgctccccataaatgtttgagtaacccaaacggacacttgaaaaaatcgattttttttgttttcggggcagtccccccgaaccgatgcgcccagatttatggggagaccgaatccttcgggaatagcttccctatagtctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgattttttttgttttcggggcagtccccccgaaccgatgcgcccagatttatggggagaccgaatccttcgggaatagcttccctatagtctgtactttaattctgcgttggatttttgctccccc

SEQ ID NO: 23120 - DNA, 1579 bp, Heterodera glycines
  misc_feature (1553)..(1554): n is a, c, g, or t
taactttttaattaatagagaaagaacggcttttaagcctttgctttgctaaattggtaattttagaaaaccggtttgaaaaagtagtgttattggcgatgctcgggaaatgagaggggcgccgggtcgtagcgaaggtaaaaagaggcaaatttctgaaaattttcttaaccaaatcctttaaaaattctgaaaattttccacctgttcccaaaaagttttatgaaaaaagcgcgtcggaaaaaagagggtttgaaaagcaaagcaaaaaaaaaaggtcgtcaatttacgtggctggaccatttcgcaaaaattttggttgacccccccccctttttcatgtatgaaagccaaaaagtaataattaaaattgtcatttaatgaaacactaattaaatcagaataaaaattggatgaatttttggttgacagctaaatttcttaatttaaaggcaaatataaccaaatatctctcaataaatatttgttgttggtgggaaattttgacaattttgccatataacgcagggaaaaagtgtgaccaaattggccataaatggaaaacatgaaaacaattaataagaagacaacaaaaaatgtttgtaggcggccaaagttgtgtcaataaaaaaaatcttgacgatattattatttaataaaataagtaaaattaattaaaatataaaattgattggtggggaaaatttgtcaattttgccattgaattcaggaaaaattgtgaccaaattagccacaaatggaaaactattactagggcttctttttttaggcaaatgcctaaaatttgcgcacttaataagtgtagctaagcacgaaaaacgcgttttccgcttggtttggggtgtctacgatgacttttataatgcctatttttgcctatctcggggtttttgtgcctaaagtgccaattttaggatttacgaaaaataacaattattttctttttgttatttagcttatttcatcagtttatttttgataattgttgagatttaattcaattttccaaggtgtccctattctaatgtaacaccccaattttggaaaaaaattcgtaaatcctttttccgtcgtcatttcgtcttctcacttttagaatcttaatattttcagaattgctatatacaattaaaatttcaaatcgattggttcatgagaagtggtcaaactcccacaatagggtgtccctattctaatgcaacacagtgtactttctttaattcaagtttaatttaagtttagaatgccatgatatgtaataatctgatggcttaatgaatgtgtggcttaattaaggctaattgccaataagggattattaattaattctttgtcaaattaaagttattttatgccaaaattattttcattcaatttagtctttttatattatttttctcagaatgccatgataagcatgtgttttgcgatctttggacaacggatggccaatgtgagaggagcaattcaaggtaattattggagaattgtcagatgtcatgtaacccgggggtggagagatgacaacaaannttaattgcaaacaattcattaacaa

SEQ ID NO: 23121 - DNA, 2485 bp, Heterodera glycines
ttttaaatatgaagtcaattaattaaataaataaataaaacacacccccacaggtgaaaggacacatcgaaaacgaagacggaacaagtacacgcgtgatgattgagcactatgataaatacaatgggttatgtggatttgaatcgtttttggcgtcatgtgcttttaccttttttggattttttgttcccgtttcctatgaagatgatgattgatttaattttaaaataatttttattgtatattgtgtttcacaaattcataaacaaattcatccgaattacttggccttttcaaaaattgcataataaactcaaaatcaaatcctaaggacataaaataaataaaaactaaaacataatgaccacaaacattagagaaaatcgattgaaattttcttcgattaaaataaattttccgaaaattatttgccaaatattttttgatcagatcgtttggcatctcgccataggagtcaaaaaagtaggccacccccggcgaacgcgcccatattgcgcaccaatgggttcccggcattcccgacgggtcctgaagtggcaaaattttatttaatgtattttttggcactcaccaaattgacaattagactgcagggaaatttcgtgcactttggcaatcggtcggccggaaaagtgccaacaaaatattttctcgtcgcccggttctcaaagagagctctgtcgatgaaccgattgtccattcctgcgacgaatccgcctctccctcaaaaacaggtaaaatcccgcagccgcagtacctgctgcaccaaacaggtagatgaggcagagaaaaaagttgattggcgacttctcgatcacatccggaaaacaagtacaatcccttcgtgtgcagcattggaggagggcatttgaacaaaatcggaggaataattctcaccattcatactgtaaggtcactagtgattgatctgttccggtcaatcagaatgagcccgtcagcctcggcataggctattaaagtgaccccctcgttcggaaccgcttcggcaaaccgaatgttcaccgctgtacagccctccttgatcagctcaaagcccggcgagtcctcctgcgcattggtcatttggaagacatagaggcagtaggcagtcttgaacatgctgtagctgatcccgttgctctcagttgtacaggccatgccaaggtgctcctgggtgtcatggtacgcccttgcgtacctgttgttcttgtagtccaagttgtacggaaactgtgggtacgtcctgccagaggcggtcagttcaatatcccgcacctgaacattttttctgccagaaatacatgtcaaagcggcacttacgttgtggtggttgaagtaaaaggggttcttctgattgtgcccaatgtagttttggtttggcaccagcccaatgatgaccctccgtggcacttcctcggtgaacagattggcagaaaaatcgtatctccctccggtgatgaacagcgacttcatcagcgtttttcggatgccgtatctggcgggctccaggtccaacttctttgcaatgtcaaggctgagaccgtccatcagatcaaccgtcttcacgatcagcctgcagtcgacaatctcaagcgtgtacttgtccctatttgcggcttcctgatgtatcataaaatcgtccgactgcagggcgagctcaatatcaatctcaacattgctgatcatgtacaagtcctggttgaatatgtcggcgctcagcttgcttatcgcttgaaagcccttgctctcctccaccgcctttttccttcgatcgtttactttggtcgggtcactgtcacggaaatagcctgccacgccaaagtatgaatcctttgccgttacagggtagctgagctcggtgtccaggaacaccttgtagctgtacagctggtttgagtcgtacacctcccgctggttgatgtgcactttcaggttccggatgaacgttgcgccgggcatttggataaggccgaccgctgcgtttgccggcacatcaaccacaaccccatcatctgccacttttttgagcttgaactctgtgcacacaaacaccttgctaaggtctacatagctggtgattgggtggatctgaaccaacggatttgtctgctactgcatgtgaaaaccacctgccttaaaatgaaagggcctagagcttattgggttcagcgtcaggtactccctgtagctagagttggacacagcgcagctcgttgggggtatggtgaagaagtccagccccgcatttgccacctcagcacttgacacatccacttttttatacaacattttgctaataataaccgagcgagtcaaatcttttcttctttaacagagctttttggggaacagtttgtccaacaacgtctgagggtttcaaaatgctttcagcttttttcccgcctcctcttctcttccttcttccgcgccccttttgtagtgatgaagaggcctgtccagcaat

SEQ ID NO: 23122 - DNA, 3765 bp, Heterodera glycines
  misc_feature (843)..(843): n is a, c, g, or t
  misc_feature (871)..(871): n is a, c, g, or t
tagtctgaaaatggtttaaattaccattttattgaggcagagtgatgacttttagttcgttcgtttccgtgtttgtgaaattcgagaattttgaattttcggctttttgtccgaattcgcgcgtccgggattcagaattgatcgaccagatttgtgaccagcaacctcgaaaatccttggaaacatgttttcacgaccttagaaaaaaaaatgtttttttcggaaaatggcgggaccaggctccactatttattatgtaccaagaaaagcatattgtgcgacatgaaaaaaaggtggtgacaaagtactcaatttgggtgaacagtgcggaaactgttggcattttgaagaaaaaaattgaaaatgagagcggcattaagcgcgcagaacagatattgaagtgcggcattacaaatggtccagccgaaatggaggacaagaaaaaactggaattttatggcattggcatttgtggtggtggccaagaaatggaggacagaaaacaattgaaacaaaaattgaaacattatggtagtaaaaaccgggaaaaaaccgggactagtcccggtcccggtcaaacccgagactttggtactcagttgtccgtgttcaggtcccggtcccgctcaactctagtctaaatcttaggaaaaaaaactcttttgcgtttgcgaacaaaagttgggacttttatttatatatttttacatttttccagctttttatacacatatttgagcgttttagcattttttccaaattttttgagaatttttgagaaatttataaaaatttctcgtgaaaatttaaaattaaaaaaaatatatataggtatacccctanaaaatcggtttttttaaagagatgccanaattaatttttaaatatacaaaatgtgattctaagcctatttaggtcatttcacgctttacgaagagctttttgtccaagaaaataagcattaaaaaaatttattcacataatttttggattttttaacatttgtgccagccctaggcattggacatggcaaaacaccaacaccaacaacaacaatattcctgacctccgcatggacggtaaaaaacgaaaaaaattgccaaaaaataattggcgtaaaacaaaacgccaacacactcaaattgaaaatcaaattatatctttgatctgatcaaatgttttaaaatcgtaaaaactcattagaaaacatagttttttacagcaaaactaaacatttattgtaatgtgagggcaaattatttattaaatataaaaaattgaaaaatgtatgaaaaatcaggtcgccggtgaggaaaaattgggtcgaaaggccatcaatttcacatatgtcggccaattgtcttgccacgtccgcaaaggcaacgcgaatgcctgcacttgtttctgcacctataaaatgcacatgtaaatgttaacaattggcttgctcagaaattacccctgtagcacccaagcaaagtaaaatttgaagctgccccaggggttgccacatttccaattaggaagcccagtttcatgaaattgccaccaaaatcaccagcgagacacaatttgagcgcattgccaggaagaacacgcaatttgttgctggcccgaagccgtttcacacgctctgtgagaacaccagcaacatttgtgcagaaaagaacaactgtcgattggccgctcttaattttaagaaaatttgaaaaaaaatttggtaaaagtacagggaaacggtctgcatcaatacgacgggtggcatacacttcgccgttgaaaagtccgcggtactcatccatgaacgactgagacgtggcaaaaaagtcgcgtccaagtaggccgagttcgtgtttcaatcttcttcgttgatcaggaacaattccaacgctttggcaaagtcggacgtcatcccaggccgacaagcgttgttgtccacttgagttgcgctttcttgggacagattttggtgtactgatcagtttcattcgtcctgctgggctgatcgatcggctcaagcggcggacaatggcaccggcaagtaaacgccacgggtttcttcacgtcagacttttgttttaatttttttttactcattaattcctgaaaaaaataattttattatttcggttaaaataactctaaagttggccttatttttgtattaaatttccttataatcgattcagaatttttttctctatcgatatgcaaaatatgaagaaattctgtaaggcgaaaaaaaagttctatagagcgaagtaaatgttgttctttacattattaagaatgaagagatagtacgtaaaagtgagagaaataaagataaaaagtaaatgtgacagaacgccaattttttcccataattatccataaaaaagatttattgccgcttttttttcttttttaccgtccatggttcccattttgcgttttcctttttccttttcaccctattgttgagtgattggaccaatctcattgtgtattcaaaacatttgatattattgcctttaccggtcccataaaaagtgtgaaaaaggtgatcttaacaatgtttgcattcggaggttatcgatggcgctaatcaagaatcttttgttccattttacgtttatttcttgcttcctatactccttgtgttttcttattttaccatcaaaaagtgctttagatgttaaaaatggtttggaaaaagacagcagacattttgatcggtggcaaggtgccacttgcgatttatcactccaaccggtataactattaatacatgttaaatgttacaacaaaatgtttattctttgaaggtcaaaaattcgcgtatttgtggccgagacacctgggccaatggtggatgggcacataacttttggtaaaaaataggaataataaaaatataatttctattaaaaatttaatttttctgaaaaatatctgcttgttgtaattctttggatactggataaaagtccatttgactatacgtcccatgttttttttaattgtacggagatatcggtatttatttcttttgtgaccccctcccgaattttttttttttacattttttatcttgcataattttaggcgctggaaacgcacctgttgtttgcactttaccttaaaataaatggcgcatgcgttttcagcgtctaaaattgcccaagaaaaaatgcaaaaaaaaaaattttttttttttctgaggggatcacaaaagggataagtagcgagatataattaaatcaaccataaatataaacaaatcatgggattggtaatcaagaaccttttgaaaacttgttcagtcaccgaaacccacacaaatgatgggctgccccacacgctggaacaccttgtgttcacgggcagtcagcggtacccctacaagggcatgttggacataatcgccaaccgctgtcttgcgagcgggacgaacgcgtacacggaccaagacaataccgcgtacgaactccgcactgccggaagcagcggttttttgaaggttctccccgtcttcttggaccatctcctgcgaccgacgttgacggtacaacaacattggcaaatttgcggttttggcaaaaaatgatttaggcatttcaaaacttaaacatacaaatttgacatcaatatctttttttgaatcatttttaaattttactttcagcagtcacaatatgacacaaaggtgcaccacatcaatggcgagggcaaggtggcctcatataggcgccaccaaaaaataaaaagaaaaattacaataaa

SEQ ID NO: 23123 - DNA, 1426 bp, Heterodera glycines
aagatcggtagtctcaagcagcactaaaataggccaatagatacaatatttactaatttttatttattttttgataaattcataaaaaattcccatttttaaacattcataaaaatcgtttgtttttttttgaaccccacaattttttgttcgttttttgaatattaatgagttgttttttgtcgttttcccaatttccaaccaaactctggaaattttgttcaccatttatttagtgaaagtccgtggacgaacaaaaaaatgattcatcaaaatcatcagcatcaatatcagctggtcgcttcagaaatgaaaacaattcaatcatttagtgggcaaattgtgaagggtattagcggatgcgtaaaacgaataatagctgggcattgaaattttgcaaaaaaaaaatttaataagatttttcgatgaaaaatttttccattaattttctttaaagaaatcacataaaatttttcagcaaagttattacaatttgccggaaaatgacaatacaaaacagaacttataaaaaagaccaaacagatataaattcacttaatctatttttaaatttggattttacattcctaaattaaaattttttttttcagttcaatttgaattcaaaatttgaatttcctcatcccagtgctctctaattcgtccctctccctaattaatggcttcatgcaaatcacccattagccttctcagcgtgcttctgatcatgctgctgatcgatccatgcttcaactattatttctttaatcccgcttgttcgttttttttaaattaaatttttataacggttcacaaattaattttgcacaaaatttcagcggatgattgtgttgtggccattcgtaatcgtactcagattccacctggggtcagttcagtctgtttaagttttgtgccatttcatgccctaggtttttggtgttttgtcgttactcaaatccatcaaaatgggcgttacctcataaatcaaccaaaaaaaaaaaaaaattatttattacgtggctcaaaagtaaacaaatttttttcccgagactcgatcccgagaccgaaaagcccgagactcgagacccaaaaaactcgagacccaagacttctttttaaaaattttcttattagcttaaaaaccgtttaaaatttttgacaagtgcaatttgtgcacatagcagattgattgcgaaggctcataaaaatttcttaatctgaaatccaaacgtctaaaaataaattttctaaaacggtatttgctcctaaacaatacacattaatagcttttgtataaacaattgagtatgcttttaccttggcaacaattcgtgccaaaaattaaaagtaaattgtcttccaacacattgtgccataacatgttgttttgaagcacttggcaaatttttcaattcagcttgat

SEQ ID NO: 23124 - DNA, 971 bp, Heterodera glycines
tcaaaaattttttccattaccctaagagctgcggaaattgtgaataattctcagaaaaatggctatctctttttaggacaattttctatctcgtaaccccgatgctaatccgttccggagagcctcttcaaaataattttttccttaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccttaccctaagagctgcggaaattgtgaattaattctcagaaaaatggctatctctttttaggacaa

SEQ ID NO: 23125 - DNA, 1625 bp, Heterodera glycines
aaaaagcacagcgcaaatttgtacttcggtgttgtactccgagattgcgatgatgaggaatgcgagcagcagacacccgctttttcccatgcagccatcaaatttctgggcattgccagcgtagacgccttttacaacctatcagagaacgcgcccgataagttggaatcgaccttgcagtcgaaaatcgaccaaactgtgttcgtcaagctcaacatcaaggtgggtagtgtaaatggtcctcccgctattatctagtccagtgtcttctacgtaaaaattatgtcagataaacatgtatgttttaaggaaaagaatgagaccgcgacgctagactggattatttcctcaatatctgaggaaaaaccggtggcggtggtagtggatgttgaaagcagcgatgatgaggccgaggatgggtcatcatcttcaaatggttcacctaagaagcgcaccaaaaagaattgatgaaggtgcgaatgatgatgatgtatggcgccggtaacggacaagatgttgacccgcaagccaaattttaaggctagatattctctgatgatttttagcattcaaccaaaaaaacgctttacacgatttttcgcttttcatcttaaacaagtcgcttctatttgcatttgccatattatatatatagtaatgcgttaaaaaacgctccttatttccaccgaggtgctgaagatgtgcgaaaacagaagcattaatctcatgtttagcctttttcttttgcacacaaccacaatacatttgaagagtcaaataatgaaaaagggtgaagacgacactgctactgctgctgctgctgtcccacgaggcaaacggcccaactcaaactctgtatcagctgcccatttttctactgaatcagaggagatgaaaagttgtaagaaggaagagccgatggcgaccggatgtcgcaaaggtgcgaaacgacaatacccttattcgttgatgtcagctcgagcccaagatgtgtggtaagttttcagacccaaagtaaagcgtatgaaaataactcaggtcgctaaaacttgaccagttggaggagaaatattcaagaatggaagaggagctttcggaagacagcgatgatgcaattgatttctacgaagacggtattgatgatattgtggaaaagtgagttagcctcctttataccagctagaatgttatccattcatcctttttttaaggataaatcgtttcgaagcaaaagtgaaaaaatggtcagtaaatcatggaaatacgccagttgtcaaaaaaccacggttagttgttttcaagcagacagaacgcaccacatattatgacaacatactgaattttacagttataacacaaatgctgatgagaatagcaatgatgctgatgatgatgcgccaacatcgactgtgtacctgaatttgcacaatgacaagatgatcgagaaaagcaattaaaaaaatccctgatatggtttaaaatgatgataatgatgaggatcataaaaaactccgatatataaaccgattattttgtgagtgttttattacccaattaaaatatcgcgaaacaaaaattttttttttgatttcctgttatttgtattcagctaaatgccatccgat

SEQ ID NO: 23126 - DNA, 978 bp, Heterodera glycines
ccgggaaaaacgccgcgaaagaaattgaactgatgcactgtgtggagagctgcggccgaattggtcaaattggagggcattgccggcggcgcaaacggaagcgatgaaagcgcgtcactcatagcggtcgccgttggagggggtgacgcggaagcggcggaaggcgggcggcacggcggcgagtcgctggcactgacgcggtcatcgccgcccccaccgccgtccgtgggcaaacggacggtgcactcgccgcccattccgccgaggccgtgccgacgcgaggcattgtcagcggactctcttaagaagcgatgttcactttggccttgattttggcacccaaatgtgatcaattgtccctcccccccccaattgttcaccttttgcgccattttgtccgtctgttttggaaccaaacctaaaattgtaaatgaattgacacaaaagaaaagcgaagcaaaatcaaacaaaacaacacaaaaacattttcccattcattcattagtcgccgttgggcttcgccctaaccccaaattattcatttatcccttcgtttgtccatttgtccatccgttcgttcattattcaatttattttcccaatgatcggatgcgttgcgccattccctccccccaaacttttcattgtttgttttcctccccccccccctttttttcttctctccctttggcctttttctttagtaactgttccattgattaaacattcattctctcgcttttcaaactgttgaatgtcgtcttattggacggagaatgatttgaatcacaaaagaagcgtttggttggatggaatggggtgagggccattttatggccaaaatgggcgagtggagggggggggggacaaagggagccgcaaaagagaggagcaaagacatttatgggataaaaagaggggggagggcatttgccaattgtgccgcttttggacagatattttaaggggaattgggag

SEQ ID NO: 23127 - DNA, 668 bp, Heterodera glycines
ggggaaaattatgggaaaaaaggaaagtgcttttgcatttcgaattaaacatcggccgaaaaattgagcaaattaatgggaaaatggtcggaattcgggcgatgttcttctgatgatgggcaatgaatgaatgctttatacgcacattatttgtgcaacttactcaaatttgttgggttggcccggaaaaggaaaatgggggggggagggcgggtgccaatgccaagctgagccaagccgaacaactcgggacagatggcaccccagaggcgataaaatttgcattcatcgtatcatcacttagttcttcgtcagtaaacatctgtccccgaattatactgttattgttgtggagttgcgcctaatccgcgccatttgccccttagggcataaaacatcaaaaccagacgacggaaaacaaacgccgtacattttgttgtaattgtaatggatgcgcttctaacggcggcggttgggcagcggaagggggaggaggaaggggggggggtgacccaagtcccttatccctccccccccgtcccctcccgactatttaaagccttccccccgcccaataatgacaatacgccgccccttctgtcctctttttttgtttctttccacagggagggttttgtcctaccaataaacggacaaatgaaagaaag

SEQ ID NO: 23128 - DNA, 1378 bp, Heterodera glycines
ataagaagaagtcctggtcattaagatttgaatagcaatttaagtgaaaattagtcttgaatgatacagaatgtaacattatagccgcaccccgtttttgagttttaatttactttatatatatatatatatatatatgaaattagtaaatcatttaagataacttacgattaataacttaattttttatggcatatgaacaagttcattttaataaataaatttaatacttatattggcttctttaaaaatagggtattttttaatgtttattctacggttctaagtttccaccctcagagaccttcagaacgagttgaagcagcttagagcaagaagcgagagcgtcagatgttcattttgcgttaaatttaaatttgaatttcccgccaaatgcataaagggcaagtgccacaagcgagaaagagagagagaagcgaatgatgtattttatttatttaattttcaattattttttcatataatttttttaaagtaattttttatattatttttaatttttcatatgatttataaaaatagtatgttgtaattggtattttttttattcgtttcttgagtttttgtaattttaattatgtgaaattcaattatttattcattcctctgttataacctttttttagtcttgagttcttgaattgaaaaggtccattgggtcagtactttttaatttatcattatagagttgctttttgaaaaaagtcctatttttgtattttttaccttacaattattttcttctaaaatatttattctagtcttgaaacgggcatgaaaaaggcaattgagggtccagtatttaacacatttttgtcttttcagtgaagttataatttcttattcaattgtattatagaaaaaatttggtggatcttctaagctttttttgattcatttttttaaaattatctttgtttttgtttaaataatttgtttattttttattagttaaataataaattgttatcaacgatttaataaggcagatcatcaatttcatataaatattgtggaataaaggaaataaacgaattttcgccacgcattgactcctttttcaagagttaataagaattactttagtttattattttaattggatttcccaatacttcggttaaacgaaaaggactaatgcaaaaatgaataaacgtacgaattaatgggagaaaaagtgaatttaaagaataatcaaattgattatcaaactaaaaatttgtttcgtcgcgatcgatcaaaagtcgcgtcaccacggttttgtgaacaagtgttttgaattggcggatttttgctaaattttaaacttgataaaattatcgtaaattagattttattttattaaaaatgttctgtt

SEQ ID NO: 23129 - DNA, 923 bp, Heterodera glycines
  misc_feature (50)..(50): n is a, c, g, or t
  misc_feature (80)..(80): n is a, c, g, or t
tgtaaaggcaatcatttgtccatttatttcgcccgaaaaatgactaccgnaataaattatacaattgatatgtcatcaanataaagaaagaaaaatgagtgaatgacgaaaaataagtgtacaatattcacaaccgaattagtgagcagaataaagaaatgattttggcttcgttttaccactggaattcgttcgttctcaactttaatcacaaccaccggcccacacagaaaagtaaatgccttaaagcattgaatgcttttgtatttggtaatttaactatttttcctccaatttccactgcatttccaattgcattttcgtctccttttacttttaatatttctgagctgaagcagaagacaaaggcgaccgaaaaagtccgaattctctcttcagacaaacgatttaatttttgttaattgtctgaacggggaagagaaggaaagaacggagtgagatgagaatagagatgaattgtcaaaattggactcgcgaagaatcattgccggggggcgaatgccgccgcgcctttccgttgggatggtccgctgcttcgaaaggcttctcaaaatggaaaaattatttagcgggagcagctcgtttcccccccgccgtttcccccccgccgtttcccccccgtatcagttcccccccagctcggttcccccccgcatcgtttcccccccgagaaaattttttaaaaaaaaattgctaacttagaaatttttcaagaaaaaaatcttagaaagtttttttacaagaaaattctaagaaaaaaaatttttgagaaattttcagcgatttttttgaaatttttttgaaaaatcttagtaattccccataaaaatttcttcttagaattttcttgtaaaaaaaactttctaagattttttttatcggaaaatttctaagttagtaaa

SEQ ID NO: 23130 - DNA, 2076 bp, Heterodera glycines
  misc_feature (1048)..(1048): n is a, c, g, or t
aaaaacaaaataaatgggaaaaaatgaaaaagaaaaacaacagtaattttagattttaattatttattaccatgtcctttttgtatgtttcgaacaattcgcccatcagctctcttgcgacaatgggtccagaatgaccttcgatgaaccgaaaaagcagaatctgtaaaaaagaggcggagtgtggtgtcgatcgcaggattggaatttttaattttggcttttttgaaaaagacaatttcgtagttttctttacctctctcctcttacgaccgacgaatttttttctcacaaatcaggattagtccatcgtagaaagtttggaattttgttaagaactaaggaaaattttttgtatacatttcacatattttcatatttacgatcgacattttcgctgacttttttcctttcactcccccccccaccaacttcttacgatcgactaattgtaagagacccccatgcacagttatgtatttaagtgatccaatttttaaaattctcaagtgggataattgaaatgcatatgcactctgccttcataacaaacacaattcaccccgtctttgcgcagcgcgtgcttggcaaagtggttgatcagccggcggtcgcgtgtcttttttgagtatacaatttctctgtattttttctgtctgagcatattgcgcacagtattctcttgagtccagcaggggaatagcaacaggacgaaaaggtaataaacaaagttaaatgttgtcagaagtgcgactaggccaaagctccacctatgcgagatatatggtagaaaaatttcaaatttttgtatgcaattttgcgtaacttgggtttaaagcggtaattagatgaatcgttatgggcaattttacttatttattaatcccatatgtcagcttcatatcagcaccacaaaatcccgaataaaaatggaataaagctgatatggtcaacgaagtgagagatggtcaaaattatggcggaaaaagtctttgaacatacctacatgaatctctaagttaatagaaaagaaaaacctaaaataatntaatatttgcttaatttttgatgctgatcattaaaatctcttacacaaacttgatcagatcactccttcaaggtgacctggaaataacaaaatacgttggaaatcggggaaattttcagaaaaaccccaagagctggacaaattaaaaaaaaaaatttgagtaggcctattggaagagaatattttctacagtaaattacaagagataagtttatttaattagcatttgttaacgcagagaaaaaagtgcttgttcaaagactttttcaaccagtctaactcactcatcccaggaggtaggtgttgacagatcctggatttcctagattttggtcacttaaaaaacattttcgtttctttgaaaaaaatatatgtatcttgtagagaccggacgggatcgggatcccgcaggatttcttcgggatcccgcgggatttaattcgggatcccgactcgggatccctccgaccccagttgtccggtctcttactatcttgtgacttttctttggcgcctgctgaaaatcggacagtgtggtggtgagtcaacaagaaatcttttccaacttttaatcactctgaaatttgtcactttaatgacattttaagaggcatagattacaaaagccggaaacgcgaaatcattttgggaatccatatcggggggattttaaaatcgcttctattgcacttcagggtctagctaacttttactcagggatgatacttggatggagcatttaagttctagcgcaaatccaattaacaaattccattttgaaaattttcacgcgctgctatcggcatttttatatgcttcacaaaatgattttaaaaggattgagcatcggtcccgacttttggatgaaattggaatatttgaaaacaaatttgtttttaaggtgtgtggcgaaatgatgtacataaataaatatttcataagtttaatgactgccgacttgaaaaaatacagcacagggcaggaaaattgaacaaaaaccatccaagacatcagcgggagctctctct

SEQ ID NO: 23131 - DNA, 1965 bp, Heterodera glycines
ggggatctctagagtctggatttggcggagggttggcgaccattgggcggggcaatgcgccgaaatgagggcccggcaatgggacaagcggaagtggcacttttgagggcgtgggacggaacggacagaagtccaaacgcggaacacagtgccatcttttgaaacatttccatcgatttatttggttggaaagaatgcgtcgaggggaaaaatgggttcatcaaacggttaatgttgattgagttctattcattctgagaatttggccactcagttggaataaattccatgctttttcttccgtcggagttggcattggcaagtgatcggcacgcggacaaatccttcagcaaattctgccgaatttccctccacacgaacgcccgccggacgaaactcatacaaagtgacgcattcggaggaaaagctgaagcaattggaggaatgccatttaaaatgaaactgagaatggcccaatgtgccattgttttgctcacattgcgttgtcaatgccatggcaattcccttttttcgtatttgaacactccacaaaagtggcactgaattggcgattttcatcctgctgtatctccactagcgtgccattctgttctaaaatgcagctgattagccaaaaacggaggccaaccaaaaggaaagggaccaaccgcggccaaattgggggcgatggtcggagcgaatgaccgtctgaaagggactgctcaaaaaccgaatggatttgccgctttcattggcattgtgttcatttggctcactcactgtgcacacgttctcgtgactcggcaaaccgatggcatttcccgcggttcgtttccccgtcgccccttttccgccgcccctttttttcgcccaattttcggcccctccaattggcccctcctcccccaaagtgctcattccgacggtccattctctgtccgagggattcacttctttgggcgaaattgacggaagaaagcgatcaccgctaccgagagaaaaagctgattggaggggcgaataacgagtcaaaactgaaggcaaaagaaggggggaagggagggaatgaaatgggaaaggaaaggatgactcaccaaaataaaacgcggaagtgagagggaggaagaggaagaaggaagagaagagaaggggagaagaacacatggaaaatggaggggagagggaagagctaaaggggaaaacggaaaatgaaaaaaggatgatgaagaggaggaagagaaaagaggaagagaagaaagatgagagagaaaagaatggaggagaaagaagaggagaatggagaagagggaatggaagaaatggccttcgaagaatgaaggtcttaatcagagtcatttgctggttgtttcgtacggaagtttatggattagaaagtgcggctttgagcgaactttgccctgcgcaggggaactttcctttgatttgcgttatcccattttacgtcttttcattaaaaaatggcatttgaacggacaaaaacggaacacctgccgaaccgaagtggcaaagtcggagggggcggaggaggacacaaaacggactctctctctctctctccccccactttatctcctctctctctctctctgacgcactctcttctccactaactctctcctccattcgtcgttcgttaactcattgtctctattggcacttcggcaggcaatttgaaatgaattaaatgccaatgcgagcttttgagctgattaattgtttcttttttttgaataaataactttgaatggttttaaagagaaggaagaaaaacaaaagaaaaagacgaaaaaagagagagaagtgggagagaagagagagagagggggagggcgggggtggacacgtaatacgtaccagggatgacacggaattccgacttccgacttccgacatttttggggatgaagttccgacttccgagttccgacttccgacatttttggg

SEQ ID NO: 23132 - DNA, 1312 bp, Heterodera glycines
ttatgcataaaaatgcattttggctaatttaggagcctattatttttcatgaaatgcaaaaccatggggtcccccctatggtttttaatttcaaaattcatttttattttataacttatttttaaactcatggtaaaaacatgagataaagcacattatattgggcttaaaattctctacaaaaaagctcttaaacgattttttcataaaatcaactcctgacaagttattgcgccagaactgaaattgaggcctagcaaccaaaaattttctatttccaaaaaaatttttaaaaatttttctgaaaatgacaccaatcgatagagcatgaaaaacggttgcttgaaagtggtcttcgttttgcccggaaaaatctgcaaaaaataataaaattaaaaaacggaaaattttcgagggggcctagctcgaaaatttctgaaaatttcagaaatccgaaaagatggttggatagagctcgtcgagctctacaaaaaagccgcttacaccgacctcctcccatcaaaagccggggagttattccaccggcgctgaaatggcccaaaaaagtatacaatttttccacagttttccagaaaaactggtaagccctaggggttcggtgaagaaccaaaaaatgtgcaaaactttccaactgagtgcctttacgaggccgatttttcatttaggcctttaaaaaatttttgaatcccaaaaacggcaaaaaaaaattttaaaaagtgacttttcggcgcctggcgctcagttggccctcggatcggaaaatctatagttttcctgaatgcgccgtcaaaagttacccgcaaggtcgaaatttcgaaccccaaccggcaaaccgtaaggagattttgtttttggaaatgagttgcactgttattctaaagtatataaactagcgtgtggcgcagtagttgctcggtgtagacagttggcttggtgttgttggatggtgctgctgctgacatgagcgcttcgcgcaaaggacttcgttgctagtgcatgctcggcttcaaaattcaaaattttaataggcttatgtttttttcaaaattttaaaggcgacatttcagcttcgcggcctcagacgggcgcttttgcgtccgtttcttaattttgttgggcttggacggtcgcatcgcaccctatttaaattttgttggggtcaaacgggcccttcgcgcccgttttttaatttgttgggaattttcggcagcttcgtggccttaggactggcgcttcgcgcccgttttttaattttgtgggcaacattcggccgcttcgcggcctcagaacg

SEQ ID NO: 23133 - DNA, 413 bp, Heterodera glycines
gttttttaaatttgttaagctcagatcgggcgcttcgcttctcgtttttaaatttagttggtccttttcggccgcttcgcggcatagtacgggcgcttcgcgcccgtttttcaaatgttgttttgctctgacgggcgcttcgcgcccgttttttaaatttgttgagatcggacgggcgcatcgcgcccgttacaacgctgttagaagaggttcaatagtgatcagaagaggtacaactgtgataaaaagggtacaacagtgattaaaagaggtacaattgtgatcagaagaggtacaactgtgattaaaagaggtacaaatttgattagaaggggtacatcagtgattaaaaaacgtacaaacaatgattagaagaggtacaaaagtgattagaagaggtacatcagtgatta

SEQ ID NO: 23134 - DNA, 1727 bp, Heterodera glycines
cattttcgcacaaaggacttcgttgctagtgcatgcgcgattttggaatgaatttatggatgtgataagggattttggtctacaggcatcgtgaggacgcgatagaggtacaacagtgattagaaagtgggcattcaaatagagcatttatggtaattaaggaattgtttttaatcaaaatagataaaaaaatcgatgtgttatatttttcattttttaaaatataatacactttttattaatgaaaaacaaattatgaaatgtataataattgaatagttatttaaattgaaatgaaaaaaattttacaattaaattttaaaataatagctgaaattctttaattaaatataataaataatttaaatgaaaatcattattcatcaaaaaataatttaattaaactaaaaaaatttattattaataaaaccaaacatttaaatttattaaaagtaatgaaaattaacccaaaaaatacaaagaaaaataaaatacaccgcccggcttcgaactttcccccctcccaaaaaaatgatgacccaaaatccccaatcacacagggattctgaggtcttaagtatgtcagaagtaaaatctgatcacttattcgtgatcagcgtcctaaattggcccaaaagacatatttttggaatattttcggtgaaaaaatttttccactcaaaaatcctgtcacccccctttggtcccgaatgccaaaatcacttttatttttgtatctttattttaaaagatgataaaaaggtcgaataaaatttatataatagagcaaaaaattgcggattttttaagtatttaaaatttcaaaaacacctttacagaaccgagttctgaatttttttctgaaaaatcgaaaatttccagaatttctggaataactttttttgtttttgaggtataaatttcaaataaatctcataaaattctcccgattttttgctattttttatgctttaaatgagctcaattggaccattttgaggcgagttatgaatttttaaaatttaggttgaattttcaagggccaaaaattattgatttttcaaaatttttttaccaccctccaaaaaatccaaaacgcaatataaagtgcatattcgtgttcagcccctcaaattaccccagaaaagtattttttggcaattttaggagcaaaaaaatttctcacgaaatgcaaatccatggggtcccccctttggttttgcatttaaaaattcatttttattttatatctttttttatattaaagataaaaatatgggataaagcacattagatagtgcttaaaattctctacaaaaatgctctaagacaatttttcgataaaaccgcttcctgacgagttataggcccgggactgaaatgtcccgctcaagccaaaaaatttttctatttccgggaaaaaatcgaaattttttcaaaaatgccaccaatcgatagagcttgaaaaactatgttttgaaagtgcccttcgtttccctgggaaaaatcggcaaaaaaagataaaattcaaaaacaaaaaattttcgagggggcctagctcgaaaaattttgaaaattttcgaaattttaaaattccatctgagagagctcgccgagctgtacaatatgttttctgccgccaaagcgctcagcacaatcccggccgagttattcccgaaaaacggaaaatgccgaaattgggtaccaaattttgccattttctgcag

SEQ ID NO: 23135 - DNA, 3157 bp, Heterodera glycines
cattaaagcacaaaacgacggacgacgcgcacaaagtcagatcaaaaattggacaattgtcgcgaagtgcttcacgtaaagcgagctcagttttgcatcgaaatgatataaaaggaagagaataataaaacattttaaaaaatgataatttattaaataaaatatcattaagtggatttaatgacattgaattttcagatagtcttaaaaggggtgtgaaaaagggtgcgcatttggcacgggacaaggcaaaagatgcaaacagttacatgcacgagaagggacggcatcactcggaaaataatggtaaaacgacaaatgccaatgtgaaatttcgggaattaaaattttgatttaattaaaattcatttttaaattaagaaattccacgccatcattcatcatcatcatcaatgtcaaaaggaaggcattattcatcagcaaaagaagggaatcaaaacaaaaggagcagaaaaggtgagaagttaaattggcaaggaaagttgaccaatttggcatttatgtatttaattatttaattttgcaatttgagagacaaaaaatttgaataataagggggaaaagggggaaaatgtgaggaattttgaagaaaacgaacaaaaaacaacggaagagaatttggaagaggaaaaggaagagaatatggaagaggaaaaggaagagaaagagaaaatggaagagaaaaaggaagaggaaaaagaagagaaaatggaagaggcaaaggaagaggaaaatgaagagaaagagaaaatggaagagaaaaaggaagaggaaaaagaagagaaaatggaagaggcaaaggaagaggaaaatgaagagaaagaggaaggaggtgaaaaatcattagaaagtgaggaactaagaagaagaaggcccggaagaaaatttgggtttaataatataagcaaaagcgaagaggaggaggaagaggaaagtgaggaagaaaacccattggaagagaagaaagaaaagggagaggaaaaggagagagaggaaaacgggggagagatggaaaaacaaaatgccaaaaaggaggaggaagaaagtgccaaaacgggggaagaaatgggaaaggaaaatgccaaaaagggggaagaaaaggaaaaagaaagtgccaacaaaggggacaaaacgggcaacaaaaccaataatgaaaatagtgggggagaaaagcagaaagaaacagcaacaaatgggaagaaaaatgacaaaaaggaaggccaaaagaagaaaaataatgaacaaaatgcaaaagatatggacaaaaatggtaaaaaagaaaaaggacaaatggccaaggaaaatgagacaaaaagtgccaataatgggacagtccaatccgcgacaggtgccaatgccaacggcggagcagcgaaatggggcggacagcgggcgagtgccaacaacagcaaaacggtacaataattaaggggatttatttaattaattaatggattttttactgatttagaagcggcagccaaaacggaggaggatttatgtgttcagtgacaacatttcgaattcggcgaaaagcaaaagaacaaaaaatatggtgaattaaaaatcgttattcctccgaatgccatggcattttaaggatttaattggtttttgagttggacaatttaaattggtaaaatatgaattttaatgaaaaggcgaaatttgggaacaccggctgattaaattttatttaaaaatataaaaaaatcataatattaaaaaattgaagaaattgcttcgtttttagaatgagcgcggcgctgccatcgcacaaactccgaagcgtttgcgcccgacgccgcgtcgccacccgcaccaccgcgccacacgtatcatttacgcgtcccccgactttcccccggtgtacaaaggcgcgtacgttgacgaagtcgcgttcaatttccgctaattgtaatcgttttgcgattcaattggctgtatactgtacattcattgcaataccgttcttatgttttgcacctcattttgcatactgtgtatgcttttaccgtataagaaagtaaacaaaattgttgatgaaagcaaatctctcccaaaactgtttattagtggcatttgtaactcttttcatcaattaaaaaatgaaaatgccaaatgaatgctcatttgtcagattggtttcgtcctgcgcctgccaatgtccgccggccattcgaacaaaaacaaaacatgccaattagtgttcattattcaaatagccatactgaagttggacaattactgcatttcctccctacttttaaataatctttcactgagttgtccgcctgtcatttggtccattacagtttttcattggcatttaaaaaattaaagttaccataataataatttggcggtttccccctttttccccaatggcttcccattaaaaaaagcaaaaacgaaataacttcgatttgcatttgtaaatattcggattttttcctgacacacacaaattgatcagaataaattgatcaaaacttttaaaaacgacgaatttaaaaccgtaaaaaagtgccgtaatgcggaaaaatttgatttttttcgatttttaatgaatcattctaagagaattttctgacattttcgaaaaaatcacttaacatttgcttatttttaaattttttatttgtttgttaagcataaatttattaaaacaaaaagttattgtgttttctaatgttatcaataatataggaaaagggagcagtaattacatcaagaagaatgatttgtcatgccgatctatcccaaaatggctaaaattacgataaatttggtaaaatcctaaagataaatattccacatttaaaaacaatagacaaaaaaatgattaaatttttatcaaatttaaatgaaataatccgaaataaaatcaatggaattagcgagcggaagcgaccatttgaagataaatggcaaattacaaaaatggaaatgtaaattctacgtttaaattgctgactttgcaccttttatcccatttggcctcccccaaagggattcatctgctgaggcccgccttggccttggcccatgggattcgcttggggcatcatcggctgctgacccatttggccaaataggggcactccgaatggctgctgaccatcggcggacatat

SEQ ID NO: 23136 - DNA, 1662 bp, Heterodera glycines
  misc_feature (30)..(30): n is a, c, g, or t
actgagtcgacgcggcccggtactagtgcncttttattcctcctttattggtcacattttttcacaattttttccttcttttttattcgtcgctcattgtcttctttagaattaactcgcgaaaagcattaatataatttcacatgtatgtcgatttatgcaaagtattgtttctacccgaccactacttcctctaattgttaccccctcatcccttttctcgacatacattcctgatatttcgtgccgaccgccgctggaagaacctgactgttctgactgcctaggccacgaatgtggccaaattctatagaatatttacatacttcattttcgaactccgtcctctatttctacccacagtcaaaattttttataccacaatacatccttattgcccaaatcgatccaaatgcactgaattgtatagaaaatagggaatcgtggccatttcatgtatttgaatcaattttggacactaaaggagcatttgtgaagaatcaatttccgactttggttctaattcgggtccgggattcggatttggtcgaaaaggaggccggattcgtgatcaacgacatgaaaaccaatggaaaaaattttcgaaaaagggtgcggaacaaactttactatgaccaaggaattattgaaaaaaaaacaaaaaaaaaaaaaaaaattaaaaacccgaatttgctcaccatgtttttgggatgtggcggcgtcaaatggctgctgcaactaaaaaataaaataaatgattaaactttttttcgtttttttttgtttaaccaaccactgcatggcgtccaagggggtcaatgctgcggcttcctttctggcacttttcggtctgcgcgactcgctgcgacgggcggtggatgacaatggttgatctgatgagtctgaaacaaaatccattattttaataaaacatattctatataaaatgatgtgaaaagtattattatctaatttgaaaaaaaaagttattttcttttatataaaataattgtttttaaaaaattaaaagatttttataaattttatattataaatatataaatttaaaaaatatataattttaaataaaatgaaagtattaatttgataaaaaagtaaattttaaaagtagtgctgtttaggcaatcagggcttgaaaaaattcaactaagacttggattctcaagcataaatcttagaaaattagcattaagcacaatgacgaacacctaattagacacaattaccactataaaagcttttcaacttttaacaataagcaatgcatccgccacctgtggtgtctttcaagttggacatgtcgaatacgggacggcccggctggtcggtagtgaacacgaggttggacggttcgccctcgcccgccttgttgaccgcacggacacggaactcgaactgttccttctctggcaggtctttcaccgtgcagcgtgtgtcgcgcactgttttggcaccaggcacgccgatgtttgcacgtgtccagtcgtcgtcgcccattttgcgttgttcaatcacatagccgtcaattgatgcaccgccgtcatgcagcggacgactccagctcaggtccaccgtgtgcttggtgaccttgccaacgcgcggcttttccggtgcgcccggcgggctgacaaacggactgca

SEQ ID NO: 23137 - DNA, 1390 bp, Heterodera glycines
  misc_feature (67)..(67): n is a, c, g, or t
gataatgagctgaaatttgagaattcaaaagtgataatgaaatataaatagagaatctcacaattcnagctacttaatctctaaataaatactgcagcaatattgtagaaggatcgggttaataatattctctgatttattattttcacgaccatccttgtgaaattctcaaaatttcagctaattatcttctaaatataaactctaacagcgttgcggaaatattgagttaatagctccaataatctccgacttattattttcacgaccatctttgtgaaattttcacattttcagctcattttcctccaaattatctgtataaatttgctcaagtaaattgtaaatcggaaattattagcgtttatcaactccatacttccgcaacacttatacagtttattttgaggggttaatgagctgaaattgtaagaattatacaagctggacaaaccaaaataataaatggaaaattattggcgcttatcgactcgatccttctgcgacgcctatacaatttatatttccatgataatgagctgaaattttgagaatttcaaagtgataatgaaatataaatagagaatctcacaatttcagctacttaatctctaaataaatactgcagcaatattgtagaaggatcgggttaataatattctctgatttattattttcacgaccatccttgtgaaattctcaaaatttcagctaattatcttctaaatataaactctaacagcgttgcggaaatattgagttgatagctccaataatctccgacttattattttcacgaccatctttgtgaaattttcacattttcagctcattttcctcaaaatgtatctgtataaatttgctcaagtaaattgtaaatcggaaattattagcgtttatcaactccatacttccgcaacacttatacagtttattttgagggggtaatgagctgaaattgtaagaattatacaagctggccaaaccaaaataataaatggaaaattattggcgcttatcgactcgatccttctgcgacgcctatacaatttatatttccatgataatgagctgaaattttgagaatttcaaagtgataatgaaatataaatagagaatctcacaatttcagctacttaatctctaaataaatactgcagcaatattgtagaaggatcgggttaataatattctctgatttattattttcacgaccatccttgtgaaattctcaaaatttcagctaattatcttctaaatataaactctaacagcgttgcggaaatattgagttgatagctccgaataatctccgactatattattttcacgaccatctttgtgaaattttgacattttcagctcattttcctccaaattatctgtataa

SEQ ID NO: 23138 - DNA, 2441 bp, Heterodera glycines
accaaattggggcaatttcaaattaataatttaattaggctttctatcaaacatgtgagctttgtacaatttccccatgatattgcgtaaagatagtttcacatttaatagttaccaaataattaaggagttttttttaatatttttcaattacttaaagtaagaaaatttaaaataataatgctattcgaattattactttctaataattttctataaaatattttttgacttttttatgccaattttgccattaaattcttaaatatgcaatttttaaaaccgaatttaattttagagtctatagacgttgcctggataatttgaaaactcagaccgaaatcataaatgtccagtaatctgagaaacaaaaacccaagatcgggaagcaaaaaaaaaagcgggatgcccgaattgggaatccgagccatggagcataggcttaaagaatggcgcagactcctaacaaaacgtattgcccaactcccaccccgttagataaaggtgttgcgtgtcagggtaattactttgttaattgattatttgaatgttaattatttgcaacaaaaaatataaatcaatttacagtaatgtcagaaaattaaaataaattaatcaaattcaagaaagtgctttactaataaattattcataatgaaaaggccttcttcggttgtcgcttttggtagtcatttatttgtcggctttatcctgttgtcgcttttcattggcactttgggcactgagaaaaaagaggtgaaaattaaaatgtaattaataaaaacttgaaaaaatcgaatacaaaacaaatatgaaaatgcgaagcaaattctgtgaaaaatattccattttctgattatatttcattttttaatttaatctttaaatttacttttaatagtaaattttctttgcacaattcagacgaaacctgccgctgctcattctcccgccgatgtaagaaaagcattaattattttaagttaattacataatttcatttgcattttcaggccaaacatccgccgccagtcgccgcccacgcggccgctggcgccggccacgcctccgatgtaataaaataaagcataaatatcaggggacattatgtattgtttgttcagccgaaacacgcttctccttctcccgctggggctgctgctgctgcttcccacgctcatccgcccaatggcggcgccgcccacgcggccgaagtgagtcgaaatttttagagaaattagtacaaattaatttgaaaaattaaaaggcaatttaagcagctcattagcttgttgatttttgtgctttttcagccaaaacatgctgcggctcccgctatcaaaataactgatgtaagttgggaaaaagcacttcccaattttaattaattttaaattgttttaattaattttaaattgtttaattaatatataaattattttgattaatccttaaattatatttctgattcacaggaggccaacaatgtttactcggtgtgtgtggagagagacgttctgccggcgccggaaaatgcgtcaaaggacaaattgaaggcaatcgctgcgaaatgcgacgaatgcggggcggcaaaatgcaaagcgaaatgcgggggcaaagaagtgaacgacgcatgccgaacatgcattatgcaaaactgtccaccggcaaaataaaaaatagcagaaatgaggagggaaagaaaggcaaaaacggcacggaaggaggacaaaatgatggcacgacgagaaggaatggatgaatgaatgcacataaatgaacaacatttcacccactttttgtgatttgaattggccaacagatcaccacttccaactgatcattctgatcattcatgccaaaaaaacaatagtccataaataaattatacagaaaagtcattaggccgctattttgggtagaaaattgtccatgcataagttggcacactttctgatcggatagtgaattagttcaggagattaaaatgggaatgttcaaaatcacattttgtgtgtttgagatttgcctgtaagatgcttaaccgcctcccaattggagggcatatttatttttacgaataaaaagaaattaaaatcaaacaaatacaaaatttaaaaaaataattcttttaggtacaaaataatatatgaatggttgggttggatatgtacgatttcagaggtattaaattatataaagtatgataaaataaaaaaggaaaataaatgagagaataaatgatcgaatgacggctatcctttgaaggttttatcttaatataaaagattattttgcctttaaattgcctcccgtaatttggggttcttcgttgtttaatttcccgaaattattttttatttaattttgtaaaagaggataaaacggaaccgtagaaaaatgggtaattttggataatttaattaaattattttcatgag

SEQ ID NO: 23139 - DNA, 1287 bp, Heterodera glycines
gtcgataggcaccaggtatggcacggaaagacttccgttttccgacatttttggggtaggaattccgacttccgaaatttttgatgaaaagtcggaaattttttaaatttttcttttcaaaaaactagcaagttttgtacaatttctgttaataaattgaactgaaatttttaaaatttcccggcggcgcctatcggcaccgccgtaccctcctccaagttcccaaaaagtttttgaaaaaatcgcgctgtataaaacgtgtaaaaatagtcactccttttcccaaaaatgttctaaaataatgaaaaatgacaaaaaaaaatttgataaaatattgaataattttttcaagcgtatactaaaaacatttgtgaaataccttttatttggttaagaattaaaaaatttagcctattaaaatatttagaaattttttattatattgtatattttttgaaaaatttccgatttccgacgtttttggggtcggaattccgatttccgacttccgaaaatttttggggcctcggaatgccatccctgatagggaccgccggaccctctgttcctagttttttgaaaaattgcaccgcaaaaaagtgggtttgaaaagaaaaaaatagtcaatttatgaaccgttaataatttgatttccgatcaactttttaccgtcggatccaatcgaaaaatcttagtcgacccatcaaccccttttaatgcatcccgccagcccttaaaaatttatttttcagcattttttgatttttggaaattttttgaatttaattgaaattttttcgaattttccaaaatcccgcaatcccgcgcgggatcccgcaaattttaaatgcgggatttgcgggattaatcccgcgggatcccgtcccgcaaagaattttcagtaccaatcccgcagcgggatccgcaaatttgaaatttccgggctctagttccagtcatggaaaccctatgattttttgtttttcagacagtttttttcggcgcgattttgtcactattttacaaaaaaatataaaatttatggcaaaatttggtctttttttggacaaaaatctgttaacaaatcgtattaaatcaccatttttttcccgggcggcacctatcggcgtcgccaggtcccctgtcctcaaaaatttttggaagaaagaccccgcaaaaaagggtttttaaaagcgaaaaaaaagtcgtcgcttgctttttaattgcaaaatgggatttttttggggaaatctgttaacaaatcagaacgaaattacaaaaaaattt

SEQ ID NO: 23140 - DNA, 1454 bp, Heterodera glycines
ctatctctttttttgataaattttatacacatacacatgttctcgagcatgatagggagggcggtgcgcaatagaccttttatttttgagggaatttttaaatttatactctatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgataaattttatacacatacaaatgctctcgagcatgatagggagggcggtgcgcaatttaccttttatttttgagggaatttttaaatttatactctatcccagaaaaatggctatctctttttttgataaattttatacacatacaaatgctctcgcgcatgatagggagggcggtgcgcaatagaccttttatttttgagggaatttttaaatttatactctatcccagaaaaaatggctatctctttttttgataaattttatacacatacaaatgctctcgagcatgatagggagggcggtgcgcaatagaccttttatttttgagggaatttttaaatttatactctatcccagaaaaatgtctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttatatttatactctatcccagaaaaatgtctatctctttttttgagaaattttatacacatacaaatgctctcgagcatgatagggagggcggtgcgcaatagaccttttatttttgagggaatttttaaatttatactctatcccagaaaaatgtctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggag

SEQ ID NO: 23141 - DNA, 992 bp, Heterodera glycines
gggcccccccaacggccccttgaaaaaattgatttttttttttttggggccagtccccccgacccgatgcccccagatttagggggagaccgaatctttcgggaatagcttccctataccctgtcctttaattcggcgttggatttttcctccccataatttttggagtcccccaaacggccccttgaaaaaattgattttttttgttttcggggcagtccccccgaaccgatgcgcccagatttatggggagaccgaatccttcgggaatagcttccctatagcctgtactttaattctgcgttggatttttgctccccataattgtttgagtaccccaaacggacccttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaacgaatccttcgggagtagcttccctatagcctgtactttaatggtgcgttggatttttgctcccccataaatgtttgagta

SEQ ID NO: 23142 - DNA, 1474 bp, Heterodera glycines
ggtctctccagcgttggaaaatttaaagagtaatgtacgtgtagtaatttaacaaagtgaaaaacgttccaccgattccaaaacaggaaacgaacggaaacggtgcgctactcgctcagcaaagtcaaattcttcggcccagttttttcacgaataagaaaattaggcaaaacatcaaatctcgcgcatccttcaatacgaaagagagtagatgggacaggacaggacagcctcttccaccacataactcctagccaatatttcggtaggggtggacagatctctttctaagtaggaattttcgttcttttctcgtattaataaacaaaaaacataatcaatagtagggattattccagttataactaattaaatacctaatttcgaaagatttttaaaatcgaaaaaaattttcccaagagaaaaacaaattagggtgaatttgaagaatgggtaatagtactgatggtatcacaccttttttgaaatttttttaaagaatttcaaaagtcataaaaatatttattataaggttttcggggtcgctgagctcgaatatggcatccatttcacccaattccgaacccctgatccgaattcgaacaaaaatcgaaaactcaaatttttcgaaattcacatttatccaacaaaatcgctccaaacgcaaggagattcataaaaagcagaaacagcctttgttttaacgtttcagttctttttttaaacttattatatggctgctgtgctagaagaacttcggaactttacggcccaaaaattgcacgcgaaattggcactagaagacaatgagtttgaccaatggcttgaaaacatggggcttctacacgcacgtcaaaatgttttttataatttttggctgcatgtctctgagttttatccatgcgaacattgaatttttttttgtttttttttcttttttcgtgcgtttggagcgattttgttggataaatgtgaatttcgaaaaatttgagttttcgatttttgttcgaattcggatcaggggttcggaattgggtgaaatggatgccatattcgtgctcagcgacccagaaaaccttctaaataaatatttttgacttttgaaattttttaaaaaaatttcaaaaaaggtgtgataccatcggtactattaccgagaactcttagggctatcgaataccaagaatgtctaatttagttagcttcgagcaaagttatggccagttttttgttgaatcttttcatttgatggtttttttataacaccctttttgatggcttttttataacggctcagcaccatctgttcttatttttaagaaatattttgattttggggtaatgcccaaattttgtttttgaaattttatggcataatgtcactcttttaatcaaggaaatataaggtttgcgcaaaatttggtcatttttgggcaaaaaactgttagcaaatcacattaaaaattacaatatt

SEQ ID NO: 23143 - DNA, 953 bp, Heterodera glycines
tatttaattaattaaaaatataaattttattaaatattttcaataatattgtttcagatgtgcgggttaaggatccgttcccaacaaaaattacacttaattaaattacacccctccaccgggtcacattgcactaatgaggaaactcgctcccccgccaaagaataggtaacatggcattcataaccgctagccagcaaatcgggtgggagtgggagtaaataaggggtcgagtgtcctctgctgctgcatacaccctcacaacagacaagtacattttcagcctgggggttcaaaaacacccaaaccccttcttcgtcacacgaaaggacacgtgccgcggaatgtactccgcttgcccaaaaaacaccaaagccaaaatagtcatgagcagggggcccacttaaaactggatgatttcccttttctcccgtcgggggcctgcccaattggtggcggagggcggtcagcccatttgaattgccccggggccgttttcctcccctttttggcccttaaatccgttactctttcgcctatcccttctttgtcggtgatcgtgggcgggggtgggacttcattccattctgcggtgcattctaacggtaccaattgattaatcggccgttcccattctctccccgttcccagtaatattttagcgctccgtggcttccccgcgggaaacagagcgaggattcgccccaagagccagtgattcctcgggaattcctcctgttccacaagtacaacatccccaattttgggagggccaggagcggagatccttgggccggaatgggtgtcctgggtgcggcccctcaaaattagaagctactcccggctccaaaccttccaaaaacgccggagggactcattagtggcgtaccataaatgggccaatttctcagaggaagaaggctggaatgatagttccggttcgtccggctcaa

SEQ ID NO: 23144 - DNA, 2783 bp, Heterodera glycines
gcaccgaacaaacgaaaaaaacggaaaaatatttcggaacttccttgtgaccaaaagtaaaaccaaattaataataatattttaatagtaattaccattttacagatgctgaaccacttggaaacgaacttcaagaagcgctttcttctgccgcatttttggacgattttatgccatttgttttggcatttgaatttgtcgcaaaattttgcggagaaaacggcggcaccaccaaattgtgcaaagagaaagttcaattttcatatttaaaattcataatgtataaataatttcatttttagtgcctttcccaatcattggtcgccccaaaaacaaaggcaccgtttgttggcccaaccaaattccatggcacaacgccacgctctgtgccaaaaaccacttttggcattgtgccaacaactgaacaaacttttgcctttaagccatttgtgcggcatgtggaccattttggcacgaattgtaccaacattttcttcacgtcggaagtggacaaattcttgttgaatatcaccgcgacgccatacgaaattgcatgcaatgactatgaaaaacgtgccaaaattgacgagccaataccgtccgattattggtcaggcggacgctttgtgaatgcttgcatggcggtgccaagtgcaaaatgcgaaaagtgatttttggaatttattttttttaaattttaaatttgaaggcacgtcgaactttacgcatgctatgaaagcattggcaataagccaagtgtcaatgccattggcgaattgtgccaaaaacatctgaacaatgccataaatgccgctggttttgctgttcaaatttgtgcacatcggcaccaaacggaggcgacgaatgagctcattgttgaatcgttcatcaacttttcgttcactaatgagccgtttgttaattaaataataattatttttttattaattttattaatttaggttccaaaagacgcgcattttgccaatttcaatggacaaaatttgggacacaaaaaagaaaacgccatatttcctcatcgaatttggccaagacgagcaaaaaagtgcaatccgagaaaagggcgacggagaaaattttggcggcgccaaatggcttaatgaggcaaaaagcaatgttattaatttttaattgttgtaatttagaatgatggcatcggctccattctcaaagacattgcgccacaaatagtcgacggcactttggcaaaaatgattcattttgtgccgccgtcgaacgatgacaaaatgctcccatttttccaaattgaaaggcccaaatattcaaaattcataaccaacgacacggatttgttaccttacaaaaatgacccgaacaatacaagtcaggaataaaattaaaaatattttcgttttggcatatttttagggagagcaacaccatgtgatatatacggcgcagattgtgtgccgatcagaaatttgttattgaaaattgaggcattggaaaactgtggaaagaacgaaagcgaaaacgatgcggtaaaataaaaataaaaattttaaaaaatatttaaaaatatttttagatttttaaaatgccaccatgggccccaccacttccgccaccggtgaccatgaaaaagccatccgaaacattgttatgtggaggggatatgttttgcgacaaacgaaggcttcaacaacagtacaacagattgagggagagtgagtcattttaacaaatatgaattaattaattaaaatacctaattaaaaattcaaattcacagtttgtgggcttaagcccgaagaaatggagaaccagcgcgaaaaacgacaatacgacccataccaaaaatggaccgaatccccgatcaaaatcgcattcaacaaaacagctcgtaataatcttgccacatcatacagtatttgaacaaatgttttaagtgcctgaaaattatgacctctggggcaatgccatcagagctggagcaaaattaattatgtatgaaatgatgggttgaattttttgtattctgagaatgatctttttaagtttggttgctttcggagcgtttgtcggggtttcagccgagttttttatacaaaaaaatgggggggggtggaatggaaagccgggagttatgaggaccagtgatgccgcgggttgagaaaaatttcgggtttcgggtcgggcactcgaaaaatttcgagttcgggtttcgggttgagaaaaacttcgggtctcgggtttcgggttcgggttggcatcactgatgaggacgcaaacccgaaggctcaattaagcaaaagcgacaaaaagtgccagaataaagtggacagacagtgaatgctgcgaatttttaaaattttcattttccaaaaaagcaaaaaatgcatatttttaaaattcatctctctttctataaacagggaagtcacctgtgttcggtttgaaattgttgatgaaatggtgaagggacagaatggcattgcgattgcagatgatgagcttggcggtattatcgtattattcatatatttttcacttgtcccaattttcattcataaaatttggcacattttattttttcaaatttttattaattttacccttttttgtagcctgcggcgtgtccccagtgggccgtggcggaggatggcaattccttcccctggcaatgactaaccgaacgtgcacggatgtaattttggcagcatttaaaaaatttgcattccctttttggcctcggttctcccttttggccaaggtttttttttccatttccctcccatcgg

SEQ ID NO: 23145 - DNA, 1961 bp, Heterodera glycines
  misc_feature (32)..(32): n is a, c, g, or t
tttgttgttttccaaaggttgccttcctcgancgattatgccacttttgttttatttatctgctcttgatctgatccttatttatctttttgatctgatatattctgtttgatcttgattgtaacaatttacgaaatgaaatctgtccatttttatgttgacatttttgggggaaagagaggttcggtgccagggaagaatgaaagtgagatgggtaataatactgccgatgatcaccccaaaaagttcgaaaattttcaaaattcattttgtgttcgacctgtactagagaccggacaactggggtcggagggatcccgactgaatcccgatcaatcccaaagatttttttcgggatcccgtaaagtgcatcggttggaatcaatcgattttaagaattttttttcagggggttttgcctaccccgcaccgacctcggcttattgttcattttctgggttttctccgaccccgacctcaacttcccgcccaagccgacctggtcccggccattttgaccgggactaattttttttttattattcttgacaaacgagttaaattattttggcaaatttatttttagaacaaaactgcgcactcaaaatttaaaaaaaatcatttttttaactttttttatttaaaaaaaagaaatttaaaccaattataatatagcgaataatgaaaaggtcaacaattgtttggttaagttggcgcaagaaaaggcagcacattttaaacttttatctcaacaaaattttgcatcaattaacaaattccaatggatttaagatatttttaaacttcgaattccgtcgtaaaaaatcaatcaaatcgaattttttatgggaatttctcgtttaactgagacgttcgatcatttcgctggtccaatccttgcaatttctgtagatcaaatcgtagttcttccacatgccatcaaacacgcgctgaatgccatcaaattccgtggtgccaatgccaaagatgggctcgtccccgtaagttttcatgtaacggccccatcggtcactcgttacgtcttcacacacaatttcgtaagttctgtaggcaatttgaccacaaaggccgcattcgaagtgcacttccaaagcggtgtgagtaatgtctgaagaaacaatgaatgaacagcaacaatggataaaacaaatccattttaaggaaaaaatgttaatgcgatttttaaatgagatttcgactcaaaataattttggaataaaattataaatgcggcaaaatttataaattattttttggttattaagtagggctaacatttccaagcatgaaagcagaatccaagtaggtatgtacttagaatccaagtgcagaaaaaattgatggaatggaggaatggggagttcggggatgagaccagcagagggctgcacgtaattacggaaatatgagacaccattcggggacgggaactttccccgaaaaagtgccaaaatgccagtcgagggagcaaacctcacacatttcaaaatttcaatacattcgttacattaccttgtcccactgactgcagttgtggcctagcaactagctcatttaccacgggaacaaacagaagcggagcagagagcagcccaagcgtaactcggccggcatttgcccatcttttggtagttcggttcataaagtcacattcaacctttaacaaaattgaaaaattcaacttttcggttattaaatttgttttttaaatttaaattactcggtagaattttttggcacgcaaatacgaacaatggcaggcacatggcttctcctcattttgccaatttccgtggatgtccgggtcataaccaccttgcttgtccttgcccattgccaaaaatatcaaaacaaattctaaaagggagggggcaaggcataagcttcattagcaaacgaatcagtgaaatttttggtatttggtttaaatttgaaataac

SEQ ID NO: 23146 - DNA, 2060 bp, Heterodera glycines
  misc_feature (1953)..(1953): n is a, c, g, or t
  misc_feature (1971)..(1973): n is a, c, g, or t
  misc_feature (2011)..(2011): n is a, c, g, or t
  misc_feature (2015)..(2015): n is a, c, g, or t
  misc_feature (2025)..(2025): n is a, c, g, or t
tttaattaaattaaaaaataaatttgtttattagttactccacgagcagactcggccctgtgtgccaattgtgccgtcagtgcgatcaatgcgacagtaatctggtgatatgtcctaaaattttaagaaaatttgagatggatatttctcatgtgtgatggcgctgagaaattcagttaaaaacatttggaatgagtgcaaattcttgccaaaaaaaaaaacattatttcggtttcaacacagagaacggacaaaagacctacaatttttaatgatcaaattttaaaaattaatctcacctaattatttgcttatcgtaataatttaatgaaggtgtttttgttgaatattttaataaagaaattcatttcaaatattaaaaattaaaggaaaacatatataaaaattgtaggttttttatccgtgggtcttttgtcggtggtgtggtcaattgtcttgtctgcggctcttatgtcactacgccattctctcaagaagctgatgcaaataatttaagtccctttaatcctcgctatggtttatgaatttcggaaggagctcatcccactcgcgcttcatttacgctccagaaattgtttttcaaactgagacattaaacatttttaaaatcttctttcaaaattccttgttcttatttaaaattttcaaattaaaaatttattaaattcaaattaaactgatgccccccccaaaaaaaaaagttttccatctgaccaggaaaactaagtcagtcagtgctctgtttttcctccgttgttgttgctgctgccttcggcctctgctgtcctccactcgcattggctcatcaaattgcatatttccgcggctgttgatctgaatacgccgtgcctgcttgtactttgtctgaaggatgttgccaatttgacggattggaggctaaatgcattttttaaagataatgaatgtattaaattgaataaaattctgtcttaaatttgggtgctcggtcgaacttgaaaaagtgtcaatgataaataatatttaaatttaattttgatttggaatcataattttattttataatatttaaatttaattattgttcaattataattttaacaatcgattataactttaacaataattgtaatatttaaattattattatctgaatacaccgaaatttgtaatttcggtgtctaaagaaatcaaaattccaagccgaaaatgtttccagatcattaggtattattatgatgagaatgaagatattttagctgggttttgtaactcttttcaacattttcagaattagtttaaattttggcatgaaatttctttggcataaaggctgattttatgttaaattcaatctctattgatcaatgattgatcgcttttaggatcaactcgggatataaattaattaaaactggcatgcccaattatttacacaccaattgcatccaacatgtctttaaattgcatgagccgctgaaaaaagcatgcatttatgatggcattcaaatttttttgttgttgacctcactccatggcatttgcactttggctttgcatgtcgctttactatctgaaagttaaaaaaatatatttcgattttttatttacataaatatttttcgcatttttcgagaacttcatcacaaaaatgctaaaaatcaaaaatcacatcccgactaagaatggaaagatttttaaaaattttctactaaatttatttttttcttgaccaaaatttttgatttatgaatttttaaaatctggaaaatgtgaattatttacaactttaaccaagtgcataaattctttgaaattttttcatcattctcattgcattattaccttcctgccaacttcgttgttccatcggttcatcaacgatcgtccatgccattccgcggatcgcttattgctctcctccttttcacgtacatcaaatgaatcgcttanattgctcttcattaattnnnattgtcattgtattgtctcttgagccccgaatcgaganttcngtattgagtnagaatttagaaaaaaaaactcaaaaatcaggaaaa

SEQ ID NO: 23147 - DNA, 1484 bp, Heterodera glycines
ttttggggtcaccgaccacgaatcttcaattatttgaccaattccgatttcctaatctaaatttgaacaaaaaatataatttgaaaaattcaaaatttcgatttttatttgagttcgtgttaaggattagaaattagtcaaaatacatgtcagattcatgattagcgacctctaaaatcccggataatattctttcctgctctctcattcaaatttccctcattttaatgaacttgttgaatgatttccacaaaaagaggtataagcaaaacaaaaaaattggaaattcaataatttttataaaaatttctatgaaataatttgcgatttaattttttatagaaaaaacttactaaataaaataatattggagccttttttctcgcttttacaaaaaagaacattttttgtttaaatttaaaaaagaagtagatgaccacatttttaaacaaattgacttcttctgcttttgctgctgaccgtgttgagaaatcctcaaaatggcaaattgcgccggcgccgaaaagctttacctgtaaattttttttattcctataaatggctttttgcttaaaaattccataaaattacttgactgagaattttaaaaacgaaccttaatcttcattttcattaaaagcgatgacgaagtgagcaatgttcgttagtcaaaaaaccatcaaatcagacatttgacattttcatgtcttttagcgattactttttaaaatcaattaagtaataaatttatgtcgccaaagcgacacaaatttctttgaaatttcttttatttttgatccttttcgtcgatcaattttctcccttcgctcgctcctttaattatgactcatcttttcttttctccatattttcgctatgagtcatcatttttgagggaattttttccctttgcttgtgcacatttcttcacgtgcctggccccgcccccatcgattgtgagggtataaaagcccggcccattctccattttcttgactctgatcaatttttgattaagtcagccggacagttttctgtccaagcatttgcattaaattgtaattgtgaatatttgaataaagattaagaaagagtcttagtcttttctctatctgtaaaagggacgctcaggagccctttcatacagatcattaagccattgacccccgttgggtcaaagaaaaggcttacaaaaggaaaggagaagcattttcctcctttcaaattgtcccttcagtaaaggagaggaatttcctcctttaatttgtccctttggacattcagtgaatttctgtcttttggacagaaattcgctttgcttaaaagactccccccttctgccgggagagtctgcttccccttctgccgggaagtgcaaatttttgtggccttttgcccacaatttaatattttttaacaaacttttcataataataatatttattaattagaaaattcatttgattaatgtaaaacccatacat

SEQ ID NO: 23148 - DNA, 1616 bp, Heterodera glycines
  misc_feature (1467)..(1467): n is a, c, g, or t
  misc_feature (1522)..(1522): n is a, c, g, or t
ttttattgtttggcctaagaacaattatatgcactttttcagaagatcttataaatttaaatttttttgcaagttcggcttattaaaaaaagagaaaattttcccgttcaatcagttcattccgagttggacttgacttaaaaataattttaaaaatttttattaaccgttaccgatcagttaccataaaaagtttgaaaacgggttacggtaaccgggcgttttaacttatttctgtctttgatttgacaaccgaatttagtgatcccaattgttgtggcccattttttgttgtggtgttggtttgtgcgcacaattcaaatcctgtcaaatttgctgatgttgatgttgctgctaatgatgccatttgctgtttcatttgttgtacaaatgccaatatttgttggccactgaattttgttgcgctaacgccccgcggattcattccgaccgttaagcatttgttcagccggcacagtttacatgttttatcttgtttatataaaaattaaacatttattccaattttaatcctatctaatataccatttaactttaaaatattacattgttcaatatcacattctcctccattatcgcaattatattccttcatcttcgaaattgaacgtcgaaaaaaatgtttgcaacctgaatttgtaaatcccttactatatattttcgcttcctttttccaaatttgtctccaattgtatcttcgaatggtttttgatgctttttctcgtcaatttattcactatttttgtgcagtttttgttttgttttttgctcattaattcattcattttttgctctctttaaattaatttttttattttttataatatgtaattcatttccccatttttacctcgcttccttttctttcaaaatggcattttgcagttgttcccaagtgtccaattgttggtttttcagcttttctgcatcagttggagacaattatccttgtaaagatttactagttgaaagaataacttattcattatctaaaaagaattaaaaattcactttaaatttgctaatttaaattgaacaaagatttttgtggtaagaattttttcgttttcgaaagtggtaatgaaattgtaaaatgagagggcaaatgcttacaaattctattattaaaaagaagccaactttcgaggcgttcgggggtaaaattagttttttttgtcccaatcagttttcattctgctcaattcgtggcagcatcgtcatgcttttccgtgcaaagaaccgattgcacatccaaaataacaatttccggacggtcagcaccgttcactgaaatgccggcagaagcgaatgatttgcccgggtaaaggtgcacattgttgggcaatgtgaacaactgttgctgatcagcagtgccattgtcagtggcaagcggaacgatgccccaatgatttgccaattttgactgaaaaaaatatatattatatnatattagttgtgaactcctagggacaccgcaaagtacaataaaacaaataattanaatatactcagaatttttataatttattttttattttaattgactttgactcaaattaataaaattaaaaatgaaaatgtcacccgtttcggca

SEQ ID NO: 23149 - DNA, 1054 bp, Heterodera glycines
  misc_feature (18)..(18): n is a, c, g, or t
gatcagctcgtaaaatgnaatattacatactcgtatagaaaattctgaattttcatatatgctctattttattacaaatttccttctgtctttattggatttttaccggcaaaactgatcataaaaatttaagtttccggtgggtgaatgcttcatttctttcatttggtggcaaatcgctgttgggacttccactgggcttgtacttatttcttcgattttccctccaaagaaaccgattcttcttgaaatgcttgttcacacatttacaagccgtagcctcagttttgtactgtattgtattttgcctaaaaatggcaaaatttgcgggaatcggttccactgttggggtccaagttgggcaaaaggggtcagaaggaatagaccagagacttgagggagcatccgataggcaaatcattgggctaactgcagtattagcagctatatttggggcaaagagagacagaattgcaataaatgccattaaaattgggctggcaattcttgccgctgcaaatcttccaccaaagctcactcttctcccgggggatcccgaattattaccgtatcccctagggagcgtattcggagttggtgaccggcggaattctcgttcatttctttgttcccttccgttcacaaaacgagaattttctccaccatttgaccctctgttccaatgtctctcattcccataatattcgttatttctttgtggcccgcggctattttgcctttcatctcttttctttgttttgcagtccctcaccaaatgcccagggcgacggcaataatagcatcttcgtctgtcgggccctcctttgacattttctctttgatattgcccaaggctcaatgcctcaacttttgaggataattctgcaacagagtcggctacagaaatttgatttgttctccgggatgccaaaagcagttcaaaatgttgtgcgagttcgtaggcacccgaataaactgtttggtcttcccgcctttacctcaaaattggagctcgggaatgagtctttccatgaactcctccataagctttttc

SEQ ID NO: 23150 - DNA, 985 bp, Heterodera glycines
  misc_feature (192)..(192): n is a, c, g, or t
aaaatttcttttttttttgttttaaaacactttttttgaagacacttagtcctttttcagcacaacagctcggctggaaaacacacttgaccagctcctttaaatttggtgattggcacaaacagcccggctggtagtacacaacaaagaccagctcaaatttgatggatttggtttgggcacaaagccttnaccacagctgaactgcttcagctagtcttgcttagccttttgaccttctcccgggtcgtggcaccaaaaattgttgtgtatttgactaagcttagactccgatgtgccttatttaattccaactttcaccaaatattaacttttccaaatgcccacaaaagggggaatcaggatgagaatgggaaaagaatggttaaaagcgagaggcaattggggagcttaaatactgacataatgggaggggccaagcgagtgacattacaaaatggttggccaaagagaaatgggaaaatgggtcaaattgagtgatggatttgtggatgaatggcaaaggaaatgttttgggcaaaaatgagaaaagggaaaatgtccgaaaaatccaaaatgaaaactgaactgaatcgaaacccaacaattttataatctataaaaataaaaaaaaacatcatgaagctagtttttaaacagattttactttattagatataaattttttaattacttttccgtacaaataaatatttatagatttttttgtatgtttttaattattgtattcacagcatttgatttatttaataattacttctgatcattttttattacaattacatcaaaatctattattctttttagccttactatattttttcgcaaatttatttattttttattaattattatatcatttaactcttgtgtttggaccgatgaagtattaattcttgatttcaaacgaattatagcacaataattatctttaataccttattgtggcaattaggtaaataaa

SEQ ID NO: 23151 - DNA, 1499 bp, Heterodera glycines
  misc_feature (27)..(27): n is a, c, g, or t
tttcagcagttttgccagtaaaaattntagcgtaagttaaaaagggttaaaaacttacagtacctccagtaacagtaatgtaaaaaaggaaaaatacaaaaattaatcaataaacgtttgatcgttaagcagctatttaattttgtgatcttttctaagcttaattaaaaaaaaatttgtatgtaattgggtattaaaatcgatacaactgagtttttcatacgattggttttgtgcttgatacctaggaaataggcactaataactcgaaaattactctaagaaccgccaaaaaaacattttcaaaaatttcagctacataataacaaaagctgtaacatcgttgaaaagctgaacattaggaacacgaagcagttcaacattgacattcgcgtcgaggagggcaatgggctgttcactgtgacatttgacacgggcggaaaagcgacaaaatgccaatacagaagcccagatatgccaacatgggcagtccaatacataacagtgagaactgaattagcccaactaatttgaaagaaatggaaaaaacatttataaaggaatgaatttcaaaaagtcagaataaaaatgggggattaatcgcaatttaaagctatcgcaattttatccaaagtgctaagtgaatttttacactttctcctaaagattgagtttaaaaatgaccgtccgcgggcactttcgcttcagccggaaatcacatgcgaaccgcccgatcgttgcataggagtgaatgaattgatgaagaaagaaattcatgattagcttttctatgttaaattttgtaaaaaatttaaattatatttcccacaaaataattttcttttgataaacaaaaatttttcgaaaaataaaatcatttttttcataccttttcgaaatcgatggttctaatttttattagccatgacataaaaagtgtaatattgtggattttggctaaaattaaaattaaaataattatgaaagtctaaaagaagacaaataaaaacccaatgatttgataatttccgtaagaaggttcagaaaggttatgaaagaatcttaaaattgctctgaaaattaaacaaatgatcaatttgaatcatatccatttaattcttctgattgatcatgcccattcgtcctaaataaaactaaataccgtaaacagtaacttcataaattgaattcctcaaactctcaaaacattctgctaattttgtatcattttgcctaataattagggcaccaatttctagtgaaaaaacttcttttttttgctcaattgatttgaagaaaggagctcaaaaaacgcatttttgcgttaaaattttttcatttggacgttatttttcgtcactggaaatcactattttggagttttgtcacttaaaatagtgaaaattcacttttttggctttttgtcactatttttcactatttcgacatttttagtaaaatttataacaaaaatgccaaaacccaaaaaatacacccct

SEQ ID NO: 23152 - DNA, 1747 bp, Heterodera glycines
agctattaagcatgcttttagcacaaatttaaattgagcttctttctggagtcgaactcaaaaatttcgaaaaattttttccctgaagcattaggggtggtacgcagggattctgaggggttgttaagtatttctaacaatttttttgtgatagaaaggcttaaaataatgtgttaataagccctacgtgcattgcgacaataaaaatatatgttggaccaaaccactactatgcatttttggcagaaccccggattctgggggtgaaaatttttttggattttttaacaaatttttcctgatagaaatgcttaaaataaggtgttatcacgccctacgtgcgttccggcattataagttcatccctgaccaaactactgtgttccgaaaaaaaatgacatcaaaagctgaacaaattttacaactttttaaacaactttacaactcctgcacaacttttgcatcaaatccctaacaactttggtacaaatttaaaaaactattcagagcaatgataatttaattgagtaattttctatattctttttcgatagaaagtcttaaaataatgagttatgacgccctacgttcgtcgcaacaatataaatatatgttgtaccaaactactacgttgcacctttggccgagtcgcggaattgtggtgacggataaatttttgttttttaagaaaaaacttgcaacatattacgattaaataattaaattattttgattgatggaattttttacatgctagctaagcatttcattttaacgtctggatagcttttgaattctctctgtctttagaggtccctgcgtgcctgcacttatgccccagcatcttgcatgttagaggtccctgcgtgcctgtacacttccattggcgtctcttttcagcgtgttccctcctaagcagatagcacactattcagtataaaagcacactgctttgttcattgtgtcagtacgctgggtccaaatataaaaatattacctctcactttggttcacattacagtgtacagctaattattttttttatttatttttacttttacttaagtctattaatcaatttttatttcaagctagcgctatatttattttgctattattttaataaaatgccttcaaaggagcagcgacgtaaagaagcaatgcgtttgcgctcgcgtgccattcgacacacgcctgatgtgggcaatgctttagtgggtccgagcacaattggccaacaacctcttgatctcgaccagggttctggctgcttttcatatgagaatttaaatctatttgtagaaccttcaacgtcgactggaattcgtgcccaaatcagacaacaacgaaatgatagacaagctattgtgggtacgccggcaatgcaactggacaccagtgttgtttcgactccgaccaccgaaggaatacggactttgactattgttggaggtcttgatttaagctaaattaaaactaaagctatatatataaacaactgccaggctcttcaaataaaagaacccgtcataattcaaacgtgggtacgccaaacaatgcaactcagcacacggtacagcaactagaggatgcaagcgacgttgaaagcgttgcaggttttttcagcattttacatagtcttttaaacaagaagtcatagatgctcggcgtcgcaaatcagcaccgtcttttcttgctgcgggtgcgagcaccccacgttacccaagcgctaggcgctcaaaggttt

SEQ ID NO: 23153 - DNA, 1411 bp, Heterodera glycines
  misc_feature (37)..(37): n is a, c, g, or t
  misc_feature (87)..(87): n is a, c, g, or t
  misc_feature (117)..(118): n is a, c, g, or t
  misc_feature (184)..(185): n is a, c, g, or t
ttgttgatccagctgtgtgcaaaatgggcattgacgntgtcattgaatataaaaatatgacattggggtatgaccctaatgttccgnccgaagtcatacttttgccattacattccnntggacattggactctaattgtccatgatgttcaatgtggtactcattttgccgactcttgcctacnncaatatggcagattggatgtgcaactgacggataaaattaaaaagataatttctgacattttgccgtccacattgttgaccgggattgttgatgtccaaaatcttacggcccaacacgatggaaatagctgcgggtactttgtgtgcctgtatgctgaatcatggcttatgaacaaccgcacatttgttctaccagatttatccatcaattatgaaaaaaagcgcattttgtggcacatcaatgagctgtatggctctgataatgtgccatatcatccaagggaaggggtgccaactccttacccaattgtctacagacatgcggatgaggaggccctatccacatccaaggccactgagccaatggaaattgatgagcatgatgacataatgatcatcgaaccacagacaagtggacaggctgctaatgccattctcacccaagcccaagtggctggtgaaaaccaagccgacacgcttggtttggtttccgagtcttgcgttccgcaagagccaattgcgcaggctgacgatgcaatatttgtcagaccgaagacgcctccgaggcgatcatcgcgtataggcagacggcaatcagcttcgattagccgctctccctcacccgcaccgaaacgtcgcacatcggcaaatactctaagccaagttacagcgttcactaaacggtgtcatcttgtgcacaagggttggtgttgcgcagcatcagcagcaaagcattatccagaatattcaaattctggtaagcttggcgacaagaagtgctctcattgtggggcactacttttcccgcatgaagaaagcagcatttgctgtcggcagggaagggttgttttgccaaagcttaacccgcacccaaaagagcttgaagagctcatcgtgtgcgacaaacaacccagcgaagggaaggagtttgttcggaatatgtcgcggtacaataatttgctccaatttgcgagtgtttcggctggcaataagccaagtcctgcaggcggaccgatggcagtaattctcaacggagaattccatcgccgcataagcagcatgcaggctggcacaacccagattcctggcttcggtcagttatacattctggatccagtcgaagccatggagcagcgacgaaaaaatcccaccttcacgggagagaaaattacaaacgatgaagagtttgtgcagggtcatcagcttaatgatgagacccttgaaat

SEQ ID NO: 23154 - DNA, 2606 bp, Heterodera glycines
  misc_feature (64)..(64): n is a, c, g, or t
  misc_feature (161)..(161): n is a, c, g, or t
  misc_feature (2489)..(2489): n is a, c, g, or t
  misc_feature (2519)..(2520): n is a, c, g, or t
  misc_feature (2523)..(2523): n is a, c, g, or t
  misc_feature (2525)..(2526): n is a, c, g, or t
aattttttttgtagaggggaaaattctgacccaaactacttattgaaaaacccaatcaaaactngggaaaaatttgaagtcaaaaaattattcgaatttctccaattttgtttccataatttccgaatgttattcggtatcataatgccaaaccaaaacgnaattcgttttaaaatattcttttctggacttgacttggtttctcaatatcgaagcttttttctccgcaatttctaaaacgcttataccaaaccctagatttttggttccgatgggtttcagaaaaaatcccttgtggtgaaaacatatttcacatttcactttgttgtgttcttgccaatgaacacacaaagaataaacaaatatttattgatcggtcggtggacaaatgcaaataataataaaaacgaatgaatgagggaagagtccaaaaaggaggggaatggtctccttataaacacaatgagaaggggggaaaaggcgtggagaacaaagtacaaatatgaaaataattaaaaaggtcaaaacgccaatttaacatttccaacacctcccttctcaagcttctaactccttcagcggccggaaggcgagaagcgaatcaccggcttcggcttacgctgcgatcgtcgaagagccattgtcggcgggtcatttgcggcttgttgatcagtccgttgatcgaccggatcagcaatttgatgcgccaaattttgagcttgtccgttgactggtggaattggctgctgatcgggaccaggattgtgtttcgaattctcttcgaaaacacaatttcgacgaagttggttcgaatgtcggtggacaattcgaccaagaactgttacatggactcggtatgtaggcgaattcctgactcgctctacaattgtaccatggagccaataagttttttggttcctgtagttcaaaaggaggactggttcggcggggaaaaacactttttctttgacaccatgccgtccatcgaattgttttgccatgttgttcgagtagtccttccttcttttgttaagctgaattttgtcaatgttctctgaattgtttttgtgctcttgcgggaggactaatgccaatttagttcggagttttcgtccgaagaataattgatcgggagaataaccatcaatggcattatttggcgtcgtcctgtaagcgagcagcacctttccagtccaatttttatcgtccgttgaacactttttcatcgctcttttgaaagtgtcgacgaatcgttcgacttggccgtttgactgcgggtgaaacggcggtgaaaaggtgtgcttgatgccgaattctttacaaaaagcggcaaattcagcagacttgaattgtgtgccattatctgacactatttcctcaggaatgccaaggcgatggattatggaacgaagtgtgaaaactgtggacttggccgtaattgaagacatttgatagacttccggccatttggaaaaggcgtccaccagaataaaataaacatatccatcttggcagggtccagcaaagtcgatgtgtacgcgttgaaatgctttgtcggtgactgtccatggggccaatggtgccttaatcggacatttctgtgcaccttggcattcatcacattgccgtacaactctctcaatttccgaatcgattcctggccaatatacatactggcgtgccaaggccttcattcgcacaattcccggatgtgcaaaatgcaatgcctttaaaattcggccacgcagttggcttggaacgataacacgacttttgtagagaaggcagcccccaatttccaaaatttcatttcttttcggatgaaatggtgcaatttcgggttccctgcacttcgttggccaaccagaaataacaaaattaacaattttctggagtgtctcatctttggttgttgattccgcaatttcttgtgccgtgactggaagatgatcggtttgcgactgtaaaatggtgttaatataacagtccgtttcgacgcaaatgttggcaatcaacacatcttcctcaggctttggataattggctattagccttgagaggacatctgcttgtccaaatgatgctgtattcgtgtatttgatgtcgaaatcataatttgccatgatcaacgcccaccgttgtaatcggctagcggaataaatcggaattccctttttggaaccgaaaatggcaagcaaaggcttgtgatcagtaaataaggtgaatttcctgccgaatagcattcggtggaatttctgtactgcaaacactagagccaatgcttctttttcaatctggctgtaattttgctgggaatttgacaaaacacatgatgcgtgttcgatcactttctcggatttgtcaggaaatacgtggccaatcgttgcgccaataccgtttttggatgcgtcagcggccacgattattggaagagccggattataatgagttaacagcagatcagaagtcatgatcttcttcgccttttncaaagccttctgttgctcttcgctccattnncantnntcgtctttcttaggagctgatcaagcggtgtgcgtatttcacgcatttctttcacgaatcgcccataataattaagcgct

SEQ ID NO: 23155 - DNA, 1348 bp, Heterodera glycines
tccccggcccgcgacttttgattaaaagggttcaactctccccgaggcataagacatctgctgctttcttttcgtttactctttttctttgtccaatactctttttttatatctcttatttctttgttttcattttcctattgtctcttcctctttttccccaagtttatttgtctgactgctgctgctttttttgcggagggaaagaaaaagacggtgccaagagagtaaagagtgtttcagccaatggcagattcgtccatttgttgtcctactgcgtggcttttgcaactatccgagtaaatgcgtaaaaggactagtaccaaaaaaaagtagttacgaaaatctcaaaatatttatgtaaaaatttgaagaaaaaggcggagagcattggtccaattaaggcccacttttaccgtaaattgtctttcacaatagtttaaaataactcaggtaaaatgccggggattgggctcagctcacggccttgcattttacgaaattttaataaattagcgccaaaaattgacttctaccaattttaaatcattaacagaatttgaacaaaaagtcaaagatcaatctactaacaccgaataccgtatttgctctttttatatgccatggtatattatttttcaaccttctcagaagggggtatataattggagactggcagactaatggagactgggagattatttttcggttgatttatttagtggaaaattttttgaatatgttgaacatgtcgccaaaaaatgtcatctcgtcaaaaaaaaaaattttttctattgaattttttgttaaagaacttctgaaaatgaccccaaaatggcaaaaatatgtaattttcttgcttccggtatgcataaaaaattggaatttttaatgaaaagttaagaaaatatggaatcgttttggtctttaaaaaaaaaaattgtgcgccagcactaagttgaaggggtgacccccctttagcccctggccaggaaggggtctcaaaaagttagattcgggcgggtgtgctttagcgaaatgttagctcaggcgctattgtatattattgtagagctcacctagtcacatttaaaaaaaaattttggacccctagctcaaagttaagtaggtcatttgtccgaaaaactggtcaaaaatggaatttttccgaatttttttagagttgcatctttttttttgcgcccgtagcggcttttaagttgccgtgggtaatgggcgaggtggtttttggttagagcattttgaggcggttcttttaaaaaatttgagtccctagcccaaagttgagttggtcatttgtctaaaaatttggtcaaaaagtcggctt

SEQ ID NO: 23156 - DNA, 1620 bp, Heterodera glycines
  misc_feature (342)..(342): n is a, c, g, or t
tcagtttttcaccgagtcaaaacgtatattattaaaaagcaaattataattaattattcgcacttattaattaaaaacatttaagcctacaaagaaaaagagtataaatccaataaattttcgcattttgtacatgtaaaaaagaaatgataattatttacaaaattcttcattttgtgctccgtttgctttattcgtccttttctttcggtttcttttcttttggctccaaaagttcgtcctctttctcaaattccgacgccattttgacgtaataacacttaatttcacaaataataattattatttaaccaaaaaacattttaaatatcaacctaaatnacatatatttcccacttaaatttttacaaaaatctactcaatttttaaacaaaaaatctccaaatcctttataaattaaattttaatcccaaaatttaattaccctttctcaaataatattacttctaaattatcccataatttatcccaaaaatttccttttcaacccctattatttcacctttgaattgcaaaaatattgaaaaacaataataaaaaaacagcaaactaattactcactatttcgcagttttctaaataaatttttgaaaatccaaaaaaataataattttttaaattttttttattgtactaccgaatgaccatccgacagagacaatacgtcactgctgctgctcgtgcccggactatgcagcgacaaatcagccattttttgttccattttgtcccttagtcgtcagttttggaaccaagtggaaacttaatttattttcctaaaataacacttttctcaaaatgtcttccttgttattggattaaataagaatctaccatttgttgtcattgcgataatctccaaatattaaattgtataaaaattcttatgattttttacaaaaaaaaatatgttagaaaagcgtgaaaaagcacaaaatgtcataaaagacctaattagcttaaaatgttttatggtttttttgatatctttttttaatatataaaaaaatggtttttagggctacatttaatccggaatatgcaaaaatatggaaataaaagtctcaacttttcttcgcaaatacaaaaataaaatggtttatctactaattagagaaaggaaaattaagtgaaaaaacgtattaacacaaaaatcgtagccctatcaattgataattaactacttaattaccttgtacaaattatgaactaataaccctgcacagttttgctaggcgtttcgtaaatgcgccatttttagctattttttcgacaaaatatggcataactttgcataaaagaattaccaaaagtatttcaagttatgtccgaaatagtacttacatgggctgtcgaacaataccaagaatgtaaaacttaattgtttttaagcaaagttatgccatgttatgtcgaaaaaatgctaaaatggcggattttacgaaacgacccagcactactcccataattaattaattagcaaaaatactgtaatgtaaattgtaagtaattagtagggctcggaattatacatatgtacataaaatcgcaaaatatgcgcatgaaatatgcaccaaaattgcaaaatatgcacataaa

SEQ ID NO: 23157 - DNA, 2213 bp, Heterodera glycines
ctttttggagaataattatctaattaccaccggtacattcatcttcacgatattccaaccgttttcggcataccaccaaaattcgtcatttttaatcgccaaatcggtggtggcggtgcattccgcctatttacgcggcgtcacggaagcggcgcaaaagccagcgacgacgacaataacagctgcagcagcagtgccggacaaatttggccacggcaaccgccttcggcaacaaggcaattcgctggtgccggcaacgggccatcgccggcggcgctgtgccgccgcctgcgccatgcaaagcagcataccaaaggctattccggctgctgttgctcatcggactgctgttccttaccggtggtgaccacggcgccggcattccaggcgctgaagcggtacaaaagcaccattagtgggattgacactcaccctgtggggatatccggagggaggataggctcaaaaaaggcatttgacgggatcgatatccaagtgggatatgctcaaattctaggattcaagggcatttggcttggtcgatctcctggaggataggctcacaaatctgggattcaagaacattggggttggaggcgtcactaaatttcaacatctgtatttcttcggttgtgcagcagcaggtggtgttcaccgaggagtccgaggcgggcaaaaaccatttgcgtggcatccaccgcatcggcagtgacggggctgacgatgaccaatcactgctgttggagcatcgccatcttcggcacattgctgccacaccgggcagaggaggcggaggacgtcggcggcatggtcagcagaagcacagcagtgcacaggtgtggcatgcatatgcgatcggctatgatattgtatgcgctatggtcttgtatgcagtagattgcctctatgtgccagaaaaaaattttggagtgtggaattcgaagaattttttcgaccaaaaattccacaaatttttttttttcaaattttcgtcgccggtgagaagaagcagaaaattgtagccatttttggcaaaaaaaaataatcctgtttttgcaatttttggggtcaagtttgaggtctgggtgccattaggcgccgcccggaaaatttttggaaattttcattatcgcggggaattacggtaaaatggttccaagaatttgggccagggttagaacgacgataccaagatttttgtaccaagtctcaaactcgggaaggattttacaaaacaaaaatctcacgaaaccacaatccatccatccatccatcaacaggatgatgctgaagttatagccagtgaagtggatcagcagcagcagggaaggccggctaatcggcgtcagccaatgattgtacacggcggtggtcagccgaggccgacaaactccgcgcgacgtgtgccggtaaggaaaaatgctaattagggcatcttagggcgtccaatttttgcgccaaatcggcgcaaccaaattatttgctaaaatgaaaggttgcgctgttgccgacacgcgaggcgcccagtccggctcgcgccggcgatctgcaacgcatgacgtcagcggaagcggaagtactcgcccgacgcctgcttgcacaagcggaacggctcgcggcggaaaggcggcgcgccagtcggctaaggttggcgtgctaaatttgattttttttaaattggcattttttggcattttgttgtttttattttaacccccctcaggcatgcttcttccacaaccgttgcttcttcacctccacccacaactacgaccacaacaacgccgcttgtcacttcccagccgtctaccgttgacccgtcccaacggcgcatggagcggtggcaggcgcggtggcgcaaaattggcccactgatcggacacaattcgaccgaaggcacggcgccggtgccgttgcgccggcttcgactggtgcaacggcgcaaaatttttggcgcgccggtaagatcgcgtctggggatgatgttggcccaaatggcactgagcgcgccaaaatagctcacgaaaatggagaaccccttcgcagcgaagggggccggtgtaaaagaggtgggggaggggggtcgccgacgaagggagaaaagtatttttaattaatttcattaaaaattccaaaatgttcgttggcggggtctatcggcatcgccaaccccttaaaatcctttttctcttaaaaaaattggcttaaaatct

SEQ ID NO: 23158 - DNA, 1175 bp, Heterodera glycines
  misc_feature (30)..(30): n is a, c, g, or t
tatgagaaatatcacaaaagtgatcatganaattgtaaattggagattattgggacttatcagctcggtcctccgcaaacactgattcagtttatatttagaggataaggagttgaaatggtggaattccaaaaaggtgaccaagaaaattgtaatcgaagattattggcgattatcagctcggtcattccgcaaacactgattcagtttatatttcgcgatgaatgagctgtaattttgcgaattagacaaaaatgatcataaagtaacaaatgagagaatttcacattctgctaattaggctttaaatataaactgtttaagtgttgcagacggatcaggttgataagcgccaataacctcagatttactattttcgcgaccccactttttgaattctgacattttcagctcattacgctctaaatataaacagcatcagtgttccggaaggatcgatttgaaatcgccaataacccccaaattacaatttcctactgtaaacttatacagattacatttggatataagaaattgaaatattgagaatatcacaaaagtgatcatgaaaattgtaaattggagattattgggacttatcagctcggtcctccgcaaacactgattcagtttatatttagaggataaggagttgaaatggtggaattccaaaaaggtgaccaagaaaattgtaatcgaagattattggcgattatcagctcggtcattccgcaaacactgattcagtttatatttcgcgaagaatgagctgtaattttgcgaattagacaaaaatgatcataaagtaacaaatgagagaatttcacattctgctaattaggctttaaatataaactgtttaagtgttgcagacggatcaggttgataagcgccaataacctcagatttactattttcgcgaccccactttttgaattctgacattttcagctcattacgctctaaatataaacagcatcagtgttccggaaggatcgatttgaaatcgccaataacccccaaattacaatttcctactgtaaacttatacagattacatttggatataagaaattgaaatattgagaatatcacaaaagtgatcatgaaaattgtaaattggagattattgggacttatcagctcggtcctccgcaaacactgattcagtttat

SEQ ID NO: 23159 - DNA, 2450 bp, Heterodera glycines
  misc_feature (62)..(62): n is a, c, g, or t
  misc_feature (2260)..(2260): n is a, c, g, or t
  misc_feature (2391)..(2391): n is a, c, g, or t
  misc_feature (2415)..(2415): n is a, c, g, or t
tactcgaattgcaacaaaaaagtcgtaaaatcggattccaatttgaaagttgaccctctganaatttttgttttgtttcagcttgcacttttggaaaatgcaaatttcaacaaagaaattgagaggacttccgagtttctcttcactgactacggagaatcggccaatttcattgacaatcgcttcgaatggcactgccgtcaattgtcctttctcattttgttggagggcccaactttgatggatcgaattgtgaacagagttttggaggataggacagaaagtgtgatgctcaatttcgtcaaagtgagtgtccatttttacatttatttgtcttaaaattgcgataattctgtggagggtgagcccattttcaaaaaaggttacctgacatttgcggaccgacaagtgcggaatgtccaccacctttttcagtttgtgaagtgcactcccgggttattgaactgtgctccgcccgtggaactgctcaaacgattgcgtgaagcgattgaccgtgaagggcaaaatttgttgcttgttcgattgaagtttgggcttacatcgcaatgtgacaacattaagcggattgaggacattggtcagttgattgggatagttttggaatggttttgtattttaattttggtcctttcgaaaattctaattttattggcatatttttgacgaaattagggttaggtgttgtcagtgtgtcaaatcggttttcaaattaggacaccgtccgattttgttttcgtttgttggagaattgctctttttccaggtcagtccagctttggcattgtgcatgattgtgggccgttgttcgacacttctgaaaaaaattctatcgagatagcgccagtgcaaccctcaagagacaaactgtcaacacagcccaacagggacaaattatcaatgcaaccaaaccgggacagattgccaacgcaactcaacaacgacaaattgtcagcacagcccaaccaggacgaattgccaactcagcccaacaaagacaacctgtcaactcacaatttgctcaacagagacaaattgttggcacaggcgctttacgaaataggggaaaggatgcaagacgaaatgcaacaaggcagcgaaaagctgcttaacaaaattggacaacattttaaacaaattgacaccaaattgttttttatggaatcgaaggtcggttttctttcaacaatgctttagtttcggcctaattgcattttccctggccaatagtcaactcattttgataaccaaattcttaatcatctcccacatttgctttagcttgagcatttgagtcggaatcagtggcaaaagcgacaaaacccaagcagcagcaacagcagaggcgaagtcagcagaggcggaggaggactggccaacttttttgaacggaaaacgccattccgaaacaatttttacgatgattacgatcaatttctgatggacgagcatcaatttcgttttgagcttttgtgaataaaaacatttcccggttcattcctttgcgagtaaatcaatacacttttcacacaactcaacagttagctttttggaaatatatgcgtcttaaaaatggatctaagtagagaaaattcaattttttttttattttataataaattatgtacattgtgctcgcaaacattccgatttttattatatttttgaaaaagaaaatattataaaaatttttaggtaatttgccagaaattgggaagattacgagcactgttttagaattatgattaaaaagcacataaatgagtgtcagaagagagattcagttttctttgctgttgctctcatccgccgattgccaatgaatgaattcacaaaatttgcacgaatttccttccgtttgggttcgcctgctctttgaaatgtacgaaaaactgtgttaaaatgggagggaattgctcaagttaaattagtaaatatttatttgctttgtaaattgaatttttaattatttaataattcgggaccgaatttttaagcaccaaatttctaaaaaacgataatttgtttggacttttggtaaaaaatcaaaattattgcaaaattgtttgttgattgtgatcagttagaactatcgaattggttttggtttaaaaaacgacccgaccagaaaaagccttaaaatccgttcccgactaaaacatttattaataaccaaaatatttaaaattaatattcaaaaagtctcgcaaattccttcgcattttccttggccaacagttgngcttcggtgtttggccacaaacacttccaatttcgcaaattcgcccaacagaacgggccaatgggccaaccgttcgtctgcgctttcgcccagcgcaaaattctccaaagtcgccacccgaagagcatccnacattcactgcacaagtctgcttntccttttgctgtgattggacaaaaatggtcacaaa

SEQ ID NO: 23160 - DNA, 2214 bp, Heterodera glycines
  misc_feature (2095)..(2095): n is a, c, g, or t
tgcattgaccctcaaaacttacatataatctgtgccccccaatcacctaatccgaccgtcacaatgaggttaaatcctaaatgaaatgaatggatgaaggaccacttttcttcccaattcataaacctaagaaaaaaaattataaattttttttatttaaaaaatttcaaaaaatttttacataaaagatccgatggagcaataaacgcatatgcacataacataggcacctaaaaattttcaaaaaaaattttttttttgacattatgcgatcataccaatgggaaaccaaaggttggtaggctcgtcgatttcttaaaattttttgaaattaaaaaaaaattattagacttacggtccatgccctcgagcatgtctaatgccaccgcgcccattgaagtagttgctgattgaatggatttccgacgatatttcccaccaattttgtgaatacaaaaaaattcatagatcaccttctgcaatataaaaaacataaattaatttaaaaaaaatttttttaacagtaaaataataattaaacaatatttttattttaataaaatggatttattgataggaaataaatatttttggccttaaaaaatgttcaaaagtttccttttgctaaaagtattttaaccaatatttataaaaaatttaaattaaaaataataaatcattttactttaactaattttttactttatttcaaaaaattatttttaattatttttagttagaaattagtgcctgcctttgtcctttgtctgatgcgccgccaattatttctttaaccacaaaattgggtcggacaaaaatttgccaatgtccgcagcagtgatgaacatcagtggaatgccaacaagcgcaaaaatcacagagaaaattttgccaaggtccgtgttaacagaaacttcggaatagcctaaaggcaagaaaatctttcaaaaaataaaaattaattttgtcataaaaattaaattattaataccaaagaaaaaaaaattaaaaaaataataattcatgaaataatttttaaagtgtttaagaaagattgaattgtgctgattatgagtcaacatagagaaaagtctcaatggagcaaaccttaaaaaaagtatcaatgataattagggactccatttttaggcaaatgcctaaaatttttgcgcacttaatacgcacagattagcacgaaaaacgcgttttccgcttggtttggggtgtctacgatggcttttataatgccaatttttgtgcctatttcgccatttttggcgcctttttcaggattttcggaaaaatccttaacaaaaatgtaataaatatgaaaattacacccctaagaattgaaaaatttttcacaaaaattaatctccaaaagtaatttgtttttttttttgataaaaattttggtttaaaaattgtcttattcgaaaaaactgttaaaaaaattgaaatataagcaaaattatgttttttgattaagcttttacgcgatgcgatttttacctaaaaagcgttaataaaaattttatttgcctattttaaaattaaaaaaaaacactaaataatagaaaaattaattgaaaattattctacaatttgaagcaaatgataatttaaatttaaatattttatgacggggatggaaagaaattatttaatttaatacgaagttataaaaaacagccaatcgatccttttttatcattaggcaacaccaaaatgaagtggcggtcaaattggtgaaaccaattaatgttaattagggtaataagaaccatttattagtgtacattgctgtgttagtcttcgtctaacacaaattgacgacgatatttaattagctccatttaattttaattaaaaataattttaacgagaagaacaccttaatttaaaatttttcatttttttggcttttaaaaaattcagttaaaaattatggaaaaaagtgccaacaatttttcgaaaatattgtggacacaaaatgagcatcgtttccaacaaatttgtgctctcccatttattcgtgaacaaaaagatgggacacttgctgaggaacgctatcgccactacataatacaagtanaattcatttcagtttttttaatggaaaaaataatatatgccaattaatgatttaattagaattattaaatttgattgatttttttaaataattaaaaacaattctcaagaaaatttgtc

SEQ ID NO: 23161 - DNA, 1104 bp, Heterodera glycines
tggccaaattcctgacattagacctattcctcaccccttaatggttattcattataagcaattccgaccacgtagcggaaacactgcaaacacatttgaaagttacttccccgagttttatgtggcgcaaccattttggcgataccgttgatgttttttataatttttggtctcatgtcactgattttggacaataaatgagaattaaaaaaaaatgaattttcgacttttgttcgaatttgggtccggggttcgaaattggttgcaatggaggtcagattcgtgatcagcgacctcgaaaacccccaaaaacatgtttcaatgaagaaaaaaaatttgaatttttttttccaaaatggggggggacaaactacactattaccgaaaaatctgatgcagaatttgtgcaaaatatttttcagggggtgggcttcctgaacaatagtaataagtagggcatccaaaaatatgcacataaaatcgtaaaatatgcgcataaaatatgcaccaaaaatcgtgaaatatgcacataaaaagtgaaaaatatacacataaaattttccaattgagggtgtaatttctcaaaatttcttcaagtttgttaaatttaagcataaaaatcccgaaaatagctaaaaatagtatgaatgattattttagaaccaaaaaagtaatttatttattttgaagaaaattgagcaaaaaatggagaattttctattttctgactatttttggcataaagtttcatttttaaaaagttacttttttatcagaaaatatacccaaaaatctgatatttttgaaaaattttcggtcattagagcccaaatggccgctttaatagagggggccgttttaatagaggatttattgaaaaaatgccgaaatatgcacataaaatatgcacgaaatgccaaaatatgcacaaatatgcaaatatgcacataaatcgcgaaatatgcacaaatatgcaaaatatgcatatagaaatccattctagaagcttcaaatcaagctaaaaacatgtttttcgtgcgtttcaggcctcccacagtccaggaaaaaaatatgcatgtgcatatttttggatgccctagtaat

SEQ ID NO: 23162 - DNA, 1337 bp, Heterodera glycines
agcaggggtgggcgaagctcggcttagtactcgaagccgaagccgaaggcgaagcccaatttttattcgaagccgaagtccgaagctcgaagcccaaaaaacccgaagttttcgaagccgaagccgaagttttttcaaaatttttttttaattccaaaaaattttttcatcacaaaatttcggttaaatatcaaatagaccaaccaacaacccctttcgataaataaatataatgatttttttaacaatgtattttctaaatttttataattcttagaatactcacagtttttgagtcaatttaaaaaataaagggaattttggaactccggcggtgccgataggcgccgacgggaaaaatttgaaattttagtgacagatttagttcaaaaatgaaaagattttgcgattttaattgttatatttatattaaatttccgtcgaacaaagaataattttgaaaaattagaagaaaagaaagtacttggatgggaactgatcaaaagaaacataatgaaaagagcaaagagcactaccactcgaccatgcgtgtgaacaaaaaaataaaaacaaaaaattaataaatatatattaatttaagtttatcaaaagcccatcactaagggtgcattttcacattgaaaactcaatctttaggggtgtatttttcccgaaacttcgggtaaaatagccgaagccgaagcacgaagttcgaagctcaaaaaacccgaagttttcgaagttttcgaagccgaagtttcgcccagccctgatcccaactgaaaatcagcggtgccaataggcgcagcgggaagtattttcaaaattgatgctatttttaagagagattttcactaaaaaaagcaaaaaaaaaacaaacaaccatcattgaccccatgaaaagcatcaaaatgatgttaagcgcagagtttggagccctgcttatgctgctgcttttgtccttcggtgccccagagatgtccttattagtgggaacagggtttggcgtagcacaagtacgtccttgaatttaaggactttcatgttccaaaggctggtaagcttttacagggacgtcattgacaagcaaatgagagttattaaagtgtaggaggattttcaaagaacaaaataaaatgatttttggcacccaagtgaaattgacggattagtaaaaaaaagaaaaattattgcgaaaccaaaatccaagggaagcttttcaaggattctaatctccttagaatgaaatactaattgacacggaccgcgcttgtcaacggtggtgaaaatgtgtctttttgacgctaaatgaagcgctgctgctatttgttgatgga

SEQ ID NO: 23163 - DNA, 1265 bp, Heterodera glycines
aaattcccccattaaacactccatccccgtcctggcctctgcccattctccgttttgggcacacttttgcttagccaaacaaaaaagagcaatgcggcattattcatagatgggcttgtgatggaaatggatgggaagtgaagggttggcacaatacaaaggccaaaactgaaggatttatttttataagtgtgtcatgccattctgaattcttttctttttttatgaattgtgccattctgtttttgggtgacgtaaatggatgatggatggactaaaaatgagtgagtgccatttgctcttatgagaatgaagatgcgtctccggcttaaatattttggcaaatttcgaccgtaggcctttgggtaaggaaataattttgagaaatttaaatgttattggaaatgaaatcaaataattctccaattactggtttaaataaataaggatacgattcttttgtaaatatgaaaaaatttgtttgtcaaaaagttatccatcaatcattttttgactaattaacttttcacttaatataatttttgttccaaaatatcatggttaaggaatgggctaaaaacccccgggaccgggactcccgtttttttcggaactcccggtcccggtggtttgtccaaaaaagccgggaccggaactcccggcaaaatcccggcggtatcccggtcccgtccgggctctattaattctatcatcatctttttgttttccttattgtcaaaatcgttaactaatctacaggtcgcttcatcgtttcgcagatattttttaagcgaggctttcagcaatcccacgagttgggtcaattccataaggcctcaggcagttttgttggtgctcttcctcttttttaatggtgataatgaaccttataaaaatatttttattacagtatcccatttatactttgaaaatgctgggtggggcgaagttaaaacgttttctgaatatgttccaacggcaaacgactcaacctttatctttgtgattaggttgcaagaattattgttaaattagtcattattgaaaaataaacataaaataacaattctgttatcttaaataaattgttgaaatattttcggggtcatttaattttgcgccgcaaatgtcattttgactgggcgccgcatctgtcggcgccgcaagtgtcgcgccgcaaatgtcggcgccgcaaatgtcctcgccgcaagtgtctgcgccgcaagtgtcgctttgactgggcgccgcaaaggtctgcgccgcaa

SEQ ID NO: 23164 - DNA, 1312 bp, Heterodera glycines
caaagaaggaagtaattaggcgtcattatgcagtaaaaaagcgttaatgaattatttattcattttgcacggttagtgtaattaaataatttggcgttcaaggttaaaaaatattctctctctctctaatgatgagcgttttgtctaattaatatttttgaaatgaaaaatctaaaaatttatttatccacataaagtaataaattataagaaaacgcattggactttgatttcgataatgcttatcccgttaatattggtggctggccatagggaagttgaccttgaccatatggaaatgggccatggcataatccgcatgattggctgcatacttgggctactgactttaaaatacaaattcttttttaaattaattattttttcattattcgaaaaaatgaaaaataaaaacctaaaaattattcatactacaaagaaaacaagtaaacagattaatttattaaagtttaatgaaatttaagaatttttggcaaaagtcatgaccaattccataaaataagaattttcaatattaaaaagacacaatttataatattggttgtttaagaaaccaaccggaacattgcaatgtgtgacaaaattgaggcaagactcttccaaatcaaagcaaggcggcacttaaaataaacaagctatttgtaataataaaaggatcagtctgcctccaccaccgccaaaaattgagccgatttgtccatgatgccaagcgggaagagggaagccagaagctaaaaaaaagaaaattaattgggtaaagtttaaatgcagccaaaccatatccgaatggcaaatccatttcttggcctaaaaaaaatttatgggaaaatataaattataaattcattaaattaattttgcaaaaaataaactcataataatcacttacaacaaatcccatttatacagcgctcatatgggtcgatacaaacgtgaagggttgcgcatgctacaaaatgccaaaaaattaaaaaaacatattaaaattttgaagcttaaacgaacccccatccgcaaagagaccgggaggacagttgccttggttattaaaattctgtttaattgatttagttttatttaataataaaccgtaggactgtcccgggccgacacccggcaaaaaaggcgaaggcatttgcaaggcaatggtaaacagagaaaaaaggtaaaaaagcagtgaattcgaatgcatttttagttgaataatttaatacaatttctgatgaaaatttttataattttaaaaatataaatattttatggtggtcaaattcaaaagtcacttatcctt

SEQ ID NO: 23165 - DNA, 1337 bp, Heterodera glycines
atgcatttaaaattatttaaattaaaaaagataaatataacaaccgaaaccttcaatctgttgccgatattccatgttgaacaggagaacatcgagcaaagactgatgctgacgatggcaagtcaactttggcccaattggtgtgtaaaggcactcgtgggtctgcccaagcggcacaatacagtccggctccgcggcacaaagcaatgccatggaattgaatttgtgaatttattttggaaacattgaccgaaataaattaaaatattttccgaaaattttgtcaaattgcttaagggacgaagccgagaaattggatgtgatggctcatcgaaatgccaaattttggcattttcagttttctctaatattttcgaaattcgagtcgtgtcagtgccaagaaatggagcaatttttttgatttgtcaaacgatgtagaatttatttggaatatttaatcatgccatttcatcagttgccgagtttgctcagttttgtgaattatgacgagattggcctcgaactgtggtgggtcgtcgtttcctgtccattcatatgttttgttgggcccaaaattggcgaccattggcaaatatttgtacatccctggaagttttatttgttttcattttattttttattgaaatatttgccaggatgagtcgcaatgtttttgccatgtccgctgtcttaaattcaataaatttggtaaatttcacctgaaaatttgctccttcccacactcacagcctaacaactggactgggccaatttgtcctgtttgaatttgtcttaaaattgacgacaaattgtcattgtcaaaagaaattgacgtgtccacccaaacaacggtgtcatattccgaaaatacatgcttcaaattgataataaatttggcattttttaaatttaaattaccgccatggcaaaaaccttccacgcgtaactgttcagttggcgcacccgaccagaaaccatctgagaaaaatcgaaaacgcgccattccaaattgcacatcgaattcaactcagttacctgcaaattataaatttaaaatgtgcaaataaatacggttttaatgaaacgcggaatgaaattaaacgtaaattattaatttactatttttgccaataatatttaaagcatagtaatttcaaattcaatactttaattttttaatgagaaataattaattaaatcgaattaattataattattaattgcttaacccattcgttgtttgttgtcacatttcccaaatcgtacgcaattattttttgtctgcaaccaaatttttctttgatgtttgcgattagcacccgaagtgatgggaaaag

SEQ ID NO: 23166 - DNA, 1048 bp, Heterodera glycines
aagaggctctgcgggaacggattagcatcggggttacgagatagaaaaatgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaaattgtcctaaaaagagatagccatttttctgagaattaattcacaatttccgcaactcttgcggtaaggaaaaaattttgaagagctctgcggaacggataagcatcgggg

SEQ ID NO: 23167 - DNA, 1233 bp, Heterodera glycines
ttgtttatgtaaaaatatttgatcaaagagaagaaaaatctattaaacttaatattttacataaaaataatttgtccaatcaaagtttatcgcattttgtaattgattttgtgccaacaattttaatgcccactcaatttccctttgggttttcaaataatgccgacaaaacaaaaaaaaatgccatttttaatcttccggtttttggccaacattttttgaaaaaaaacattggaaaattgagttaaaaagagtaaaaactaattttacagcagtaagatccgagttggttttctcatttattatcgtcattttacaattatatttttttataattctcaaaatttccacattattctttaagaaaatatttctgaaaaataatcttgtttctccaacgaattaatatttatttacatataatttcctaaatttacaaaatccacagctaattaatgcacaataatcaaaaggtaccaaatcttttcagtgatgcattttcattgggtgtgtgagccggccaatccaggcatagaaatcacactttccgagttgggcacattttgaacatggacaccttaagagattaaatggatttgattattctttcttaattgactttacccttgggaccgtttatgggcactttgccaatgctaatgccaaactctgcacatttcgagtcaatctcagtgactttctgaccaaactgcccactcaatgtctgccattcgctgttgttgctggcatgggaagaagcggaggcggcaatggcgaacatggcacggacgaagccgaggctaagggcacactcatctaaaagggggaagagatatttaaaatgatttaaaaataaataaataattattaggcaattgtccattaattggttattaccagcagaatgagtggcaagggatgcttcgatgtcggccaaaagagttcgatcgccgcctttcgagcagccgatcagttggcctttcaacgcgtccgcaacattttgggcatccgaacaaagcgatgacttggaaatggaattggcaaaagtgccaacgtaattggacataagtgaaaccactttttgactgccgggacagcacggatctgtcggaaaacaacaaattagtaaattaaaataataaattaaaaataatacgcggtgccgaaaagcaacattggcacatcaaacagacaattgcgacgatggcgagcacagagacggacggggaagaa

SEQ ID NO: 23168 - DNA, 1809 bp, Heterodera glycines
catatagacttctcagaaccgtttgaatttgtttcttctgaatatggaccgggtgaggtaacagaaattttaggtgatggaaattgtggttggagaagcatctctcttgccttaactggcactgtgtcaaatcactccgagataagaaaggatgtaattgaatatttggaagaaactgtttaccaacattctttttctaatcatcacgataatgaatggtggtgtaagtctgctattttagtttttaacatgtagccaacattttagtgctttttgatagtattgaaaatataagaaaacgcagagagaatgctattgctcctgcaataggcgcccatgaaattgaaaaatggatgaataatttggatctagcagcagtcaccaaaatgtttcgaataaatataattgtgtgtgaacgtatacaagaacgaattttccgttggcaagtgtactcaccagatttagaaacatcggttagaaatatttccaatatgcaaattcatataatttttagctttcgaacctccaacataaggaatcgactgcatcaatatttttatactttcatgacggtcattatgaactaataagaaaactacaaaagataaattaattatttttttattttttttcttattataattagaatttccctttgaaagttgcaaagaaatattgtggcacttattgtggcacttcattttttgaatcatgctttatagcaccagtaatatggttttgcaactttaaaaaaggtttaataaagtattttaaatttattatacattttttaataatatagtcgatgattgctgttattaccatgatttatgctatataaacaaatctataaaacgatacgattgcgacaaaaacttttgcaaatgtttgtatgaaagtgctgaatgttcattaaaagtctgtatttattttgtattttaaatagtatattttttagacgttgttatgcttgacagttcatgtttttggtgaacactttaaagaataagaaacttttaaaaatacagagatttatattaatttattataaatgttgtataacaataactattttttatatttattgtctttaattcacttcgggtggcggtttttaggaaacgcccacttggcggtttttaggaaacgcccatggtggcggtttttaggaaacgccctggcggatttaggaaacgcccatggtggcggtttttaggaaacgcccacttggcggtttttaggaaacgcccatggtggcggtttttaggaaacgccctggcggatttaggaaacgcccatggtggcggtttttaggaaacgcccatgtggcggtttttaggaaacgccctggcggatttaggaaacgcccatggtggcggtttttaggaaacgcccatgtggcggtttttaggaaacgccctggcggatttaggaaacgcccatggtggcggtttttaggaaacgcccacttggcggtttttaggaaacgcccatggtggcggtttttaggaaacgccctggcggatttaggaaacgcccatggtggcggtttttaggaaacgcccatgtggcggtttttaggaaacgccctggcggatttaggaaacgcccatggtggcggtttttaggaaacgcccatgtggcggtttttaggaaacgccctggcggatttaggaaacgcccatggtggcggtttttaggaaacgactcagcacgatttgaaattagttttaacaaactataacgccaattattgattaatgtgagaagtttcttgtttttatgttggcaattgaagtggaaaattct

SEQ ID NO: 23169 - DNA, 2652 bp, Heterodera glycines
aatttttcgagttaaaaccggttcaaaacccggttttttggcatttccgcaactggagacctactttttcgttcatagctcgtcaagacgaatcgattggtatataattgtgccattttttccgggggtttgactatagtacacccaaggaaacaattggtctagtagctaaaaatcgaaaaagtgcgagattaaatactttttgcgaacgagttgagagttagccaaccgattgagtacccaaaaatcatgtcccaattggtgcctaattataccccgggcctgattctttggagttatatctcgccagatttaattgatgaattctggcattccactccccatttgttgcccttctctctcttctccctcacccgatatctctctttgctcttctctacctatctcttctctctctcctctctctctctctcacatcgtctcttgtctctctcaggttctcttcacttctctacctctcaaatttctcttctctacgtcttttttctgtctctttatctactctctcttccttatctctctcattgctttatcgtctcccattctctctctcacattttccttgtactgcttcgcctcgtcgcccaaattgccctcgaactttgtccaccgctctttgcttcccttccacaaatcgttctccagcagatcggccagcatcggcgtcttctgcttcactgctgcccacagctcttccgccgagcccaatttgtccaccgagtccatcaattcgacgattttgtcccattctttggccaaaacattgcccaattttttgccaatcaaaaaccaactatgtggcaacaactcttaaatttatttttgactaatcattttagcaaatgccttttcggcacctttgacatttgccggaagcatgttccacatattctccggtgtcatcatatttttgatgacttcgttgattttgcccgtgtcaattttgcccagcatatcctgcagcattttcgggtccaaattggccgccatttctttgattttgtcgaatcccttctttccatcttttaaagagggaaaaattggtattaattggctttccatggctaaaaattaattcgggaatcggatacgaactcgaaaaatattggaatttgggatcggctagcaattctactggccaatttggatttcagattacccgcagctccgcccccggctttgcccagcatttcctgcactcccgaaagcattccgtccaagtccaaccccccccaaaaggtcgcttaagtcgccgccgccaccgctgccctttttcttttggtcagcaaaagtgccatcgacgagcaacaaaaagcaaaggacgaaagaaagcggggagaaaaaagtgggaaaggaacgaaccatcgaaatgagaaaatgctaaaataaaagagaaaaatgaatggatttggattgattgccatttttggtgagtgccaatggaatgaatcgaatgaatggaaaagcgagaaaatggaggaaaagcggcgcttattttacgtggctttttcttttttcttttttttgcgtttgccaaatttcttttgtcagcgcattaaattaaaacattacaaaagccaatagaagaagtgaatgggcgaaataaataatgaaaagagaaagatttctttttggaaatgggccaagggacatggccaaaaaatgaaaagaaataaagaaaaagcaaacgaatgaaggaatggcacaatgactgatgaaagaagtgcccctgggaaaagtaccgtaacagcaacagcaccatcgtctacggtagtaacagctatttgactactgtatgtattccttaaaattggctattttcatttggagaaatgaaaaaaatatattttattaaattgcattaattttaaatcaaaaaattcacatgtaatgcacaacatcgaagcttaacactggcataataccgtaaagcgtgaaaatgtaagggtaaatttagggtacggtaagtgtgccattttctccatcaaatgccacaattttgaggggagttggagcagcatttgtccagcggagtgttgcgcccgttgctctcattgtgctgctctttggtggtctttcgtcgttttgttgttgccacattgcaattaataatgatgccattgtcagtcccctcattaacggcttcaccatcctcattattcactccattagcgacttcaccctcattagtcccttcgcctctttcatttgcccgctcttccgttaaagcggctcttattcgattgagccctaaattttgaattttccaaatcatattttgaatgttatgaatgcgcgccttcgtccagcgtttgtgggctgacgctggtgaaaacgatgcggaaccatccgggcgtgggcattcggcacgcgtcgcccgcggtgattatcactttgttgcgcatcagtcgctcaaagaggcgccgttcgccgtcaaaagtgggctcatcgagaaactgaaaagcgcaatttaagcaatggcaaattacaggataattagtcggtttaaattcggaaaaaagcttattttttaatataaaaccatacattaaaaaggggggtcggccgccgataatttttttttttgctttttcaaaatgtttttttttcgacgcactttttccaaaaaat

SEQ ID NO: 23170 - DNA, 1150 bp, Heterodera glycines
aataattttatttatttataatttaatttaattaatattgaaaatttataaacatagaattgttttgatttggtgaattggtgctactatattcaaatttctttgttgttacagtataatttttatttaaaattttcatataattaatcctctcgttatgtttcatctgtttttttgtggctggcgacgtatgtttaataataatcttattttttaaacattattttacattttcttattctgcctaattagtctaatgtcactttgcaacatatcaattgaataagcgagcattttataatagaataaaaaattttaagttaattcgtatataaaattaaaaaaaggttattaaaaaaccagaattttaatagttataccctggaattccacaaattataaataattaaaataataattccttagaatataagaaataaaaattttttattatcattattcattattacctatatctatgtggacagtataaaaataataattcttccgctttaattttgaatattttatgaaagtgcataattaaataaaataaaaaacccactttttacactgcttgaatcaaaaataaaaaaataaaataaataaattatcgcaaaaccaaaactgtcaaaaaaactttttatgccaatatcgaaatggaattctcatacaaactaagcaacgaagcataaacacatgtgattataattatgagccaataggatttttgtcagagtataacacctaaaatttacgcccatttttatgattagaaaatttaaaaagttaattttattaaattaatataataaattatttatcattactttatgtcagaaattattaaatatttttgaataatgaaatgaatgagaaaaaatttaattacggtaaaatattttttgtggaaaatatcaatttaagcaaatgttttttattcttgaatttagagtagttgaaatcatgtgaattaatccagttcccaagtttttttttaaattttattagcgtaaaaataattgaatttttttccgctgaccatttttctcatttaccccatatgcacttttttgcgcgcttttttccaaaaaacttagagtggggggggggggggggtctcaaaataagacatagtcatttttcttgg

SEQ ID NO: 23171 - DNA, 858 bp, Heterodera glycines
  misc_feature (38)..(38): n is a, c, g, or t
  misc_feature (40)..(40): n is a, c, g, or t
  misc_feature (47)..(48): n is a, c, g, or t
  misc_feature (51)..(51): n is a, c, g, or t
  misc_feature (57)..(59): n is a, c, g, or t
  misc_feature (61)..(61): n is a, c, g, or t
gcattagcgctattccattttgcgttccgcgtttctgncncctggtnnttntgtacnnncnaaggcgcctgcattccgcgcccatagggcccctcgggtcttttgtgacccgtagcgcctcgcctttccgcgccttgcattccgcaccgtttggcctcccgggttttttgtaacccggggcgcctccattccgctccattccgcgccatacggcccctcgggtctcttttttggcccgtggcgcctcgccttccgcaccacagcccctcaggaaagaatggtcatgcgcttaggcagcgagcctatctcgcactcattggcggcgttgtgccgagctcacaaggagggcagtgagcctaatctgcgcaaaattggagaaagcgcattggagaagcgcattggagcagcgcaaattgttgaagcgcaattggagatgcacaaattgaagaagcgcaaattgaggaggcgcagaccgaggctgaatggaaaattgtcagaggaagcgcaaattgaggaagctcaaaccgaggcgaaagggaagagcaaactgtctgagcaggaacaaaaagacagcgcgcaaattgaggcgaaattgaggaacgcaaatcaattgcaggcgcaaactgagtctgagcgagggcgcagactgagattgaacacaagcgcaaacagaacgatggcgcaaactgagacgaccacaggcgcaatactggagaaccactaagtggcgcccgtagctcagttggacagagcacttcatgctttgaggagatcgtgggttcgagtcccaccgggtgaaatctttgtgttctacactacgagcctggctgaggccatcatgaagtcaaaggccaaggg

SEQ ID NO: 23172 - DNA, 2485 bp, Heterodera glycines
  misc_feature (1243)..(1243): n is a, c, g, or t
agcacaaggatgtgccaattccagcaaatccccttgagttgcttcctgcttgaagcatggagagggtgggcgggggaggaggagaatggcatatttgatgtgccattcttctcgcttaagcgccgcggggcgacatgccaaaattggatggcaaatttttttttttctcgcggtactgagtcatcaattttcttcgcgctgaattggcttgggctcaatttggatattctaaatttgctgcatgaatgagaatatttcccaaggctgtttaaatgccatttaaaggctccatttatttttgctttgaatgcctgaggcaaaacaaaataaaattcctaaggcttgtgttagagttagtctcgagatcgaaatccgaaatttgtccgatttcttggctcgagaggaacagtttaaagaactgctaattatttccgctaatatacctcattaatggagcgcattcaaaaataaaaataaaatgcctgagggcatttaggcaaattaatgatttttgtggtgcaacgcatggagaaatatttaaacataaatatttttttgtgttaaaaattcaaaaatatttgtaaataaatatgcgaataaaccctttaaaaatgtgctaaatcttttaaatatttattgaaaatacaaaaataacaatttttgtgtgccgataaattaattaaaagcgcgaatattgtctgagaaaaaaaacgatgtgggtttctcatttattatcacttactaattaccctcaccatccaattctctgcttaattgtcaccaccaacgtgccaatcaatggtcggttgttgtttactaacctaatcactaatcaccactcaccatccaattctctgcctaattgtcatccatataacgagggtggagcgggggaggggcaattattttggaaaatgacgtgattaacaggcccggcgggggcggggaggggaggggcagagaacaagaatggggcccctatttgctgaaagaatgtgacgcgggggtgtgagaaggagggggaggagggccaatttagtcccaaaatggaaggaaaagataacagagaaaaagggcccctcgggggacaaatgcctcccgccgccggcccctttttcaatgtgtcctcatttgtcagcagagggaaagcgggggagtgtaagaggccccaattcctactcccctcacccattcctcacgactcttgggcctatctctacgccgtttctcccccccccccccnccctcgtcctcatattattggacagacaatctcggcgccaccacgtgctgctctagtgctgtgtttgtgtgtcgagactctcgacccaaccaggtttgggtctcgaatttacggggagattcttgacccaacatttggttcaggctcgaaccttgaggataagtttcggattccaagtttttggcacatgagtgatctcgctgacatattctggcatcaactttcaagaatctcgggtgacaaaatttgtcggtctcgaatctcgggggaccaataatggtcgagagtctgacaattcactgccgaaatagttggtccccttccctacaatgtatttgccatccaacgacgaaatgccctctatttacatggaaggagaggaattttggtcccccctcccgccgtcggggactctgctgggcccaattctctcaccaccaccccctcattgtcattgtcagcccaccctcttccatcgtccccgccagagataagaaaatactcgcatccatccccacccctccgcccccaaaaggaagacagaatatatattgttgtatgcattgagataggacggcccccgaggggtctcggccaggggtgtgacttgtctcagaaaagacgagagcgagagtttggcgagaggcgagagtccccaaaaagacgagagcgagagtttggcgagaggcgagagtccccaaaaacacgagagttggcgagaggcgagaggacgagaggcgagagtttttcaattttttctgtagccttatttttaatttaaaaaacttcaaaatcgtatattaaattaggggtacgggcctgggtatttgggcaaataccgggtcagggtattgccgggtacagaaagccgggtcagagtcctagtttttaaaccgagtccaagtcatgaaaaatccaaacaaaaatctttaaaattttttcatgaaaattaaaaaatattttcatgaaatatatttattttagaaacaaactttattatttgtccattttttccaccttttttttgcggtgcgttttttaaaacttcggggacagttggggtcgggcggtgccggtaggcgccgccgaaaaaatttttgaaaattgtcttcggatttgtttacagattttattcaaaaatgaccaaaacttgtttttttaattttttgtttttaagtcgctttttttggtgccgctggtttcccccaaaaaaaaattttttggaacatttgggtggggggg

SEQ ID NO: 23173 - DNA, 1016 bp, Heterodera glycines
ggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcatctggtatagaaatctctttggaaacatgacagtggctgtcatcagttgtatgctctaaaa

SEQ ID NO: 23174 - DNA, 2539 bp, Heterodera glycines
ctcaaggtgttcaagtcgtccgtgcttgaggtgagacttgttcctaaagtggcttgtttctagtgacgaacgccccgtcaaatatacgttttttaaaattgttttcgacgttctgttcgaagttcgaactcgggttcaggtcaacatacaaaaataatttattgttctcttaaaatggctccttatttgctaatgttctgtttttattgcccttcatattcagtccgatgtgcaagagctgtgctctcgcattgtctatttgcatttgtgtttggacaccgtccgtgccccacccctcgtccgtgcgttggtcaaacttttggtcgtggcggagacggatcgaccggacgggggcaatctgctcgaagtgttgctgtccaaaatgaacaccaccgatcgggtgattatagccgtacttaaaacagatttatggcagggtattgggcaaaatattgttgacttttttgtattttttttaagttatgccgtctcactttgtctctgctgcgcactttgctctccctgcactgtgaggatttgctgtggtgcgcggtgttccgccatttgatgccgttcattccgctcggcagaccccgccggtccaaccaaagccgtcgcttcgacattaacgtgtcgttggacgccgccgctttctttctcaaaagtgtcccggaatgtacattacgtattgccgaggttggcatgttggtaaaaatgttgctaccgtttaccacccattctcccagctgtactccgaagaacagttcaagacgtacatgcacgaggcgggcgatgcgatccgcgactgtgcgttgggttgcgccgggtggcggttcaattacgacggtgtgtcaccgaacatgacaatgttgagcatcaacaacaacaacccgagtgatgagctgcagtccgcccgacaagtgagtggcgttaatggacttttccttcattgtcagaattatttttggcatttgtttttgtctttatccaaaatttttgccagccttttactcgcatgtgctcggcccgttcctcatttgcatccacaggttggaatcgctatttccagaaccgttcctcgcacggcactctgtcggccgagggcgccggtgcggcggaggcaattcaaagtttgaacgaacttggcaaagacgacgaggagcgggacgaattgggcaacaacaacggcaacagacagatgatggacggtggaggcggcggtggcttatcccaggaggaggacctcaacgaatttaagtcggtcgtttcgcatttaatttacttttaaaaccattcatttaatgtgctctttttcagtctttactattcaatggccgaggatggtgttcgtttggactacttccaattcgcctacgagggcgtgtccgagtcggacgagccggactcggtgacttgttcaaggcgtaattcccaagaaagcgaagaggaaaaaggttggaatggacgagttatggacacagtttaaataacaaattaatatttctcgggtttattattagaattttggtctctagagaatttgttattgaatttattttgaccctttcttaccatagaaaatgcgaaggcaaatcgcaaaaatggtggctcacaatcagttgccgttccgttacctctgtcttcgtcgccgcccacaatttcggctcgttctcacataatggacgcaatcgtcgccactgagtggagcaaaacggacggagtcagtcacttgggttcaagcgttcttcctcccgtaaaattaatttcgaaattccttttaatgggaaattttttaaaacgaaattccatgcgctttacttttgggtctaccgtcagttccgtattcttttcctcaaccttatttttaagccatttcagcaattcattcttgctttgtttagagccgtgatcagttcattgaaatgcttaacgcattgcctttgccgtccaaccgagaacacgttgagaaagccgctgctgctgggcccggtcgttggagcccggtgccgaagagagcgcgcactgttgaggagaacatggcactgatcgaatctcgatggcaatatttggaggtatttaaaactgccgactaaaaaagggggcgggggtcaaccgaggataatgaattatgaggaaatctgaattttgaattcacaggaattgcgattggaaagagaggaaacagccaaaagggagggagaaaagggcgaagaagacggggacaatctcttccgattggacttaagcgaagtcgcggcaacagacgaaaatgggaacagcgaagaacaacaacgacagatggcggaagaacggatggacgacgaggagaacggcgtcagcggggacaatgacaaaaacgcaaataatactgacaacaataacaacaatgaggacggatttccgatggaatgcgtcgatggaatgggtaagggtcaggttataggcgtaaaatacaagaatttagaaaatttcgtaattttaaaacttatttgtgcgagtcggattcttaaaccgaaggaggtgtatatcactcttttaa

SEQ ID NO: 23175 - DNA, 1931 bp, Heterodera glycines
aagagtttcccatgcgatagacagtcacaggggaaactggacgcccagctcatccaaaacctgttcaaccatggcgttgtctcctcgtgcacgggcacttggtttggtctccttgctctccggcactcctccaatgacaatgctcctctgtctctccaggtcatgcggtgtgagcacgtcaattgagctaatttgtgtgagctgtgtagagcaaaccaggagttgcgctttgacagcggagagaagcaccattgagggcgtcgttgtcaatagtcgaaagtgcggagagggagtccaactgtttaagaacattcttaacattgtcagcgacggtgttgattaaatttgagtcgacaattttttggggagaagatgggtggccggcgtcaatacgggaccgcttgcgagaattaaagacggaaatattaaaaatcatttttgaagacagataaagctaaaatttaagaatttttagtcaaaggcttcaaatcacgctaaaaacattttttcgtacgcttcaggcctcccacagtccaggaaaaaatatggatttccatataatttgacgccctatcgatcatattcccattttactccgtgaatgacatctgaatccttctgtttactcatattgttgtatagatcaacatcaatgccttagcaatattagcacctcagattacccctaaaaataattttccttaaactaaaaaaagttttcgggaccaataatctcctccataaccgatttttgttcctttagatcagattttaaaattctcactatctgttaaaatattgaagaaaatgctaccgtttggttcccaattcatcggaggacagccaacagcaccaaatttgttgtttattacttcgactacaacaacgcgttcgttcaaattggttggtctttctaaatcccaattttagcagctgctgcgaatatcattgtgtcgaatgtgctttcggttccttctctgaattttccgcagttgccaagtggccctcaacccccgccacagcccatgctgatagcaccgaatattttaaatgaaattaaagctgagtcgtccgccggtgtgagtaacggaacttcagtttggtcccaacacaccgcagatgatggaagaagttactattacaataaggcaacaaaagtgtcttcctggaccaagccggacgatttaaagaccaaggaagaggtcatttgatgggaggaaattcataaggatactttggattgtttagaaagagctttctgtatggaaggagtacaaaacaccggaaggaaagccttattattacaacacccaaacaaaggtcacaacatggtcaaagcccgaagcgctgaacaaagttaagtccattctctttttttgctctggagcacaaaacctattttaagggttcttatcatgaaatcatcaatttgatcagaatatggttaataagttcaaacaaattcctttgtgcgaatgttctaataagcacatcaacttttagcttagagatccaaacatctactccattatggaatgctttatctgaccaagaattaatcaattgttgatttgttcgatctttagtgcttttttgcaaaaataaacctttataaaatcatattcttaatgattgtcatagatgtaatcccagaacattcaatttaagtgtcgttaaaatttagctcggttatagtcattttattcctttcagaacgatattatcttttttcagaaacaaaaacaaagatagaagaaagcgatgcagcgaacgaatcaaagcccgatttggttcatctttcatcgaattccgaaattgaaaaggcaatggaagcgactttaaagaacttaagttgtgaagaaaagcgacgaacccctccaagcgaaagaaattacacaaaaaaaggagaggaggacgattctgaatacaat

SEQ ID NO: 23176 - DNA, 1321 bp, Heterodera glycines
  misc_feature (29)..(29): n is a, c, g, or t
ctgacgcatctgttgacgccttacagacncacacatacaaacacaaccgagcgcacgttgtccatgaccgtcgtgaacgctgattcccgccttgatacaacgatcgcaaatcacctcagcgacgatgagcaacggaacatgcttttgggccacctggttgttgttgttgttgagctgaagtggccgatcttgtgatgtctcggcatcaaagaagcaaaaacggagtggttgttcgtcgtcatcttcatcggtgtcattctcatcatcatcttcagaagcaacgtcgatgttgatgctgttgttgttgactcgcgcagcgcgagatggtccagggccaagtggctgtatgaagcatggctgatcattcgtgtgcggtccggcacaaagacgacagtcatgcgctccctcatcggcttggccaagtggtggacactggtgaagcccaagataggcaacacggccacagtctcggcaaaatcgtcgccactgacaaagcgtacgacgctgtcgcaaaccacggccgtccaatgggtcaggtgcctggttgacaaggtggtagttgaagcagtcgtcgcaggggaagacgaagccacactcgttacaacgacgggcactgctttcaccgtttggcaactttttttttgaaaaaataattacatgattgacaacaaattaatacttacttgttccgacttgcacgggtatccggcaccaaagcggagacagaggcgacacgcaactttgcaccccgaggcatggtaacgcgcatccgcccgtcgctcacagtcaatgcagtagccggggactttgaacagctgctcaatgcgcccaatatagttgtaatgcgcgcgctccaacaaaaggcagagattgaagcgggcggcaattcttcaatatatcattgactaatccactaaaaataattaacatacccatcgcctttgaacactatccggtactcctgctctttctcgaacaccacgagccgaatttgccccactccatgctgattgtttagccattgttgaagttgtcgtacgtcatcaagcgtgtacgtgtgtttgttgagggcgacgccggcattggtcagtagatcagcagcatccgcgccgtgttggtcttgacgaatcgcgtacgcagaaagtgctgcacggccaccgccaccggccattctcatctctcggtctctcagacccagaagcacggcacgcgccaggcaaagcctgtcgtcagggttgatgacacggatcagcgactagtcgctcaatcgctgccgccagtgtcgcagcgttgttctgctcaggtggtcgaagacggatga

SEQ ID NO: 23177 - DNA, 1866 bp, Heterodera glycines
  misc_feature (1773)..(1773): n is a, c, g, or t
gaagttcagacagcaacataaagcgagatttggcagtcacagatcacttttttccacatacatttccgattatttgtggcgtaggcaatttggaggaccgcacattttttttaatttgtggacccaaatcgcggaattgtatccaataagcacataaagctcctttatttgttatttaaagcaattgtgacaataaaaaagcaaaaaaaactgaaaaatgcgaaaaaaaaagcggatacaaagtccactagtagcatttttcagttttttttacttttttattgaatcgacgtggcagaagttcaagcagcaacataaagcgagatttggcagtcacagatcacttttttccacatacatttccgattttttgtggcgtaggcaatttggaggaccggacattttttttaatttgtggacccaaatcgcggaattgtatccaataagcacataaagctccttatttgttatttaaagcaattgtgacaataaaaaagcaaaaaaaactgaaaaatgcgaaaaaaaaaaagcggatacaaagtccactagtaccagaagccaacggcgagcaattaattttttgaaatgctttttctttctttttctttaaataatgattcttaattgcttcaacgtttttttttgttggtttttggtttattttatagaccaatttgaaaggataaatgccgataaaaggaaaagcattgaaccgaaaatttaacacagctcactcggcataataatagagccataaatctttaaaatgaacagactgtgatgtcatatgtgccattttcaaccaatttaattatatttaattgtcaattgtcaatttttctcttaaatttaattcttttaaaaaattctattcacttaataatagagccataaattcttgaaaatgcttcttgctacatatgatgtcatctgtgccatttttgaaccaatttaattgtatgtaattggcaatgccaatttaaaaaaaaataaaattagctccttttaaaaaatgctaatgtaaaatttttttaattcatttatcaaagaaaattgcttataattcaaattaagtaactatactttagcttacacttttacttaaaatttattagcttcgtaattgttgtccataattggcaaatgttcatttttgtatggtctgaaagccaacaaaaattggcatttatgttaatttttacgcaaaaaataaaatttatttgaaaaattcctttccaatttttttttaaaacctcaaaattcattcaactcttaattgtttttaattttcaaaatttggccttcatattttaaacagcagcagtcttagtttttttttcattcgacacacaaaaaagaacccccgaggggttcgttaatttgccaatttaaaacaaattttcttcatcattcacattcagttttggcctgacgcccagccgccaaccaccatatttgttaaggaggggacggggggctgtcatgttcagcattttgtgtgtcattttcgggcccggaaacgcaatttggccaaaatgagtgtccccgtagaggggggggggggaccatttttatgtgcatacaatgataaatgaattgttggcatggaatgtgaatgtgtgccgcgccccgtgccgtgtgtacaacacacaacgaccacttttctggttgaggacgatgatattccatggcacatttcccagcgctggcaccttcccctccggggacgactgaaattggcacattccgtcctgcgcaaattatcattattanaaatggcacacccccatcattcagccctccgttttggacagaaagtgcattttgccaaacagtatttttttcaaatttgggttggaagtcaaa

SEQ ID NO: 23178 - DNA, 2205 bp, Heterodera glycines
  misc_feature (33)..(33): n is a, c, g, or t
  misc_feature (80)..(80): n is a, c, g, or t
  misc_feature (208)..(208): n is a, c, g, or t
agacaagatggtagagttttaaattccgtctanaatttataattaaattaaaaaataatttttaagattcacaatttttntaaactagagttgcacgagaccggactagtatttgtctcaaaaaaacagactgattttctttaattaaaatagcaaaagataaaagtttatttagcaaagaacccaaatttaaaaaccccaagaaacnaatagaaggaagaacatttaaatacatccctaaagattgaaaatttttagaaatttgtggaaaacacgaattatcggatcatctatgcatgtattaaaatgatttttttccttcttaacaaaaattttatgggtttactcattttttttcaaaaaatcaaaacactttttagaaatttttttcatattttcatatttttatccacgtttcagttttttgtccatatttcatccatattttggattttttttgtccatataaatccggtcattaattatgacaagggatttaatttgtaggctctaaaaactgccaaaataggtaggctctaggctgtaaagcccctaagataggcactaaaaaccttatttttaggtgcgtaaaataacaaaatttattcaaaaaagtaaaaaaaaattggccaaatcagtattaagctaaataattttaaatcaaaaattcttgtgaagaaaataaataaataaatttttgagaaatatttcatttatagggctgtattttttgcattttaaaaaataattttgggcaaaatgacaaaataggaaaaaataggttcttttaaaaattctttaatcttttaggctctaaaaataaaaccctagaaaataggcactattaactcgaaaagtagcttaaaaacaacagaaaaaaaaactttttttttttgtgcatttcaggtcaccgggagctaaagatcatccataaatgacaagtaatacaaggcataggaaagaaaaatacaaaaataaaaataaaaaacgatattgaagaaattataatattttacctggttcgtaattaaattaaaatcatcttcaccaatcaaatatttatttggaaaaaacaataattaattatgaattgataatttagaatttgttggtgcacattatcattatgaacataaagttatattagaatacaaattatagaaaataataatgagaaaattttagataaatcaaataaaatgcttattttaaactaaatgtactataattgaaaaaaaccgctgccaaaaaagcaaccagtgcgtgagaataattaatacaagtaaattaataataaattgtgacatgttttaacattccaaatgtaaaatcataccattaaaaatataatatgttccttgcttttaaaatcttattaaaatacaagcaagttttataagtgaattaaaaaagacatattatgcatgcgtatactcattaaatataaaagtataattatgagattaacaaaagcataattaaaatgttaaattaattattaaaataaatgaattacattgttaaataaaataataaattttcaagtataatttaataaattttataatagataaataatgaaaatgtagcaaaacgatggaaaaaaaataccgagtttcttgcactttttacgttcaaaaggaattttaaaagatacttaaataaaatcaattttatatgaattttaaaatattgcttcctgattctcaacaaacccaagcaaatgtaattcaaagtcgagaagtgctttgttcaagaatttatactatttaccttacaaaataaataacaaaatttcaattaatgttcctcataaatatcaaaaaaatatttcatatattcgggcaaaattgtaaaaaaataactatttattagatacccataagagaaaaaaataatcattagaccctttgctagctaataaatattgacatttaaaaatgaaaaaaataaatttattttaagataaacgaaaataatgataaaaatcattaaaacaatttttacatggattatattcaattaattaactacgccgtgataatagaaaatttaaattttatattaaaaatataaaaaaaatagtgcaaatacaaatcagtaataaaataacaaaattgtttaaaaagttaataaattaaagatttgttattatttaaaaataataatttctgaaaacaaattttttatcataataaaatttaa

SEQ ID NO: 23179 - DNA, 2353 bp, Heterodera glycines
  misc_feature (2327)..(2327): n is a, c, g, or t
attgacggcaaccagcagagattggcatttgaattggcaggcgtttagaagaaaaatggctgggaggataaatggatggcttttaggtgatcaacaagggcgaccagtcgttgcttaattacgtgtgcagcaaagtcgacccggacgattacttcgaagtcagcgtgtccaacccgtccgttccgttgcccattccgttgctgctcggcctgcttcggatgctttcgacaaaattggactcggaaactgtccttcgcttccgttacattgaaaatgtgctgctgtctctgaacagtaaacactcactgctgaccatcgacgagttccaaaagatggtattggacgaacagcaattccgatggacgattgaacagctttacaaatctatcaatggtatttgctaaaaatatgattagccagagaaagaacagttttttaagcctttgacaacggtgaaatgaattcggcactgaagaggcagctgaggatcagcaaccaactgattatgaacttgctcaggacatcttgatcacagcgattcatgagacaaatgtgtcggcagaattttttgaatcaatttgtcatctcatggttcgaatcgaaaaatgctgattgtgaggtaatggtcggttttactgatccaaaaaataggagtttttgaccaattctgcgaccagttcgggcattttcttgggtcctgatcacgattatgatattcattctatcaatttcgtatcctaaaatacaaatttcggatacttttttattatttcatgtaaaagcagtcaatgtttttgtttcttcaattatacaaaaggcaatcaatatttcgttttttccttttcttatttggtgaggaattgctcaaaaccccattttgtttatattttgtaggatcattaaaactgaccattagcaagaattattgccattacagcaccattttatttttcgatgcgaaccattaaaattataaccattaattttactgaattttcttcgatagtttgcaggttgacagtttggacggccggttgttccatatttttgcttctttttttttttgcacattgctcatacaatgttcaacttttcattattatatattttttttttttgttatccattaagagaaacggcaatccaaaattttcttttctatcattttgaataaattaaaaactgaccgaaaaataaagtaataaaaacccattcattattcgttcagtgccttaattatgaaacagtgcaaattttactgtttgttgaacttcaaaaaattttgcatttcagtttaattcaaaatctgttccatctttccatctctctctgaaaagcatatttatgcacaaaataattaaaaacacagacaaaagaaaggcgtagaaagataataaatgagtgagcaatcggaagtagagaattacgatggaatgttttgccttgggtttgtcttagggccaatttaagcctctgattttgtgggtgtgaaaatgccaaagttaggcaacaaaattccccgagtccgtcctcctttccgtttcggcatttgtgtcacaaaggcctttgccttgtccattggcatcgcgaatgctttcccattttgacaaattgctcctataagtgtccatccgacggcaccactccctttgagccgatcggaactgttccacacttttgggacgggcgcagtcagctgagaaaaggggggggggggtaagggggtcagacggaaaagttaattgactaattaattgggggagggatcagacggaagttaatttcggctaattattcgctgattggtgccttaccgccgtccactctcagtgagtaaatggccaatggcacttttccatttgcactttcttccgtcgcgcattcgtaagtgccgtccatcgtttcgcttaagtaaaacaattggaattgaggcgtttgttgcctttttcacgttgcgtttatcagcaccaatccgccgctcatcgaatgcacaaaatgtggcatttcttcatcggatggaactaaagacaatttaaaaaacaattaatcaattcaattgagcatttggaaagtgtcaattagtcaatttattgatcaattataaaatgattaatgctctctccctttgtctatgtgtctctcccccctctctttctctctctctctttccctcaccgacaaatcctttcatttgctcacttttccgtccgttgtgtttccattgtgccatttgtccttcgctcggacatttcaaatggacagaatcgccgggaaagacagtcactgccacagttttcgtatattttgcgcaccgttcggtcacttcngtcggccgggggaagggaaagtcgct

SEQ ID NO: 23180 - DNA, 1724 bp, Heterodera glycines
tttttaaattttcccaacaaatttttttaaaagctttcgtttttaagggacattttccatcagcgtcactatagaagcggctttaccgcctcatttcccattcatttgccttacaattgccacgatgacttccactgttccacaaattgtgctccgtctgttgctctttgctgtcctcattttgaactgcttcgactgttgccatgggtaagctttcggatttggaagcattttgcctcacttttttgcttatttctcggtcaattattttcccatttttcagcagagttcattctaagtccagcacagttccaacgactacgaagtccagcacagttccaacgactacgacgaagtctcctccagctccaaaaaaaggaagtattctcgacaaactcccaatttgggccaccattgtcatcgccgttttaattgggtgagtttgtctgctgcttttttgccgtgccattttcctccgtcttcaatttgttccccatgttcagcatggtcatcgcaattggcattgtttgctgcgcgtggtggtgctgccttcgtcagcgatatgttcgccgttctgcaactgatgggccctcctcgtcactgagcgacaccgaaaagtcaaagggcggcggatattcgtcgaagccgagcggattgatgtccaagctgcctttatggaagtcgtcgtcctctacgaccaaaaccaaaatgccggacagtctcaaatcggacatacaaccatcaagggcatcatcatcaaaaacgaaagacaagtcttcgtcaacaatcccggacagcaaatataccatgctgacgcagaagcattgaacggaacggcgcggacggacggacgatgatggcattgttattgatgatatcggatggatttcatatttaattgatgtgtaattatgcataattattgtattgtttttgcctgccattttcgatgctcacacattcatttccttgtgttactctgttgtgtatggtattataattattgtgtgttgtgctgaatgctattattacctattaatggtgttgatgaaactgtgtataaattgccttgaatgcaggggtggagcgcgcacagaaaaatgccgcggatcgcgcattcaatttgccgcgaccgcggatcgcgcaaaaaaaaatgccgcgaatcgcggtcgcgctccagccctgcttgaatgaagaagctcagtgatgatttaattactgttttcgttaattgatggttgttgcaacttgaaaaatatgtttcagtacgtttttgctccaaattcggttttctaaaaaccattacaaatccggggattatccaattttcgtagattaactgtttcaagatttgttccgtttcctcaaattgcgtttgcccaaaattttttcgtattttttgtcgattttcggtaccataaatgttaaatgtaaatgtcgctaatgaattgctgcgtcgaccaatgaacagaacattaatctgcgaaaatatttgctgcgtcgtcattgtaacttgtcccaattaaaattgttgaaatgagcggcggagtcagttactattgggtcataaaaacgatagttttaccatttctggcaatttttaaaatttaaaatttgtttaaatgaattatttatttatttcggcactttgaaaatgaatttttttttctcaccaacacaatttgcattgttagcagtcccattgggatttcattctgtggtct

SEQ ID NO: 23181 - DNA, 1730 bp, Heterodera glycines
aggaagtgctcaagctgtccaggagccctttgggccttctcgatgatgccctgtgcagttgatcgcggatggtggcatcgtacttctccagaatttgtggagaatgtcggagcttggttagcaccgatgacagcctgctgtgggccattttgaaattggaagagaggtccggattggactccttccacggccatttgacagagtaccttccgtctgtctcttgacggattgatttgttaaacagctccatagctgtttggtcgtcatcctgggcaggatcatcctggattcccagtgattcgaggttgaagaaatgctcaacctcattgatggttggcatttgttccacatttgtgctgtggatggccatcatcgaaagggccttttgacttgagtttggcggtccaatagtggactcgccatttaccagcgggctaaatgctgtgttgatcacaaacagcccgggagacacttctctcttcccttggaagaattgccagaagtgtcttgcgctgaggagtatcattggctcctcctttgtgaagcacattgcttcacaagcttcgtgatgattcgtgacggattcatcggcgctccattcgaccatgctgaagtgagtggagattttctccgtccgattgagtagaatttcctcccattttccgtccgccctttggagaaggacggagtaaatgggtgaatggaagagtaacggctcccgttttcctccaaacccgtggacctccatctcttcggaggtgagtttgtgcgggcggagcttatcgataagcggatccgctccgtacgttgtttggcttcccgggtcaaagagcactgcaactttgattatattccggctgtcgcgacttgacttagccagcagccgtcgcgtcatcagatacgcgtgcggctttttgcacttgggaaccttgttggctctccctttgctggtgtccacggtggacatccccatggattgaacgatctccccctctcttggtggagggtttgactgatcgttctgttgaaatccagccgtgatcaggtgggtttggctttccacctgccgctgagggaactttcgccctcctggctctcttcccgacttgggggaggaagcggaacgattcccatttgaccgtgaatgggactcctccctcttgaagcatatgaggaagtggtgtttgttgccacagtttcggcaccggtatggtgaggtgcactcctcagtgttgtgaccttgcacaaggcagttgaggcagcgctgctgttctttcagccgttttcgacgagctcccggtgttgggaatgccgggcactcgctcgggagatgatcagttcccgagcagaacgagcaggaccgaccccattttcttgctggggttttggccctttccggatttttgttaatagcggagaacgccctatattctggctgaggcgttcctccgcgattaaatggccttggtggttggctctgtcggttgttggagtgacggtggtcacccctttgattccaggcacccctctgttgaggtggggaattgaaggcggatgaacgtggtcgttcatcgcctcggaggacatgtgcacatctctgcacttcctcctttacttccactattgcttgaagtgcctttctgatgtcaaggcacgaaaatgtctttcctgaggaaagctctttctccgtcggcgtgggtgaggatggagaaaggaagcttcgacttgat

SEQ ID NO: 23182 - DNA, 1189 bp, Heterodera glycines
cagttggccaccgcccccccccccccccccccgaaatgaaaaattcaaaaattttacggtaaaaattggcaatttaaaaaaatttaaatcaattttcgtaacaaaatgcataaaatttgaaaaagccgaggggacacccccatttgaccgtagttttttgaaattttgatccaaaaaaatagacactttttgccgaaaaacggctacaaattcctgttttttttttctccgcgttgaaatttctaatacaatactggtgaaatattttttggccaaaagagaaaaaaaaagctcttcggttacccctcaccggacaaatatttttctggttacgggcctgtggctttgatcaccaccaccacaccacacacattttattatgatgattgaaattatgtgttgtttgttgttgtattggaagttttaggtcgaataaaaaagaaataaaaataattttgtgtgttgtagaggtcggcattttccacacacacgtgcgtggcaccgaccgtcacgggcaaaaaatccgtgtgtccaaataaacagtggaaaattcattcttcaccaaattcatatttattgcttgccccaaaccgattgaaatgtactgaaatggccgttcgtaaatttccgactttttgttcgaattcatgtccggcgttagaaatgagtcgaatggatgtgttattcgtggtcagcaatatattttttttgccccaggaagagaaattttcaaacaaaaaatttgtttcgaaatattttttgagagttggccattcaatcgctgcagcatttatattttttgaacacctagttttgtcagaattttacttgtcaattcggcagcatcattttttttttatcaattacatttacctttatttacatataatggcgtaatccatgaaaatttgtaaaccaaaatttaaaacaaataatattgcttttttattaaaaaataatcgaaaaatacaaaaaagtgcataaagcaaaaattaattaatgtttataattctttgttatcctcaatccaatcagtttcttcttccttttttacacttttcaactttctttccactctaaaaattgtaaatttattaaaattaaattgttttttaaattttaataaaaatgccattacatccaattcatatgctgaacaagcagtccttttgttaacatggcttctcat

SEQ ID NO: 23183 - DNA, 2783 bp, Heterodera glycines
ccgataaataaattaagtgatattggacaataaaattaattatttaaaaataaataaattaggatgggaaaaaaacttttccaaaagtaggtcatgttctttaactgaacataaagataaagaaataatggtccgacgaaaaattttaaaataaaaataataaaataagacgaaaaaattaaacgtaaagataaattaaaaaattgaaattttcaagtgatggtgttccgtaccactcgccatattatatatatatttgtttcgcttttattttttttcgctcattttcacattagccaaatttcaattaatttaatttttttttctttctcattttaattccttttgtccacaatgcaaaaataaaataaattaataaataaaaaaataataataaatataaaatatatttcacatcatttcttctaattaccatatatactgcattcccaaatccaatttttgagtactgtaaaatccattttcaaccttttttaaatataactttcactcgcatttccatatttaatttgttgacgcaaaatacatttcccatcattttttttctcattttcactccgcatttccaaatttaattattgacaaccgtaaaaatccattttccacagttttctaatataccaatttttccagtttccaacgaatttttcctctcttcgccatatttaattcggaaatactcaaactataaccagcaaattttcaattagcaaagtactaattaattaattaaaaaactaaaaatcaattcaacaaattatttatttaacaaataagtgtaatttaataaaaaaattaacaaataatcggcaaatgcttactaaagaccactaacaatagtggcctcatcaaacacagaaatgcgcttacggtcagtgagacggcggtgacactggtcacagtgaccaacagttttaaccggcacaggacggttacagcgaccaacaagcaggacggacaaaacaaaaagcacaaggacaaggacaaagttcaacacaacagaggtgtggaaggcccacgctggccaaatcggatcgtcagtacagtgcggcatgtcatcggcacacagaatgggctcctcccactcttccaagccaaaacagcgccgactgcaattgtggcccgaacagctgacgcgccacagttcgagcttctcgatttctgttaaatcgcttaataacacatgctaatctctttccccctcgtctctcttctctcatttttcccttttctctttctctctctttctcttacactatttcccaatgtatcgtaccgtacattcgctattccatttgaagtgacagccgccccatttttgagcccaaatattgcgaaaatttccccattgtttccccaaataaaccccctgacggaaagggcccattcctaagggtggaaaaaacaaaagcgctcattaattaacaaagggaaacattttgggggagtaattaaatcacattttttgtcccgggacataagcgaaacacaagacaaggatccgaagattgaagtaagcaaaagggtcattaattggggtgcttaatccatcagaggaggaaaaacgaatttgacaaaagaaactgaggaaaaactgaggaaaatcgtaacatttgaggaaaagagaaataaagattaattgaggagaaagacaaaaggcaattaaaggagtcgggaagaaactaaaaacggcaaattggcgctaattggctgacggatcatctgactgagaacacaatcgacaatttggcactaattgttgtctgatcaattgacacatcatttgactcggcaaaaattttcgccaacaattcattcctcgccatttgctattttttaaattaactgcggatcacccactaccacttcattacattctcatcaccaaaactacaaatttcttaattcattaactgatcatcgacaattatattcttttattcgaattcactttaattcgacaaaatttcttcgagcactgaagaagacgacccaacacgggagcgaacggagcgtgagaaaagacattttgaactcaatcagaaaagggaacttcatcggatggaagtggagaccctaaaaaagagggtctcgactttagagcgggaattggattcgatggggacagcgcgcacctcagctggcttgccacatccggggacttttgacggaacagcggactttcacaattatttaaaatcttttaatcttgtggcgacggcacatggatgtacacctgttcgatgtgcgcaaattctaccattatatttgcgcgggtccgctcgggctatttacgatggattgctacaagacgataaatcgaattggaagacattagtcgacgcactcgccaccaatttaaagaaggtttcatccagccttgttgcgcggcagatgctggcaaaacggaagcaacacgtcggcgaaagcttagacgaatttgcccaagagatcaggactctagtatcaaaagcgtacccggatacgtcgcttgaaatgaatttcgatgcgttagtacttggagacatggaggaagacgtgaaaagggaacatgacgagcgactaaaaagattcagatcgggaattgccaaggattttttccgctcgaacatgacggcatcaatcaaagaaaaaattctcttcatggatgaacctcagtcatttgaagaagcgatcacacaggccaaaagggttcaacaaatgcagggagcgttggcagaagatctctggaaacaaacacaaggaaccaaagccgaagttgc

SEQ ID NO: 23184 - DNA, 1016 bp, Heterodera glycines
ttcaatcactgggactcaacccaccagcatttcaatcactgggactcaattcatccaacatttcaatcactggtactcaacccaacagcattccaatcactgggactaaacccaccagcattccaatcactgggactcaacccaccagcatttcaatcactgggactcaatccaccaacatttcaatcaccgggactcaacccatgggactcaacccacaagcatttcaatcactccagaattcaatctcaccaattcttcgaaacccaataaccggaaatgaatgataaaaccgacagcggctcgaccgcttagcggcctcgcactcttcttttggcattttcttatggcataacagttcttccttgtttcttgacattttcttacgacacaacatttttcttctatacaaatttttcaaccaaaatctcattcattcatttaaaaacataagcaaaacaatacctttcatatcaaaatcaaatcactttaaacacaaacaaaaaataaagaaaaagaaacatttttaagactgttttttacacaaactgacaaaagaaaaactgtaaaacaaaaacatttcatttttcacagcatttatacaacacaacacaatgttaatattataggattttcttactgaataaactaaggagtgtcctctttcttttattaaatattttataaaataaaagatgggatataaataaggaaggggtgcgagacaaattcactattgtctctcccttccatttcttttctcttatttcttttacttttccacttactctctcttttttcccactccctccctctcccagcgcatccagcagactgctgctgcacagcagcagggacacacgcgtttcggcgccgcgcgtttcggcgccgcgcgtttcggcgccagcccagtttttggactataacttttttctttgtcaacgaaatcaaacattgttggtatcattcgaaagctgtaaatgtcctatattagcctacaaaatttgaaaaattat

SEQ ID NO: 23185 - DNA, 1047 bp, Heterodera glycines
  misc_feature (980)..(980): n is a, c, g, or t
  misc_feature (1022)..(1022): n is a, c, g, or t
tagcttcaaaatatatatttatgcatattgaaaatactttttttcatatcattgaatttgttaagcgataatgttactgatttagaaatgaaagtaaatatcattatgctacaaatgaattttcatagaaaaataaaaaaaccaaaaataaattgatttataattgaagaaaagcgatttaaaatttttattcaagtcttctaaaataatttaataagtgaggtgataaataattattaaatgtaagaaatatttagaaaaatattaatttctgctaaatatatataaaaaataaactttttttaagaatctttaatttaaattaaaattaaaatttttaaataaaaacctttttttaattggaaccaaataaagaaacaaagaatattatacatacttggatttttctaaataagtatatttattttatcaaaaatttttaatttaaacctcgagacttcttagcctgcgtcaataaattagttatattatgttgtatgttttttaataattaaactatttaaagaagcagagatgccatcatcgacaaattttgataaaacgttgaacagacaaaaataaaacgaagaaaattgatttcattattaccttaaatctttaaaagcaaaatacttcatttatttgtttcaacaaaaatagaaaataataatcatttgataacttaagttattattttgtcaagcataattacccttaactgatcaggctcaagaaggcgccgccccgaccgccagtacttcaactgccactgcgtatacacgataattccatattacaccataaatactttcaaaaatatgtatatgtatatgaatttatttatgcatagtgaaactaattttatccatatctctgaattcgttaaccaataatgttagctgatttagaaataaaaataaacattattatgcttaataaattttaagaaaattaaaaaaccaaaaataaattaattttanattaaagaaaagtgtttaaaatttttattctaattattctanataatttaataatgttaatgatacg

SEQ ID NO: 23186 - DNA, 891 bp, Heterodera glycines
  misc_feature (58)..(58): n is a, c, g, or t
gaaaaatccattttaaacaccaattttttgtgattttaaaatttttgagaacctcacnttagagaaatttatttcaatatttttgttattttatgtccctattttttgtgatataattaccgtaaacatatgggaagagataaaaaaaatgatttctgcaaaattatttgtcggttaaatatagcacattatttgttacataatgcaaaaaattccatggtcaatagagagagtttcagaaaatagacaattttttaaagttcattttcggggaggagtcgtagagcaatcattcaaatgcgattatgtagcaaatttagtgttcttaatgataatcgcattcgagttgtcgaaaaagtttttcccaaccttcttggatgtgattaagcacctataatttgttacatttgttaaagcaatttggttaattttgaaaaaaaaacataaaaatatctttcttctaccttttcagttttagtgcacttacacatgaattttacagaactctgtcaatatttggagttctttgattagattcttgtacttgtaaattttttaaaattaaaacattgcaattggatatacaatcaaataatataaaaaacaaatccacatgtgatataagacagtgaaatcaaatgaaattaaaataattagcaataaaatattttggaagtatatttggaaaagaataaattttaaaatgtttaactaaaaaatgattactaaataaatgaattaacgaaaacgaatagataaagagtagaagcaaattatgccagactaattaactgctaaattaaataaataaaaaaggctcccggaaaatgcatcagttgacgcattttccataagcgaaattaaataaaatatgatatgtgaaatatagag

SEQ ID NO: 23187 - DNA, 1312 bp, Heterodera glycines
cgggaccgggaccgggccgggaattcccggtcatccgaggtcccggttcccggtcccgggttttgaaaagctcaggccccggtcccggtagggcaaccgggaaccgggaaaaacaagcactggtaagaatgggggtctgagtgaaaaattagtgaaggaaattggagtcaaagggaaaaatttagaaataataattaaatatattcataaagtagcaagaccaactgtgccaatggcctaatggctagtctccttcactttcccttcttctttcccctggttcaatccctctacagaaatgaaaatattttgaaatttctttttatatatactcatggctttcctatcgacaaaatatgattcttaatttttttttaattgtattttatcatttttaaagaaaatccgtacaaattgagcctagtaatcccaaaaccagccttttttgttgaaaatctgttaacaaatctcactcaaattttcaaaatttcccccggcggaggcaatcggagaaaattcttaataaaaatcggatattttcctgaagaaaagcaatttaaatgaaaaattatagcttttattaaattattactaattattaacgggaaacttattaaaatttctaatattcaatctgtctctcttgctttctctcactctctctcatctctctctaaaagggagtcccaggttcaatcccacctgagttatatatttaattaagcaatatttcacatttttctcaacgaataaagaaaaaataattaagtcatattattctaaatttttttaagtaaatttaaaaaacaaaacaaaatttgatcacccaataacatcaatgacagcgtcatcttcattttcaccatccgaatgctccaaaaaattgtcgttttctttttggtcttacagcctctaaaatgtttaaaattcaaatcaaattcaactcgtcaatggccagcggtggcggggtcgtctctccggtgtccattgacgcagttggtgttgtcgaaaacggcaccaaatcgccgattggtgtgacagatgtcgatggcagcgaaaagccaaattccaaaatttcgtcgtccatctcgggcgtccgcactggtcctggagttggtggcggcgactccatcgcttcttcggccgatgcagcagatgttaacggccctgcttcgtcctgcggtgacatttcggcattgggattcagctgtggagcggctgaaattttaaaaaatgatcttgaattaaaattagtgaaaaaactcacttttgttggcccatcgggcttttgtcgccttgttaattcctgaaa

SEQ ID NO: 23188 - DNA, 2562 bp, Heterodera glycines
tcgaaacgcccaaagcgacgaagagccgggtcaatgcaattgggacgatttgttgcaccaatgacaatgacattcgagcgctgcttcagtccatccatcaaagtgagcaattgcgaaacaatgcgacgttcaacttcgccgtgtgtctaaaaaattaattcgtgtcatcgatcaagaaaaccctcttaatcagggaggctgcagtctaactataaacattgcaaagaaaatgggaaaaccttttctcttttcggggcaattgcgtcaatttcatcgatgaaaagaatggcaggcgaattcttctcgcactcggaaaatgctttgcgcaaattcgactccgactcaccagccaatttactcattatttcaggtcctaaattacattgccattatttacaaaaaaaaatctcataaccattgagcaggaaaaagaatgcgccagtttcattcgcgacagcacgggccacaagtgtttttccagtgcctggcggaccgaacaaaagcattcctcggggaggtttaatgccgatggatttgaaaagcatcgggtggcggagcgggagttcaaccatctctttgatctgcgccaactgcttgcgcatcccgccaatgtcatcatagccgacgtcgttcagattgttctcctcgtcctcacgtttgatcggttccccctcacaatgaatgatcgttgttgggaccacaatgcaagcaggcgccggatcagtttcaatcacttaaaggagcaaaaattgtagtttaaaagggaaacagcatgagtaaaaccaaatattctcaagtttaaacaatgattctctaactttttaaagtctgatccgtcaacacagttagttaagtataccctaattttttcttgttttaaaaaaatctccatagtggatgtgatctttttatgtttgaccaggtcccggggttttattagattaacataaagtcaaaaaacgtatcttaaactcaacagttcgcattgctgcgttgacagtgaacgtgtcgcctttgtaaaccggacggtaggcctccaaaaagtagggcttaagaaacacctcgaacaagtttcttaagcaaaaagatagggaatatcatgtcttacaaggcttacccggtcagcccctcaacggtgtcatcaatcggaagcacgtgaatgcgcagtccatttggcgtatttgaagcggacgacacactgacgacatcgcccagtttgacgcggagattctgacgcacaactcgattcatcaagattttctcgggaggacaagtgtcactggctgaagagattaattaatttcacgtagaaaatgaggccggataacctatgacaatgctagttgtctcacgacgtttttgcctttgagaaggatcgaatcgccgcgaaacaatcccaggtcatccattttagtctaaaggccataattagactaaataacgaataagtttcaaacctgtgccattagaacgctgctgttatcgtctttgggcgattggtccacaatgagtctgttcggcttcggcattttcttgagaatcctaaaacgtcatcaattttcaactccttagcatttttaaaatattacgcagttgccaactcctcatttcgtttcgttttctcatctttttgagttggaacagaagccattttgagagtctcagaaatatcgctaaaaaggtaaaaatttagcttattgggggaagaaagtcaaaacgaaaaaacggctctatgaaatttaagtgagcgtccaagtctcgggaattaataaatacaaaaatttatggcttaagaaactgttaaaatgatagtaagcaaaaaaagatataattcagcttatataaacacaaaatcatctgcaaaggcacgacattgtgtaaattcaattgtcatcatttcttttcgacgatgtgaaaaaaacgctaacgctaagtgttttgacgtaattaataacagaacgccaaataaagaaattcaatataaatttaaaaaaaaaatttaaaaattgtgttcgattacagtagttaatttcatagtaaatttcaatatctaattgtttatggataagaaaaagaaaatgaattttattttcatttttccaattaaaagtggaaaaagtacaacgaaaaataaacgcatttaaatgataaaaaattgcactgacaagaaaaggcatcacagaaaagttttttaattgatcataaatggacagaatatcatatgcatagactggcgtttataaaataaatagacgatgagcgaaactcgaggtcggaaaactccgttcttatttatgcccaagagtttcgccacccatcgacgacccgaattggtattacaaaacacagtaggaattgtgagtgactgatcatttacagtaagaattgtgatttatgagtgagtgactgtgatcatcattgaccaatgcaaaatgtttatttatcccttcgctcttttggcattagatttgattcttgtcgtttgtgtcgatgggctgtggtgtcgtcatgttgaaaatatgcagtgcattggacgaatagaagaaatatttgctgggcatt

SEQ ID NO: 23189 - DNA, 848 bp, Heterodera glycines
aatcatcgggactcaactctccagcattcaatcactgggactcaactctccagcattcaatcactgggactcaactcaccaacattacaatcaacgggactcaactctccagcatttcaatcactgggactcaacccaccaacattccaatcaaagggactcaacccaccaacattccaatcaacgggactcaaccctccagcatttcaatcactgggactcaactctccagcattcaatcactgggactcaactctccagcattcaatcactgggactcaacccaccaacattccaatcaacgggactcaactctccagcatttcaatcactggactcaacccaccaacattccaatcaaagggactcaacccaccaacattccaatcaacgggactcaaccctccagcatttcaatcactgggactcaactctccagcattcaatcactgggactcaactctccagcattcaatcactgggactcaacccaccaacattccaatcaacgggactcaactctccagcattcaatcactgggactcaactctccagcattcaatcactgggactcaactctccagcattcaatcactgggactcaacccaccaacattccaatcaacgggactcaactctccagcattcaatcactgggactcaacccaccaacattccaatcaacgggactcaattctcctgcatttcaatcactggggctcaaccctccagcattcaatcactgggactcaacctcagcaaatttctttagcatttttaactttttgtgtgccttgggatgttgaacagttggggagggctcggccgcttcgcggcccggtacggg

SEQ ID NO: 23190 - DNA, 1859 bp, Heterodera glycines
tttaattttatttattttttatttatgtattttgttaattttttttattaaacaatttttccttttccatcgatttgaattttcattaaagtaaacgcaaaattatttgttcaattatgtattaggtgtttacaataaatttccgtttgcttttagcaaaagaaagaatttgataatgatgcattccagccaaaattcagcctctaattcctaccagccgcagcagaacggcaacaacattcaccaaatctccgaggggacgacggccacggcactgcccgaggcgatggcacacagtcagcagcagcaaatgatggcaccaaatgtggcagtgatccaaaacggaggcggcatcaaagggggcgaagaagtgcgaaaggagtcgacggaggaggacgagtcggacgacgaggagatggacgacgaggacgtggacgacgacgacgacgatgaggaggaagaagaggaggaggaggaagagagtgggagcggagaggaggcgaaccatcgtcggcacggcacggagagcggcgacacggcgacgaccacgccggcaggggccagcacggaggttccgctggcggcgcacatggcgacggacgtggcacagacgcaggcggcgccaggcaacgcggcagcagcggcaccgccgacggggactgaactgctggccatccgagcgaatctgcagattctgaaccatcaggtggtgatggcacgatgggatgaataccaaggagtggcatggcacaaaaaaagcgtacaaatggggaagtcggggctcattcaactgagtatcataagctacgcatcaaagcaatcaaaatggaattcacttcgggattcttccatgtgttccaatttatgtcatccttggctagcagtctgatatttcgtcgcggggaaaaattcaaaaaaaattcaaacccaggcttaattctttagaattttgtaatttctctgaagagtgcaaatattaatgaaatactaaatttaaacgaactataaaatttttcccgattatttgagttttttgggatttgtaagaattaggctgacgtgaaaacttaaattgaatttttttttcccggcgacgttttgtcttggaaacttttttggattgaatcgcatgaattgtgacagtttaatactgtgcgatgtttgatcaggagatgtgtccactctttgtccagcactaatcactctcattgcccccccccccccgtcagatggctcttctgatgcgtgcgcttaacgtcgcgccgtgcgcctgtgccgagtgccaagacgcgcagcgtgtgcagcactgtgtggcactgcccgtgtccaatggcattgcctcgcagcatttgcaacacgccgctagacttggcaacatgcacagcggcagtgccgcgtcgtccttcgcgacgcccggcactcagcaacagcagagtctgttctccgccggcggtgccgacatgagcggaagcggcgcggaatcggcaccgcggggccgacgctctaaatactgcacgccggaggagaaaaaggtgtggccgaacggatgaggctcgcccgggggggcttttgcccgtctgtgccattctcggtcgagttcaaattttggcaattttcttggaatttttgaacagatggaacataagtggaccgagcgtgtatgagaagcacctgcatctctttcatttaacataatgagcgacaaatgacagatgggtttctccattagcggtagtaaaaattagaaattacctctactgtgtccattaaaattatggacaaacgaatcgatgaattctactgtaattacagcatgctatgttcagagtcagcggtgtgacgcttattcactatgccac

SEQ ID NO: 23191 - DNA, 1234 bp, Heterodera glycines
  misc_feature (8)..(8): n is a, c, g, or t
ctatacanttttgggcgctaaacacatcccgaagacctttaagagagagaatttatggatacattcactgaacaatctttggtggagtcatgctgagtcagttcgatttggcaattaaagtgaagagtcggctgaacggaggaagagggggaaaatagcataagaggaagagagagaggagaaaggaaaagagaaagtggaaaaggaaaagcgtaggaagagaaagaagaaataaggggggaaaggaaaagcgtaggaagagaaaaaagaaaaagggggggaaaggaaaagcgtaggaagagaaagaagaaaaacaggggggaaaggaaaagcgtaggaagagaaagaagaaaaaggggggggggaaggaaaagcgtaggaagagaaagaagaaaaaaaggagggggtgtattatggggaggaaaaagctcgggggacagacaaactttgtcggcaaatttgaacacagacgcactctgtccggcactcaaatcgcccaaataatctgaaacacaatgaaacatataaaatcggaaaaacaattgtgccaattcatctccaatcacccaaatctctgatcagcagtccgtccaccgcacacccgcgtttgtccaacacttccaccgcttctccgccttgtccatcggacaccgtacacgaatggaccctcatacagtaagtcggtgtttcgggctgacaactccaccggtggtacaccttttggacattcaacaagtgctgctgctgcaactaacgcccaactgtgcttacagtatccccaattttgacaaatcgaattggctgtccgttggcgtttatccaaaggatgtcgtatctgcaaattgagacggctccttctcccaaaatgccaaagtgcacctgcaacttggcattgtgtgctggccttgaatgcttgccgaagtgctcagttggccgacctccaattgttgggccacccttttgtgactttcgctgtaaaagcaattcaaacggaaggcgcggtccaatttggtgatcagaagctgaacccagcaattgttcagtccattttggacaataaatgcccacggggtgaaaagagaccacaacaacggccgccacacttacgccgctgacctcgcgactccgtctcagcccacaccgttcgaattggacgccgaatttaatggctgtcgttgtgccattgccaagagaaggcactgaaattgaaaaacaaaaaaacaatggaagggat

SEQ ID NO: 23192 - DNA, 1019 bp, Heterodera glycines
  misc_feature (30)..(30): n is a, c, g, or t
agcaggttcctctcatttcttcctctcatntcttcctctccttccttcccttctcttccctttcctcccttttccggcctttccccgccgctttccctcattcgcttttccttctccctctcctcgtcttccttcgttctttgattatttatattagcaaagccaaatttatgcactcaatgctcacaacttcgcccgaaagaatctcaataaaaatgaatcggagagggcacagaaaaagggaaaaagagacaaataattacagagagagagagaaaagacaaaaagggaaaagaatgatgagtgaattagcagaagaaaggcaccgactaactgaacataaaaggcattagcagaagaggaaaagggagggatcagctgagaaaagccaaaaaatcgcgaattaattaattaatttattggttaattaacagaaatacaaaaaaataaaaaaagcaaaaatccaaatgaatctgattgatcacagaaagtcgtcgtgttcctccccgatcagtgccattgtcgtcgtgtgttgccaaatgtactctctcccgcctttgcctttgttcattggcactagcattttgcccccggcactgtccccgctttttggcgaattccccgccgccattccccgcgcagccccttcgccctgtgtccctttcggatttgtccgttctttcaaaggttcgctggcaatttggccattttctgcggttgtttttgcacttttaaatgactgttgttgagctccaaaatgggccgagttggaggcggccgattcgttaattgctgtggtcaaagcggtggcctcaaaatgactgaaacggaagaataaaggcaattactaattaattagttaattagccacccattaagacgcgcatttgccaacgaagcgcacaaagggaagtgatggagaagacaacggacgggcgacagagagagaaaggcacggcaatactcggaggaggccatgcagaagatgaagaagttcagacagtggttcaacacctcgg

SEQ ID NO: 23193 - DNA, 1919 bp, Heterodera glycines
  misc_feature (24)..(24): n is a, c, g, or t
  misc_feature (68)..(68): n is a, c, g, or t
  misc_feature (1818)..(1818): n is a, c, g, or t
ttaatggactttttcgtttatgcnccgcccaaaaaaatcatgatcccgaaaaagaagacacactttgncagcttctgtctttttaaattgcactgaataaccccaaaccccaacgtattttaagttaaattacctcgcttccttctgtggcagagccataccacaaaagaaattgccaaaatgacgacgacgacggcgccgacgacaatcccaatcaatatccctgtttgggttgctgttggtgttgccgtcgtcgttgttgttgtttccgccgtcgtttctgtgccgcaattgggctcacagccctttgccgctgcgttgttgccgatgttaacgtagtcggtatagcggtcggcaaccgccgttgttgcaaaaagtgccaaaaaaagctaaaattttaatcatattatggatgcagaggtgtgtctcccccttaaaaaaaggtagcgaaacttacaatgctgccgagaatcggcgcaggaagaagggaacatacaacaatcagaacttccacacaattgaccaaaagcctttttgctaaaatataatccattaaaataataggcaccacatttgctaagaatattgcataaattttcatggccatcggcaccgcggacccaattggacgattagtttttttggaaaatagacaaaagtgatttttttggcaaaagagacgttctttttcgccccatcgctgaaaatttaaaaaataccaatagcaaaaaaaaagctccggtgcctcctcgaaatttttttttgatgaaaatctgctaaaaatggctcaaaatcgtaaaatttgtcatttactctccgccctggctacgggccagtgatttgtgtatgttttgcgtgtaattttttaattggtggggtagattttttttctaattcggccaggtgcccagctaattgtaagccgttccatttcaacccaaggacctccaaaaaaaacatgtccagcaaatttctagccaagtgttctatgattataaatgcatgtaaagtgtgccaaaaaaattattgccaaggaaaatgacaaaaacaaaaaaaatgcacttacggaggctaaacgacacgcgcttttcccgatgcttctgctgttgttgtttgtccttgtcatttccaattggaattctgaaaatttaaaataatcgtaaaagaatttttgaatccaaaaaatggaaagggagtggtggtgcatttgtagatcattttttgcattattaaaacgaacacaaaccattgaattaaaaaaaacgagaattcgatcgccgcccaaaaaaaaaaatattttttagtaagagttttaaaaaaatctcgaaaagtttaattgtaagatttaaaaattccatgaaaatttttttggcgtacctccagtacagtgtgccgccctttgacagaatggccgagaaaagcgtgcagcaaaacatgcgttccaccggctccggcacgtccatcaacggctcaaaaaatgtgtcggccaattcatgaccacaggaagtgtccataaatgagccaacctgacaagagggatggtgagagtgttaaaacaaataagcaaatttattagcgtatttagtaaatacagaaagaatattgtttcccgtcctcataggccctgaaattttagggggaagcctcaaaaaacggaaattttgaactgaagtaactcatgtggccgggttggttaaattcccgtttttctcatcggggaacatgggttcgaagcagcctgactgcagaaaatttttacgcatttatattttacagccataaattggtctctattggaaacaaaactttatttaattntttttcttttgtatttcaactgacttggcccgactgtgtgagcacaacggcacgcaaagcacatgtttcaatgtccccaaatttttgtgttttcttaaaaa

SEQ ID NO: 23194 - DNA, 1857 bp, Heterodera glycines
  misc_feature (62)..(62): n is a, c, g, or t
tctagagtcctcttcccggaaaagccttcaagcgccaattgcctccttctaaggacgacggnattttcgaggagggtttcatcgaagaacgccgcaagggactggaacagtttctgaacaaagttgccgggtcagtaccattgaaatgctcttaaaagcaataactttctttttagacatccgttggctcaaaatgaaaaatcgcttcatatctttttgcaaatgaacgagcttgacaagtgtgttttactggttttattagtcagcctttttccattcgacagaaattacgtcccgggacgcattcgtacggcctgaccaactgacaaactctgcgaatttgccgtttgcccattctcgaccgattaatgtcatcggtttttccttcgtctttttttgttggctcccgccctcatattattattttattgacttatctccaacgtcactttctgaacattacttacgtcccccctttgccaagttaaagaaagacatcaatataattataatattatcgaatcctatacttcatttatacggaatatgaacagtgattgtaagcataaaccatatctggtgtacacagaatattttatttgaataaaacaaaggcaataaaagccattctacaattttcgaagaatcctaggggattgaaagaaattttctctaaagaattattaagcgcaaccatcagaaagaacacaaaataccaatgtggtacgaattcgaattcttttatatattgtcgttaattaataaattacaaattctgaaaggttcaaattgtgctcggaacattcttatcagcttctttcttgattttttccgcgtccaacttgcgcaagtgttgaagcgctctctttgctgctgtgcatttggcgatgcgatagcccctgcccattcccgtgaattgcaaattgtcattgaccgttacctggaaatttaaagctttgtgcccagaccattatagagaacagcccgttttaaacagtttttgtccttaccgtcactcgaactttgcccgtctccaatttcctttccaattttctgaaatgaaaggacaattaattgtaaattgctatgtgcgcttacgcaaatttggctttgcaatttttgcgctcgaagagttccctgacgggcgactggggcgggttggtacagcacttttctattacttcgtgcatcagtccgtaaaagaccctccacacaatgtccaagtccatgccacagtccaagtaaacggcgcccgcgactgattcaaaaatgtcacccattgcctttggaacttcgacgtcttcctcatgcccttcatcaatctcatcctctgtgaccataaatatctgaatgtgaaataaattgtgaattttttgtttgtttaatatctaatgaaaatgggaagacctcatcatcaaaatttgcacagtgcagaaaatccttctgcttgcagaaattgacaaatttctcgatcatttggaaaagtggcggacaaaacataataaaatgcttgataataacaaattagatgagttataaaccaattcaaaagaacacactttgtgaaagttgtacttaacagcaagcgacgcaaaaatggtattgttgacaagtgccgaccgaaggtccgtcaatacgcccggggaatactgcttacgatgttcaaacagaaagcgagttatcatataatcaagaatggcatctccgagaaattccaatctccggaaagcgacagcgtacggtgaattgtgtcagctttggaaaatgccattgccgacctggtaacagccggtcacacgattgttgaagtaggaagcgtgggtgaatgcctggaccaataggccttaatggagcaaa

SEQ ID NO: 23195 - DNA, 2425 bp, Heterodera glycines
  misc_feature (108)..(108): n is a, c, g, or t
  misc_feature (2275)..(2275): n is a, c, g, or t
aaaatttttagccaattattcccatccattttcagttacatcgaccaaaatgtcatcgcttttctccgccgttttcgtcctcttttcgccgcttgtccaattaatttngttcatcaaagagaacagtgaccgcattttgatgtccattttccgcaacatttggccaatgatcgcgaaaaacatttgtggcatgcatttgtttccgaacattttccgccgtttgcgacaattggccccgtcttttctcaacgactgtccatcgcttcgctttttctctttgtacggcactgatgacttccccgattttccgtgcgatgacagtgccgcggcatcggatggacaagcggtggccaaatggtttttcacgccacttcaaaacaatgtgccaaaggtgtttgagtgctggatgccgaagtataatgtggattggcggctgaaaatgtcagccttccaaacggtgcttccatttatcatttccgtttttgctaatcaaaattttccatgttttagccatttgcatcggcttcatctcccgtcaatttcattgtcgtcatttggtttcactggtctcatgccgttgtgccatttgcgctgaccaacgaattgacgggggaacaattggcattcaaaaagactgacaattggcgtcgttttctgttggttcgttgtccaattgcgcgagacgcggacaaatgggcgaaatgggaaaaggaggcgattgattggcagattcgtgatcagtggaatcaaattggcattaaaattaatgatgaggacgaaatcggtgatgggtaagtgaatgtgaaggcttaatcaacaattcaaaatgattgcgtttctatttttaggcttctcgacgaaactcccggctcaagtgatcagcagcagaagtgaacgaatgaattgttgtgaagtgattggccaatttgaattatgcgattattgacgtgctcattaaatgtcccttttgttgagatgataaatttatttgtaattgtattcagtagggtgaaattcattgatttcctgtaacagtatacataactgtatgatttttcggataccatagtcaacccggcaaaaaaatcgacattgtcccacaagttacgaaagcagagcaaatttggtcattacctaaattgaacattctctgataaatttgaaaaatttgctggttttggtccgtgctcaaattgattttgctctcccccgcaggggagacgcgcgccgttcccgcaggcaagttgggccccagcggctttttggactataactttttttttcattgtcaacaaaatctaacaaatcttgatatcatcgagagctcttcagatgctctaatagcctgcaaaattcaattttgtcaaatttgaacaaatttatggccaaaaaagttggaaaatttggctttttcaattcttctggtcataactttttttaaccttaatgaaagttttcaaaattttgcaggctaatagaggacacttagggctttcaactgataccatgaatgttggatttggttgacaaagaaaaaagttataattacgaagtatcgccgatttttcaataacattttccttggcccaatccgtccgtctgttccgtttcccacccctccgcgacggtcatttgcatcttttcactttttcttccactctctcatttttctgtattctctctactcctttgcatcttttccctttttcttccactctctcatttttctgtattctctctactcctttgcatcttttccctttttcttccactctctcatttttctgtattctctctactcctttgcatcttttccctttttcttccactctctcatttttctgtattctctctactcctttgcatcttttccctttttcttccactctctcatttttctgtattctctctactcctttgcatcttttccctttttcttccactctctcatttttctgtattctctctactcctttgcatcttttccctttttcttccactctctcgtttttctgtattctctctactcctttgcatcttttccctttttcttccactctctcatttttctgtattctctctacttctttgcatcttttccctttttcttccactctctcatttttctgtattctctctactcctttgcatcttttccctttttcttccactctctcatttttctgtattctctctactcctttgcatcttttccctttttcttccactctctcatttttctgtattctctctactcctttgcatcttttccctntttcttccactctctcattttctgtattctctctactcctttgcatctttcactctctctcattttctgtattctctctgcactttgcattgctgatgtatccatccataaactatttccttgttctttcgcttccgccctctcattttc

SEQ ID NO: 23196 - DNA, 2417 bp, Heterodera glycines
gcaaaaggttaactaactgatcaaacattgattgtgatcggagcaataattttaattaggttttacaatttatttttgctttcttttcgagtttttggccttctccgattaaatatttgaacttttccaatgctttttcagctggtgtgcttttggtggccgacagttcaaatgccttttcgtcagtcgaaaactgatgatggaatgtttgcggggtgccggactgattttagaaaggtcggcacaattcgaaatgaaaggggaaaaccccggaacaaaacagagaccaattggacaacgaattgttttatgaattggacggaatgtacattttggtagcgaggaaaatggccgagtgaaaggaatggaaaaggattttaaaatttgttaatacatttatttttgattgtttcacaattgttgaaacttttcaacagttaatttggcagtttttgaaaaatacaattattttttggcacttatatagggttggagtcgaaaaaaaccagagcaggggaaaaacaaaagtggtgtacccctttggtttgcaaaaaataaaatcggattattcatttgttaaaagagacactttcaaaataaacatcagtgcggcagaaatagcaccagacacgggaagagtgaccagctgaaattattttaaattaataataacatgtaaactttctccgccaaattaaattacccaggatttggcaatggagccaaaatgacgccaatcgatgccttcgcccgagttaatagtgccgacagcgacgacgctgccaaccaaacaatgggtggtggagacgggcaaccccaattcggaagcgagcacaacggtgaaagcggcaccaaattcgatagtgaaaccactgaaaaatgtggtggatgaaggaacataatgaacaggtgtatgatttgcctgcacggattgatttgagacagcttttggccaaccatttcgatcacttaaaagggaaatgcaaatttaacgctcggccattcatttgctcatccgccgttgacccacctcggtgcccaagaatccaaaggcccaaacaaatggaaaacacgccgaaaaggagcagccacggggaagtgtcctccttctctttcacggtgccgttgatcccacacgaaagcattgcgaccaggcgagaaatggagttgctcacgtcattgcgcccgtgggcaaatgcggcgaagcaagcggtgaacacctgaaaaggtggtcaaacggggcatcgcaaacgcagaaaaagatagcctgaattgtgctaaacattcgcaaagtgtctttgttctcttttcggtccttgcgcggaaaaaaccacgagatcaatccacgaggagctgaaaaacccgaggggttccgtctttttttggatttctctcacttagtcgaaacgactgaagccgttcacttgatgagagattgctccattcattgctttcgtcgtcgttctgttcgtcgttttgttcgttgattttttcctctctgcctcctaaaaaccgtttttatttttcaattggacaaatatgctaatttgctggttactataaatccagcgcaaaatccgcggacgcaatatgaaatgagaaatcagtgcagcaacgactccaaatccaatggaaagcataatcagcacccaaacactaattctgtctttgattacttcaaaatctgaaatttagtggcaataattattgaaaataacagagcattacgctcaagtttttgcgacccatttttgacgatggcaaaagtgttaaaagcgatgcaaaagaaatagaagaaaggcaaagcgcgaagaccacacttcaccgggtttctctgaaagttgaatgttattcgagttttcttaacgaaataaccaactcttcgcagaacggcaaagtcgacaatcatataaagagtggcagagacgaaaccggacaaagcgggggacagaaccttttgttaagaatcaatttacgagagacaaattgaccgataattacccacgaaagagcaatttcaaggattttccaccaggaaatgcctttgataccgttcaacaccaaagtgaagccgagggtggcgccgacaatgctatgagtggaagagacgggcagacggagaagagtagcggtcaccagccaaacacttccgcctgtgctaggaaagtattttgtcattgtgcgcttttcactttcaaaactgcgcttacccccgagaatggccaattgtccgagaaaaaattggtccggatgtttaatgtagaggtctatgttcaccactttcttactcattgtcgctgtcacattggaacctgaacaatcatttctgtaatcaataataaattatttctgaatcaccaaccaacaagcatagcgccgaatgtttccataattgtggccaaaagaacgcatttcgt

SEQ ID NO: 23197 - DNA, 2352 bp, Heterodera glycines
ggtctttcaacagatttttcaagaaaaaatcttttttttcctcgaattctctaagaaaatttttataagaaaacatttattccaggctgtttatgtctcgacagtgtttcggcggctgtgttttagggtggaacgattttaggttccggcagaagaggggggggcggggggggaatttcgaaattgcaagaattttgccaagaaatattgtttaaaatttattccgtcagctttcgctgtcacctcttccgttatagcactctcttcttcgtcttcggcaattggtgccaattcgaattcgttgcgtggttttggaagagtctcgaattgtttttgcaattcctttctgttcatgcgcccttcgctcgggttgatgttcaattggtcgcggaagggcgtcccggcaacggtcgaagaatgggcgggggttgcggcggagtccaaactgcgctgagagcccggagtttctaatcaaaaacgctgttgagaatttttgacgaaaatgcaagtgcctacggtcttcgatgtttttcggtgtcgccgcgacggatgacaaaacggtgtttggcgtggcgattggctgacgcgtggttccgggggcgctaaagtccaaagtgtgcagcggcgtgttcagaccgcccttcagcggagtctccacattggtcagtgccagcaaatcgtccgcagccttgcaattagccaatatttgccaaatcccttttgatgtgcttttacccgtgccactgagtcaattgcgcccgcgggtgttctttgggtgcgcgcagaaatggcactgacacgcgaagattcgttgtaatcgtgcaaaagggtgctgaagaaaggcataaagaggaaatggccactgaaaggataacacaacctggtcggattgtcatctaccaattctctgacggagtccgaggcgtgtccaattttgattatgtcgtccaattctttgtcagatatttgaggctccggcaacagcaatttgctccgcttcttctcgtgcttttcggagaaaattgactgtggtgcatcttcttgtcttaatgggtttttcaactaacagaaaaataaaaaattttcaggaaaaattgacaatccttaaaaatctaaacaaaattttttcttaaactacattaaaattaaaaaaaaattcccggcagcgcttatcggcaccgccagacccccacattttactttttttttaaattttgaccccaaaatagaaaaaatagtctttttttgcggaaaacgactacaaatttttatttttgctctccggagctgaaatttggcccgaagaataaaaaaaagtccggattctcacctctgaattttttttttctggctacgggcttgaagccttggcttttcttcacggaactttcccctacccaatgaccgtttggctttttgtttgtattaatgctatccccgtcaagcagtactttctcttgcgcagtttgtccttgtctttgcgacggtcgtctctctcctgccagtctctccgtctgtcctccaccatcgtccgctggcgtttgtcgaatttgtcttcgcccgggtcgtggaatcccgcgggcacttccttctcaaaaggcacttccgcgttgtaatccaacaggcgatgccttcgcattttgtacgcaaatcccgagcctatcattatccctgcagcgcgcaactcgcgtctcttctgcagtgacgccaatcgacgcgcttcgcccaattgtttctcgcgtgctttgcgctttgccttctttccctgtgtgttggcgagacgagcgcgagcttcggaaagcatttccaactcttaaagacaaagccaaatcacataaattaggagacgataagacaaccgtcttcgtccatgtcaattgggtcgggacgggccggcttcgtctcgggagtcgggtccacgtctcccggcttcagctttttggcttctttcatggtatcagcctcgtcaatgccttcggcacgtcgttgagcctcgtccaaaagatgctcatatcttaatatttagtatttcaaaagctgttcataaatgaatggtaatggcataattaatttgttttgaaaggccttttttttacctttccaaacattgcgccgccgtccgaccgacaattggcgcgatggttcgccattgcgttggcataatctttgccaaatgaagtagtttctcgtcctcttcacgtgaccattccgtcttcttaattcgcgggtccaaccattcgtaccatcgtgctttgcactgtttagccgattttctgtgaagcaatgaagcgatccgactccattggtttttgccatatttcataatagcagctttaagaatttcatcctaaa

SEQ ID NO: 23198 - DNA, 1409 bp, Heterodera glycines
  misc_feature (1253)..(1253): n is a, c, g, or t
  misc_feature (1282)..(1282): n is a, c, g, or t
atttggatttatgaaggaattgtgtcctggataagtgatgacaattgagcgaacagattaatggaagaagcgcgtctcattcaacgccaaatgcatccagaaaaagaaataaatttatgaaaggattacggaaaaaatatgaaaaggaaatgaatgggggggggggggggtaaattataataaacctgccatttcggcaattaaatttgccagtcattttttaattgctgctgagaccattactgtattctgatgtaaaataactatactagaacgcaatatctcttacaaggtataaaaacgtctagaagtaatccgattttttccttgactttatatgtaatttaaattttttcgtcattttttgtctctttttttcagttgatgtcaccgtttgctgggaccagagcgtttgggcccccgtttttgggcccccgcgtttgggccccaacccaaaaatagaaaagtgtgtttttttaaaagcctgagggatccctcgccacttggcataagctaggtttaattaacattcgctcattttttacaattttacttattccaaatcctattattttagttaaccaatttgatgtacattctgatttggacattttttagaaatggctaacccaattgcaaccaaaaaacaaaaagtaaaattgtcttacgaaggccacctttacaccttcgctaaaatgagttctgatgggatgacaaaattttggagatcgagttcaaaaaatcaatttcacattattttggagtttctccggggaatttctcgcaactatcgaatgaacccgtgattttttgttttattgtccaaattaccttatgaacccgtgaatttctgttaatttttacattttttattgttaaaattattgttgaatttatttttaaaatgtttattttacatttttatgctgaaatttaaaaagttgtttttactgtgatttttcatttttctgtacttggggcccaaacgaccctggggcccaaaaacgagggcccaaaaacgggggcccaaacgcgggggcccaaaaactggggcccaaacgcccccgactctccctccgcccctctcccaaaaaagtcaccgtccgtttcgatttcggcactttttgacgccgccaaatggaactgacaatgagtgaaaggcacaaaaaggcaaatgaccagcagcagaggagcactcattttccttattatgcttttattcactttatttttaattatttaaaaattactanattaaaatatgttaaagtatttctaatanatgaaaatattggtaatttcagcagaatgaaaatgcatcgacaaatgaacggatggataaacggcggcggcgattttcactttctaataattttaggatgattcacaaaaagtgacggggcgtttcg

SEQ ID NO: 23199 - DNA, 1932 bp, Heterodera glycines
  misc_feature (19)..(19): n is a, c, g, or t
agcctgaagcatgtcgacntgagcaacagctattacgttatcaacaccaaatacattgtgtccggtgccgggtcgcgcatggaaaatgcaaaaagtgacaaccacgctcgattcccggaggcatatgagaaatatgtgaaattcaagtaattatttgctgtattgttaaaaattggaggggaatcggaagacaattaattaatgacgtctgaaaaaaggatccggttaaaacgcgaaaagcgtggcatgataatgccagaagggcgggtgggacttggcagctgattaatggtagaattgctcacgtacattggctgaatgcatgggttcgattcccacccgaggccaaacattttgccaattgtttcgttattgtaacatgtaacatcattcattagaacatttaaaattacataaatactaataggttaaactagattaaaaatgcgaaaactcagatatccaaataacgttggaaaacgaccagagatcgcaggtgaaacaagtaaggcacgcgacggagccgcactcgacggaggtgcatttgttggtgttgaaattgacgcagaaaaaatggtcggcaaattgaacttttatgcggccggaatattatacaaagaaaaagatgaaaacgtgcaaccaattgagaaagtgccagatgaaaaagtgccaattgggaaatggcacaaattcgaagggcaagaaattgaactgatgccaagagaaattgatatgacaggtgaataacgaaaatattaatttattatttaattcagtatataatttaaaataaattaaattaaatataattaaattttgccatttgaaagatgaaaatgacaacatttgcattgaatttttggcattcgctgatgctgatgaaatgaaagacgatgcgcactttaaaatggacgatacagaacgaattcaagcaaaattgggcaaatatatttgcaaaaacatgaaagaaaatgaaaaaaacaagcaaaagaatcccaaaaagctaaattacaaatttaattggacaacggtggacgatgttcaattttatgcggaagaagcaatgggcgcaatgcgggagaaatttggaattaattacaaggaattagcggtaattatccacatatcctaaacacattaatgataaaattcgattgaaactatgaacaattaaaagaccgaaaaaatgtattgttttataaatggtaaaaaatatttttaaataaactttttaggattcttttctatcggatgacttaactgacctgggtatcaaagggaaaagctcaaacaaaatttatcgtacagaagacgaaaagtttttgttaaagcaaattccacaaccctatcaaatggaaacaatggaaagaacgttgaaagattatctgaagcatatgatgcaaatgggcgacaaatcatttatcaacaaaatcttttttgtgtttcgagtagaaattgaggtaataaaatttcaaatttaatcaaatgttgtaattttgattgcttcctttttatattttaacaaattttcgattccttttttattcttgaagttttttgattttataaattaagagtgggaaatcacttccttaaaatcttttaaaaaaatttttatatataaattctttcccagaacactcaaacactctttctgctgatggaaaatgtgttcaaaaatgccaaggatttgccacttttgaactttgatgtgaagggcgtcttctcccgtcagcccaaattggtcgaagttgtccctaaacagcgtttaaacgacgtcgtgctcaaatggtacaattattttggtggcgaaccgccccttgtgccggaagaagtgatgccaatgtttccagagggtattttgttagacaaagaaacgcatcgaaacatcgtagaacggctgaaacgcgactttgaggtgatggcattttt

SEQ ID NO: 23200 - DNA, 1754 bp, Heterodera glycines
  misc_feature (1705)..(1705): n is a, c, g, or t
gttcaccttggagacctgctgcggatatctgtacgatcaggcaggagattcaaatagcttccctcgcattttcaagggccgtgtggagcgcacgagacaccacaggaaccgcggtgctttacgggcgcaacatccctatctcaggctgagccacttccaggcacgcacaccctaaaccagaaaagagaactctggctcggactccacacgacgtctgcgagttcatttgcgttaccgcgcaaaacagctcttgcgaaccgtcatttccctagcctggcgtgggaatgttaacccacttccctttcggcaaccggatggaccaactgcgcaagcacagaaaagtcgtcatccgtagtgtgttacggcgttagccggtgccttaggatcggctgacccacattcaactgctgttcacgtggaacccttctccacttcagtcttcaaggatctcacttgaatatttgctactaccaccaagatctgcactggtggaagctcccgccgggcccacgcccaaagccttcaacgcaaccaccacgaccctcctacacgtcatggccagactacgcgacaagcacgtgtacaagccaatgacggtggagtataggtggcccgctccagcgccatccattttcagggctagttgattcggcaggtgagttgttacacactccttagcggattccgacttccatggccaccgtcctgctgtctatatcaaccaacaccttttatggggtctaatgagcgggcactttggcaccttaactccacgtttggttcatcccacatcgccagttctgcttaccaaaaatggcccactgggagctcaaacattcaacgcctgggttcagagtcaagcaaccctggcttcatacccatttagagtttgagaataggttaaggacatttcgtccccaagtcctctaatcattcgctttaccgagtataactgcttaacgagctccagctatcctgggggaaacttcggagggaaccagctactagatggttcgattagtctttcgcccctatacccaagtcagacgatcgatttgcacgtcagaatcgcttcggacttccaccagagtttcctctggcttcatcctgctcaggaatagttcaccatctttcgggtctcagcgcatacgctctgtctccgccccatcgcatgcgatcgagacgggactatgttgcgccccaacaccgcagtgccagggatcacacatcagctccgtaagaagccttcactttcattgcgcctttgggttttgaacacccaatgacttgcgcatacgctaaactccttggtccgtgtttcaagacgggtcgaacagatgaccggcttttacaccgagaacgcacaactgagagcccgagctggaccgaactggttgctggtacgtgtcgcacgcgaccgccaccgacccccagctcgagtcaacacggacccgaaaccattgcacaattcacccagagtaaacagcactcccccgatccgggtaccagaccccgaaaggctggcctcaagaccgagctcacgcagctactccgagcatctcagcgcactccgcctgcaaatgccccattcgccactgaacagaaggacagcaaaccccagtctggaggctagcaggccaacgtacagcaacaaacgggtgaatgcagaccagatacgccaggctctgtccgtttccacctcatncggtttcacgtcctctttaactctctctttcaagtgcttttgcactttc

SEQ ID NO: 23201 - DNA, 1012 bp, Heterodera glycines
ttgtgaattaattctcagaaaaatggctatctctttccccgacaatattctatctcgtaaccccgatgctaatccgttcctcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccgcagagactcttcaaaattttttccattaccgcaagagctgcggaaattgtgaattaattctcagaaaaatggctatctctttttaggacaattttctatctcgtaaccccgatgctaatccgttccgcagagactcttcaaaattttttccattaccgcaagagctgcggaaattgtgaattaattctcagaaaatggctatctctttttaggacaatattctatctcgtaaccccgatgctaatccgtccgcagagcctcttcaaaattttttccttaccgcaagaggtgcggaa

SEQ ID NO: 23202 - DNA, 1923 bp, Heterodera glycines
tttcgtgtcagtgtctttcggccatttccccgctcgacaatcgaccgcccacggggacaaattggccatcgttgagccaaccggcggagtaattcgtggactcggaggacgactaacgaacatcgggtaaacgaagagttgcctcggaatatgcatttcttaatcgacaattttcattccctttttattactttgatttcgcatttttaattggcttttctttttttaattaatctttttcaggtttcggtctccgtttacactgtcaatgcgctgtccggcgactgttgcgctccgtcgttggattggacgtgcccaattccattgtcgcccttctcccgcctctgttggctgaattttacagcctgtggaaagtgaaatataaaatttaaaaaatatcaatcttttattccttttcagtttggcaacaatggacgaaggtaacaaacaaaccaaccagtccttgtttttctgttcatgtggtcttaagaatgcactgtccgtctccatttacccggccctaatggtggcgtcggcctttggcttccggtgatttttggcactgaactgctccgtgagcccgaggctgactttctgtggcccattgctctgacggaagtgccacagtcccaatttcgacatatttattgccgtagctcaaaattccctaccttcggcaccaaatctgtaccggaaactgttccatggacgatgcctttgctaaatatggtggaaattgagccggatatttaattttctctcgatttattattttaatatttttaaggattccgaacgtggcaaattggagaatgaactgatgctaaacgaaatccaacaacttgtggttaggcattcagcagacgacaatggcactttggcgttgaacgctgtacagtcgcgtcaaattgcacaacttacccaagattacatgtccaacctgcttaaattgttttccgtttcgtgccaagtccgtggggaagggcacataaaatcccgagaaatttgataatactttaagttgaaccgtgagggacgggccaccgaaattgctcgtcggaccacaaattccaagttgatacaagcgatgtgcaactacgcgtccaaagcacgccgacccgggctcagtgaaaaggtaattaagaaatattaaaaatttgtgtttacattcaaaaaataaatcttttcgttgattgcgatcagattgcttcaattggacgcgaacatttacaagcggttgaggcggaacagcagcgaaaaaagcagcaacagcagagcgcaaatttaaattatggcaattccatgttataccatcggagagtgcaaaatggaggtggaacaataatgctgatcaaattttaaaattttacatttagctaaggatgggactgaaaggaccgtcgctgatacggtggccccaaatgtgaacaaaatgttggtaccgaagcgaaaagtcactgctgacgaattgttggattctttacgggcagaagacgggtgagtgatgaagagcaattaatctcacaattagcccttaaaaatcattcattccgatatttagagccaaaaagcataaacaaaatgccaaaatgtgtccccctccgccgtcggtgccatcatctttgtcctcctcatctgccactctttcttccgcgctttgggaccgatgaaaatgatgagaatgcaattgttgtcattgacgaataacacctctaccactgcgcgaatcgcgaagatgccgagcgatcaacgagcgagcagtcgatctgatcggctgcgagcaacacgaaccatgaacgagctccacgaatgttggtgccgttgtccgattcgatgttgttggatgcgtcaccgctgaacaacccgttcgaaaaaggtgcaccgtggattatgttacgaaccctgacgtggttttcctggagt

SEQ ID NO: 23203 - DNA, 1156 bp, Heterodera glycines
ggtacttttctgttttgtgacacccctgaaattttcaaataaaaagtcatttctagggtaatttggggcgctgatcacgaatatggcatttatttttcaaaattccgaatcccgaacccgaattcgaacataaatttgaaattcataaattacaaggaaaacatatttttatgggttttcgaggtcgctgaatacgtactgggcctatgcctaagctgaagcctaagcctaagcttaagcctaagctgaagcctaagcctaggcctaagcaagctgaagcctaagcctatgctgaagcctaagcttaagcctaagcctaagctgaagcctaagcctaggcttaggcaagctgaagcctaagcctaagctgaagcctaagcctaagctgaagcctaagcctagatacatgccaccaaattagcgcaaattttattacgcatttctcggcagtttggccaatattttgatgattttgtgtttgctgaaaaaaaaactccgatttctcgagttaaggttatttaattggtcaaaatggatgtcataaccgttttcagcgacctcgaaacgccataaaaatatgttttccttgtaatttatgaatttcgaattttggttcgaattcgggttcgggattcggaattatgaaaaataaatgtcatattcgtgatcagcgccacaaattaccctagaaatgactttttatttcaaatgtcttttgagtgctctttatagtgcggtcaattaagtcccagctgagtttggcactccaattccggcatttttttcggcttgaaaaagggcaagcgcgcccctaattctcttttttcaacccatttcgaacatttttacatcgattctgaacatttttaagcatttttgagtttgggggactatgattcaatattttccatgggctttgcgaataattggtccatttcatagttaattttgtaaacgatcaatttggaattttctcataattttcataaagttggctttttttctttttttgatgggatgcttattaaatacgcaaaagagttaaggaaaacaaagtaaatccgctatttgaaggcccctctctggtagaaggcccccaaggcccccctaaaacacggtttttaatggaaaacgatcaattttattaggaaagaaa

SEQ ID NO: 23204 - DNA, 994 bp, Heterodera glycines
ttttcttagacccgagctgcgcgccaaccatggtggtgggggcggaggcggaggtgacattgcggaggcggccaccgagcagcggaccattgccgtgccatgccaacgctttgtgcgcagtcggcaggcggacatcttcacgcgtcgctccacgcgcgtgtaccgccccgtctacaccaaggggcgcgtcctgcgaccaccaacagcgggaggcgagacagctgcggcggaggaagaagctgaagcggtcacgcctgcgcctctgtccatccgcacgcgaccgtttggctggtgttcggcagaggcgcagcaaatggagacagatgatgatgatggtgatgaggaggaggatgaggaggcggccgcgctcagcgatgacgacggtggtgagagcgatgggctggagcagccggtgcgcaagcgggccagggccgagccagtgcaagaaattcacaatggcgtgaaagcggtgcggagcatattcggtgcacgcaccgttgcgtgccaatgccaagaattggtcgcgggtaaagcgctgttgttgttcttgttgctgtcgtggagatgagaccgcctgagcgccacacgatttgaaaagagaaaatgtgctggtactattttgcacaaaatatttcattttgaaataataaccttgcttaaaatcaacaagaaattagaattttatctcaatgtgattgacgcatcaaaaatgagagaaaaaaatttgtatgcatgtcaattttcactcatcatctgcgcagcccgcgctttcctctttattgtcctccgtctcgttggggtccgtgggcgatgccaccatgacgtgcacctgcacacactctagcggataataggacatatgtgcgccaccaccgcgctcaaccagcgccggcaggtttgggtggtgcaaacggacaccgtgttggcatagaagtactgacgcacctaggcaaaaaaaacaacagaatgcggggcggcccttctttaaacaaaa

SEQ ID NO: 23205 - DNA, 1320 bp, Heterodera glycines
ttttttccccctccccttttcccccagggggtaattattttgtaaaatttttttttttcccccaaaaacttttcaaacccccattttttcgcaccgtgaaatgttatttttattgaaattttgaaccgttttgagtagattagactagaaaaaaatgaaaaatttgaaaatcatttttcccactcccctctcccaggggtattattttgtaaagtctttttttcccccaataaacttgtcataccccttttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcccaccgtgaatggttatttttattgaatttctgaaccggtttgagtaaattaaaaaaaaaaaaaattgaaaattttgaaatcatgttttcccctcccctttccccagggggattattttggaaaggcttttttttccccaaaaaatttggcaaacccccttttttccccccgggaaggttttttttttttgaaattctgaaaccgctttttgaaaaataaaaaataaaaaaaaaattaaaaatttttaaaattttggtttcccccc

SEQ ID NO: 23206 - DNA, 1242 bp, Heterodera glycines
tgttttttatgaaacccaagaaaactcctaccccctgctggcctgttttttctgaaaatccaagaaaactcctagcccctggctggacctttttttttgaaaatagaaagaaaactcctagcccctggctggtttttttttttctgaaaatccaaaaaaactcctagccctggctgggctgttttttctgaaaatcgcaagaaaactcctagccctggatgggcctattttttctgaaaatccaataaaactcctagccctggctggacctgttttttctgaaaatcgaagaaaactcctagccctggctggacctatttttttttctgaaaatccaataaaactcctagccctggctggactgttttttctgaaaatccaagaaaactcctagccctggctggactattttttttcgaaaatccaagaaaactcctagccctggctggacctgttttttctgaaaatccaagaaaactcctagccctggctggacctattttttctgaaaatccaagaaaactcctagccctggctggacctgttttttctgaaaatcgaagaaaactcctagccctggctgggcctattttttctgaaaatccaataaaactcctagccctggctggacctgttttttctgaatatccaagaaaactcctagccctggctggacctatttttttttctgaaaatccaataaaactcctagccctggctggacctgttttttctgaaaacccaagaaaactcctggccctggctggcctgttttttctgaaatccaagaaaactcctagccctggcttgactgttttttctgaaaacccaagaaaactcctagccctggctggactgttttttctgaaaatccaagaaaactcctagccctggctggacctgttttttctgaaaatcgaagaaaactcctagccctggctgggcctattttttctgaaaatccaataaaactcctagccctggctggacctgttttttctgaaaatcgaagaaaactcctagccctggctgggcctattttttctgaaaatccaataaaactcctagccctggctggacctgttttttctgaaaatcgaagaaaactcctagccctggctggacctgttttttctgaaaatacaagaaaactcctacccatggctggacctgttttttctgaatatacaaaaaaactcctagccctgggtggacctgttttttctgaaataccaaaaaaac

SEQ ID NO: 23207 - DNA, 2065 bp, Heterodera glycines
  misc_feature (9)..(9): n is a, c, g, or t
atacaaacncatttgaaatgggggattatgggaagattaatccctaagaagtcgtgatgcatatttcccaaattcatctcactatcgcgattttttgtttattttcatttacagggaatatttcctgccaaaaaaaaactacctctttattcatttctttcttaccttcacaaagaatcattgtcatccaaaaactcttgaggtttatgcccgtttctccccctttcactttaccctccctcactccctttatccctgcttcccatcctttctcttccttacagtctctccccttttatccgcctcctctcaccagtgatgttcgagagtctcggtctcgagtctcgactcgagaaaagtctcggtttttttttggtctcggtctcgagtctcgggttttcagtctcggtctcggtctttgagactttcgagactcgagaccgagacttttttacacccctaatgataggctttttgtaagttagaaataaatatacttttggtatatttttgcttcattttgtttactcgtgggtgtggtccggtgggttgttctcttggttatgttcttcattttagcgttggatcagttccctccaagtaatttttttttcttctaatttttcaaaattattcctttttcgataggaattcaatcaaaattttaacatttaaaatcataaaatattgtcatttttggactaaatctattaacaaagtgcactaaaatttcaaattttccccagcggcgcctatcggcaccgccggccccccttgttccccaaaagttttttggaataagcgtgttttgaataaagttgtaaaaatgagcttttttgactcaaaatgaggcttttttgcataccaaatgaggcttttgaaacttttaatctgggagccctgtttttagcattttaattttgattcataatttttcagttgaataaatgcaattatttcaaacgtaatagtaatttttcataatttttaagaaataagaaaattttaaaaaaaagtaattcccctccaagtagttgtttttcttctaatttttcaaaattattcatttttcggtgggaattcaatcataattttaacaattaaattcgtaaaatattttcattttttggactaaatcagttaacaaattgcacttaaattttaatgaatttttgttttgtgcgtttttgaaatgataaatattgtaacaaattgaatcaaatttaaaaaaaaccaaaaattagttaagaatagagtcaaaaaaatatttttaacgatttttaagcgaataggaaaattttttgaaaaaagtctcgagtctcgggttttttgggtctcggtctcggggttttcggtctcggtctcggggtcgagtctcgggaaatttttggtctcgaactgcactataatcttctaatattaattgctgcccatttttgaacccactttccaatatatcacaatggctttcattggatacggcgctcttacggccgcgctgagtggcatcattttgtacgcaaatttgcccacccgtctgaccattggcgccattgtgccgaccgttgaatttttggccgagacccaactgaaaaagttggaacccggccaagctgtggctggaccacaaattaaggtcattagcgactaattgaatacaaaatttattatcaattactatacaagaaaacaatgttatcaacttgtaaatgcacattgttcaggctagcgatctgttcaatgccggccatcctctgcttgtgatggctgtccgtcgacctggtgcctttttttgaatattccatttcgatttttctaaattgaattctttctatttggaaagaaaattcttaaatgtttacatttttttgcccagagccttgttaagaaatgccagagggattctgatttttttttctgataaaaaatataataaatttcagggttttgatcagtatttggataaaagtcaggaaattaaaaatggatattaaaaattctggctatcgatctaaaaaatcaaataattccttactcacaattttttggataattttttgttaga

SEQ ID NO: 23208 - DNA, 2025 bp, Heterodera glycines
ctatctgtaaatgccaatgctgcagaaaatggcaaaactttgcacccaatttcggcattttccgtttttcgggaataactcgctgggggttaagcggagcgggttggcgccgcttaagcatttgtgtagtttttaaagctgcatccgatggcgttttcagattttgaaaattttcaaaatttttcgagctaggccccctcgaaaatttttcgtttttgaattttattattttttgccgatttttcccaggaaaacggagaccactttcaagcaaccgtttttcgagctctatcgattggtggcatttttgaaaaaatttcaaaattttccggaaatagaaaaattttttggcctgaccgggacatttcagtcccgggcctataactcgtcaggggttgattttagcgaaaaatcgtccaagagcttttttgtagagaatttcgagctctatctaatgtgctttatccggtatttttatctttaatataaaaaaagatataaaataaaaatgaatttataaatgcaaaaccaaaggggggaccccatggatttgcatttcatgagaaacttttttgctcctaaaattgccaaaaaatacttttctggggtagtttgaggtgctgaacacgaatatgcactttatattgcgttttggattttttggagggaggtaaaaaaattttgaaaaatcgtcaattttttggatttgggaatttaagtgattctttgaaaattcataactcgcctcagaatggtccaattcagctcatttaaagcataaaaaatagcaaaaaatcgggagaattttatgagatttatttgaaatttatacctcaaaaacaaaaaaagttattccagaaattctggaaattttcgatttttcagaaaaaaatttatatctcggttctgaaaagtcattagggaaaagtaaaatactacaaaaatccgcaattttttgctctattaaataaattttaattcatatttttatcacttttttaagaattgttataaaaataaaagtgattttggcattcggaaccaaaggggtgagcataggatttttgagtggaaaaattttttcatccaaaatcctcaaaaaacatgtctttaggggttatttgggccgctgatcacgaatacgtgatcagattttacttttgacatcgtcaagacctcagaatccccgtgtgattggggattctgaggcatcattttgagggggggggcgaagttcggatccgggcggtgtaacattatttttctgtgcatttttacgttattttcaatgattttaattaatttaaaatattttgttgagttaataaataaaaaattatatttaatttttttttgataaataaattttataagtttaaattaattatttttttaattgatagaatttcatgtatttttttaattaaatttgttaaaaaatattttcattttaatttaatgaatcactgttgcacctcttctaatcactgctgtacccctaaaaaacgggcgcgaagcgcccgtctggcccaaacaaatttaaaaaacgatcaaacgggcgcgaagcgcccgtctggccccaactaaatttgaaaaacgggcgtgaagcgcccgtctggccccaactaaatttaaaaaacgggcgcgaagcgcccgtctggccccaactaaatttgaaaaacgggcgtgaagcgcccgtctggccccaattaaatttaaaaaacgggcgcgaagcgcccgtctggccccaattaaatttaaaaaacgggcgcgaagcgcccgtctggccccaattaaatttaaaaaacgggcgcgaagcgcccgtctggccacaacaaaatttgaaaaacgggcgcgaagcgcccgtctggcccaaacaaatttaaaaaacgggcgcgaagcgcccgtctggcccaaacaaatttaaaaaacggtcgcgaagcgcccgcccaagcccaacaaaatttaaaaaacggacctcttctgatcactgttgtacctcttctatttcctgttgtacctctt

SEQ ID NO: 23209 - DNA, 3296 bp, Heterodera glycines
tcctcctcctcttcatcttcgtcgtcgttgtcgtcatccaagcatccatgccgctccagcgggtcactgatcgtcaagaactccgtgcgaaaagcgaccaacgcctcaattagtatgcgcgtgtcattggtgcagtaggctgcgagctgttcacataggtcgaactgttgatggcggtgttccgcgtaccactggtcgaatctgcgctgtcggtcgggcgtcattccaccgtataagtagtcagcttttggcggtagcgactgcagaatgagcccataattcgtctcaacattcgccaaatgagggaagaactccttatcctgcacattgagtccaaacgctccgggcagagcgccgagtggcaccggcataaggttccagctgtctcttacgatgatttccgggtttttttcgcccctcgcaattttcatttcgtataatttgttaccacggcggatcatctgtggacaaaacccgttgaggaagaactgccgaaacagcataatgttgtcaaagcgacccccgaaatgggcgaagagcattgtgggatagcgcggatcgaattcgctgagcagccattgagcaaaggccgccattggacacggagtgatgaattgggcatcggtttgtgtgcgttcatagacgcggtgggagaatgtgacggtgcgctgccgaccgcaaatgccacatggcgcttgtagggaatttcgccataaaatttcgtttatgcacttggtgcagacgacatagcatgagatgaagttgacggaatgaagtctgcggtcgccctcaattcgtgtgttctgtgttgtttcgcagtcaaaggcgatcagtctgtactttttggggcggcgcgccttcaactgctgtatgaagcagccccgctccggcttatggtaacatttgcaggtgtagcagaatttctcaccgcaaacgtgtccgctgcgtccttttcgtcggttttgtttgacattccacacaactccgcactgtttgcattttttgaattgtcggcacacattgctcgacaaatgatgactgaagcagtcttggcttatgaaatccttgccgcatgctgtgcattctctgtaataattgtcgttgttgtcatccgctcggcacggtcgccccactcctatgcgaccactttatgcactttgctttacattgtagcgtgtgatcattagcattatcataggggcattcgcacgaaaagcagtagtagtcacgtccaaacaccgctttgcccaccccacatcgaattccgtcaaaatggccgttgtgatggtagagtgggatttcgatgttgtaattgtccggcccatattgaaattttggccgataggtgcctgtagtgccaaaaatgaacaccttaaatcgctggtttgatgtggcgtatttccgattccaatagtccacgacaatcggcacatatacaaccgcgtcatactctctcaaatcggtgcgaatgtttgcgctgctcatcagtccaaacacgtcttccagtcgtcgcccattctgccgattaatatctgaaggtttgtcggctcatctctttgctgtggtattttctgcttgcctccaaagcgtaaaaaagacaataggaatcatcactgttgttgattcgcagaagtgcactctctttgatgatatgttgcactgaattcgttgtccttttcccactgccacgcacctgttgccgctgaggtagctgcgcaacatcaagcgttgtgatggtcacagtgaacggcgagccccacagagagccctcccgcgattttgactgtgccacctcaaggaagcggttcataattgagtcggcgcggaaatgcggcgtatgggaatccatatgctcggatttagcagatctgaagagattgtagcgcccaattgatccggtgtgatcccgttctgctgtgactcgtccagggcggttgacatgcagtgagcgaacaatgcgcgcagcattgactcggggttggcgggcagattttcaatgataaaagtcgactttacactctgcactttgaacttttggctgtactgtttgtcggcgctcagagtgcgaatgcagtttttttgaaatttcggctctccctccacatcatcatttctttttcttctctttgtgggcgcttcgttgccgcccaactcgccgcaataattgtgatcttccaacgacattattattatttattaatattttaatttattttttacgaaaaaagtgagccttttccgcgtgagctcgctgtatatatgcgcagcaccaacagcgcgcaacgtgcgccgtggtataataaattaatcaatcattccctatgccctttcccaaagggtggtaaaattggcacgcacacacaaatacggattaatcattttattcaaaatgcacaaagaatacatgtcggggctttcactagcgtctaacatacgcagaaatgcgtcaaatgggtgacataaggacatgtgatagatgaacacgatacagtgaattgcacatgtggtagtcagcggggactggtacgggtgcttatttgtaacaaaaccttttggaaatttatccataaatgatgtctttacaataggaggaattgtttttgcgagactatcaaagtaaatgaccgcttcctccgtctttgaaggggcataaatcgcgcaccaatgggatccttgtttgtaatgtgggtcgttgttcacgactagcgccgctgggtaccgtagcgtgtccggcgctgggagctggtcacttgggaaacagccccggaaaactcgtgcggtttcccgactttgccttaaaatagtcgaaatctgcgcgctgtccatactcctttttcttctttaaccaacagatagaacaaagctgatgaagtaccagactgacaaacaccattaaatagagtgcaaaaagtgcccaacagatggcttgctgataaaagttttcttccccgggacgatccttgcacatttgatgaatcaatgttgggaggagtgttgcgactggcaactgctcatccacaaccaattttgcagtttttggtataggagtggtgattttgctgctgttgttgttgttgtttttggtggtggtggtcgtgttcctgctgatattggtgttggcggtggtggtggtgacaatttttagtggtttgccactcacgttgcctttccccatacgagtagatgatgccaaacgaggcacaccaatcttctgtggatagacagttgtggtggtggtgatggcagtgttggtggtgctggaagcccctcgggatttggttttgttgtttgcatta

SEQ ID NO: 23210 - DNA, 1911 bp, Heterodera glycines
tttaaaaaaattcaaactttcaatttttgcaaatattgctgatgcattgcttggtactgtaactacaatatgagtaaaggaaattgaattcttcctatttacatgcgtaagatcaatatctttgaatcacattcggttagagtcagttcaacgaagttgtagacaagagcatgaaatcaggcaaattattgaagaacataataggcggtcaataataatgaccagatcaaaatagacactgagaacattttcaactaaccttaatactagcttattaacaatttagccatggatatttttgatatttgttcacaatttcaaaccaatgagcatacaactttaacagcaaattgcccctatctgtggctatgattatcacattgccttttattaccccgtgaataactgaattgattcgatttcctttactcatattgtagttacagtaccaagcaatgcatcagcaatatttgcaaaaattgaaaatttgaattttttcaaatgttcgaatccgggttcggggttcgaaattaagtcaaaagaaggtcaaattcgtgctcagcgcaccaaataacccctaaaaaagtgttttttgaatttttattccttttttttttttgtgggaccaataatcttcatgattgccatttattaggctataaatttcggctttccagaatttaaaattatgaaagttttagtcgaaaacggtacaaatcgttttttagtttaaacatcatcaccatttctgatttccttcagttagcaactgcacagcttcgtgcaaaaacccagctgttggaagagcaaatgagtgaggaggacagagaaaaggttttgaaaaattaaaactattttaaaatgattttcgaaggaacgaaaagcgcggcaggaccaattggaagccatcttcaaaatgatggagtctcagaaggagaagtttggcatcaatgagaaggaggaattggtggagcagatgaaaatgtactcagtgtgaaagagaggaccaaccaaaagaaataatggagatcgaagagcaaccaaataaaaacatagcaagacgactgacaataaatatttttgctctcaagtcctatcttcaaaattcgatcaaagacacgaacaaaaaatgtggtcggatataagttataacaaaacgaaacacaaattcagaaaaatataaaagaaactcaacgaaaaatctctcagaaaataacgaaaaatctaacaataaaagaaaagtaagttgttttcaaaagtagttaatggaattgatatcaaaacaatgggttttggtaacagaaaaagaaagtgaaaaaccagaataaatttgaaaacccagtcccgacgataaataaaaatgagttagagatcgtcaataaataaggctgaacaacaaaacaatgaaagtccggagccgaataaaccctactcaaatcaccactcatcgttggcgtcttcagaaggcaatggagcagaattgttctggatggctgggtcctttgcttctccattcggggttccgtcgtcttgaacgcgggttccaagcggcaccgaattagcaccggttgcagccacattatcagtcggaacagttacagcagttggcaaagaattggtgtcaggaacagtttccgacggaacgcgaacagcgatcggcaccgaatttgcaccgctggctgcttccgactcgtcaagtggcattttcccctcagccaccagcttaagccaatccggcacttcttggtcttgtttttggagtccctgtgggtgcgaaacatttaaggcaccaaccaataaaagttacttcaacgagttctttcgccagctcaacatcttccgcgagatcaaaaaacgatgtagatgctacgtctttgatccgacccagtgcgcctaaccacacaaaggaat

SEQ ID NO: 23211 - DNA, 1088 bp, Heterodera glycines
ttaggccggagaaataaaaattaccagctatttgccccaccgagggcaagcacagcgagtcgcttaaatgcacaccctttgacacgtaaaatattccaaaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatatgaaatgcagtgggcgagcacagcgagtcgcttaaatgcacaccctttgacacg

SEQ ID NO: 23212 - DNA, 1395 bp, Heterodera glycines
tagggttgagcggtaccggtactggccggtaattaccggtttttttggtaccggtaccggtaccgccggtaaaaatttgcactggtaagaatgggggtctggtcgagaaaagagtaggaaattggtgaagaaggagaaatttttgagaaaaaattaaattttatttcatttagtcatgggattacacacatgcgcatgtggtgtagtggttaaactttctacctttcataatttttcgcctgggttcaattccccacttggatagaatattcttcatattttctttaccattattttaattaaaattttaattttaaaaaatattccaatttttttctttcatgttaagcatcctaaaaacccaaaacttaatcaattggtcatttttttacaaattctgttaacaaatcgcattaaaaattacaaaatttttcccggcggcgcctatcggcaccgccggccctccttgtcccccaaaagtcttggaaaaaacgtgccgcgtaaaaagcggtgttgaaagcaaaaaaaggtcattgatttacatcagggcgcgtatcgaaaatttttcaaaatcagaacatcaagcccaaaaaatcagattctggggtcgaaaatcaggacattttgcaaaattgcttcaaatcagttatttttacaatttttcgatcaaaaatgtatcaaatattatatttttcgtctcccattatcgattttaacaattttggggagaaaattagcaaatcatcaattttagcgcattcggaaagatttttattaaaaaaataaccaaattttgtcataaatcttatattttattgataaaatagtgacattatgccataaaatttcaaaattgtaagtttatttaagaaatcaggacaaagttgggtcactccctccaaatcaggaaaaatctgacaaatcaggacattttaattttatcagatttggacccttcaaatcaggacaaatctgataaatcaggacagatacgcgccctgatttacattaatttacatggccggagaccccttcgcaaaattggaaaattggctgctgaccccttgttttgcaataatctgaattttgaggtctatatctgaattttagtgttctatgtcctgaatttgaaaaaaaaaacttggtcaacctgaatatacatatacttctgaacaattctaatgctaaaaaacaggcactcgcgcgaaaactgaataaaaattttgtatttggaaaattttgtccaaaaatttttatgttctaaaattaccggtttttaccggtaccggtaccggtaccggttgaaaaagttggtaccggtaccggtaccggtttttgcagtacccggtaccggtttttttgcaattaccgattaccgctcaactctaatttata

SEQ ID NO: 23213 - DNA, 2332 bp, Heterodera glycines
atccatgcataacaattactcttactttatgacaacctaatctggctattaacacctaattagtcgaatcgtagctcatttaaggcccaacaaccgaaatgcccatttctctgctttaggcaattgcaatggcaccaaatttggctgttgccctgatgaggtgtccatggcacgcgggccggactttgaaggttgtggtgagcccacctgtgccgcgtcaacatttggctgctgcaaagaccgacgcaccatcgcatttgggcctcactatgccggctgtgaccggtaaattttgagtcctccattttttcattgcagaaaaagcggcgcctttttcgtatctcagcgatacagtatttattgaaaataatgtaccgtaactgtactgtagttataataaatttaaagcattaattgatatgagaacaacttacagtaatttattattgtttacgggtttagactattttcaacatggaaaaaaatcttgaatcaattcctacgaattttgggactcgataaatttttaataattctcatacccagtaattagtcattcattaattagattaataaaatcactgcagttcgtccttcccttgtgagctgtcaacgtacggatgttgcgaggacggcgagacggctgcgctgggccccaacggcaccggatgtggtgccagctgcttgctgaccaagttcgtacggcacatttacagaaatgacaaggctgtcgagaatccgaggagtctatggatgagaatttcaagccttagatctctccctctttttttctttctctctctctcgccctctttctctctctatctttctctctctccctctttctccatttttctttctctctctctatctcctctttctctcctccccctctttcgctctctctctctcactctccctctcgcactctctcctctactcttttctattctcgacttatgctcccaaaaattctcgactgtaaaactcacgggatcacaggtttggctgctgcccggacggcaaaacgcatgcccaaggcgcgaacaatgagggctgcggctgtgagtacgcgcagtacgggtgctgcccggacgggcacaatgcggccaaggggcccggcttttacggatgcccggagagctgtgcgcaaagcaaatttggctgctgtccggacggcaaaacgattgcccgagggccgaacaaagagggtgagtcattgtaattagatgatggtataattatgccattaattagcagagggtgagtgattgagatattcattatccgtgtgctatattcgtatcctgttcttggcacattgaccgaattgtttaacattgatcagtgatcagaagtagaaagaaaatttagatactgagatcagactcattaggaaggttaggagctggaaataacacacagatcaatgagctgctgcgaaataccaaattattgcactgatcagaactgttaagctgatcaaacccgttatgatcaagaccaggcaatatttattactttggaatttcattaatcaaacagtctcagttgattacagttaatgcctcaaccatttgtcaaattttattttgatcaatagatctgtgtccgttcattttattctatgatcataatgatacaaaattgaaaatttaaaaaattattatttttttcattttcccaggctgtccatgtcagtacacgcgttggggctgctgcccggacggcgagacaaccgcgttgggcccgctcaacgaaggctgtgacgattgtcgttatgccaagtgagcattgccacacttttcatccccgttcccctctctactttatcaatcatccccgaaaataggggccccttttgggtataaggtaaattagtggtatttttgtggttctaccatactcctttgatttctaccgtactcctttggaaaattaccattttttggtggttctaccatactcctttagcaaattaccattacttttgtggcactaccgtactccctaatgtaccctctctgtgcatcaggtacggttgctgtttggacggcgtgtccaaagcgatcgggcccgactatgctgggtgcccgaccaccacgcccgcgccttacatgctcggcggtaccgtatcaccatcgtacattggtaagtaccactgatcaggcggctttctgccgactcttatcaattattttgataactttaatcaatcataggattttgattgctataatttcttatctctcttacaccgttttatcggtgttatcgatcaattcccatttcttgctgatcggtatagtattcgatcagttttaatcattga

SEQ ID NO: 23214 - DNA, 872 bp, Heterodera glycines
actagagtagagcgggaccgggacgggaattcccggtcctccgaggtcccggttcccggattttgaaaatatatttcccggtcccggtatggctcccgggaaccgggaaaaacaagcactggtaagaatgatggtctgagcgaaaaattaatgagcgaaattgggggaaagggaaattatttgataaaaatcaattataaatttcgtttttagagtagtatttccaagtgtacaagtggtctagtggttaatcttctgttggttttctacttctttcccttggttcaatccctcttcagtagcctattgacaaaatatgattcatatatttatttaaatgtacacatatatattatatatttttttttaaaaaatccgttaacaaattttactcaaattttcaaaaatttccccggcggcgcctattggcaccgccggactcgtgatgcgacatttgcgccgcacagcaaaattggacatttgcgccgctcagctaagtcgacacttgcgccgcggatatttgcgccgcgacatttgcgccgcctagcaaaaatggacatttgcgccgcgcagtcaaaaataatattttcatttcaatttcactaatatcaataagatttactaaaaaccaacgacaaaaataacgaattgaaaaattaaaaaaaatcactatcttaaagatagacattaattttttttatttttaatcattaaaaatcttacattgattaggttcatcaaagatatgaaaaatgaagaagaataacaactaaacagactgacactgtttgaattagtcctaatcacggatttttgacctcccacggctcattaaatagttggaattgatgagtagggaggggggggggggg

SEQ ID NO: 23215 - DNA, 1570 bp, Heterodera glycines
tcggtcggtcggtttcggttaaaaaaccgaagaaaaattttcggtatatcgtttcggttttttttgaatttttatattttttccaaaaaaaagcaataaaacatttttattaacagtaaaatgtttttaatatttatattgaatttttggaagatttcgattcaaaaaaatcagcatttcggactttcttggacgcaagcggcgtcgacggtagtcgtatgtgtcgcgcgctgtcgaaaataaccgctcacttgccacgcttgtcgccggaatgcaaagaaatttttttgcttcttctgccaaaactaaatgtaaaattccttagaacggggtaataaattgggcaaattaaaatacccggaaattcattggctctctctttccaaaattctaatggatcagaattagacggaatggtgacggcagaacaataagcattgatttcgctcgttgcatttttctcttctataattcaaaaattttaatgaaaaaacaaattgtttttaacgtgagtttgtctcgactactgacgatgctgacagcgtatgatcaaaaatcaagcaatcccttcggctttttagaaataggagaatttggcaacggtaggacctcctcactgaattgttcctcccttaatgattcgaggtgtgaacaaatttggcgtctgaaaaatacaaaaaattcttcatatttcgcctcatattcgctgtttttgtgttttgatttaaggtggtttatcgcattggatgtgttgcctttcttacatataatattcttacaacactcggcacattcgtactcgaaatcattgttgttgctttttttataaagcccgatttgccaaatcacacttccagagggcatgttgactattgctgtaatgttttagatcaataaattaaaaaaagaaatgaaaattagtgataaacttttcaaaagtccgaaaacttaatcaaaaaccatcgaatttcaaacagtatattatgccaaaaattgttattaacgggttatgtcgcttcaaatcgccagtcggtttttttcggtttttgaaaaaagtcggtcggttttttcggttttttgattatttcggtcggtcggtttccgtataaaaaccgaaaaaaaccgaaaaactcaaaaatttctcggtcggttcttttcggttaaaaaccgaaaccgaaaaataccgaaaaaaaccgaccggtccgatctctaatgtcaatgtgatgcactaacctctacaccacattccaaatgtccaaaattgagcaaattttctttatttaataaaaatttggcaaatggttaaaaaaattcaaatttcgtctaacttttttgcattttctcccacgaaaatgccattcttaggggtgtatatttaaccccgaccccgatcggggttaagggtcggggttcggggttgtcggggtatgaagctcggggttcggggtcggggttttccccgaaaatggccaaaaatgtcggtgttcggggtcggggacgcaaccctatttttagaaactaaaaattaattattttggcagtttttagcaaactataaattggagcccta

SEQ ID NO: 23216 - DNA, 1668 bp, Heterodera glycines
aaaatagacaaaaaacaaatgaaaaaaaaatctgaaaactccaaaaattacttaggaaaacgcaataaatttcataaaaatctttgtttttttaatttatagaaaaaaataaaactcaaaaaactgcaatttttgttaaaaaaaagacaaaattttttaaaagcaagaaaacttgagaaggctctgaaatttgaaagaaagattttttttaaatttagctcagaaattttaatttttttttaaattaaaaattattaaaatgagtatttgaaaatataattgatattatatttcctcctctgaaagagagccccccacttgggcttcagcctcctcgatatttagtgaataggaagtctttatttttcaatcctttttttcaagaaatctaaaaaaaaaataaataattaaaaaaaaatttttttgcaactaactttaattgaattttttttcaattaatttattttttacttgaaaatttcataaaatgtactgttgatttggtccgcttacagcaagtgagcgtgcaaagcttcgctattatgaccgcaaatttggccaatgttcaccaatttcgggctcatcagcggaacgtcaaaggcaacaacagcacggcaaattggccaaccgtgccaatgccaaaagtgccgatgccgaactgctgaacgaaaagctggccaagctgtacagttcgcctcaggcaatcaaatcgttcgaaaatttgtgcttcattgccgctctgttgcgcaaaaaggacatggacactaaggtggcttattgcttcagtatttatttatcaggatggaagtcggctcctggttcagttttccgattggaaaacttcggattccaattatggattcgcgaaattttaagcaaaaaattagaaataatgattaaaaaattagaaataatgatttaattatcaattgcgaaaagtatttcaacgactttttagcattcataataaaatagaaaatactaaaatcaaaggttatatttgtctttttttggagggatcagatgttcaaatcattcaattgaaacgttgcggcaaatctactgagaaaaaacttgagtttattgaatgaaatgcaattttaggccttttggacgtgttttaaatacaaaatgccctccttattttggaattgaaaaactgtttttatggtattaaatattttgaaaaattatgccctaatttttaaaaaccttgcaatttctgagcaacggatttttatctgatcagagagagccatgattgacatcagagcaattttgtttgggcaaaccccgaatttcttgatcaatcaatcaatgctggttgattatagaatttccattttagcaagaccaagaatggaaatttgttgccatggtgttcgatcggctgtttctgatcattttcacgttcgcttgcttgttcggcacgtgttggattctcttccaggcgcccaccttctacgacacgcgacagccaaaacagccgatgatgagcttatgataatgatcattttttaagcaattttattgggcaccagttttgccaattaaattagggacaaatggactttagaactcactcgtttttattgtttatttcattaatagagcatgtgaagggctcttgaatgataccaagattgttggatttggttgacaatgaaa

SEQ ID NO: 23217 - DNA, 966 bp, Heterodera glycines
gagctgcggaaattgtgaataattctcagaaaaatggctatctctttttaggaaattttctatctcgtaaccccgatgctaatccgttccggagagcctcttcaaaattttttccattaccgtaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctatctctttttaggacaattttctatctcgtaaccccgat

SEQ ID NO: 23218 - DNA, 1376 bp, Heterodera glycines
  misc_feature (23)..(23): n is a, c, g, or t
  misc_feature (39)..(39): n is a, c, g, or t
tcaagaaaataaataataaatanttgaggacgaatttcntgggaaaatttttcattttttctcggtatattttctgaagttttggtcaattttcagtggtattattttctgaattttttgggaccgattcttaggggtgtatttttcgtttttattgcatttttgataagaaattcctggaaaagaccaaaataggtgcgctaactgcccgttttaggttttttaggtgctaaaaagtcgttctaaatcaaaaataattgttcggagaaaatatgattttcatgattctcatctagactgagtttttcgtgcgtttcaggcctccacagtccaggaaaaatatggatttccatataattctcagccttagtaatgagtaagaaaataaaaatgtttccattaaattagagtgaagcgggaccgggaattttgggcaaaaccgggaccgggaattgccgggacctgagaagccgggaccgagaccgggacctcgatttttgttcgggaccgtgaaccggaccaaccgggaaattttaaaaattcataaaaaaaaaatttttaaaattcaaaaaaatgcaaaaaaattcaaatttaaatttatttcaagtgaaaataaattaaaattaaaattatatttttattttgttttttattttataaaatccaaaaattaaagctaaattaaattaatgaaaattttcaaaacaaattttcttcaattatttcaaacaattaatcattttgaattaaatgatcgaattttattagtttattagaaattcagatttgattttcacatcacttttttcggcgcgcttttcccaaaaaattttggcaaagaagggtggtccggcggtgccgataggcgccgccgggggaaattttgaaaatttgagtgtaatttgttaacagattttcaacaaaaaaggctggttttgagattagtaggcttaatttgtacggattttcatttaaaaagtgataaaatagtgtcaattaaacaaaagtatgaggaatcattgttttcgatagtaaacccatgagtatacaaaaagaaaattcaaaatattataaattctgtagagggattaaaccatgtgaaagaagtagaaaatcaagaagattaaccactaagccatgtgcacaattggcagtgttacttttaaagaatatattaattattattttttatttttttccgttgactctaattttcatcactaatttttcactcagacccccattcttaccagtgcttgtttttcccggttcccggttgccctaccgtaaccgggacctgagattttcaaaaaccgggaccgggaaccgggacctcggatgaccgggaattcccggcccggtcccgcttcactcta

SEQ ID NO: 23219 - DNA, 2600 bp, Heterodera glycines
  misc_feature (2591)..(2591): n is a, c, g, or t
cgcctatgggcaccgccggcccctgtgtccaaaaaatttttttcggaaaaagcgcgtcacaaaaaaacatgttttttaattttgactaaaatttccaaagtgctgatttgaccccaaatgatgcttcttgttgtctaaatgctggttttgaaaattttcagtttgcagccctgtttttataatgtaaaaagccgtttttttaatcttatttttggggccaacttagttttaacctcgttttgtccttagtttataatgggagactaaaaatataaaatttgatagcattttgatcaaataaattgtaaaaatttactgatttgaaaaaatgttgctaaatgttattatttttgagcttaaaatcttatttttcggccttggtgttcatattttgaaaaattaccgatcggcaccatggttttgaggggccgtcgggtgccgataggcgccgccggaaagtttttcgtaatttttcatgaattttattaagaaaatttgttctaaatctcaaaaattttcaatatttcccgccttcgcggatgaatttttttaaaacgctcggagtccacaatccccgaattagtgtcgggggtcggggggctcggggtcggggcttaaccctaaaataaaggggcagcaacaccaccatatcgttttattcacagtcaacacaagagacacattaataaatttttaaaagtgagaaataatcaatttactaacaatttgaaaaaataaaattaaaagcctgaaaaagatttatttcaaaattatacattgtattaataaatcaatctaaaaagtgtgatgagatatatttaatataaaaaaaattaggaaagacaaagatggaaaatcccagcaggtctctaagaactctgccaagggagaatttaatagtaaaaattaactatcccaaaaatacagaaatattccaatgaaaaatcactgacaaatttggcattgtggatcaccgaattctgactccggcattttttggtcggaattccgatttgtaaatttttctttaaaaatttgcacaaaaatactaaaaatagcactatatgtaaaggaaaataattaatgattaaaaaatgtactatcttaacagaacaaataaacaaaaaatacaatttaaaaattaataaagctattaaatttgtaaaagaaaacaaattaataaacagcgttgctttttgtcatctatataatgaagagcataagaaaaatccaatcgtaaagtaattaattgaattaaattaaataaatatttttattaaaacacttttaataaatcataatattaaataattaattattcaacattcattaaatgtggcaaaaagaaacattttaataaaaattaaaaacaaatttatcatatataaaaaaaatttttaattaattattttttaataaaaaatacaattttcattcaaaaatatacttttatttgaaaaaaatataggaaatgaaacctttgaataattaaaatacttgaacaaattgaagatttaaataggaaatgctgaaaatctttaaacttttataatgaaataatttgagctaattgtttaacaaaaataaatttgaatttaaaataaaataatttaaaaatatgttcaacagctgccatgaaaatgaaaaagttttaaaaatattaagacaaaatttgaaattttaattcatattaattaaatattttacaaaactttatttttaatatcacaattttttaaaatgattttaatcattcaaaaatgaaatttttatactaaaatgattattctattgttctatgtttatttattatgcaaacaaatcaataaaaaaatatttacacatacaaaaatggaaaaggaatattattaaatgaaatttacattttctagcattaataaaatggaatatgtgtaataaaactactaaatgttagtaaattaataaaaagcagtaagtgataataaattttattataatagcaattgtaaaaatacataaaagttaattcataaatgcgaaaattcatttctgaccgtatacatatacatgtattatatgtattctattggatcagcgagaaatttaaaaataaaatttactaagaaatataaatatgattaacaaataacaattagttgattataataaaaaatattacataaacaaaaaaatgaaaatatgtaatttattaatttgttaaaagaaaagcaaaaatcattactcataaatattaatcatagcaataccaaaatatttatatacaaaaaactcaaaaatatttattgcattcataaattaaagaataaattgtaaatattaaacaaaacatcattaaggactgcttatacgaaaaagtgacatagtgaaaaattggcttataattaacttttattcattcaaaaaatactttttatttgaaaaaaataaaggaaatgaattggacagaacaagcacaatttatgtaaattttgaaattatgcattcacttattttaaaaacacaaatatttatattatataaaaatattaaaaaaagttgagagaaactaaaaaccttaagagttatgatcaaataaatttatgacaaantttattttt

SEQ ID NO: 23220 - DNA, 1526 bp, Heterodera glycines
  misc_feature (1433)..(1433): n is a, c, g, or t
  misc_feature (1451)..(1451): n is a, c, g, or t
aagaggtacaactgtgattagaagaggtacaactgtgattaggagagagaggtacaatggtgattagaagaggtacaactgtgattagaagaggtacaaaagtgattagaagaggtacaacagtgattaaaaaaggtacaacagtgattaaaagaggtacaaaagtgattagaagaggtacaaaagtgattagaagaggtacaacagtgattagaagaggtacaaaagtgattagaagaggtacaacagtgattaaaaaaggtacaacagtgattaaaagaggtacaaaagtgattagaaggggtacaacagtgattagaagaggtacaacggtgattagaagaggtacaattatggtttaaaatgaaataaattagaaaattgcattggatgcattataaattcatcaaattaaaaaaatcatttacttattaaaaataaagttagaaatttataattagaatatttatttaaattgaaaggaattaatttctcgaaaatttaaattaaataaaacagttattcatcagaaaataatttaaaataaattaataaaacaatattaaattaaataaaatacttaaataatttaaattaaaacataattcaccaaaataatttaatttaaattaaaaatttttatttattattaataatacaaaacaaattaattaaaaaatgtaaaagtaaacaaaaaatgcatagaaaattaatgtacaccgtctggattcgaacctgccccccccccagaatgatgccccagaatccccaatcacacagggattctgaggtcttgacgatgtcaaaagtaaaatctgatcacgtattcgtgatcagcagcccaaataacccctaaagacatatttttggaagatttttgtgaaaaaaattttccactcaaaaatcctggtcacacccctttggtcccgaatcccaaaatcacttttatttttgtatctttttttaaaaatgtgataaaaaggtgaaataaaatttatataatagagcaaaaaattgcggatttttgtagtattttatttttctagagtgacttttcagaaccgagttctgaatttttttctgaaaattcgaatttttccagaaattctggaataacttttttcttttttgagatataaatttcaaataaatcccataaaattctccatatttttctccatttttaaagctttatttcattaaaatagtcccacattgaagtgagctatgaattttcaaatattaggccaaaatcccgagggccaaaaaattgccaaaaaataaagaatttttaaaaaattccaaaaattctgaaacttaaaatagacatcatattcgtactcagcaccttcaaaatacccagaaaaaaatttttcaccctctttttcaacccaaaaaaaatttccgaaaatttctagggggcctagctcganaatttttgaaaatttccngccatataatacactattcgatagcattttaaaagctctacaaaaaatgtctaagacatttttcgctaaaatcaa

SEQ ID NO: 23221 - DNA, 1770 bp, Heterodera glycines
aatatacaccgcccggcttcgaactttcccccctcccaaaaaaacgacgacccagaatccccaatcacacagggattccgaggtcttaagtacgtcagaagtaaaatctcgatcacgtattcgtgatcagcggcccaaatacccataaagacacgttttcggaagattttcgttgaaaaaaatttttcactcaaaaatcccggtcaccccccttcggtcccgaccgccaaaatcacttttatttttgtatctttattttaaaagatgataaaaaggtcgaataaaatttatataatagagcaaaaaattgcggattttttaagtatttaaaatttcaaaaacacctttacagaaccgagttctgaatttttttctgaaaaatcgaaaatttccagaatttctggaataacttttttcgtttttgcagtataaatttcaaataaatctcataaaattctccctatttttctcgattttttatgctttaaatgagctcgaattggaccattttgaggcgagttatgaatttttaaaatttaggttttaattttcaagggccaaaaattattgatttttcaaaatttttttaccaccctccaaaaaatccaaaacgcaatataaagtgcatattcgtgttcagcacctcaaattagcccagaaaagtattttttggcaattttaggagcaaaaaagtttctcatgaaatgcaaatccatggggtcccccctttggttttgagtttcaaaatcacaattaattttatatctttttttatattaaagataaaaatatgggataaagcacattagatagagcttaaaattctctacaaaaatgctctaagacaatttttcgttaaaatcaacacctgacgagttataggcccgggactgaaatgtcccggtcaggccaaaaaatttttctatttccggaaaattttgaaattttttcaaaaatgccaccaatcgatagagctcaaaaaacggttgcttgaaagtggtctccgttttcctgggaaaaatcggcaaaaaataataaaattcaaaaacgaaaaattttcgagggggcctagctcgaaaaattttgaaaatttttaaaatctgaaaacgccatcggatgcagctttaaaaactacacaaatgctcaagcggcgccaacccgctccgcttaacccccagcgagttattcccgaaaaacggaaaatgccgaaattgggtgccaaattttgcaattttctgcagcattggcatttacagatagccccgccaaaccaacggcattcagtgccaaacattccaacttaaaatcctacctccaagcattttccgcccccacttcttcccgcaaagttacaggcctccaaagacggacaaaaaaaatttcacgccgtttcagcgccgccggcgctgaaccgtccaccggagcggaaaacccatatttttcctgaatgcgcctcaaaaagttgtaagacccttccaccactttcagacccctcccgacagccgttcgactcaaattagtttttaagacgagttgcaacttttctctatggtagtataaactagcgtgtcgcgcagtagttgctcggtgtagacagtatacttttggtatatatgggcgggcgctgacatgagcgcttcgcgcaaaggacttcgttgctagtgcatgctcggcttcaaaattcaaaattttaataggcttatgtttttttcaaaattttaaaggcgacatttgcagcttcgcggcctcagacgggcgcttttgcatccg

SEQ ID NO: 23222 - DNA, 1647 bp, Heterodera glycines
  misc_feature (70)..(70): n is a, c, g, or t
  misc_feature (127)..(127): n is a, c, g, or t
  misc_feature (134)..(134): n is a, c, g, or t
gcttttcctttttgcagactgtacacatcctttttgtagtcaaagtcgaggcaatttttgcgttttttcnttcaatgtcaaaggatattgcgaaatatgtgcacagataaaatatgaaaaaatattnattctcnccttttccatttgcttttgcttaaactgttgcataaatatttttgtgtaaaaaaagaaaagtggccgattggctaaaagggaaaagtggaaactgttgttggattggaaaacgaacgttgggcgggtgaaggaatggccaaggtggaggaggacaggacggatttggccgcattttatgaaaaagtgagaaacgactgactgggaaagcaatggaaaggaaagaaatgttcgttccattagcatcatttgcgatttttccgctaccggacgatgggatttttactgagaaagccaatcgtccaatttttcaaaaaggcttatcgtctcagtttttatgagtagaccaatctcaaattgtatgaataggtcaaccctcccattttgtctgagtagactaattgtccaatttttctgagtaagccaatcgtccaatttcataaattatataatattatatcaaatttggcctgagtggcccaattgtcctcctattttgtctgttaggccaattgtccaattttttcagggtgggacaatccagcaattttatgagtaggccagtcgtccaatttcatctatgtatcaaattttgcctgaatggcccaattgtcctattttgtctgtgtaggccaatcgtccaatagtttgagtatgccaaatggtccaattttggggattcttcctggcttgatcatttcgatgaatattatgtattttttctttgactaatccttcaaactttgctttggtcaatccgaaaccatatcccatactgctgatcatttccattttactgcttctgatcagtgtttattttctcgttagcgattacctttttttgttgttcagtgtgaccccttttcctctgatcgttggcgattacagtatttttccaaatccaattcaagagatgtcccgtgaaagtctggttagtttatttgattaaattaaaaaatatataaaaagttccccagaatgttaatctattttgcacttggcaaaaatatttttcttttatttgtgccgctgaaatttgcctaaacccaactcattaaaagccccagagattagataagagcatagaactcctttttttgtagtggccattctttgcgataattttcccatcacaaaaatgtttttagtccccaaaaaattgcccgttgaattggtctttgatctgagccgtttcattaaatttgatcgaaaatggtcgagaaaatgccgagtttgctttttatttgaccaatatttgttggcacaaaaccgatattggctgaagctgatcaaaaaattggtcttttcctcaatacaaatgattttcatgatcaattttcagattactgagtgcattcgttccattgagagcttgcgggaatacattttggtggacatgaaagacgtgccggacctccgaaaaatggcggcacgcgccagttacagaagtatgtttaataatatttataaatttaattaaaaaatacttttaatttcacactaataagtattaca

SEQ ID NO: 23223 - DNA, 1267 bp, Heterodera glycines
tcgatgtattcttttcataaaatgtattatgtcattcattgttaattgttcgtttataacaaaacatttatctaattgtttttaattatttttgtttcaattataattgttgtactcttaattttatgtaaatttcgagcaatattatatgttttgatggtttatttaaattttatcacgaatagggttgtaaaataaacagggtttggcgtactgatgcatttaatacatttttttccttttctctctttctccgttctgtctcttttcctctccatttttctcgttttcactcttctcacctcactctctcgctctctttcttttctacccatctctttctctctctctccctctctccgtcactcttcctcacgggtctgtatcgtttcggcgccgccgtttcggcgccgccgtttcggcgccagcccttgtttttggactataactttttttgttgtcgatcaaatctaacaatcttggtatcattcgaaagctgaacatgtttagaagctatttctaagcaattgcttagcgattagtcgcttactaaaaaagttctaactgaaaattgcaaaaaagtcaaaatttttgtgattttttcttaataacttctttacaggtcaaattttttttttggttttttgtaggtctaatagggcttctgaagggctttagaatgataccaagattattagatttggttgtcaaagaaaaaagttatagtccaaaaacaagggctggcgccgaaacggcggcgccgaaacgacctagtccccaaaataatacccctgggagaagggagtgggaaacatgatttcaaaattttcaattttttctagtctaatctactcaaaacggttcagaattcgataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattgggggaaaaaagactttacaataatacccctgggagaaaggagtgggaaacatgattttcaaattttcaattttttctagtctaatctactccaaaacggttcagaattcaataaaaataacatttcacggtgcgaattgctttttaatcctccccaaaaatgtaggcttaacttttttagtgaaaa

SEQ ID NO: 23224 - DNA, 1017 bp, Heterodera glycines
tttttctcgtccatatgaaattgcgcctttttggttaattttgggttgaatctgttcgcccatgtgcccttgaagtaaagcgcgttgatcagcaccaaactgaaaaaaaaaatgaaaatccattttacaaccatttacatttgtttttgctatactaaaatcaaaatcgtaggaaaagaaaaagaataaatattcgtagctttttgacataaaataattaattttttttccgggagcactccaaaatttcgcctcaaaattttttaaattcaaaactagaaattttcaagaaaaaaaatgaataatttttctaatgtttttttgaaatttatgatgatgaattattaatttctcaaaatttttgttaatttctaatttttgaatttaaaaaaaaaattttttttcacggcgaaaattctgttccatttttcttcgtaattttttttttgcggcgatgtttttggtgcaccatggaaggaaacttaagctaattgggtattttatctgattttttatattacaaaatattgttttcttttataaataaaagcagttggtttgggcatttgcgctttcttaccgagcgttctcgtcaatgccttcggcactgatcagatcgcggattttctcatgggttgcttccttcacgaatttgttgattttcttaagacaaaaaatgtccggccgtcaattaattgaattttttaattgaaaaaaactggcactaataaaagtatgccgtttttgaaacttattaaaaatcgaagggggtggggaaacatttttggttttacaaaaaatttgcttttcataaaatgtcgggaaaacgtattttcaaggggttttctggggggggggggggtcggggtcgttttcgcgccagtgcagtttttaaacttttttcattgtcaaccaaatccaactttcttggtatccttcgggagccctaagtattcgctattagcctgcaaaattgcgaaaaatttgattaaggttcaaaaaaagttatggccagaa

SEQ ID NO: 23225 - DNA, 2375 bp, Heterodera glycines
gatttcatttcttcaaatccaatctcacgtccagtatgcggttgatttacgtaatccaaaacgtttccagccaatcgttttttattccgccgctcaatcattcgccaatttatttttcacggtgcccaaacggcaccggcggaatcgcaaatcgttctgcacgagagcaacggggtgcgcggcatcgtcatagacgcttcgaagctcttccttcttaataaaactgaaaatttcgtccttcagttcatcgggactcgaaaggggaaattttgttggattttgaagaaaaaacaaaaaaaaattatacatattttttttattcattcttattgccagatgagagtactgtagtcactgttattgtagaacaagtgtgaaaaatcgacaaaatggacagatcaaagtactgctgaaaagcatcaatttgtgtggaaaaaagacacaacaagatttgataattaattaatttagtggtgctgcttcaaaaagttttttcttgacaaattttgttaaattcatcaaaatttttcgaaaaacgcccatccgcacacctccgaacccccaattccatgagatatgaaattaacagcccacaatccacaaattagccatgctgtagtgaaaattttgttaaaaatatgatcaaaatttttcaaaattgatctgtgctggcacctaacattggggggggggggtagcccatcccctggaaccaggaggatgcctgcgcctagctatgcccttggtgaaaaacgtttcatggtgtgtgcgctaatttgtaagatcaaattacatatatacaacaaatgattgacaacattaatgaactgacaaatgtgtctcttttcaacgcctcctttccattggtgttttgttctatagacatcattaattatccatccgtccgtctctcccactttgtcaacttcggcaagcctcagccgaggcaaaatgtttgaaaatggggccgtgccggaaatggtggacgcgtcattgtgatatgtatgtcaatttgaacgcggggtgggattggggatcatctccgcaacaacagcacggcatcatctccatccacgccaaatccaggaaaatccagatccaggaaaaatccaggttgccgaaaaatgacctggacctggacctggatccaggaaaaatccaggcctggatccaagtccaggtcgaactctagaaatcacatataaagtgcagaaagtcgggactctcgtaaggttaaaaacctctggcctaattaagggcatcaaataattttttggaaatcctttttcaaaatgatatacaattatgttcagaagatgtattaaataattaatgagcataattagcgcaaaacaattaattagtgataattagggaagcaacttttagtgaaaaaactttttttgcttaattgttttgaagaaaggagctcaaaaaacgcatttctgcgttaaaattttttcatttggacgtcacttttcgtcactagaaatcactattttggcgacttcgtcactaaaatagttaaaaatcactattttgacgttttgtcactattttgtcactatttcgacattttttggaaaattctttaacaaaaatgcaataaaaccaaaaaatacacccctaagaatcgacctaaaaattttttcaaaaaatacacccctaagaatcgacctaaaaattttttcaaaaaatacacccctaagaatcgacaaaaaaaaaatttcaaaaagcactcctaagaaatgaaaaaaattttctcaaaaaggtattttcgtggcaaaattttaattttaaaaattatttttttatgtacctattttgtttttttgcccttaaaaatcccagccctactcatttgcaatgcaatcagtgaataaaaattatttttgcttaatttttggctgaaaattatgtcactattcgtcactattttggactttttgtcactatttcttcactattttagcatttttactcactattttagttaactatttcgggatttttcgtcactaaaagttgctaccctattgattactttcaatattataccatagtaaaaactaaagcccagcgcgggattccgaattttttttggaaacaacgggatttgcgggattaatcccgccggattccctcccaaaacaattttgattgactccgacaaaagtaattagatttttttgtcgacaaacagtaaaagccgaggcagtacgaattgggtttctctccattttatatggatttgtaaatatttccaaaaaatgtttcattaaagaatttttcggaaaagaagccaccagaaaaaatacgtggaataaaaaagtggagtgtatggcaaaaaaaaattattttggcactttccgctc

SEQ ID NO: 23226 - DNA, 1236 bp, Heterodera glycines
  misc_feature (53)..(53): n is a, c, g, or t
cagaataattacgccgatactaatgtttctggaatttgtttctctgcgcgttngtttggaaaaaatttggaaaattggctatctctttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaactgcattctcagaataattacgccgatactaattgttctggaatttgtttatcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctctgcgcgtttgtttgggaaaaatttggaaaattgactatctctttttctgctcaacagtaataggaattccaaccgcattctcagaataattacgccgatactaattgttctggaatttgtttctctgcgcgtttgtttgggaaaaatttggaaaattgactatctctttttctgctcaacagtaataggaattccaaccgcattctcagaataattacgccgatactaattgttctggaatttgtttctcggcgcgtttgtttgggaaaaatttggaaaattggctatctctttttctgctcaaccagtaataggaa

SEQ ID NO: 23227 - DNA, 947 bp, Heterodera glycines
ttataaatctaataagggatttttatcaatattaataagacaaccattgttaaacacatataatgattaattcaattcattttgattgataaaaaaatttaaaaataaaattataaagcagaaaaaatgaagacttttcatttatcattagcctgatagaacctagcttaatgtttaaactaaaatgaattcaatgcaattaattgtagttcaacatttacaagaaaaatgaaaattataatttcattccagttgcatattcggagtggaaatgaatacttttgacacaacccgtttttaggtctaaccctttacagaaatgtgccaaatgttgtgtatgcaacaaataaaaatataaattgtggacggtgaattttcatatattttattggagaaaaacagcagaaattggtcggaggaaaaatgcacaataatggtgaatgaatagacgaatgccaagtgaaagggaatggacagggcttcagtaacagtcaatcaatagggagaaaggaaattgattaacaataagaagagagtgcataaagagagagaaatagtgaataaaagatatgcactactaagtgagagaacaaacacggtgtgatttggtcacacctaacaccaaacaacattacaataagtataaaaaacgatcatggttctaaaatagcagcataatttgaacgcataaaaatttttattggaaaaatatggttttaatctaactaactttgaaaaacgttattataatatttatctttacaaattaaccggaaatagtgataattttaattctagtttatataaaaaaaattacgtacgaagggaatgattacgcacgaaatttcaataaaacgctgcaagaaacaaaaaattataatttatttaaaaaattaaagagattatcatgagaaataaattattaagaaataataaataaatatctc

SEQ ID NO: 23228 - DNA, 1414 bp, Heterodera glycines
  misc_feature (50)..(50): n is a, c, g, or t
ttttggatgatgtttttgatagtattataaaataaaaattttcacttctnttctctttttttgatagtggtttcgaccctataatatttgtatgataattttctaaatgattaggtttttaagagtaatgcaatcggttggtcttttgagtgggtattttcaaaaagcgtttaaaaaggtatgtgcgcaactaagtttttataatatacttttttaggaattttttctgtgaattaaatgacgatcaaattaaaaaaaattggaaagtctggaaaactataccgtggctgtttacgttgagagcaatttcccctatgcacaatggctcacagaaatcaaagattatttgttttcttttgtatattacgaaagaaatatgcgctgctgttgtgctcattctgttgttccgggaacctataatctctttgtatatgccagcgtggcaatcgaggacaataaggaaatcgtaatatttttccatcgcgatgtattccttcgatctaatcccagcaatatatatattagtaatctttaccgggttcgaatgagcataagacaaatagttttgttactgaacaaaagagagtggttaatttctcctgtaactatagtagtcaattcgtttctaaattacgccgacgggtaggtattttttgctattattgcctatttttaaacttaagtgaattgcttaacaaatggaaatatttgccatgtcgtgccccgatattgaaagaaatatgttgcgataaaattgccagaagtaagttttctatgggacaatatcggtcacttcctcttagttttaaacaaattttttcaaaaattgaataaatatttatttctgaattttttgtattgctttttaaaagtttatatttctttctatatatttacataaagcattaaaataatttacttagtactttttggttttgcgtttggccaagaaaatagcaattgttgttgtctttctaatgaagagaaacagcagttctggcgttttattgagcttaatgactaaaatggaagcaatttcttacaattgtcattaagaaagtacatccaaaagtttttagcattgagaggaaataataaaaacaacaaaaaatatgacaatttttaaatatattacgacaatcaaaataaatgtaaatttgttttgctgaaaatggattaaatagttaaactttaataaataaatcaaattgctaaaaagaattaaaaatgaaataatcttttatttagtttaataaacaaagatttttaatttattaaaatacctagaacaaatgattataaaataattattttattaaaatttaattatatctatttccaaaatcgaatactttttaaaggcgaatataaagtaaattttattatgtttattaattgaaagcataataagtag

SEQ ID NO: 23229 - DNA, 1223 bp, Heterodera glycines
  misc_feature (114)..(114): n is a, c, g, or t
tcagaagtttcgcttttcaaaaagctcgttgggatcgtctgttttcggcaaaatagtgcaccacagcaaaaaggcgggagtttgaacgacacttctctagggttgagggtgttntgagtcagaagtttcgcttttcaaaaagctcgttgggatcgtcctttttcggcaaaatagcgcaccatagcaaaaatggcgtagtttgaacgacacttctctagggtttgaggtgttttgagtcagaagtttcgcttttcaaaaagctcgttgggatcgtccgttttcggcaaaagagcgcaccatagcaaaaatggcgtagtttgaacgacacttctctagggtttgaggtgttttgagtcaaaagtttcgcttttcaaaaagctcgttgggatcgtcctttttcggcaaaatagtgcaccacagcaaaaagggcgtagtttgaacgacacttctctagggtttgaggtgttttgagtcagaagtttcgcttttcaaaaagctcgttaggatcgtacgttttcggcaaaagagtgcaccacagcaaaaatggcgtagtttgaacgacacttctctagggtttgaggtgttttgagtcagaagtttcgcttttcaaaaagctcgttgggatcgtccgttttcggcaaaagagcgcaccatagcaaaaatggcgtagtttgaacgacacttctctagggtttgaggtgttttgagtcaaaagtttcgcttttcaaaaagctcgttgggatcgtcctttttcggcaaaatagtgcaccacagcaaaaatggcggaggttgaacgacacttctctagggtttgaggtgttttgagtcagaagtttcgcttttcaaaaagctcgttgggatcgtacgttttcggcaaaagagcgcaccatagcaaaaatggcgtagtttgaacgacacttctctagggtttgaggtgttttgagtcagaagtttcgcttttcaaaaagctcgttaggatcgtacgttttcggcaaaatagcgcaccacagcaaaaagggcggagtttgaacgacacttctctagggtttgaggtgttttgagtcagaagtttcgcttttcaaaaagctcgttgggatcgtactttttcggcaaaatagcgcaccacagcaaaaatggcggagttggaacgacacttctctagggtttgaggtgttttgagtcaaaagtttcgcttttcaaaagctcgttgggatcgtcctttt

SEQ ID NO: 23230 - DNA, 1782 bp, Heterodera glycines
  misc_feature (1661)..(1662): n is a, c, g, or t
  misc_feature (1673)..(1673): n is a, c, g, or t
agggcagtgcgttaccctcctaccactttcctgaagacggaactgctggtccgcatggcgacatttatgcaggagttcgacctgctgcccgccaaactgttgcagacgcccagcgcacgccatgtgggctcgtggtacaaacaaagtgagtgaatcattaccatttggcatggtacagtaatccctaatccagcgggtaaacctgttggtcaatctaatccacaatccgtgccaaatgtccgttggggcctgatcagaaattgtttgggcttagtaaccctaaacagcttttggtcgaaggaatatgatttacatgaacttcatattatcgaaaatgcctggtccgacgataattgtctgggctaataatagataatcagtgctgattaaggaagattgacaataattatgttcggataagctaagcaaaatcgttttaaaatcgacttctgatcacttcatttttaaatatattattgacattgcaccgttcgttttcaaattgatcagcattttttattatccaaaaaactaattctgatcaaatccaccgaggatccatttcaaacagtaccaagaaaagagttgtttggatcatgatcttgtgattgtttggatcctgatctgctgatcagttctcccagccttgatcaaattgattaaattaacttcacccacatttcattcaggcttctctgaactgctccatttcgagggcctcgagcccagcgacatggtgttggacaagttcaacaaccaattgcgcacaattttgcatcgtcacaacaccgtcgtggagacaatggctgaggcattgctcgaactgaaggaaagccacggcgtggacattgcatgcgaacgcaacattcaggtggagtggatgaattgaattccagatatttgttgacacatggtatcgagtcttggcaagaggaaagtgttcgagagtctcgactcggcagaaatctcagccttcttgggtctcggctgaaatctcggcgttttttgggtctcgagtctcgggtcatgaataacatgaacttgtagctgttttttcgtcaaagccgcccctaaatacttttttttcattgaattacggtcccgaccctccgggccaatttttcgtcggcagaaataaaccaaaagcataattcgcacgggaattcctattttcagttaactaattttaatttaatttaatttaattattttattcatttgtgatttgtgcatttgttcagtacttcttggatcgtttctacttgaatcggatttccatacgaatgttgcaaaaccaacactgtaataatattattaccaaattattaaattttaattgttttaaaaaaacatttaatttcctccctttgtaagtggcaattttcgccgccgcctgcgacaccaatggcactaacaatcagtcgcgcaagacagtcgtggtggacccggccggccatgttggacacattgacccgcagtgcaatgtgcgcgacattctgctggacgcctacgaaaacgcgagataattaatttattatttatcaattaattcaattcattttaatatttattttttaattaattattttttctttaaaaaaataaataaataaggcactcatttgtcagatataaaacactggtgatttatgtatttttannattgttttcanagttaaattagacattacgataattaaagttttcaagagaaaatttttatttaaatcttaaaatatttatttattaattaaacaaaataactgcctttcgcacttttta

SEQ ID NO: 23231 - DNA, 949 bp, Heterodera glycines
gaaggtgtgcagtcaatgcctgtactgaaatggcagggatggaagggaccggcgggtgctgagaccttataaaataccatcatatccatactttttctcaaatctccattaacttgtaatttttggtatctttcgatgccctaactgttctctattagtatgcaaaattttaaaaaattccgtcaattttgagcaaagttatagccgaaagtacacaaacaaacaggttttcaaacttttttgaccataattttgaaacaacgaaattttttgaattttcaggctaataaaaaagacctagggctgtcaaatgataaataaaaaataaaaataatttaataaaataaaatgaatcttcttgtttagaattcgatgcgtgccaccattgagcatcaccatcgggtcaaaggctttgatgccgactcttccgatgatttggcagaagtgcgtgcctgcattgtgctcggcgcggaaaacctttcaattaaggcatgtgctttcgattttttggcactttatttttgtccgcttttattttcactctgaccactcacatttctcatctttctcagatcagtgatcgcggtggtggcgtgccgagtgccaagctggccaatctgttccattatctgtattcaactgcgccaaagccgtcacgcgatgactccaacacgccatttgtaggcaccaaccaatgaataaaaactctgatcacgctttcccgtcaataaatatcttatcacttttttttgccataggctggttacggatacggtctgcccatttcacgcctttactcgcgctattttcttggcgatctgtcactgacttccatggacggttatgggacggatgcggtcatttcattgaaggtagataattcgatcaattagagttgtttaactgggaaattcgctcctctcttcctctcgagaatggcacgggaaat

SEQ ID NO: 23232 - DNA, 1874 bp, Heterodera glycines
taaaaccctgaaaaacttgctcattcacccaataacctcccagtgttcccttttagtgtgtgataattaaacaatgggctgtttctcttcaacccttttgccttttatgttcgccgcctttttggttacgctgatcagcgaacatgccgatggcactggactaccgcagcagagttgctgttgtggaggcggaggcggtgggtgatgttgttgcggtggtagcggaggtggacttggcggattaagtttaggcggcggtggaggcggctgctgctgttgcggaggagggggcggaggcggaagatgaagtgaccaaaaaatagcggaaaaattgggaattaatcgaccaaaaatttacaaatggaaaaaagaaattggaatttattattataaaaagaaaaaacaggaatttattgaccaaattgatgaaattaaaagaatgccaaaaaatggaagacagaagcaatttgcgaaagagttgggcattagcaaagaaacattaagaaaatggaaaaaggaatttggcattgaaatgagcaaaagtaaatttgaaattaatttccaatataattattaatattaaattttattatattcttaggtccaattcgattcaccgaagaacaaaaaatgagcaaaatgaatgattattatgaaatgaaaaaagcaaatccttctttaagtgacaaagaaattgctgacattttgaaaattggaactgccaccctaaagagatggaaaaaggaaaataattcgtaatttttcgtttttcttatttgtattggtttcaaaggtgctaggtcactttaaaaaaaagttcaaaaatcaaaagtctgatttttcttataattttttatcaattttttaaattataaacatgttataatttaattaaatgattcttaaatacgtttaaagttttgttgaatttcgaataaaaaataattaaaatttacctaaaattttaaattttggagcttaaagggtgccaataaattttaaaaaagctaagtatagacggtaacatgtgatttcgtccgtaagggatttcgtcagtgataataatcattttttatgaaaaaacatttaatttttcataaattaaaattcattcgatatttaaattcaaagtaaaattatttgctcattgtcaatcgatatatgggtggtcatttacatatcataaaatattttgtatttgtgcttcgtttttgctaattttataatcctgtatgtttatttataggtggtcgccagccattcattcttcataatctcggaatttctcttttaaatttcttaccaggggtggagcgcgacgcagcaatttgaatccgcgctgcgcgaccgcgtgagctttctgtcctcgctccgtccctgtttcttactaataattttgtatttctgcattttgagtatgttgatgctctacctaatcattttttgtctccaagtcgaatcataggcgtctggcgatcacgtatggaagcgacctttaccttttcgagtgtgttacgagtagctgattttcgcgttgcccagatgacggaaagtgggcacgtgaaaagcacaaataaaaatggattcggcattgcaacaatttgagcaatcttatagaggactttgcaaatcgtgactcgtttaaatatttacggggtctgttcttatggctcgaatttttaatttttttagctaggtgtacgctgtttttattaattaattttcactgacgaaatcactcactgacgacatgacttactgacgaaatcacccgggaacccattaaatgaatgtatttagagatgcaatattaccatatatttaggccaatttcttcttctgctgttcaactttctttccattttggcaaaaaa

SEQ ID NO: 23233 - DNA, 1920 bp, Heterodera glycines
cgacgatctcttgggctcttccacaccttctccaacagtaaattttaataaaattgaatatattttatgaattctttaatctgttcagcctcctgcaagcaaaaagcgcgtttggcacgatggccatgagtgttgtgctcattgggccccgaaaggggcgtgcacatctgcgcctctgcacctgaacacgtggtgttcgggaacgtgccgattcaaaaggattagaccccacccctaaccagacaaatcactcaagacagaaagaatgggtccgatgaaaatattaaaaccccccccccccccccccccccccccgggcgtttccctcttttatttgacctttgtccgcattctccgcatcgtgccaataaaccatctgtttccatcccttcataattaacaaatcagccaataattgtgcagtcggtggtcttatggacacttcgaaattgtacgtattgtttggatgatgaaaagccctcggggaaagatccttaacggcaaagtcatcgacggatgaatggcggagggccaaacccaattaatcattggcacttccaacccattggagacggccatgtacgcctcgtaggggcgctgatgactctctcccgccatcaacagcatgaaaccggaacggagctcagcgcaaactgagaaaatgtggagagtgggggattggctaacaattaaagtctaaccgcaaagggcggaagggaggggaaaagccgaaaaaagggacaaaaccgagaatatcccaaaaagacaaaggaaggtaaagcacacttttggacatcaaatcccagctgttctcccgcgaaatgcgcaatgatttgtgtctgtgttcgagcagaaatgtgccgggagaagcagaattgaggcggtcgatggtgaagttgagagtggcgatggtggcatggtcatcggagttggtgaaagactcttcaaaacaaaaaattctaacactgatcgactgactgatcaaacaaatccccaaaaagagggggggggggggaaacgcaccgattggaatttgggagggaaacgcagcgacggacgaagcagcgaattggtgaaggagtaaaagaggagggaaaaggacaaattggagaagcgaaagagagatggccatttcggactcaattgggaccaattgagaagcaaaaggcaatttaaaggaagcgaagggaagagaatttgagcagcaaatgcaaatgaaaacgacagaaaacagccgaggcccaaaacgaaaacacccaatcgaatatggccaagtcgcatccccataaaattgcctcactcggacagtcagtccttcggcaccaattaccctcaacgagcaaaggcatttcatcagcggagggagggagggaaagggacgaacttgcggaaattattattttgaaggaaaaacaagatgacagcaacagcagaagaagaagggcctaacaaaggagagtgttcgggtgatggtggaacttccaaatgaaactttgtaggtgggtagaccacccctgggttgtattgccaaattttttttctagctgcggaataagcttctgtgccgagatatgaggctttaaatatttaataattatattatattaaatttaaaaggagaagcaacaagcgaccggttggcagggtggttgtgtgtcacgatttcatttttgtaatggaaagttcgagtcccccctacgcaaacatttttttattgtttttaataaattttattttaattttctctaaatcaaaatcatttaaaatgcgagatcttcaacgatttcaatttcttcttcatttttaaggcatcgttcaatgattaaaataaaattattagccatgtcaatctcgacaggcgaaatagttgaatcattaaaagaagcgaaaaatgttttgaagtaaagaaataatattttg

SEQ ID NO: 23234 - DNA, 1136 bp, Heterodera glycines
  misc_feature (58)..(58): n is a, c, g, or t
  misc_feature (63)..(63): n is a, c, g, or t
cgcttttggagtataccagctccgaattgtggcattgtgcaccattcgatgggtgtancttgngctaggataagcattcaggggcattcattcgcagagcaactgaatgtttttgtttttcattggtgagtttttggatgaataacgatacaattttgggaagatcgaatttggcatggggcctctgacttcgctggtcccccccccccctatgtattcaaatcaaaatcaacagcctttcattttatttgagcttatctttttatttgagcaaatggtttgagttggaaaaaaataaaaattttatataatcaaattcctttatatgaataaatacaacaaaatatggatgaaaaatgttagctgatcatcggctcttggagagtgcaacccgcttccattggaaaaagaaaacccccggctgatgtccttagtttcgccacttttgactgctgttgactccgttcttttgtcaatgcttcggtctgcataccttttcttgctaatatccgataagtccactcgactgcgaagaaaatggcagcgtttgtcgggacagcccttaaacaaaaaggtaattaggaagcttaagatccaacgaataaaatcaaattagcacctaatcaaagttgagccaagtccagcaaagaatgttcgccagccgtgttccgagtaagcttttttgacaacttctcggtctgaaaaactatttgttcaagtttttctcaaaaaaatttacgcgcccaggaaatttggtttgaaaatttttcttttcgcattccatcctccccaatttttctcacaattttcatacgcatcgtccgattggaaccgggttttgaccacatcagttggataattgctcagccatgaacacattcccgctgctcctccagcaaaaagcaatttcaaattggacattccttgcgattgttctccattttcggagtccattgaacgcctcaaaaaagcataggaagcaaaataaacgcccatcgcaggacaatccctcagctgagtgatcagaaggccgctgaaattacatattggtggtggaacttgatctatttgattttttcgtgctgtttaagcatcttgaccaggaaaaaattggcttttatatttcgatcggtttt

SEQ ID NO: 23235 - DNA, 1755 bp, Heterodera glycines
gcgcgaggagcgaagcggagcgacgagcgagtgtaccgagtcaatacgaacctgatcaattcttttagatgtcacttagcgggcatggggtgaacggctaggctcagctgtcttccggtagctgctgctgcacgaacatccagatacgcatctgcgcctgagctgctactgcactaacaacctgacgcatctaccccgttactggctacaactcgacgggataggctcggctttctataaagcgcagccatctaccgggacgcctagttatctatatataaaaataacgggggggctaaccataaaacgatttggcggcaaagaactacgcaacggatcgccacgagaccggtaccattcgaaagagctcggttttttctatcgttctatccttgtggaaaaatttacgataggcagaaaatttcgagaaaatcgcgttcgaaagaaaaaaacccggctttttacaattggccaaaaatgggttgtaaaatgtgtgttttcaccttatttctcgggaaccataaaagctacgcttttgcggtaagcgaacaatttgtagagctcgtcgagctgaagggtgagaaaaaaattttgtagctctacgacaaattcgaacaaagttataccccggcaaaggtcgaaaaaagcccattttttttgtattttcgccttccggtttacaatccgtttacaattgtaaattcgtccggaatgtccggaatttcgaccgaccggatggattttgtgtttttgcatgtgttttcaaccggtttacatgtgttttcggcgtgagttctttaaaccggttccggtttttcatgtattttcttcacgtttacgtgtattttcgacacgtttgcatgcgttttcaacattatacgtgtgttttccttacattaacgtgtgttccagtacgttaacatgtgtttttgagtatttttacaactttatgccttgtgttttgctttgtgtttttgcattcaatttttacaatttaagcaccagaatttttctgattgttccggaatgcttcagaatagttctgataattctgttacagaccagaacggttctgaaaattctggaaaacgtcagaattgttctgataattctgaaacacaccagaaccgttctgaaaattcaggaaaacgtcagaattgttctgaaaatataaaattaaattaaataaattaaattaaaataaaataaaataaattaaaataaaataaattaaaataaaataaaataaaataaaataaaatgaaataaaataaaataaattaaaataaaataaattaaaataaaataaattaaattaaattaaattaaattaaatagattaaaataaattaaattaaattaaaataaaataaaattaaataaattaaaattaaattaaaataaaaataaaataaaatacattaaatttaaataaaataaaataaaataaattaaaataaaataaaataaaataaatttaaatacaaaaaaataaaataaaataaaataaatttaaataaaattaaatttaaataaattaaaataaattaaaataaaataaaataaattaaattaaataaaatcaaatcaaaataaataaaaattagctgttttgcacgataaggggcgggcgcgaagcggcctgcccctcgaggtgcgcgagcgaggagcggagcgaagcggagcgacgagcgagtgtaccgagtcaatacgaaccgggccttttgcccggtagccacgctctgcatgacaaaa

SEQ ID NO: 23236 - DNA, 2281 bp, Heterodera glycines
tcttccggcggtttattcagcaattttaagccccatggggatcgcttattccggaccgacaccgaccgaaacgtcggccttttcccccgctcatctacatcaatttcggcaccggccgtatcaattcgagcgaaagcccgtaatatcagcacgttcggcggacggaaacagccaacgtcaaaactcacaaaacggaggaaaaagtggggaacgggggagaatttgaagaaaaaagcgatcggggggtgtttaaataggggacaaaatcgagataaaaaaaagtaaagttagggacggaacacgtgccgactcgaagcagtggctcgaagcaaaaggtgatcagccaacacaactcgcacattgttctatttggactttgaaaatgggaccatttgcgagccgaaaaaaactgtggaggtaattaaaggaaaaaaaaattcaattattggaatgaatgacaaattggcattaattaagaattacgaacggatcacggacttacgaatgaacaaaagcgaaagagtaagcgaaacggaggacaaattggcactcacttctcatcatttcacttattatcttccaaaatgattgccaatcgaatggtttcttaaaattgttctcttttcagtgtctccccgcgtgcaaacgaagcgaacacattttcagccaatacactcacaggggatccatttggaatgcccgcaattacgtctctccctttcggcaagtatttcattcaaagtaaatagcggcggctttattaatcccacaacagtttaatcattatttgccccttttatggttttcaatttctttaattctctcttcccctccctttctctctctctccccatctctcactttccttctttctctctcttcccctccctttctctctctctctctctctcctcatctctcacttaccttctttctctctcttcccttccctttctcttccctctcttcccctccctttctctctctatctctctctcctcatctctcactttccttctttccctctcttcccctccctttctcttccctctcttcccctccctttctctctctatctctctctcctcatctctcactttccttctttctctctcttcccttccctttctcttccctctcttcccctccctttctctctctttctctttcctcatctctcactttccttctttccctctcttcccctccctttctctctctttctctctcctcatctctcactttccttctttccctctctgcccctccctttctcgtccctctcttcccctccctttctctctctttctctttcctcatctctcacttccctcctttccctctcttcccctccctttctctctctttctctctcctcatctctcactttccttctttccctctcttcccctccctttctctctctttctctctcctcatctctcactttccttctttccctctcttcccctccctttctctctctttctctctcctcatctctcactttccttctttctctctcttcccctccctttctcgcattttttatctttttaattttcccttttcattttagaatggaggtgtatttcacagatttgcaggtccatttcaattcaaatctttgctaatcccatctgtgccacccgcttctttttgagattgaagtgtatgaggaagtgccaactttgaccgtttcccgcttcatcgcccaattaggcggccaattaggcttatacattggactttccatagcatcattcgtccaaataattcttccttgcatacggaaatgccatgaatggatgaaattgcgaacggagaaacgacgaaaaaacaaaaaggaaaacgaaatcgaaatgttgcgacggaggagcgaaatggtgggacaatggttggacgaaggggacgaagcaaatgccaataccaatgtgacacaacgaatctgtcaatgggacggattgccaaaggcattataagcccgtgttttagcctcgggcattcgtcgcgaatgactcgcggagacatgaagcgatttattttgtatcatttgcataaaacactttaattgcctctaattttgctcatattaatgtgcaaattgatagcccctatattctcattgtcagtcaatcgccaaaatccgtcgaaacactttcttttgggcaccactctcatcacaaatcaatcactcagcccattaatcgcataattggcctttttcggctttcctgggaggattaatcccacgtattattttttgattgtttttgtgctg

SEQ ID NO: 23237 - DNA, 1537 bp, Heterodera glycines
aaagagttcgattcccgtcgaagtttttaaataaaattcaaaaaaattatttcttctccgaatgatgacttctgtttatatttgctactccttatggtccatgaagaggatgaaaaccaccaacttttctgttgtctgacggagaattgcgtttttaataatacttttaaaatatttttttattccttacattttttaatttaatttttgttccagtgccaaccgtgtcgactatgttttgcctgattttgtgcacacaacacggggccatgtgctgcatcggggggacgcttctaatagggtgaagaaacaaatcgctaattaaaaaaattcgtttttcagcaattttatggaaattttttgcaaatcttggtatttcatcataaaaattttgaatcgcaatttcttgaaattttcttatcaaaattttctcttggattttttttttgttaatttcgtttaaataattttttggaaaaacttctttcttaataaaattttgaaaaatctctgagaatttttcaattttttctaagttttgaaaaaaaatttagggggggggggggcgatctgctatttttttaattttaaaataatattatttctcattattttttgctgcagttgtcacacaaaaatgccgacgacgacgagcagcagcagaaggtcacgctgggcgttgaacgctttgcactgcccgaactgctgattcggcctggcgatgttgaagtgcagcaaatgggcatcccagaagcattgtgtgctgtcattgaacggctgccaaagggtgcggcggggggcaggggtttaaccgaaggcttttacttaaaaaaagatgtgataccaccgtgtgtgtgctgtacccaatcccgcattttttgggaattgcgggatttgctggattatcccacgggacccagtctcaccgcaatgccgcagcgggatctgcaaatttaaaatttcaggctctaatattgactcgccgtagggggcggagcaggtcacccccgcctcgaaattttttaaaaattgttagaatttttttttttgaaaaaatttttagggctgggggaaatgaagtgcacctcgtagcggaggagaagaaggagtacttttgcttattgctttcagaaatgcagctgttgatggcgcggaacattgtgctgaccggcgggaacgccctcttcccgggctatcgcaaaagaatgtaaaaatttggaaaaaaaacaacgactcacattttaccaagaaatagtgtaatactgttgtttgtccccccctttttaaataaaaaattttcaataaaaacaaatttcctatggtttccgagggactaggtcgtttcggcgccgccatttcggcgctagcccatgttttttgggtataacttttttctttgtaagcaaaatcaaacaatcttggtatcattcgaaagtccttcacatgctctactagccttacaaaaaaaagccaacaaaattctagcctttaaataattattaagaaaaaacttcaaaaatttgacttttttgatatt

SEQ ID NO: 23238 - DNA, 1716 bp, Heterodera glycines
cttgtaaaattttttattgtatctaggtcccggccggtaattacaacttttttgatatctgcaatggcaccagttttcaaaataataagtaccagtaattcttggaaatttaggaacagggaaagaaatttcaaaagtgtagaacatcaatttataaacaattattttttatattgttatatcttttggttaaaagctattaagaaaaggacaaaatttgcataaattttaaaaataaattgggcattttggatccattttttggaaaaatctgttgacaaattgcaatgaagaagatcgtcaattaattttaaaaaacaggaaaattctatcggaacttttccaggtcccggtcaaaaccgggacttcggtactcagttgtacgtgtttttcagtacccggtcccgtaaaactctagtttttatatctgtccatccatgattttatttttaatcattttaatatgtaattttctacttatttttattcaatctcggcattttctgttttaacctcgtattgttgttattttttaatagttttaaatacaaaatatgacatttctgtgcttctgcccattctgccgttatttagacatgctgatcaattagcgatctttaaggtctcattgacgaagtaactttgccaaatgtaacaatgttattccttaaaaactttttgtgcgtgttctttcattagataaactgattagtgaccattttaaactgatatttgcatatatacgaaaaacaaattgttaaaatgccaaataataggaagccagcaaccctctgcctaaaatcccgaccatgacaacaacaatggcattttactccaataaatgtcggcaactacagaagcgactttggcttccgcccgagctctcttttgagcttctcctttttatgcagccatcaaaaatttggggcgtaaggcgcttgctgaggacaagcgcaattttttaccgtttaattgtcggcacgaaaaatttagaatattggcgaaagccatactcagttttggtaaatgataaattgtcgattaaattcagattttatttttatattatttgatttaaaaaaaaatagtttttatctttaataagacgatttttatcctaattatgctatttgattctgttttttgggcactagttccgatatatttagcataaataacacattttccacttttttgaagcttctaggttgagttttattatgctttattttgcctttttaggttttcgtgctttttctgccatttttcggttttgatgcctttttaattccttttcttgataaaaatttatagtttaaaaattttccttatttgatacatttggggccgtaagtcgcttgttgaggacaagtgtaattttttaccgtttaattgtcggcaggaagaatttagaatattgacgaaagccgtactcagttttggtaaatgataaattatttatttaaattcagtagtttatttttatattatttgattttttaaattgattttctatttaataagatgtattttctgctaattatgttatttgattctgattttcgcattggtttcgacatatttagcataaataatacatttccactttgtttgaaagttcttgggttagttttttatgccttattttggcttattgggttttcgtgcctttataccttttttatttcttttctcgataaaattctatttttaaaa

SEQ ID NO: 23239 - DNA, 996 bp, Heterodera glycines
cgcgagccttacgagtcgtgttttctgtatgaataattccaactctttttcgtcttcatttctcattaaggaccattggaataaacgaatattttgttcaacaaatgatcatatttcttcaattttacaaggtgtttttcatttaaaattgctttattttcatggtatttagggcccacggcatggatggctcgaaaacgcactttacgtgtgcctttattttgaaccgggtcatgatacgctgaacaaccaattcacgacgatgcgtcaaataatcgatcatttttttgccaatcgatgggtacgctgagggggcgcaatttattcggacaaaatgaaatcgcacatttcacagatccttcatttgcatgtcgattttcaaggtttccaacaaagaaaaagaccatttcctatttgtttgtttaatttattttaattttcagtcaatttgttccaaaaatgggggcgctttaaggctgccaatgcggcgatcgccagcacttgggacgcttctcgtgcgaatgccttcgccgaaatgcatttctccacaattcgaagtgccacttttcctacctccggattgctttctttggaaatgttcgacgattatgacaaaatgctaagggcaatgagcgaggcaatcaaatggcttatccttcaccttccaaaaggtcgtttcgtttataatcaaaaatctttatatatatgtataagttttcagatgaatttatgtcgagaaataaaagatttaatctttttgctattgctgaagattctggagaaattctaaccgttttgaaacagttgtcgcaatttgaatataaattccgaaaagtttttcaccctttttcactaaatgtcattttttaaagaaaaaattaaggcaataaccccattgaggaacaatcgtcaagattgtattaacgcacttcatgtacgaatttcggacaacttctcgcagattattgcctttttgcgcaactctttgtctgtcaa

SEQ ID NO: 23240 - DNA, 1509 bp, Heterodera glycines
acagtctgttggaaaataaattgcgagccgtcatccaagtgagagattttcgttttgccaatttgttattttttgcatttttcaggccgtccctcgggccgttttccatgaaatggccaaattaaacgactgtttcccaactgacacttcatccgtttccattgaaaaggcgcgaattcgtgaattttcggacttcaaaagacgaagcattttggctgatctcacctttaaaatatcgaaacttgcgctcggaatttcgaacacctgcattaaacagctcggtgacgtggaaattcagccgcgtgctctgttagccgatggactccgtcgtgaacttgatgtaacattctttcgatttgttatacctttttaattttaatttcaagattcggttaattcaaatttttgcctcggatgtccaaccaaatattctccgaactcttcaaaatcagtcgctgaaattgcaacaattccgaaaatcttttctgttcatctgtgaccatgtcggcattcgcgacggaatccgtatttggacggaacaactcaaaagcattttggaggagtcattaaatgataaaatattcaaaactgccgaggtttgctgctcccacaacagttatttttccccaagttgtttttcgtttagcgaacaacaatgaccacttccgtcgtttctttcataccgcagtcaaaattggtggtggaaaaactgctcgattttgcgctctccgccacagcgccacagttttgtcaatgtatgcctttttttatatgaattccacgttcagatcgaccaaatacaaccgaatggagtccatttggcgttccgctgatgggaaaacaatcaaattttacggcaacgttttcgcttctcttgatgtaattaatgccattaaattattgaaataaccaaaacattgtttcttcattctaagaattggttgctgtacggtttgaactcgatggtcgcaactctgttggccaaggatgtgtttgaattgcaacgaattgtcgcacgacttccctttgagcagcaccgttcgttgtccgcctcgccaacggcacttattgcccagctgacaacgaatgcggcagagtttacacagtccggtccgaatcgcgaactgttgttcgccctcgccaaattgggtcagcaattgctgttgttacgcaatctgcaaatgttcgtcaaagcggagaaacacagccaattgggcacactgcaaacagcggaacggacactccgaaggtcatccacgcatttggagtcaagggatcagggctaaattcgcaattaatgagatttgtctcaatgcagaaacccgtaatccgtcattacggatgtccaaaaacgctgtaatttacgtaatccataaatgcttgcaatcctgcaagaaatgatctatcgaagtgtaaaaagtcatttcgtaggaaggcactgtcgaaaattacctaaatttttctgataaaattctaaaaataaagggggattggatattatttatggtc

SEQ ID NO: 23241 - DNA, 1626 bp, Heterodera glycines
  misc_feature (152)..(153): n is a, c, g, or t
  misc_feature (155)..(158): n is a, c, g, or t
  misc_feature (160)..(160): n is a, c, g, or t
  misc_feature (1504)..(1504): n is a, c, g, or t
  misc_feature (1536)..(1536): n is a, c, g, or t
cccaatttggcttggtggaacagagaaatgtgagcacagaatggtcaatgtagctgaaaaggggaaacaaagaagacggcggccaaccatattaattggtttccgtataagtttgattttctcaatccgaaggaatcgaaaacggatttggnncnnnngngaatggtccggcagaggaaaatccacaaatttgtcatcgatctgtacagacagtttcgcttttggtcctttgtccttgctaattttgatttgtctccaaattgtcaattcgctttttccaccaaaatgcgtgtcaaccaaaacatcgaaacggtcggaaagcaatgccattttgagtccgagttgggcatggtcaaaagatggcagaatgtccatccacacgtcgccacaaatccaactgaaacatgaaaaaaataacatggaaaatgaaaattttataatttttaaaattcattaccgtcgattcattttggtggttcaattagcacgcttttccctttttccaattaattaatttgtgtgtcacaaaaggcaaaaaatttgttgttaacttaaaacagagagaacaattagaaaaaatgagagagcaaaaaatttgcttattttagagaaggtaaattgaaaacagcaatttctcattaaaaatttgaaattaccaaaaaattatatgtgcataatctttttgtgagaaagaggagaaaaaagggcagttttatatttttatattaaaacattagcgtatgtttgagtaccggtggtgaaaatgaaaatgccaataatttggcgagaaaaaaaaatgagaaaagctacataattgataattggttatttctagggctgctaattttatgtaaatacatttttttcctggattctccatagcctaattagtaggaaaaacactttcttttttgtgtttgcgaactgttgtgcctttgcacttgaccaaagaataaatatttatttattccaattttggtgaagacacaattaaataaagaagagaaatgggggcaggagtatcgattgagggagatgggcacatacaacaaataaatgagggaatgaacggatggtcaaagggacgggggtatttatggagggaacagcagagagagagtgggaggggaagagatagaaaggaattaaataatttaggcgggacaaatcagtacccttcccaacatctccccccttaaaaagagtctgtcctcatccatcggtccgttgatcagtgatcagtccatctcagctcggagtgtagcgttgaggaggacgtcgattgcgttgcgggcgatcgacacggacatggcctcgttcggcatttgcttcgtccgtctgttgtgcaggtgccgcttgttgatcagctggcagagctgcttcgttgggaccatccggcggtgccaacggaagaccaaaagcgtcgttgaaaatgttcaacgcttcgttgccatggtcatcatcatccgtatgacggggcgtcatttggtttgcatggaatcgngttggaagtgtcattcggaaactttacctcgntaatgactccctgacattggctgacgatcccagcgcgccatgattgcgattggcgatgacgaagcaaaactttatcgccaagaaaaattt

SEQ ID NO: 23242 - DNA, 1551 bp, Heterodera glycines
cccaatgtggcggaatttaagaaacgacccagcacgattacgaggtctcaaaaatagcgatagacttggcctgagagaaatcacttataaattgccttaaattttagttttgattgccttctacagaagcttttatcatgtgattgggaccaatgaggccatctcacaaatcatgcctaatttatacaatgtttggttcaacgagtacagtaatgttgctgacggtggtggcactttgtctgatcaaccgagcacctcccagcagccggactttgatcagtttgaggagtgctccgacgaggaatttcttgatgatccggaggtgccgagcacttcacatcagacgaaccctcatcagcgtcacccgccggcttgaggaaatcagtgccttgacaacattaatccatccatcgatcacaatcgactgatccaagtattcattggtgatcattaacgcagatcgttttgagccaatgaattttttacactgtatttttatgctcaatttaaattgcgagaattccgtcgggggcagtaatctttggggccaacacataaaaaatcaatgtatgaaaaaaaccggaaggaaacaaaatatttttaaaattatatttttattccaacaaatttgaaatttgtttttgacatttctttaaaaggtcaacattacaaattataataaatttaaatatttttcataaatttgctccaaaaaaaatttaaaaaacattttttaaataaaattccttaacaaaaaaatgcgtagaaaaagaaaatcaacgcaataaataacaaaaaaataatttctaaatatacttttattccaaaaatttatatttgagattattttccataattatttcataaatttatttatacaaacaaatttcaaaaaccttttaaatcacatttttattggtttttaattttattccccaaattttaatttttttaaatattttaaattagtcaatgaaatcgtttagcttaaagctaaaatattttaaaataattcacttttttcgacttggcattgtcccaatttgtcggctccattggacttgctctttttgatgaacaacaccaacaacaagacgaagaagatcaaaaggatgatgattgtaatggcacattggcaatgagcgagtgccaatttgaaacgcaaatgattgccatgtttgagcaatttgaacggtccaacaccgaaacgatgggacgcgcgacggcacgttagtgcccttctcgttttttgtttgatttgtcgggaggtacgtcgtacgtgccaccccctggggtcgtcgtccccgtcgatgcactccaaaacgtcgctgccgaaacatcatcaggacaaaacgtcgaaaaacgtcgccataaattaaaaaaaaattttttgaaaacctatataaattttattgaaacacatattttgccgaattccaaaaaaaaattgaattttttcttgaaactttcttaaaattttctagttttgacgagataacgaacaaatttgaaataataaaagtttgtcgcccgcccgaactttaaaaaaat

SEQ ID NO: 23243 - DNA, 1821 bp, Heterodera glycines
ccgtaactgctgcaccatccgtcatcaaagcattgccgattgacgaatctggcaaaattctctttccgatcgtcgaccaattcggtacggaattgggattagtcagtccctaatccggcatggaatactgtaactgctcaattcccacagggcgtccattgcccagcgacgcttccggtcactttgtcgatcagtcggacgagcaaattccacttgatcagtttggccaaccgcttggccctgacggacttccgttgatgaccaattcgcgtggcgaatacgtcgtgcacagttcgcccgccattcccacagcttcgattgggccaacaacggtgccaattgcgttgccatttccggcactttccgggcccggactaaaagcggaggcagaaaaggaggaggaggagacggaggagggaatgccacccacggacagcacgggaaggctggtgttgccggtgatcagcgcggacacgggacaactgatgccgcgcaacgaggagggacagttcgtcaatgcgcacggagaggtgagacaaaacataggcaacaatagaactgatcagatccgcagagttgaaccgggagagagggcaaagactgatcagactgaaaaaatattaagactggtagtagttgatcagacctgggataaaaatgctttactcactgggaggggatcagactgattaggcggatgccagaaaagggtcatgaatttgggaactaagctgaaatttgcaagaacggcttaatttcagaaaaagttatttgaaggtcaagactggtaaattatttctttgtaactaaaatggtaatttttcctgatcggacacgagacttaccaaaaacggtgcctgtgttcccagttccgttgctgatccgacaaaggtgacattggttaggagaagttccgcttttctcgactctcgagtcgtgaaattttttgcgtctcgttctgtctaatcacccttctttcccctgtttttttaggtgattccaaccgacgactttggtcgtccgtttgattggcatggcaaagtgctgccgcgcaacgagttgggccaattcgtgttccacgatgctgtccaatggccagacgaccatcaaacggcgccaccggaagtcggcgacgctgcgtccacggcacttttggcgcaacgcgagcagcaacaaatgctgcagcgacggcgcaaccaaaccgcgcattgttttgtcggtggttttgtcgaactgctgaatgtgttcgacacgagtgccaacgtgaaaatcctggattaccgcatgatgaaggaggcggtcaaggtcagcgggggaaatggagaagcggcggatcagcatgtgtagagagagagagagagagagagagagcggacagagtgacagacagtgaaggaaattcatgtctttttggtctctgatacagtaatcgtgataattatgatagtgatcaatcagagataaaggacacggatgctctggacaatgccaatccccgacgcaaacttcagctgattagcagcagaattttacatggattaaatctcaccaatgagggggaggggagctcacacatgggattctctgatcagcaattgcgataaaaatgataaaatcacttgaatttatccagtctctaatcacaattttattatttccgtttgcattttctacccctaacatttcatctcttcacacattgatagagtttcctcatggaccattttgaccttcgtcacgaccacggtgttcggatcggacttttgaaatacggcgttgtgaggggaggtgcccattacgctgggcgactacgacacggag

SEQ ID NO: 23244 - DNA, 2725 bp, Heterodera glycines
tacacaaacaaaattaaatgaaaaatcgggctgctggcggtagatgggaacaaaattgacgtaaaattcatgataatatatttgaataaatggaatgataataatgtgcgaagcattaagacattaattgatcaattaggggatgaaccgttattaaaaaaatcctattaatgatgcgcgttatttaaaaaataaaaacaactttactatcaaaaagctttttagcgatttccaaatatcttctctattagccttggaaatatcaaaaaaaaattttgtcaaacttctaaaaagttatggccaaaaatgtcgcaaaacgaggtttttactttttttaaacttaaaattcttttgcaggctaatagaaaacattggttgcttttgaacaaagttttaaatagtttttgttaggaagttttcattttgatgattttttaattatcgccaattatagtgattattaggcaccgagcaagtatttattgatcatcaaagtgactgatcggtgatgggcggacgaatggaagggaccgatcgccatttgactaaccgtatccattaagcatgcaactgtaatttgcactcgcgcaagtgtcgcttcaacgccgaactttaccgtctcagcggataccaaagcggtggcgtttgtttgaactgtcgccataacaccgcgggcagaaattgtcacgtgggcaattgaacatttggcactttgaccttcctaattgctctttctcccctcctacagtattgtcgctttggttattttcgtgatcagagcaaaccgatcactcatcggaaggcgtgcaaacgtaagaaaaaggaacacaacaaattaaggacaacgtttttttcagcctgtctttgccatccgatcggctcattgtcgcgcaattgcaaccaaacaagcggacaatgcatttgcaagccgggggtcgacggtaattgggcaaaggcaaagctaaggccgaaccaattcgattgtgccgggttcaggcccgacttgcaatcgatgtgccaagggcttccaacagtccctgtcgccggacaccccttgcgtccgtaagtcgccccttttgccttttgcttcgccatttcaacgcgtctgtttcaggccctttccctcctcgcccgcccaattcactcgccaaatcaaccgaaccaaatggtaataaatgccaaattccgttgcatttgaacttgttcagcagatgaatgtgagaagtgccgtgcgtctccaagtcgtcttacccttaaaaaattctgtcggcgcgattacggtaatgtttctattttgttactgtcctttttcatcaattattttaaaattcaaattcagccctgaaattacaactcatcagccgtgaattggtggaggggtgggccaaatttcgggcccaactcctcgacgagccgatcaaagatgagctggggactcttctcggcgcggagatgggccgcggcactgaaatcagcctttggctgcccaatcgaaatttaatttgcaaatgcccacggctgaaagtcggccgcaaataccttctgatgggtcagtcgcttttgaaagtgccaaagcaaacggaaaaggcggaacaaaaagtgccaacttttccattgccttttgcctttcacttttggcactttttcctttccttccaataatttcgcatttctctttctattggctgttctttgctttgctgttttcctaatttgccaatttcagctcgtcacggctcatttaaatctgatggcaaaggcattgtgaaagaattgggcgttgaatttggcggaaaaggtgaaaaatctttggcgaagccttcgtctgcgattgtttttgatcggcacgtggtgatgatggaatgggccgatgaagtggcggaaagggcaacgcgattcgcacagaaacggcactttatggagaaatgccaacggatgagagcaaaggaagagcaaacggaaaatagagacggaacagagacagaacaaacaagaccagaagagaaaaatgatcacaaaatggccaaatagagggggggggggggggggggtgatcaaagaaacaatggcaaatgggagacacggactcttttttgagcatttgccaatgaaatgactccgattcgccccctttcccaattaaataatgagtcatcgtcccttccaaatcatatcgaaactatagaccggacaactgggttcggagggagcctgattggggatcccgactgaatcacgatcaatcccgaagattttggaataacgatcgggacgtatcccgaggtcgggatcccgagaaaattccgcgggatcccaatcccgtccggtctctaatcgaaacgctgacctcctcgattttccaacattagagctttagttgcccattatcagttgatatttttgtttttcattccattacaagactttgctttgcttgccacaacaaatgatcatcataaattgtcattagccagatttactaaataaacgcaatgctttgctaaacccttaaattccaaaaagtacttgaaatgctcggtccgttgttactagaactactgtatcgtgttactcaaaattcttttatagcttctatttccacccctctctctctctctctttctcaccgcctcgctctctcccccccccccctctctcttcccccttacaaagttaaaaaatttaagaaattgttaattttatttaaaaaacttcctttgatgtt

SEQ ID NO: 23245 - DNA, 1142 bp, Heterodera glycines
  misc_feature (153)..(153): n is a, c, g, or t
  misc_feature (158)..(158): n is a, c, g, or t
  misc_feature (186)..(186): n is a, c, g, or t
tccgtccctccctcccgtcggggattgtgccgactttgccttatcccccaccctccgccggcggggcaccaaggttcactaataagcttcaaaatggatagggctcggagcggggaaaaagcttaaaacacctccccccccccaacctccaanccacncccttgggggaaggaggaacaacggtgncacacacattggcacacgtgccaccctcgcggtaaaatgttatggcaccaccaccatgggaggcgatgctgctggcacccccagccatatatcaatctgattatccccatactcttgctaataaatttgttgtagtaaaactgattaagcctcccgccaccgggcatttttgccggcgggaaaaaaatgcacaggcattccaaaagtaatatcattagcaaacagcagccaaaggccgttgacttttttgaataaaagcgattttaaaagggggagggttgctatttgagcttgttttaagaatttttttagtttttaaccaaagcaaaggctatctcttagaatggcttaaaaggtcctcagagtatgagataaaaaaatttctcgaaatttttaaaattttccattttcttcctaacaactttatcgtattttttttaaaaaagcacattttccttacgaagaaataaaaaatttattgtaaaaatgtctttgcattaaacagcctaagagttttaaacaaaaattgtttttgtcgctttaagacataaatattagaaattgtaccattgcgtttcaaaagctttctcaaattgaatgaaaatgcacaataatacttggatatacagaagctgcctaattgcattcaaattgtttcaattgtttaaagagagtttaattttctggtgcttttactcacttttcagggccccacttggccgctctcttttggccacacttttcaactttctcaccaacccaaacagcggtggtggtggtggtggtggatggcccataattaaggccaaaagattatgcagatatgcgtgaccgacgaggggggcccaaatgtttccccccccccataactcccgccgacattggctaaaccgtttgacacttaaggctttggcaaaagccttcctccctcccaccaataatgaactaagcctgat

SEQ ID NO: 23246 - DNA, 1121 bp, Heterodera glycines
  misc_feature (1100)..(1100): n is a, c, g, or t
acacttctttattccttaatgggagcaccttggcaccctcccccccccccccccccgggggctaaagggaggtcattaacgtgttggcgggcacagattaatgaatgtaatccccaccccgctcaaccctgaatcacaaacacacaaccaccgccagggctaaggtggattatgcagatgcacaggacgaaataaataatccacagttgaccctaccaacaccaacttattcatggttttaatttggtaatgtatcgtaactgagataagccaaagttacagtacataattcatagtgaagagatacacgaataaaaaagaaaattacttaatgcaaatatttttcatagtctaaaattttttttggctctcccatcgtcgtccttcttctcgccctctagggtaaggtaatattttagagaaattttgagtcaacccataaaaccctcggtttggcaattttgaaaacaatctgattttcttatgtctaaaacctctcccgccccagtagagggtaatattttcgaaaaatgggtcatcctcatctcgaaccataggctagcacttctctttttttttgaaaataacattttgagtcacccaccctcttttcgcctctaagcctctcaagcctagctaaaagcccacaaatatcgtattcattgtcaatgaatggcactgctctaattcggaggagaggttcgattaaatgccaatacataaatgtgtgaatgtgggcgtcgaggttgttgatatgatatgcctgcttttccccaagtgcggtggtgtgggggtaagtaaagccgagagagtttcgagttgggagggggcgggaagcaaccccagactaatttgccataaataacacctgcccattttggacttttggcacagaatgggcttcattaattcatctactgcaatgggcagctaattaaatgattaattaagaagggaaatgggataatttcacaatatatttcctaatcccatcaaggaaagttgtgtctgtctgctgatgggcaaatgaatgtgcggtacggcacggcacgaaatatacatacagcaagaaaaaaaaggtggttgctaatatgtacaanatgatgaacccagtctctgac

SEQ ID NO: 23247 - DNA, 1095 bp, Heterodera glycines
  misc_feature (25)..(25): n is a, c, g, or t
  misc_feature (146)..(146): n is a, c, g, or t
  misc_feature (1074)..(1074): n is a, c, g, or t
  misc_feature (1090)..(1090): n is a, c, g, or t
atggtggacataggtgggaccagcnaacaaagtaaacggctccaaaatgatgtggaaaactcctgctgaaactgctgctggtgtcgacgcgaaaaaattggcgttgaaaaacacattttttgatgtgaaaattggtaatccaaatntaagcgaatttctaaaacaaataattagtcaaattaatttgttaaataattagtcaaattaatttgtttgacacaaaatgatgatgaatatgaatgcctatcaatgtttgtccaatgacaaatcttaaaattgcattatggcatcatgaaaaataattttgcattattaagcgattaagtcacctctaattggggcgcgtaataataaacaaatataaatgaaagaaataattatgtgtgggtttttcgagaaataacaattacgtacatcttatatataataataaagaatgaacttatttttataaaaatgttttacatacttttagaaagagtgggctcaccggcgatgccaataagcgccaacgaaaaattttgagaatttttgccaagaaaaatttttgcaattgtttataattttaaaaattagagcggttggagtgccagattccgctccggtgcttttcactgtaaacaagcgagcttaaatactgttttggctttatgagtcattctatctaacacctgctcgggtggagtggttaccgtaatccacaaatatacttataataccggaccactcgcaaaattaaagccaatgaatttaaaacccaaaaaagagtttaagtcgtttagggatcattaagataatgaggggagggggattaagatggaaaaaatgggaggagcagccgttgatgccttttaagtcatcaatttccgcgaaaactcaaactgtgagagttcattcatttgcgtcacaaaatcataagggggctgttgggcgcacggcgatttaaaaatgaacatttggcattatgtttttatgcactcacccgccaacggcattttttattatttacctcttcgcgcggaggctaataagttatttattaaaattaaataatgtgggtaaccaaatttgctntatgatgggcggaagnagaga

SEQ ID NO: 23248 - DNA, 1125 bp, Heterodera glycines
  misc_feature (34)..(34): n is a, c, g, or t
ctgttctcctctttttctctgttctcctttcacntcatgcaatttttttcctttccgtttctgtcttttcagctctttttctctaccattctcgataaggttttcactatcccttttctatcctctctctctctctctcactctctatctctctcctttctctcttctctctctatctatctcctctctatgtttatctctctctctctcttatctctctccgctaactgtactatttctctatttcctctattattactctgcctccgcttccgccctcacttatgtatgccactttaagccagggctggcggtgacggggcggggattagcgacgtccgccggtggccaaaggcaaaagattgcctaaggcaaaaggaaggcacaaaatagggcacggcttgaaaaatattaaattaaaagatataattttttaaaattcgattctgatcacagatcaacttttcatgcgcattgctccatactctatctctctctctctccttgccccttgctctctctctctctctccccatctctctccttgctctaactgtcatgccatcattgatcattccatccacagcattctctcccctttttctctaaccgtctaacaacacccctatttttgttgcccaaatcataagtgactgtctgacctcacctcctaattaccctgctggtgtccatgacaactcttgtcactctctgctgctggtggtggtgatcaacaattttattctctcaccgacttgccgccttgctatttcgccaatagcaaatgtctctttctctgctgcacacgccatcctccagcataaatcaacaaatgtgaacatacactaattgcatgttattagtagtcactaatgatgataataatgtaataaatatatatccccaccattaccaatccccaacctcaacaaaagtttccgtccaaccgccgatcacaaatcccctaaatccaccacaattctcattgtcagcaacagcaggttgtgtgtgtttgttgttcgtgacaatttttatcttttatttttatcactcaatttttgcatgttatttcttgccctttttctctgacacttcctctgtccgctctctttctctcttctcctc

SEQ ID NO: 23249 - DNA, 951 bp, Heterodera glycines
ccgtgactgatgataaatcatcaaatgttgacgattcttccgtgactgatgataaatcttcaaaatgttgacgattcttccgtgactgatgataaatcatcaaatgttgacgactgttccgtgactgatgataaaccttcagatgttgacgactcttccgtgactgatgataaaccttcagatgttgacaattcttccgtgactgatgataaatcatcaaatgttgacgactgttccgtgactgatgataaatcatcaaatgttgacgactgttccgtgactgatgataaatcatcaaatgttgacgattcttccgtgactgatgataaatcttcaaatgttgacgattcttccgtgactgatgataaatcatcaaatgttgacgactgttcagtgactgatgataaatcatcaaatgttgacgactgttccgtgactgatgataaaccttcagatgttgacgactcttccgtgactgatgataaaccttcagatgttgacaattcttccgtgactgatgataaatcatcaaatgttgacgactcttccgtgactgatgataaatcttcagatgttgacgactcttccgtgactgatgataaatcatcaaatgttgacgactcttccgtgactgatgataaatcttcagatgttgacgactcttccgtgactgatgataaatcttcagatgttgacgactcttccgtgactgatgataaatcatcaaatgttgacgactgttcagtgactgatgataaatcatcaaatgttgacgactgttccgtgactgatgataaatcatcaaatgttgacgactgttccgtgactgatgataaatcatcaaatgttgacgactgttccgtgactgatgataaatcatcaaatgttgacgattcttccgtgactgatgataaatcatcaaatgttgacgattcttccgtgactgatgat

SEQ ID NO: 23250 - DNA, 1468 bp, Heterodera glycines
  misc_feature (6)..(6): n is a, c, g, or t
ctctcncatcgagtgccacccaccttcaaatgcctcgggacgaagcagagaatgtgcgtcaagcggctaaaaagcaccgaattaggaaactgtacaatacagtacatcaaattgtcatttggcaatgcaatagaattttttaattgcctatcctaaaaattcgataatttttgcaaatacaaaaaaacacccaaaaatgttgtcaagtattttttggcttttttttggaaattcagcaaatttagttttcagtaacagcattccaaacagatttttcttgaattttagatatttttcaattttttcccaccttaatgtacaggtcaggcactgttgttgctgctgctttacgcctctgaacattctccgcactcatcaactgttcatgctcaacaccagcaacattgaaccttattacaatacattagcaaagcaacatttggtttgttcgtaagttttaaatgttaaaaataggtttcataaataatttaaaaaattgtttttttttgagttcctataggaaagtgaccagcagaaaaaaggggaccatcactttgtgaagttgggaaaaatcagtaaaaaaaaagtaagaaatcaaaagtacagtagcaaattaaaaaaaaaatcaaagaataaaaatcagccaaaatcttaaacttttttggaataatcaatggggaaacattcgaataaatccaaaataacatgataaaacatgtgttgttaaacccatctaacaatcagcactttttctgatcacttttggcgcataggcaaaacaaaaaaaaaaggcatcgaattcaaataacaaattgatatagaaaattcagtcactttttttttaccacgcaatttcgggcccaagccctgtcggattttggtacattgcatgacaagtggcggacaaattcttggccatttccatgtgcagtgatggcatgccatggtgatggccaagtgctaatgtgccagccagaaaacagaccaaatgatcctgggcgagggcacaaaacaatgtaataataaacatattaattattttaaacaaaaaagctaactcgcccagtgagactcgaatttttctaaccatttttggggagaatttgacatcaacggccaaaagttcgccaacaaaatgcaacgcgtttggcattgaatggcgccaaagacgcgtgtgcatggaatcaattgcatttttgtagtcatcgatcaacctgtggcaaatttaacaataaaaaaatgtttgattgttaattatgatagatttttcagcgggtgtccccccgggtgcactacgtttccctcccgcatcgtttccccccccgagaaaatttttaaaaaaaaaatgttaacttagaaatttttcaagaaaaaaatcttagaaagtttttttacaagaaaattctaagaaaaaaaaatttttgagaaatttttatggtgaattactaagatttttcaaaaaaatttc

SEQ ID NO: 23251 - DNA, 3497 bp, Heterodera glycines
tgacgccattatctttgagtattgcaatgaaaatgtgaaaaccgacgacaacaagccgagctgcctttactttttcctctccgacgacgatgaccaagtcagtctcgagtgcttcaagttgtttaaggctcggcctcggttgtccgccaaatttttgatcaaacaaatgaattgggcggaaagcgttcagtggcttaataagcaaaacggaaagtgcaaaagggtggagccgggaatcgtcatgaaaagaagcggcaaaatggaggacatggacctgagcaccgcattgcaaacacttttcggaaaggaataagcgaaacgaatgggacgagaagcatcggaaattaacatggggggaccaccgcactagtgatgctcgagactaaaaatttctcgagactcgagaccgagacttggccctgaaaccgaaaaacccgagaccgagacctaaaaaacccgagccttttctcgcgtcgagacttgagaccaagacttgattccgagaccgaaaaacccgagacttttctctagtcgagacttgactccaagactcgagacccaaaaaacccaagacctttctcgagtcgagatttgagatcgagacttgactccgagacgatacttgatcccgagaccgaaaaacccgagaccgagacttgactccgagactcgagacccaaaaaacccgagacctttctcgaatcgagatttgagatcgagacttgactccgagaccgatacttgatcacgagaccgaaaaaacccgagacttttctctagtcgagacttgactccaagactcgagacccaaaaaacccgagacctttctcgagtcgagatttgagatcgagacttgactccgagacgatacttgatcccgagaccgaaaaacccgagacccgagaccgagacttgactccaagactcgagacccaaaaaacccgagacctttctcgagtcgagatttgagatcgagacttgactccgagacgatacttgatcccgagaccgaaaaacccgagacccgagaccgagacttgactccgagactcgagacccaaaaaacccgagacctttctcgaatcgagatttgagatcgagacttgactccgagaccgatacttgatcacgagaccgaaaaacccgagacccgaaacaaaaaacctgagaatttccccgagtcaggaccgagacctcgaggatccctagaacgccaataggggaggcagggaaaaggggctcaccacccggaaaaaaatttttgaaattgaaaaactttatttcctttgaattttttttccctagggggataggggtatttgaagtccctttttcccgggggagaccccttcccccccccctgttccccccgggggcgggaaataatttttgtttttcccaataaacgggccccattgaaaggggggaaaaaaagggggaatcaaaatctttgtgaaaggaaaaaaggaggggggaaaaatgtgggtttaaaatactttttttttttttttttcccaaaagggaggggggggggaaaggggggccaccccggttttttggccccaaatttccaaatttgagggggggaaaaaaaaaaaaaaattttccccaaaaacaaatttttttttctccccctttctcccccccccctctcccccccaaaaaagagaaggggcccccccggggaaaaaaaaagggtcaaaaaagaggaagaaaaaaaaatttttttttttaaaaaaaaaaaaaaaaaggggggggaaaaattttttttttttttttcccccacaaaaaaaaaaaaaaaaaaagaccaccccccaacattaattttttgttttttttttttttttttttttttttttttttttttgttgtttttttttttaaaaaaaaaaaaaaaaaaaaaaaaaaaaaaaaaaaaaaaaaaaaaaaaaattctttttttttttttttttgagaaaaatttgtaaaaaaattttttttgaaattttttggggagaaaaaaaaaaatttttttcaaaattttttttctccccctctcccccttattttatattttttttgtttatttttttttctcacccccggggggaattttggggataaaaatattttttaaaaaaaaaaacaaaataattttttttcccctccccttttagtacaaaaaaaatgaattttttaaattttgccgttttttttttttatttttttttcccatccggttgccaaaattttttgttcaaaaaatttggttgggtttttgccgggattcatttttataaaataataaaaagttttttaaaataggaaaaaccccaaattcattttataatttttgaataaaacgatttttataaaatgattattttatattatatgaaatttattcacaaataattttttttctcaatatcattgaatcaattttttactagaataaataataatgcaagaatatcaaaatctcgggagcatttttggctaaataatgtgatacacattgaatttaaaatgaaaaagagacccttccaaatgggtgaaaatttaatcatttttaccccaaaaaattctaaaaaatctttgttcttaattgaactgttctgcagaacaaaagttcatcaaaaaaaaaaagaatttttcaataagttacctgtcgagccttattttcaaaacacgcgttttggcaatgcgccaaaagggaggaacaaaaagtgccacaaatccaactggttctgccagtgctaccggacatggaattcttcgaaatgggagaacagcactctaatattgaaggctggattgatcgcttcaattttgcgatcgactgtgcagctctgacccttccggacgatttaaagatgaaattgctaatgaggaaattgtctagcatgagtgcctccgcgcagtgaagcatgacgacgaagaatttggaatgttcatcaaccggcagaaaaaggcttttacgagacttcaattttaagaaattgaacgaagagcaatttaattgcttggtcctttggatttaattaaaagcgccgaacgaaagcattctacggtcaagaattttggcaaagttgccggcagatggcgatcaaatcaaatatgacaatgtcgtcgaagatttgaaagtttattgttatttttttatctttatatttacaaaaaaaataataataaaggttttcatatgaatttccaaaataaacacacatagaaattgaagacatgccaatttgtaagagtttgactacgatttccaataattcctaagacagaaaaagagcaatcacagaaaaaaaaagagcagcagaaaaatttaaagaaaaatgattccaaaaatcactttattggaattgatgcaaatttctttctccatctgatcagtgtttgagacccaattcccaatttcttggcaattttttcatcacttatttttggattcatttctttgattttggtatattgcttcacctttctcaatttatcctcattggaatatt

SEQ ID NO: 23252 - DNA, 1404 bp, Heterodera glycines
  misc_feature (1229)..(1229): n is a, c, g, or t
  misc_feature (1267)..(1267): n is a, c, g, or t
cccccccccccccccctccctttcatctgacccctctaccgcgattcgctccccgcatattttgatcagataagattgttcaattgcgtttttttaattttcgtttgttgcgaaatttttgtgcggggcgcaccaaaaatggtgccatccgcgctccaaggtcaaaatagtttttatgttcacaatctgtcaatcaaagttcttgggcgagaaaatttaaagcgctgcggagatgcaaaaatatttgcggtcactttaccgcagtttttatacacgggaactgtcaatcatataaagaagggaacgccgaagcgacttcatttcaattccatttcggttgaggcggggggtcggggccattctttgcctctcggggcgcttgcccacaaatattcaaatttttccatcaatcatctttatctgccaccgcggcacggcagcacggcatggcagtgggtggagtcagcagccgcaccatccgcaagtttacttcatttgccactttcgtccgctttcaattttgtcagcagcagaaccatccccaatttcaattctcattgtttgtcagtttcgaccactttccattgccaacatgtcttttattgcccccggcactttcgcgttcctttcaaaagactatggggaattttcgactgggcattttgacccaaacagagcatacgacccaaattcgcttgcagaactttcgtaatggcatttattttgcttccattatctttcattttttctttgtagtcaatggagaaaagagtttctggacggccgatacggatccaaacaaccaacccctccttccaccccgcgtgccccatcgcccagcttcccaatcccggtcattgttggtaattttgaatttgttttttggattttgcaaatatctatcttgacaggaaatcgtccacaggatgaaaattgtttggtttttccacaaatatcttgtctgattttttccattttagggcggcagatgttcccaaatgacgatggatacgaatcggaagatgatgaaattctcttgccacctccgccgatccccccgcaacttggccaccctccgccaaatgtgccggtaatttcggtctcgcttttcgttgctttttctcaaatttccgagtgcttttttcaggcagttcgagttcagccaatgcatgttgggcagcagcggctgccgctgagagtcctgccgcaaattttccaccctccaccanatgtgccgggtaattttgggtctttctttcgattgctntttctcaattcccgagtgcttttttcaggccgttcgtgtccaatcaatgcagcaacccgtaccaatgagagccgtgccacaattcctcaccttccgcaaaatgctcggtatcttgagcctcgtttttcgggtgtttt

SEQ ID NO: 23253 - DNA, 866 bp, Heterodera glycines
gaatccgctaataatccgtccttggatttgcctactattaacccgtggccaaaaggaatttaacgcattttgccttatgtccttgagcatcggcctttgtctactctcctcgtccttggcatatttgccaattaattattaccccccccccccatcaaaaattgcttttttcccccgccataaaacgcacttccaacagtcggttcacccacacttcatcagcaatcacttgctgaagctgttcagaggaggcgcgcaagaagtttacgtactgttggccaagctgggcactgttgttggccccggcggcggtgccgcctccggccgatgcctgctgagaaattgatggtggtggtgaaatttttcatataaacgctaggattaccggatttgaatcatgtctcccggattgataacctcgggatccggtcctgccccttctttccaaaaagccgggaccgggatccgggaaagtcccgggtgggagtccggtcccgtccggattctattggcatacaaaacgagctttgctatctttttaaaatttttccgccccagggggtacttttgagaattgtttattcgggaagcctcagtttatttatgtataaaagagaaggttagttagatttttaaaacatttctatcccaaaatttttttaagactgaaaacccaacccccgcgttgaaatggtggaattgtgccgtggacggtcggtgttgggacgagagttgagtgccggcgccgccgccgcctccggcgatgttgccaagcatattgctggactgttcgcccaccaaattcctcatcttgttgaacagtgtgttcggctttgtcgatgccattgacagaagtgcaccgattg

SEQ ID NO: 23254 - DNA, 926 bp, Heterodera glycines
  misc_feature (895)..(895): n is a, c, g, or t
taacctggtcaggcccctgatcgctaagtgatcgcgcaaatctttctcaggggtcctctgatcattacgcttaggtttcaatgtgcataaagataattaatataactcacttgcgcacttcccatttctcgcggcaaaaatttttctcaatcgattggctgatcgaatgctccatcaaatctgtgagtgatcagaaaataatcatgctagcatatcattgattacatatattttaaaaaaacagtaggaaaactttaccaatgtagcggacaaccatcggagaaaattggctgatcaatttgctgtggaaaatgcccatccgcaagttttctgcgtattaaaaaaaagtatggcataaaattttgtacagacaattaaatattcaagagtctcttgactcgagaattcgcggattgattggacaatttttattcccattggtctcgacaggaattctcggtctcgatttctgggacgaattcagttccataattcaaaatatcaagctataatcctgggtcaagtaaactccaactcaatttttttgttcgaaagcaaattcccatgatctcgagcctggtctcggccactccgatcacttacgatcaatgcacaggtagtcgttgagcagttgaaacaacgggaatgagtcccacgagtcgggcggttgcagctccaacgcggcgtccaaatccacggaatagagggaccaaaaaatttcggagtgatcggcaagcaaatcggaaaaccaggcaaatgcctaaaatggcagggaaaaataagaaaatggcaaaaataggcggagaattaaaaaaatgatgcgcaaaatggcaaaaaaatgtgctcaagtgatcaagttcatttgatcaaagggaaagacaattattgatcagangtaatagcagaatttcaaatttgactgatca

SEQ ID NO: 23255 - DNA, 1058 bp, Heterodera glycines
aaaaattttgaagaggctctgcggacgggattagcatcggggttacgagatagaatattgtcctaaaaagagatagccatttttctgagaattaattcacaatttccgcagctcttgcggtaatggaaaaaattttgaagaggctctgcggaacggattagcatcggggttacgagatagaatattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaatattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaatattgtcctaaaaagagatagccatttttctgagaattaattcacaatttccgcagctcttgcggtaatggaaaaaattttgaagaggctctgcggaacggattagcatcggggttacgagatagaatatagtcctaaaaagagatagccatttttctgagaattaattcacaatttccgcagctcttgcggtaatggaaaaattttgaagaggctctgcggaacggattagcatcggggt

SEQ ID NO: 23256 - DNA, 1913 bp, Heterodera glycines
  misc_feature (43)..(43): n is a, c, g, or t
  misc_feature (48)..(48): n is a, c, g, or t
  misc_feature (50)..(50): n is a, c, g, or t
  misc_feature (62)..(63): n is a, c, g, or t
  misc_feature (65)..(65): n is a, c, g, or t
  misc_feature (104)..(104): n is a, c, g, or t
  misc_feature (118)..(119): n is a, c, g, or t
  misc_feature (142)..(142): n is a, c, g, or t
ttgattttatttcaaattgattttttaaaaagggataataatnatttnanttagcataaatnnanccaaaaatatatagaaattaatgtgcaccgtcgtgtccngaaccttcccctcnncctcagaatgatcctcagaatcnccatttacgaagggtttctgaggccttaacaatgttcaaagtaaatctgattgcagatctgttatcaggatcctaaaatacccttaaagacatatttttggaagatttttgtgaacaaattttccactcaaaaaaccatgtcaaccccctaaagtcccgtattccatttgaagtaatgattatactcggattgaaaatccaaaaatgccaaaatatgcactaaaatatgccaaaaaatgtatggatttaaatagacacaaaaaatggcagaaattttgtcaaaattcgaaattcgccatataaccatttatatgaactaaaaattttcactgaaaaaagagaatttttttggtatgaaaattaagggagggattcttggaaagcaatgatctgctaatgatagggggatatttaagattaaactacaaatgagcccttaatgcttgataataattggacacaaaacattgccagcgtaacacttacacctattaatttacaaattcaaaaagcggaaaattgtttgcctacatgaatttagcgtgacaatttaatgagtttatatttcgaaaatgccactggtacttaatttataaatgcataggatgaaaaatattagtcataaaaattgaatatggataattctttttttttttttggctttttggcaattacaaatcagataaaaccaaaaatacgactaaaaatgctcttccaaaatttcaaaaaaagctttttaaaaaataatttcaattaagaaattttcaaaaaagattataaagttaaaaaattatatttaaaaaagaaaaagtttaaaatttaattttgtttaaaatttgtaaattttaaacacattaattgttttaaaataaaaaattatcacaaaaaaactaaaaaaatttaaattcaaatattttaaatttctttgttttaaaaaataggctcattattcaaattattccatgattaaatcaaaaaactggaatattactttagtttcaaatattcaaatattttctacgacttttttttaatatcattccttcattttgtacaaacaaaataaatcccacattgacgcctgaatcccgaatctagatagccgaaactcgaaattttttttgtctcgactaaaaaagttttttattttacatacccaaatctcgagctttttctcgtcctgcggaaaccctgctgtgaatgttagattttgttgaacaaaaaaaattggctcttgaaagtttttcaaagaagttctcttattttaatccaaaattctttttttattctgtcacgcatttttcaaaaaaaaaatccgattccatgctttatttgtgccggatttaaaccaaaaaatttgatcacctgactttctggacttcttggaagactttcgcttcgctgaagacgaatattggacaagaagagtaacgcatataaaaatttccgaaaacgaaaaaattccgttccatgaaacaattttaagttctatcctcgtggggttttgtttaaaatataacaaaattcatttttgtatatttgtcttattcaacttaaatgagatttaaatgtagaaaattgaaacgaatttatgtatttaaatgaaactgaaaattttcaaaatcagcattttagaaattttattccaaatgaagaaaaagcattaaaaagattttttgcgaagcgtttttttcaaaactttttgggaacaagaggccggcggcgccggtaggtaccgctgagaaaaatttttcaaaatttgattgcagct

SEQ ID NO: 23257 - DNA, 1088 bp, Heterodera glycines
ctttttaaacaggccaaaaagtttagtcttaactttttttttcagaaactgatcagaagcgcaccaaactttgcagggaaactccccggtaaaggactaacttacactgaaatgagcgccgagctagctgggtttaaaaattttttcgaaaatcagagtctttcgtttttatttaattatttattattttttgcaaaattaattcataattattttttcagaaagtgctctgaaacgcaccaaattttatttacaagctattttaggcactctgatgctttttctatcaaaaagggagatgaataaattttaaaaaatttttaattcctctttaaacaggccaaaaagtttaggcttaactttttagtgaaaattaatttactcatttttcgagtagtgatcagaagtgcaccaggttttgcaggagcctaaaaaggtcaaggaaaggcgtctctgcgttgatttagcagtagtacctatgaatttaaatttcctatgaatttttaaaggttcacaatttatttattttttgcaaaattaattcataattattttttcagaaagtgctcttaaacgcaccaaattctatttacatgttaaataaggctctctgatgctttttctatcaaaaaggaagatgaataaaattttttaaaatttttaattcctctttaaacaggccaaaaagtttaggcttaactttttagtgaaaattaatttactcatttttcgagtagtgctcagaagcgcaccaggttttgcagggtaacagctgagaataatgcttattcatataattatttaactgtcccataatgtttctttaaaaattttagacattgcaattttgcgtacttttccaattttttgcaaaattaattcataattatttttttcagaaagtgctcttaaacgcacctaattttatttacatgttaacaaggtcctcttaggcttatattatgaataaggctaaagaataaaaaattttttaaatttttccttatattttggttatttcgttcaactttcggtggggtgcttggaaaagtggaaacatgcgtacccgtccgatctgacaagttaag

SEQ ID NO: 23258 - DNA, 1427 bp, Heterodera glycines
  misc_feature (47)..(47): n is a, c, g, or t
  misc_feature (91)..(91): n is a, c, g, or t
gagtgagtacctcggtgcaggaaaattataaaattttaaaaattttntaattgctttttaaatatgccaaaaaatgtaggcttaacttttntagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccagactttgcagggatactgaaaggaagagaatatagccgtattttaaatgcgttggattttgctccccataattgtttgagtaaaacggacacgaaaaaatcgatttttttgttttcggggcagtccccccgaaccgatgcgcccagatttatggggagaccgaatccttcgggaatagcttccctatagtctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtcccctaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatgcgcacccgtccgatct

SEQ ID NO: 23259 - DNA, 1488 bp, Heterodera glycines
ggattagcaaattcttctttaatactcctttgtctttaagggggaggggtccgcgccgtttgttccgatttgctgccgccaattgccaatttgccgccccaagaatttgcaccaaaattactccgcaagtttatctcaaactcaaacttgggtaattaaacccatacataagaaatgtgtgagaaatacaaaggggggaaattgtgacaatggggacaaaatgcgaggggaaatgcaaagggaaaaatggcacaattggggggcacatgaatgtgacgtaaatgcagcatgccgttgtccagtaggagacgagcagccgaagtttgtccatgaaccattcttcggtgaggccaatcactccgttcgggagagctcccagtgtgagcgcacgcgccgttttgtgctccttctccttcgacttccattgatccaaacgcagccattcatccaagtgcgcgaatagcccttcgcctgtttcgttgtcgatcgtacatcgatgaaaaactagcggcgtgatttccaacaacgatttgtctccagaggcttcgcggatctcagagatgctgctggagtcgattttctggatcgtagcggtgcgtgtgtcgattttgatccaattgttctggctcagctgcagataatggtagcggaaatttccacaatctgcgaatggtgatgacgctgtgaggatgtgaagctccggatccaggaatgcgttgagcgtcttcttctcaatgcggatttggaccggaatgtagcggtagcaattgttgactgcctgatagtccacattttgcattgaaaactcagcgcacgagaagatttgcatcgtgtcttcgtttagccacctggccataacatccttgcgtcgtaaaagtcgtctggcctgaatggtcggatttcctcctctggaacttctgcggcattccttggaaaaaagctgcgcgattgatcggcttgtggcgagttgtcctgcagttaattgtactgcgagttgctcctcctggatggctctttttcccaatccacgatcggtgacgatcttcaggtactcctcctccaggattctaaacgattggttccgacgagcgaagtgcttttccgctgcatgttggtttcatcttcctctccttcccttaccatctactgattatggtatcctccggcacggtatggaacgcaatttttcagtccattcctgaaatcgaattattacaattttttatgggaaatataccgtattaatcaccggcagctcgtaaaatgtttttttaataagtcagaattttttttccacaaaattagaatgattttttttttctagaaaaagctaaaaaataattttgctaatttctctattgaaaatttaaaaaaagttaggacaagacgtcaattggtatgaatttccatgctattattcaggcccggtgcgggtaaaattggtattttatgaaattttttagggtaaatctgaaaaatagggacatt

SEQ ID NO: 23260 - DNA, 2389 bp, Heterodera glycines
ctttatgcataaaaattacaaaagtgaatcattcatcaattttgcccttttgttatgaaatttctggtttagacaggaaaagatgtgttactgtgccgtgaattagcagatgaagcaaaggggacaacatttgggcttaaaatccagagaaaagtcaattgtgcaattttttcgggatttacctatagaattaaagaataaaactgacaacttattaactgaaaattataggtgaatcacaagaaaattcaacactcgggcttaaaatccggagaaaagtcaattggtgcaatgttttcgggatttacctatagaattaaagaataaaactgacatggagcagaatttaaatttacatgtacaactaactttggtaccgcattggcaaatgtaaaatgccatagtcagaattttcaaataccctgtgacacaaaagggaaccaacagtaaattcagctttcctttaatcaaccgagtgtaaaagaaaaatgtgaagttatatgtccagatggaaaaagtgaaataacaattgaagccactctgaattatgtgagccaacaagacaaaataattaacccatcgaataacaaaaaggaaacacccgtacttggaacttccctcgaacaattttccgatatatttaatttcatatatacattaatcaaaacaaatctttttaattttttaactatactttttactttgattgtgatgataacatttataatttgtatatgtccaatgatttacccacttctttttaaatactttcctttccgtcgcgggaatgtcgcgactacgcgaaataggatttttaatttaaaaaataaaaacaaaaaacatttaaattaattttaaattagacagataaatattaattaattaaatgtgaacaaaatgaaggaatgagagaagggaaaaacactagtcatattagtcacaattttttctatccgaaaaattatcaaatgttaaaatttaattatgaataattggaacgttaaaagaaataacagattttaaacaaatgttaaaatgagacaaaatgtgaatgatattaaagaaattgtaaaatgttagaaaatcggaaaaggctaaaatggcacaaactggaaaatgagaaaaggttagtaaaattggcaaatgttagggacagaaatttggacatgccaggttggcaaacacattttcaagcagaagttgccggtataaaaggagggcgctaaccccccaccaatcagtacaccaacggtttcctgagaggcattgcctcgtcctcctttccctcccttccctttccccccgtgccggcaactgctccgcctgcccgttcgtgccgccgactgttgtgccgaaccgtgcgccgcccgttcagtgccatgcccgatccgtgcgccgcccgttcagtgccaagccgacccgtgcgccgaccgttctgtgccatgcccattccgtgccgccgccccgcaccactgatgccgtgccgtgtcgccgacgtttgtgccggatgccccatctttccccgacttgtgccgtcccccatttgtgccgtcccccattttgtgccgtcccccattttcccccattgtgccgtcccaatttctgtgccgtcccccattttcccccattgtgccgtccccatttctgtgccgtcccccatttgtgccgtcccccattttgtgccgtcccccattttccccccattgtgccgtctccatttctgtgccgtcccccattttgtgccgttcccccatttcccccttcggtttaattacccaagtttgaggatttcaataaagtgcaaattgttacactttcccgcctcacttgacccccagcaatttcgccatccccgattgaccatcaagcgtccaccccaaaatttcgccacaaccattccctctcctggtcaccattgcgccagcggcccacaccccgccgactcgcactactcgtccacaactcaaatcccagcaccaccaagcagcgccggccctctaccaaccattgaactcatcagcacccccacatctcgccaaattcctacccctcccatttgtgcgccatcgaaagcgtacaagtggtgccacgacccgggaacaattgcacgcccgcctctaccggaccacaacaactgacccttcgaaagcacgtcgccacttttctgaaaaacaccggccgctcaaccattcaccaccggactccatttgaaagtaaacacggtcacaaacccaaaaaactcacaaaaaagggtcaccaagctcaagactcgaaattaagggataatatccccacaattcaaaaaaacacacacacaacacacaaacaaatcacaattcagtgagaaaggaacgcccaccgcatcccgcgcaaagaggaaaaaccaaaa

SEQ ID NO: 23261 - DNA, 1159 bp, Heterodera glycines
ctcttttctctctccctttcttttccactcttttctctctccctgtcttttccccttcttttccgtcgtcttttctctctccctttcttttcccactcttttctctctccctttcttttccccctcttttccgtcctcttttctctctccctttcttttccccctcttttctctctccctttcttttccccctcttttctctctccctttcttttccccctcgttttcctctctctccccctcttttcccccttcttccccccctttttctttttctccccttcatcaatttgtttcttcgtccattcgcttctttctttgctcctttcccatcgcttttcaaatggcaaagattttatgctcgataatggtcggactttccatttgttgccaaataacattatcaacttcctcttttccccatttgtgcacatttatttgaatggtcaaagggaaacacaaaatgatcaaattgtttttaaaatttttataaaatatttaattaattaattgttttattgttgaattggcccatggattggcaattgtgatgggaaaaggaggatgtttttatctttggagaagacaaacaaatgggggaagggacggacagaggggggagcggggcaattagcaaaacggcgatcgatgccaatgatgagcgactgactatcaatcaattaacattaattaataattaattaattaaacaaacaaacaaacattaatgatgtgttgttttatcattaacaccacgatttccgttaccatttataaataatactttaaacacatgttttaattgaataaagttacgaaaattgctgaatttaaggtcagttaagaattttaaaattaaaaagacgaacaaaaaaacaaagaggaaaaggaatagaagaagaataagagaaggaggaaaaggaatagaagaagaataagagaaggaggaggaggaagagaagaaagagaaggagaaggaggaaaaggaagagaagaagaataagagaaggaggaaaaggaatagaagaagaataagagaaggaggaaaaggaatagaagaagaataagagaaggaggaggaggaagagaagaaagagaaggagaaggaggaaaaggaagagaagaagaataagagaaggaggaggaggaagagaagaaa

SEQ ID NO: 23262 - DNA, 1094 bp, Heterodera glycines
tgcagtggcaagcacagcgagtcgcttatatgcacaccctttgacacgtaaaatattccaaaaaaaagagatagtgattttttctggattaggccggagaaatataaattaccagctatttgaaatgcagtgggcaagcacagcgagtcgcttaaatgcacaccctttgagacgtaaaatattccaaaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgatatgcagtgggcaagcacagcgagtcgcttagatgcacaccctttgacacgtaagatattctcaaaaaagagatagtgatttttttctggatta

SEQ ID NO: 23263 - DNA, 1195 bp, Heterodera glycines
  misc_feature (1189)..(1189): n is a, c, g, or t
acaattagcactttctcaaatgtttcaccgtttcttctcttgttactcatcaaaattgatctgaatgtttctgttatctgaaaatgagcatgattcatacatatcggagtaaaaaagctttataattcattggaaaattaaacagtattttttgttaatatttttactatttttatgtacctacattggcattcccgttgttcaattaaattttctgatcagtcaaaaatagatctcgccaatcgaccggcgagtccatttccgcactttcttttcactttgtatttgtcggttcttttttcccgaagtcattcatcaatcactttcaattgccattggcccttttagctctgagaaaatcaatccgaaaataattgcactgataaaatcaattgtaaattattgggatcaaatattttgaaaagtgtcgtccaattcgtcggtttagcatttgtcgctttccaatttggcttctttgtccactgatcattgtccccttttgccagtgttttgttgtgaaatgtttcgtgccgatgccatcaccaatttcgagcgatggctccaccagcaacgcgcagcagacgacggaggacagcggcagcagcagtttttgtggtccaaaatcgaattgcgaccggtggaggacgacgacggcgaggcgatgggttacggcatttttgcacgggaggacattcggctggacgaaacggcgataaaagtgaaacgaatggaaatggcatttgcattcagtcggattgcgttttggaactcaaaaaaaactatataaaatggccaattttgaggttcccgaacggatgatgataacggcggggagagtggcggacattggggaatatgccgagatgatggaaaggtgggggggggggaagagaagagaggatgtgggaagtattgaaaaagaaatatcaatttaaataaatttaaaaaatgaggaggggaagggaaagaaatgcgaaaatacattaaaaattagagatcggaattttgcgaaaatacggataagtatcagtattacgtacttgacaccgatacggattaagtacttacggactaaaaatacggaaaatccgtagtccgtaaaaatccgtatcggccgaaaaaaatacgtattacggactacggatccgtaaaagtacgtatacggatccggtccgtatccgatctctanttaaaa

SEQ ID NO: 23264 - DNA, 1094 bp, Heterodera glycines
ttggaaaatgagaatggcattcccaattgatcatttttatgcagtgcgttgctatgtttgaccataaacacttcacgcccattatctggttcgtgccgaccaacacttttgtgcccgctgggcgtcaactttttgtgtgttacggtgcgcatgacaacgcccgacttggggtggaatatggctttacaataaaggtggggggacagtaattatggccaactaattaagctaattaattgcagaatgagtccaaccctttcaaccgcgtcgcattgccccgtggtcagtgtttccgcattctcttttttaagtgttctgtttattttggaccttttcattgccctcgccgaacgcagcggaaaacgcgtgagcgaaaagcgaagggaagtgctgagaaaggctaatctttcctggtgattcaccgattaattagcctcgggtgatcagttgttctgataatttagcacaatttatgccacggatgaaaagccgagcttttcgttgcgaaaaagctgcgcaattcttttgttggaacgcgacaaattgtgcgtttttccttaggcgaattgatcaattaatttattggatttaaatttaattaggcaaaattggagccaatacatttttggagacaacaattgtgagggcaatgatggggaaaatgatggtcaacaattggcggatggaagcgaatcattgcgcgaaacgcaactcttggcctccattttgggccatttgcaaaatgcgcttgaggggcgaatggcaaattgcgtggatgccgaaggggaaaacgtagcgaaatggcaaattggggagaaggaggaagaagaaaaggggcacgaagaggaagcgaaaatggtggcatcgttgtgggaggaacaagtcgaaattgtgcgcggaatggcacggcatttgacgcccattttggacggatggagcaaaagcggggggactgatcagaacacaagtgacggatcagcaacaggccaattctgacagattttagacatttctttttgtttgccttaacttttccccgtttatacaattgttaatggttgttttttctttttcgactctcagaatattcatcg

SEQ ID NO: 23265 - DNA, 1889 bp, Heterodera glycines
  misc_feature (1807)..(1807): n is a, c, g, or t
catcgaacataagggtgggcgcaaaatgaatgccgtattttaggggaaaatgtgccaaaatccgtccgcctaagggtgtccactcacgcgggcaccgaaacgaccatcacattcctcggcttcggcaaggcaaacgcgggccaatacacatgtgtggcagagaaccaatacggcaaagcggagcagaatctgttgatcgaggcagcatgtaaatggaaattggaaaaggaaattccaaattcatttgaatttagcacggccaaagtttgtccaagggttggccaaccgggaatgcccctccgatcgtccgctgaggctcgacgttcggatagagggcaacccggcgccggaagtcaaatggctgaaggtgcgctaattgacactaatgactggtcaatggccgagcaatttgacaggactggcgccctctggtcgagtcgtcgcgagtgcacattgtgcacgagccgggccttgacctccggtcgctgctcatcgaccagccgatttggagcgattccggcatttattcgtaagtgctaattgggccatgaattaatcactaatgggcaaaagagcattcattagttggattaaattgggtttacgaagcacttgaatcttgttttgttttttggcatcaattctgagcgttttcagttgccttgcaatgaatgacgctggccaagcggtcacttcgtgcacaattaccatcgaaggtaatggcaaaatgtcaaatgtaaaattattggccaatttcagccgccgaaacggatttcatgacagacataaagcttcgggcgttgaagaaaagcataaaaatggaacggggcccactacgcgacatttacgacattcaggaggccgaggtggaggagtactcggccagcgaagcgacctctgttcagaacggaagctaaaccaattaattggccattatttggaaccatttaatttggaagaaaattaaatttaatttgggggaaatattttcggtaaatactttaaaattcgattgattaatttgttggttcacaattttatttgccgaatcagcgcaagttttccggcactttttccgtggctcaaatttctgtccaaatagcaaatgttcccccgccgcccaccgcccccacacatttctttgctatttttcatagcattattttggaatccctcctccacttggatagatagcagctgttcccctccccccttccgaatcgaatatccccggaggggatatatccgctttgatgagattgatccatttcgaccatcattttagatcaagctcggtggaaagcttttcgtttagtttcctgaaaatagcattcatttttggcaccgtttcaatgtgtgcctttttcatcaaagaaaatgcaattgacaattattacataattaattatctcattttctctcctctctctctcttccccatctttctttctctggcgattccttgttgtgttttatgtattgttatcgccgtcaattggtattgtttattgattgattttttgatccattttcaattgattttttctccattgtcctgatcggacttgactgcccaccgatcgaaattcaaccactcccatttttcgttgtctccgtcccatggttttgcgccaaataaactcactcaaataaagagcatttatttcattttttattaataaaataataataatttttaaatgaatagattaatgaattttcttaaattaaattaatttttttctgtaaagtcctttttaaatttaattgggtaaaatgtccgatgctttcgccgccggcgaagaanatgcaaagggcggtggcctttttgcggttaatggcacggcaaatgcaaatcgcaagtcgccgtccgtctcgcgaggcgattc

SEQ ID NO: 23266 - DNA, 1154 bp, Heterodera glycines
gggggggggcaaagggagaaaagggaagggaaaggacacccccggggagacaccccccgggggcgtatcaatgggccatttttacaccccaacaaaacgctttttgcattagcagcagcaacggcagatggtcagcaagggatgggtggtgttgagctttgtcctctccgtttatttgtgcatttaatggagagcatcgagaaaaaatgcacttttctattttttaattgtccgtttgttttttgcccactaatatatgtaagatttgatcacaaaatgaatgtgacagaaatgggcaccgattgtgccgatttcgaatgtgccatcattatgccattagtttccaaaactcgacacaattcaaatggaaaaagcattgtgtaagttcataaaaatgtaatggctgaaaattggagtcacatgaaatgcaattattgaagccattcccgtggcttttacaaaatcattaattaattttaaaaaacggacgaaatttttgggacattcgcgcattgttgacacattaagcagaacaaagcaaaagctaacagacagaagcagcagaagagcaacttggtgaagatgcacttgcacaaatgggaggagacaatgggcaaacaaagaaagaaaagaaggaaaaattggggggaggaggggaaaagcgagggatttggggctttccggtggcccatcaaatccaacgacgaaccaccataaaatcaatgctttgggtatttttggcgtaaatcttcaaaaaaaaagtctcaattgcggttgatcaaaatttggcccaatgattgtcacgcgctctttgagtccgatcaaagtgtaaaataattttaaatcaaaattggttatatcacaatgcttttccttccattttcagtgccgatcgttctttcatcgattcgcttcttccgcctccgtccccgcgccgttcgcctttgccatcgacctgcggcgccccgcccggctctggtagcaccgccgcgcggttgggcgcttcgcaatgcacgcgcgaggcgcaagtgcaagtttttgtgagccaatatttaaacttatttcttgcatattttattttgggggatgtcgtcggtaaaggcttctcgagagacgcgccccgagaaaagcctttggtctcgtttcttcaaaaa

SEQ ID NO: 23267 - DNA, 1790 bp, Heterodera glycines
ttcttcccgcccattcttctttgatgataaaacgccaactctactaaaatttaaaattttcaatttaataatgaaatttttgtttatacctaaattctaattttagcatttaattttaagccttcaagccgaataaaatcttttttcttcgatggatcaacaggagaaaaggtaaactttcaatgtgtggtaatttattcaaattaataaaaacaaattttttaaatttagttccggatggtttgcaaatgttgaaatgggtccaccggatgtggttgtttttttgcatttttttactagtcaaacaatcaaaaatatagattttgggcgtaactgaagcatttaaacgcgatgacaacccgaaaaaggttaaccttggagtaggcgcatacagagatgaccaggtaattttaaaataataatgttcgtgagattttattattattttttaaatattcattttctgtttagggaatgccttttgttctgccgagcgtaaaacaagccgaaaaagaattactcgaagcaaacctcgacaaagtaagtgataggacagtcaaattaatcttgatgcacttataaaatggagcagttcattctaggaatatgctggcattgccggtttgccggacttcaccgccaaggccattgaattggcgctcggaagagattctgaagttttgaaagcgaaacgaaacgcgacggttcagtcggtgtccggcacgggagcattgagaacgggcgccgaatttctcgttggtttttaagattttacccaatttttattgcctaaatagtgtaaaatgcactaacgctgatcataaatttgacaaatgcattttagtccaaatggtttccgcacaacaaagttgtttatcagccgacgcccacttggggcaaccatgtgcccgtgttcaagtgcacatcaaagcaaattaattgccaagtccaaatattcttgtcgtttaggtttgctggctttgaaatccaaaagtaccgctattacgacccgaagacttgtggctttgatgagaatggctgcttggaagacattctgaacatcccggcgaagtccgtcattttgttccacgcgtgcgcccacaatccgacgggcgttgacccgacagtgcgtttttatatgaaatttatttgattttttcatcattcctcatttttaactaacttatcacaatccggaatgacaaagaaacccctaattagccagagcaatggacaaaaatttcggatgcatgcaaaagccgcgatttgtacgtctttttcgacatggcctaccaagggtttgccactggcgacgtcgatggggacgcacacgcattgcgctatttcgttcaacaagggcacaacatttgtctagcgcaatctttcgccaaaaacatgggtctttacggtgcgaattattgtttttatacaattattgtatatcagaaatttggttttacgaattcaatcaattaatcatacctgtttttatacaataattttgtttttgttccaacaaaccctatatatgtttttttatataactctaaagccataaatgtaagtctgaataaggtaattaattgtacgagaaagaagagaatgctaacatttaaccaaagttacaaaacggtaaataatcaacgctttctcaattatcatattttttggcattgcaaaaaataaaaataaattatttttattaattttaggtgagcgtgtcggtgcgtacaccgtcgtctgtaaggaccaggaagaagcaacccgagtgatgtctcaactgaaatttt

SEQ ID NO: 23268 - DNA, 3161 bp, Heterodera glycines
tttcgttttaatgaatataactcgaaatctccgctgggctggaggaccccgtcccgcttttgcgagacccaacccattaaacgcgcatttcgcttttcggcattctcaagaagaatgggcgtcggttttttctgcgaaccccagaaaaacctttgccacctgtacacaaaacactaaaattttaatgacttccagcaatttttaatttgattgtccattttaatttttatcattttctacaaaatattataaaatcatagccaaatctctaaaaataactttctggcaccgtatgcctttttatgactgatcattttaaaacaaaaccacagtacactatttaactttaaatcgatgccaaccaaaataaatgtccataattcaaaataatatttcaatatccatttgctaacctaattataataagtgtattcagttgatcacaacacagagtctcagcatcagcaattccatacgtctcatcctcctttcttctctcccctcaattgttcagcccttcttgtcaaagtacgcctgcgagccctttcgggtccggcttaatggtgtcggtgccgggctgccagttggccgggcacacctcgccatgcttgtccgtgtattggaacgcttgcacgagacgaagcgtcttgaaaatgcgtgatgcgatttagaatttgtgtaaattttagtttcaaaaattattatgaaaccaaacgcttttcttcagttagagggggggggggggggggaattgcgtaagagaacggtgggataaaaatgcacgtgcttttagccctggttgtggtaaaccgttcattaatgcctcgttttataattggtggacaaccagtcctagacaagaaaaagtgattgaagagcctgtccgtccgaaggaggaagacctttttttctcttcggaatcaaaaaaaaatttttttcccaatttttttttaatgaaagcaacaatggagaaaatagcttttttgagcattcaaattaaaaaaacaaaacaaaaacaattgcctcgtcaaccgagcgaccaacaggcaaatcgttgatggtgatctgacgaagaacgcccttgtcatcgatgatgaacaatccgctggaaaaggcaggaaattaatgaagagacagacgaccccagtcctcctctcattgtcagagtttctctgtgtttatgcggaaaaacaattttgagaattttccatggattcacgcacaaatttgacgcccattccaatgcctactggagccgaattggatatttaaaaaaaaacagagtcaattgataaaactttagtctcgcgtttgttcagatgactataataatatgttatggatcggatcccccgggccggagtttacggaatgttaataatccgtaataccgcatctgttgaaaatttcgggttgatcccgcaaatccaaaccggaaaaaaaaaattgaatttcaatcccgcaaaatttgaaagttgcgttagggttactactctttaccctaaaaaattttatgaaaaggggagggaggaagggggcccgttttgataaatatttgaaaaaatttatggaaaattcttataccatccggccccccccccctcccgttaaaaaatgaatattttcgaaacgagattgccgttaaaagcattgaattagtcgagcagcacagaccgataagcaatgcccgcctcctccatcagcacgccgtagtcacggctgattttgtggctggtgtccgccagcaccgggatgttcatctcgccaagtcctccctgctttcgcggcttgttgatccattcaagatggctgaatggatatgggaagatttagtgaaaaattcgtgcaaaattttaaaaatttatccgtttcctaacaatttccagggaaggaatcgaactcgagcaaactcccaaaaaccacactccctccctgcattgggtatatcagtgtaaatttaatcccgttagttccggtccacatgccgggaagtttgggtcgggaatggaccccgggaatccgtttcggaaacgggtccaatgattgtccatgcccatacataccaaaatttagagtcggtagaacacgcgatgagttggacaccgatctttttgaactctcccgccttgtccgaaaaggcaattatttcggttgggcaaacgaaagtgctaaatgggagaaattatagtaaaagagtgaatccatcaaatgcactgttgccaagtaggcttatttctctaagatttgtactgatttcaaaatttctgacaaattttttttttaaaaaaaggactcaaaaccgcaaaaaattgcgttttttccctgtcgcctacaatctttttttgaaaaaataaggcaaaaataaagcgctaccggcaaaaaaaaaggacgttcgtctgggcgaatttatgggattagggtaaaatttcagatttcggagcctttgtgcccatttaaaaacttggcaacattgagcatattatcatccaacgctgttgccccgtacaaatcgagtgggtagaagaacagcaccacatattgccctttgaactgttccagcgaaattgggtttgaaagtcgccgttcacaacggcgtccgccatgaaatttggcgccggcttaccaatgaaagctttcgagctggatgacattttgtcggattcaataaataaaggcactgcttaattgtaaaattttaaaggtggaaagaattggtttttaatgcaaattttggtacttttcggttttggggcctagatttgaatttttttcaaataaaaaaggacacgcaaagttgcaaacttatgtgccaaaattatattgtgagcataaatgtcagccaaaattacattgtgggcataaatgtcacaatttaagctgatctttgttgtttaaacaaaaaaaaatcaaatctaggcccaaccgaaaagtaccaaaattttttgaattttctttcctttggaactacatatcaatttatgggaattaatctgatgaggattttatcctcagtttgtggtttttggaggagtaaatgaggattccttttgaaaatgcgatatttttcgagaaatgattacctgctttttgaaaaactcacaaattttctgatttagtttgaataagtgtaaaccttagtatgagaattaaaaaaaatatat

SEQ ID NO: 23269 - DNA, 1968 bp, Heterodera glycines
tagccctaaaattttaacttttacgacaatttttctttaccctccatataatcatcgtatcttttttgtgccatctctctggtgtaaaaaatgtcgtcccagtaaagcgggtcacccttttcgccccatcggctgctgctgctactgcttggcgtggtgtccggcgcggacactttttcgcccggcggtgcagcgaattcactctgaacaaaagaccaaaaatttaaaaattgctcaaattatttgatgtatgtggtccctctaattgcttaaaaaattctaaaaaaaaaaaaaaaattgttttaccaaatttcaaaaattaaaacgacagcaaaaggattgattgactgctgctgggtggagaggtgggttcgatttccgtgggtattctaacatttagtcaggtttgggtagaaaaatgttgcccgggaattttgaaaaaagaggcaaaaaagttagaattcttgaaacagcgccaattaatcctagaccctgccagttctacaacgacggtaatttcgaattgactcgtaaaaatccgtaatcgcttcaaaaaattgcttttgtctgtccatatggggtccttaaatctcagtactttatccacagtaatgttcggcacattacaacggcatcggttccacgggttgaatggcgagcagcactgcagcacttcgcgaatttgcagcaaaatttctcgggtcgcctcacagtcatcggccaacaaatcgcatatgttcggagcggtctgtgcaaaatgcaaaaaaaaaaaaataataattacttacaaattagtggtaaaaaatagagaccgggtgggaccgagactgcacggctgcgggatattttttgggcaatgcgcgaaatttgggactccgcggcaatttttgaccaattaaaaaaatattttgaaaagtaaaaacaatcatagctaggagggacctgatttttagtggcaaaaaatcccaaaataattaactaaatgttcacaaaaaacccaccccccccattcagtccatcgcaaattttgtgtacaccgggctttaaaaaaattttaaaaactttaaaaatggtttaaaaaattggaaaaattttaataaatgcgcgatccgcggtccgaggcaattaaatgtgcggtgcgcgggatttttctgtgtgcggctccaccccagccacccgtcccctatttcaggtatgctgtctggagtccggtcccggatctcgtcccggttcattttccgaatcccggcgcttaaaactagttccaattttttggaatggcatttattacacaattctttttgttgttgttgttgttgttgatcaattcaccttattaggattgctttcatagggtagcaaattcgttttgcgagtgatccgttgcgagaacattggccatggggtttggaagaaaattcgcaattcttctgcgggcggaacaaaatgaagttgttttgtgcggtgttgtcctcttccgtctttgtttggtgatgatgatggttcagaggcaattgaaggcaaaattgtgccaattgttttgctctttaattgcattatttatgaattaattaatttaaaaagataattattagggatctttttttatgtaaatacatatttttttcctagattctccatgctctaaatagtaggaaaaacactttcttttttgggtttgcgaacaaaagttgggactttaatttacatatttttacaaatttcgggggttttctacatattacatatgtacatatttttatacatattttggactttttcgcattttttcgtacatattttacattttttgataatttttaagggattttttattaaatgtccccaaaaaatatcccaaaatttcgcaattttttcaaaaattttgagaattaatagaaattttttgtgaaaataaaaaaattttttttttgaaaatgggccccaaaaaagttttttttttcaaaa

SEQ ID NO: 23270 - DNA, 2293 bp, Heterodera glycines
ttcgctctaattggcgctgtacactcggtcccttccaatcggtcaacgatcacgaccaaacagcacatcacaaacacacgaattatttaaaaaattattgtatcgctgacccattcgttggaagggagtaccgtacctctgctattgcttgtcctaccgtaccccgtgcactgtgtctgtcccttactttttctaggatccttttttagacactttctttctgtttcgtttatattttttatctctccccctcccttcttagtctttgtgcgatcgtaataataaaatgcgatggaatgactgaccgaacattttgctgatttgtgaatgtttctgtctcagtcgtctgtccctctccacctttctctatctctttatttctctctccccttttttctgtatctatctatctctctctctctctttctcctctctctttctctctctctatctgtctgtctcttctctctcctctctctttctctccctctctctccccccctctctctctctctctctctcccttctctcttttcgctttctctcttccccctcccctctctcttcctctctatctctctctctctttctcctctctctttttctctccttctctgtctgtctcttctctctccttctctctctctcccctttctctctctcttccatttgctttcactttcaatttcaagacattcttttccctcttaaaatattacacaatttgcagatgggtttaatgaatgaatggggaaaggacagtgatatttttatttatcaatttattttattttgattatttatgcgtttctctgccgttcgcttcgtgcaaaacaaaaaacgctttggatgttttacttattccaccgccctccaattctttgtttccaattgctccatccatcatccttatttctgttcatctgacaaatcattcatttggatcggtccggtggcatttcgtacaaaataaacattttattaaaaattaaaataaaaattgtttttaacattttttgttcgatgaaggcttcagaatgttttaggttttaaggctcattagctcagttatcatttacgaaaaatacgaaaaaattgtacaaaatgacatcgattattctttcaccatccatttgtcatcaaagaccaaactttttgttgcaaaccgtatcaaaaagtcgagaatacgtcgagacgggggaaaggtctaattcaaaatccatagaaaggacacagtccaatcccgctgcccaattctaaatcctgggacagctgatttcccggtcccaacaacaccttcgattattaatcccacttgaatttaactgtgtgattttttaatacccttttatatttcattataaaattccatttttcttaattagtcttaaaaccattaaaactcattaatcggttcacctttcctgctcagaattcgtttggagtccattcgcgaaaggaaagcatttgaagcagtttcggcatccatttcccctgcagcgatgtccccagtgccggtcaattcgcccaccacgccgacaacaataaacggaggaattactcatccgatgccaatgtcaccggtggcagcagtgggggcagaaaaggcacgggaggagcgggcgggggcaaaagcgatggaaaatcatcagccgatggggggataaatagggctggcccggacggtaaaagggataattcaaggacagcctaagcgtaattttagcttaggtcggcgtactggagtcccgcaccgatttatggatttaaggagagttaccataaaacacataagcacccagccatttttaagaatctttttggagagggattattttggaatgacttaattttcccaaaaagtcattttaatttttaaaagacttatttaggacgggcatttattttaggaatttgttaatttaaaagtgaggttcatttggattattaaaacctaaatgggcttggttggttggtttctttttggcataccttttgtaataaaaagttttaaaaatatatttcctataaaaattattcagacatccatttaaccaattctcatcccttaatttgaattcaaacaagaacagaagtataacaattttaattttcaaatttattcattctcagtgcctttattttgcagacaaccttttttatatcaaataaaacaacttatataattttttatttgatttttgacgatcgataactgagccctattaaaagtggacttttcagtacctaagttttttttacatgaaaatggcaaatgcgccttaatttgcat

SEQ ID NO: 23271 - DNA, 2126 bp, Heterodera glycines
  misc_feature (13)..(13): n is a, c, g, or t
  misc_feature (32)..(32): n is a, c, g, or t
  misc_feature (48)..(48): n is a, c, g, or t
atttttgcgattntaataatttgccctaattntggtttgttttcagtntactgactgtccctggtcgaacccgagagcagaaaggtgtgaattgaattcaaattcaattatggaacaacaaattaataaaaggtgccaccactggactggctaattggtcaaattatcaaagcaatcaaacagaagttgaacattccgataatcgctaacggcaatattcaggtagcaacggtatttctagtgcattttcaaattgattttatcggtaaatcaaccttttctgtttttcaatattcgggcttcgtccaaatcttatttgaaatgttgttgggttttcctcggcagatgcccggtgatgttgaacgatgccttgccgagactggaattgatgccgtaatgagtgccgaaggggtgctcaacaacccacaccttttcgatggcaaaaatccattttcatttgaggtaaactattcctccgaattaattgtaaagtgcatataatttattttttggttgcacgcgaatatttggagtttgccgaccgttacaaaacggggacaagcgcagttcgtgcccacctttttcacatttgtcattacaggtgttttcgtcgaattatttttacaaattattttgctaattaatataaatttcagttttctgaaatacgacgacttgcgagaacggaatgcgattatttgttcgcttagcgaattttctgagaacattgagaaattgcgcaaaaggttttagtcttttgtttaatttcaatttaaatttgaccgtttcaatttgaggtgtcagctcgaagttctcaccaatgcaaatcattccaacgacatttgttggtccgcttccgtgcagcagtgttgtcccaacttcgaatcactccaacaaatggtttttaattgagtccaattatttctcgttgctttttttagtccatcattttcaggttctgtccactccccacttcttctgcaagccctatgttcgtcaaatgttaaaatgcgctgcggaagcctcggaaaatggagacgatgtgccaaatttgcccgtctctgtcagtgcgtatcgcgagaagcggcgggcggagatcgaaaggttggcaaaagaggcgggcgtatcgaagaggcaaattcggaagagagagaagcggaagagggggcagacaaaggagcagaaccgaaaacagacgtacccaaagtgtgaacggtgagtggaacagattgcacagtccgtgttcaaatggtttgggttttccggttttgaatcacttcggtttcaattcccaacagcctccggttctaccccaattgacaattcccaaaataaagtgttaacggcgaacactgcacttatcgaaaaacaaaaacagatgccagcagccggccggtgtgaactgtcactggacaatgtgtcgacgctgttgcaaatggacatgcgcaaagcaatggaaggaccgggagggcgaaggaattgggcagcggacggcgcaagatgagaaatactgcaaaggtgggcactacttcccccttcccgtcgttccctccccccgcatcgtttcaccttgagaaattaaaataaaattattaacttagaaatttttcaagaaaaaaacatagaaatccaagaaagaaggattttcgaagaattacagcggttttttggaaaaatttttgaaatcggcaattcactataatttttttcgaaaaatttttcttgggattctcttataaaaaaatttctgattttttttgaaaatttctaacttttcgtcccgagggtaaatgagattccatttctcttttctcggtcacagttcacggttttacgcccaaaatgatggccgaaaaatggaaacgcacaacaacgccgccaaatgcttctgatttgtgagtgatgcgaatggaacaaacggacagaaaacgaagtcgcaattgtcccagcagatcggaatttgaaatggacttcggaatttacaattttgtgccttggtttttattgtatataaaactctcgcatttgttaaattttgttcaaactccgccgtatttccaatataaacagacgcatttcaatgtttgtacttctcttgcgtttgtctatttttgcagagctttctc

SEQ ID NO: 23272 - DNA, 1768 bp, Heterodera glycines
ttcgcatattttagcttttcgcatttcgctttttatttttcaatttggcctatccctggtgtcgccgttttagcttttaatcgacggtgttttaagagaattcgttggtgcgcctccgcagttttgctttgaaagttatgaagtcagttgggttggttcttccccatacattaaaaaagcgggggtggccaaatggcgaaaaagccacgtaattgactacctaagttatacggcgtgattttaaaggcgacgaccggtgggagaaacctggccacaaattgccaattattgtgtcaaactacaagattttagggggatttatagtcccagtcgcgggaaaattcttgaaattcttaatgaattcgtaaaataattgtttacccaaaaaatttcctttatcctttccgtaattcaggtgcgccttttggatgagactggccttgaactccttttctccggcacaggtttcgcaacgaacgcccacaatttccattttttaaaatttgctttctgagatattattcctttctgctctttttttactttccctattttttgttagtccatgccgaagaaatgcatcgcaatggcagcatggcaattggacagttcaactttactggtctcgaagtctgttgttcacttgtcgttttgtgacttcttttcagtacgacaggatgtacatcccttccgtaattcccgttgaacgggcggttgacggccgctgtttgtgccctgtttttgggtccgacccttacgatgtgaaggcggtctgttcctgcgtagcggctgactggcgacccatcagaatgactcgtacgttgtttttagtgcaaattcattggtaactctcttctcatcctttcctccgtttaggccctgacgttgttaaactgtgcgctgactgtaagactaatcattcgcttggcttattgcctccaccgattgaatttacaaatccgacgacaaacagcaaaataagcataatgtggtgggcatttccatttccccattttattttcatttattaaagttgtttaggcctcttttcgtgctattcaatgcgcttttcctccttttgctatgcattttcatcatcggatatcttcgctttcgatctaacggccaaactctgagcaaaggccaatttcaagcagttcgcttcgtcccaccttcgcagaaagaacgtacggaccaaagcgaaggcaacgcggggcgtattgtcccccgctgtcttccttcgtcaacggcttcgtcactcgctgttcattccaattttgggcttggcacagtgtctaccgcttcactgacaacggaacctctcatttcggcttatgactctttcgaggcgccaatttgtgacgtttgtccgcagaatgtgctcattgtgtattctcacgacagcgacgcgcacgaacgcgcagtgattgcattggcagagtttttgcgcaatgttttccttttgaatgtttccgtgagtttttcgctgtattattttattcgtagtttttgtcttttgttagttggaccgatggaacttgaaaagaattgaacaaaacatggtcgattggctatcgtcctctgttgtttcggccgacaaagtgttggtggtcaattcggctggggctttggagcggtaccgtacgaaagcattttggggagcaagtcaaattgtggagaaaatagaatcggacttgttggatcgcatttttactgcacacattgaaaaggcacttcagtgagtctctgttttttggatatggtttga

SEQ ID NO: 23273 - DNA, 1280 bp, Heterodera glycines
  misc_feature (11)..(11): n is a, c, g, or t
  misc_feature (24)..(24): n is a, c, g, or t
ttcaggttttntgaaaaccaaatntggacaatcttgggtgtcattcaaaactcttgatgaggagaagctttctctagcaaatgttaagcaattttgagttgaaaaaaagatatgaggcttcaaaattttgttttttgagtaattcataaactaggtaacagataaaatcaaaaaattcggcactatgggtcaagcccagtgttagacaaaattgctcataacgccaaatagcgtaattggcgtaaatttttgcgcgctaattcaaaagttacactggtaaatgccttttttgtattttttatttcgatcttccataactcgcttcattcccaactaaactgaacaaatttggtatctaaaaaaagattttgaaaaggagaatctttttctaagcaaatgctaagcaatttaactcatatgaaaaaagttgtgggaatttcaaattttcattacgttataactcagctcattgactgctgattttaaccaaaatgcctaaaactaataatttttctattgatgttaaatgtcgaaagtgaatttgttcttttataaccaaaattatttgaattagcgaatttggtgttttttatgtgttagagacatgaaaatagtactccaaaaggagagaaaaagaaatgcaaatttttttcatcccatttttgtaatgttctaggccgaaattcttaaccaaatcactgaaattttgttaattttctttttctctatcgatgtgcaaaatttggtgtgaatttaacaagcagaaaaaaagttaaacagcatgaagtaaatgttgttttttacataattaaaatgaagagatagtacgccaaagaaagagaaattacaaagaaaaagagaaacgacgagatagtactaggcttttctctgcacagtggagttgacccatagtgaattcggtttttctctattaacagagataaagaaatagtacgccaaaatgagagatgtttttttctctgcattctctatttattggtacacttctcgttttttcggacggttacctatccaaaatttttgtttttgcctcccagcagaatcgaatgtgtataaaaagaatcgcctttccctccacttcacatttctccttctgtaccacactgcaaccaacgaaccacttcaatggccgaagaatattttttaatcgctgcggctgccttcggagcaggaattgtaatgctgcgctttcttcattttttttcaaaatgcaattcaaacatttttgtcccttttcagtactgttggaagacgtacct

SEQ ID NO: 23274 - DNA, 2075 bp, Heterodera glycines
actaataaatatatcttaataccttaccaatttttaatcaatttcttattttcacgttttcacctaatttctcacataactcatattaaaaacgttatggcttaaaacaaatgtagattcgtattcagcatccattttacccaagaaaaaatattttaaaaaattcaaggggtcacaaaacataaaagtacccagcttcgtgctcagcgcctcagattacgcctagaaataatctaccttaaattaaaaattcgggaccggaccaataacctccaccattaccaaatttgtgctcattaatttccaagaccatctaatttatcttcaaaaaataatcaaaatagcaaaactgggtgattttcttggtccacttctgttgaattcacaatttttggtgctgagtcgttatataaaaaccatcaaaaagggcgttatataaaaaacgatcaaatggaaaatttcaacctaaaactgtccataccttttgttaaagtcaacagaattaaacattcttggcatcatgcgatagccctaacatttatctattagctcatctaaatttcaaaaaatttggtcggtcaaggctgagcaaagttatggccaaaagtacacaagcaaccaggttttcaaaaaattttggccataattttttaaaacctaacgaaatttttttaaattttgcaggctaatagaggacacataggttatcgactaatagcaaaaataaaaaacaaaaataatttctaacagaaattttttaattaaacataaaattattttgatcatcaaaaattctgatcaaaacatcttagaaagaacaaaataaagtgattttgctatcattcgctagccctatgtgtcctctattaagctgcaaaattttgaaaaatttcgttaggtttcaaaaaagttatagctaaaaatgtttgaaaacccggtgccttgggtacttttggccataactttgctcaagcttgaccaattttttgaaatttaggtgagctaatagagaaatattagggctatggaatgatatgaataatatttaatttggtttgctacaaaagttatggacagttttaggttgaaaatttccatttgatggttttttatataaagccctttttgatggtttttatataacgaaatagcaccaatgagaagggcaactactcagttcgactttttagacttccgtcctcacagaagggaccatcattttgtctaaatggtccgacccgacgtatttcatccgcacccaaatgtacaccttcacggtgcgcaaccccgacgaaatcacccacggggccatcccttcggtgaagcggcaggggccctattcgtttgaccaaattcaaaagcggaaaatccaccaaattgtcaatggaactgtgcagttcgagacgctgcagtcctaccacttcaacgaggaggccagctgtgccgagtgctttttgtacaaccgaatttggatccccaatttggtctatcagaaatttgtggaggcggcctccaaaccggcgatgagagtgggttttgcccgttggcggttcatttgccgcttcgtctgcgctttgcttctatcccggcatttccccttcagcccgccctcgccgcagtggccatgcaaacgccctttttggaggtggaagtggccgagttgctctacgacggctacaaggacccctttctggaccaaatctgctctttgcccgtcgtaaactttgtctgtgaacaaattctccatttgccggaccgaatcggacttttctataaagtcagacatataattagcaaattttaattcaacgaataaataatttcagaaaaatgggacggcgaacggagttttcgttgtggaggacggacacaccgaaaacgcggagagtttgggcagaattttgtcgtggaaaggctccaaaagccttcccgactattggtgggaaggggaccaagcactgctaataaacggtgggaatgagaagcaatcgctacaatcactgggccattcgcctccttttgaggtacggacggaagaagggcccccgtatattaacaaaaggaacgcctccgcg

SEQ ID NO: 23275 - DNA, 1128 bp, Heterodera glycines
  misc_feature (90)..(90): n is a, c, g, or t
ttgaggagctttttgagcgtaattacgattttacttacaccattttttgctaggcttagatcacatgcgatttcggcactctgataattntagcgctcataatgggatgtataaaggcgattgtagaaggaattggatgcgctaaaattgtttgagaagcttttggaagcgtaaaattgtttgagaagcgatttttacttacaccatttttttctaggcgtagatcacatgcgattttcggcactctgataattttagcgctcataatgggatgtataaaggcgattgtagaaggaattggaagcgctaaaattgtttgagaagctttttgagcgtaattacgatttttacttacaccattttttgctaggcttagatcacatgcgattttcggcactctgataattttagcgctcataatgggatgtataaaggcgattgtagaaggaattggaagcgctaaaattgtttgagaagctttttgagcgtaattacgatttttacttacaccattttttgctaggcttagatcacatgcgattttcggcactctgataattttagcgttcataatgggatgtataaaggcgattgtagaaggaattggatgcgctaaaattgtttgagaagctttttgagcgtaattacgatttttacttacaccattttttgctaggcttagatcacatgcgattttcggcactctgataattttagcgctcataatgggatgtataaaggcgattgtagaaggaattggaagcgctaaaattgtttgagaagctttttgagcgtaattacgatttttacttacaccattttttgctaggcttagatcacatgcgattttcggcactctgataattttagcgctcataatgggatgtataaaggcgattgtagaaggaattggaagcgctaaaattgtttgagaagctttttgagcgtaattacgatttttacttacaccatttttttctaggcttagatcacatgcgattttcggcactctgataattttagcgctcataatgggatgtataaaggcgattgtagaaggaattggaagcgctaaaatgtttgagaagctttttgagcgaattacgatttttacttgcccattttttt

SEQ ID NO: 23276 - DNA, 1837 bp, Heterodera glycines
ctatttattcatccctttccgatctctttgaacatttttcctccttttgattgaatttcaaatttgtaatttacagatgcgcggtcatcctcggtcggatcggtgaacagaagcgatcgccggcgtccgattgacccataagcgtttgaatttgcggtcgattggtctgtggcacttttgctgcagaatttgtctgtccttcgcttcttttctatgagaaatcgaaatgttctcttcgcgccaaccttcgtttggttcctttgctcttccgttgcctttttccttctcatcgcttcctctccccgtcccttctccgtttcctcttgctcttatcaggcgaatatctcccttttctctttggcattgatcagtcattttggctgtatcccgcttcaggtccctggccctgatcagctcactttcggtgtgcctctgctccgtccattccctttttcccctccgcgccctgcgcctttccgtcgccctcggcgtgcgcgacaacggcgcctctttcgccgcgacttggccgtaagccgtgacttccgtccgttgagaattcatttgcattttgaccccgtcatcattgaatcgtaagcatcgaaatctcagcactaattattttttaattatttggctttaattttcgcttagattattcgtttttcctcttcaattaagtttgcctccaagtaagcagatgttcatcaacgtgagttgtcgccgaattttcgctgcttttcccctcccaagtgtacgccgtcctttccctccctcccttttcagtccacgctgttgcctcaggcaatttccttctggcaggtaccgtaccgtacccaatggtacgattttacagtatttatttgttgcctcttcagaaatcgcttctcgtccgtccggccaatgttcccatccgtttgagtcggtcagcttcatgtatccattctcttttgcagtttcctttgcttttaagcaaatgcgagtccaatcagtattactctgatcagtctagtgcatttttgcgatgtgtgacgcggtgcaaggcaattacgaattgcggcgaggtgcaagtgccggacgcgcacctttttgtgagaagagagaagcaaataaataggggaggggtcgagagtctcggcctttaggacgacattggctacaacccaaaacggatgattgcttcccattctggttaagcaatgccgtttctgtctgcagtccaaccctttgtcctgcatcccttccggcccctcggatgggccgggagtgtccgacaccgattttctgctttacgtttccgccgtggacacccaaaggtgtcgcaacgaagagaccattgcctatgctgcgcattgccagcaagagtccgagcttgacaggtcaaaaagccaattgagtaactgcttttccaccgaccgtttcccttcattttcccctaattattaggccaattgccggtcacgtgaacatttgccccggggcactgtccacccatgcccatgacaaggaagtgcttttgtccaccgtcaaacatgaaattctccacgcgcttggcttctccgccggactgtacgcttttttccgcgacgcggaaggaaagccgcgatcgaaaaggtgagaaggaaaagaataaccccttttttcaatgattttcaagaaatgtgaacaaccgtccgctttcatttaaccgcgagcgcggctattacgacgcggacccatcgacggtgagaacggtggtgagggaggattggtggacggcagagggacaggtggagaggaagagagcataattacactaattaaccgaattaattgtcagatccctcacccaattcatttg

SEQ ID NO: 23277 - DNA, 1358 bp, Heterodera glycines
  misc_feature (1320)..(1320): n is a, c, g, or t
catgtagaacataaaaggtaactcgcccggcgggactcgaacccacgaccccagcaatccgtgccatgctataaccaactgagctacaggccggggcccaactggtcgagtcacctagcaatgttggagaaagtgcttcgtcattgctgctttagttcatcatttgatgtgcagttaaacaaaaacaattgatataagtttacagtcattagtagggctacgatttatagttttttaccaattttcttcctgagctccacgtggcctgaaactcacgaaaaacgtgttttttcggtggttcttaagctatttttctagttattagcaactattttctagttttttattttagcacaaaaaactaaaaaattttgaaaaaaaccatttaactatttttgcttgtgaattattttcgatcactttgcccttacaatctttgacggtacggagaagtgacatctgaaattaacaaacaaaaaacaatattcgttttcttcattcatttattaataaaaaaatctcgaaatcataaaaaaataaaaataaaatagatgaaattattgctggaagaatttgaaaattaaaaaaaaaatcggtttggagaagcggcggagaggggaggggaagaagttcggctctattacagttcacacgaccataaaaattttttgcaactttaatgtaacataactttttcaagaagcatccaaataaaacattcttggtatcatcgatagccctaataaacacctacttgtctgcaaatttcgttttgcccaggatcataaaaacttgaccattgtgaaaagggcgaggagaaattttgaaagtgccgtcaacgtaaaggtttttcacaagctaaacccatccaatgaccgattctttcccgaacacaaccactctgtgcgggtcttcatgcccggtatcaattaaaagaaaattttccccttcgtatgtctgttcttcttcccgaaattccaactcatgaaaagaagatcggggtcgagtttattgtttttctcgtaaagataaagaaaaccgttttcgtaaatttgctgttttcctttgttggaaataatacggcgtaaaataggttgctgcgctgccattgcaacaaaaaattttgattccgaaagtgacgaaattggaaattttttgactttatatagaggttgtttagaagtaatgaaaacaacaaatgtaactgagacggaaatttttatttaaagtgtgagatttctagtagtttcatcatttgcttttttctatgactgcattgttttgaatttgattttgcaatttttcattttgttctactanctttcgtcttcctccttgtagatatgtctgactcgctg

SEQ ID NO: 23278 - DNA, 1616 bp, Heterodera glycines
ggaaaactctagctaatccaaacatcattattttctttaagaagcttgaataatatgtgaacataatgtagagaacatattaaaaatatgatttgattcctcaaaaatcatgccaaacaaaatgattctttcctcccctcaaattgactaaaagtgttgcgtctcgtcatctttgttactctcctcagccaaaaagttcttatagctttgctcgctcatcagctcgtccaactccttcaggttgctcaccttcatcttgtacagccaacctggacaaagaaggagttgtgaaattaaaacagcttttccccatttataagagaattcctcaatttttggtagctgttgaattttttttttttgtcaataaaagcccttgtaataaaattcttgcattaggacaaccgacaaaaatttaaattatttaaaaatagtaaaaattggcattttcaaaatttaacatttcgttctcctcaatgtttcataggtatatttgctgttttcttgtatgtgtttataaaatctctaaacagcaagacttcgattgacactaagaaaattgttgccttacggtctaggaaattggcctatttgtctatttaggcccctttttgccatcacttttttagattatttctcagtagaatagaaatgcttcaaaattagattttatagataaattattcaaaaaacatgtacatcttttttttgtcgttgtaaatcactgttttttggcatacgaaattatcggaccagacatgttttccattagtcagaaattgttgaattgtctcaaataggcatttgttttggtgcggaaactggtttggactataaaattgccaaaaataaaaaatgatgaaaaaaggggaatacctaaattagacaaatgcctgaaatttatgatggccatttgtttcggctcgtaaaatgaaggaaaaaccgagatttatgttaccctttccgtagcagtccttgttgaccagcgccggtttgtcctccacttccgcgttccgttccaccacttcgccggcaaccggcgcgtaaaggtccgaggcggccttgaattgaaaacaccaacaaacatcgacccgaaaacgggggaatttgttaagtaattcggaaaacaatacaacaaaacatgaatttatttcgagtttcgaaaaatttttgcaccctcaaaaccccagacttttgggccgataaaatttggagagtggcaaaacttacattttctggtcccatgaaaaaagtctgaaaatgatggttttgcacgacattctcaacgagtaaaaaaagtgcttaagtgtgagtgctaaacatacaacttccgaaaaagtttacattttttactttcgctcttagaattttttacagtagtaatgtctgactttgattccatgttttaccacgatttgtttttttggtcgaaaattgtaagaaacccgtctaacaaaatcataaattcgtcacccattttttgtacatccgaaaacgctaataattcgtatattttcctccatcaatgcaaaaatggcacttttgcaacaccatcattccccgactttttgagtgggaccatcaaagagtaagcttcaccttgtcatgcactacct

SEQ ID NO: 23279 - DNA, 809 bp, Heterodera glycines
tgctggtgggttgagtcccagtgattgaaatgttggtggattgagtcccagtgattgaaatgctggtggattgagtcccgttgattggaatgttggtgggttgagtcccagtgattgaaatgctggtggattgagtcccgttgattggaattttggtgggttgagtcccagtgattgaaatgttggtggattgagtcccagtaattgaaatgcagaagaattgagtcccagtgattgaatgctggtggattgagtcccgttgattgaaatgctggtgggttgagtcccagtgattgaaatgttggtggattgagtcccgttgattggaatgctggtgggttgagtcccagtgattgaaatgtcggagaattgagtcccagtaattgaaatgcagaagaattgagtcccagtgattgaatgctggtggattgagtcccgttgattgaaatgctggtgggttgagtcccagtgattggaatgttggtgggttgagtcccagtgattgaaatgttggtggattgagtcccagtaattgaaatgcagaagaattgagtcccagtgattgaatgctggtggattgagtcccgttgattgaaatgctggtgggttgagtcccagtgattgaaatgttggtgggttgagtcccagtgattgaaatgttggtgggttgagtcccagtgattgaaatgctggtggattgagtcccgttgattggaatgctggtgggttgagtcccagtgattgaaatgctggtgggttgagtcccgttgattgaaatgctggtggattgagtcccgttgattgaaatg

SEQ ID NO: 23280 - DNA, 1508 bp, Heterodera glycines
tttctcgagattttgttgaaattcttagacatcaaagattggtaattttttgtcaaaaaaaacgccaaaaacggaaaacttgtatctttatatcgctttttgttaataagggttataaattgtatgattttgcattttttctgcgcatatgctatgaagaaaagggttcaaaaatagcatttatacgttaaaaaatttttatttagtgaaggtttttagtgcatataaaagcatagtttgggggtttcgagaataaatgcatattttgccatttttgtgctttgagggcatattttggccatttttggcaaattttcataagaaaaatgcaatagtgaaaaaacacccttaaaaacctaaaatattggattttctgtgagaacttttgaaaaaaatttgttcatataaaaattcaattttattttaacatataataaaaattaaaaaaaaattcgtacttgcatataaaaattttgaaagtcaattgtttttaattgtccaaaaaaggctccttatccattgttttgatgtttttaaagtcaattctgtatttttacacaattttggcatttttttaagggttagaagccatctagtgtaatttttaaggcatattttagtgcatatttgggcatttttcgggttttaagggcatatttgagtgatttttagtgcatattttatgcgcatatttgcattttttagtgcatacaacttataaccctattaataaataatagattcatgtttattttgattttttcttttaaattgatttttaatatcgtatttaactatttagaagattactaaatggttaaagaattttaatattaagaaaatatattttcaatttggaaaatttgggttcttattttataatttttatttccatatttgatatttttggtcgattttatggctatttttttgaatttatacctttatattacaaactcgaacattaaaaacaaataaataaaggaaatttatttaaataaaccaaaagaaaaaggaaacccaaacacacaaacgaacaaaacagaaaaagtgaataaatcacaaaacattttgtacggatggagaaaagtgattgctgctatatgtcgatttgaaatgccttttaggaatatttccaatgtttacaaataataataataataataataataatgcccggcagagaaaatgcatttcaataatagcgatcagaacgccacaatttgaaagccctccaaatactccccacgcaaacgacaaaggaaaaaattataaaaaataaggtccattcttctctcgaattcaaagcaccggaaatgccattcacagctttgaaatgttgattaacggacagaaagtatgacaacgaagtgcccaatccgaaggaaaagcacacgagcgcagcatatacaccaactttttcattgtcacggcgtcgccttcgcaaccgaagagccctttttgtccgacgaaaatcgggaaaagaggcagccgaaatatatctctca

SEQ ID NO: 23281 - DNA, 2244 bp, Heterodera glycines
  misc_feature (151)..(151): n is a, c, g, or t
aaaagttcacgattttgagttctctggtaaaaaaaaatttgtttttcaccgaatgtcctacctttatgtacaagattggtatgatttgacgttgttttgcgtaatgccgagcaacttttgaggaaaaaaaaaattgtcaattttcccattntaagaaatttggtaaaacctctgtagacggtgtccggcacaaattccaggatcaaattcagataaacttcatcctttttgtcaccgcttgagtagaagaagtacttgagcttcaccacgttacgatggtcaagctttcgcattatttgtagttccctgttctggaaaagagataaaaaaattctacacaaaaaattatttataaaaattccatcaattccaaaaatttttagccagcgatggtagaaattgacgaatcgaggacaattaggaagaagttcataagaaattttaataaaaccaaaaaaatggttgtagttttcaccttatttccctttaatttagataatttcttggattgcgacaatttcgtgttctttttttataaggagtccatttactggattagttagcctgacaaataaaatcttacaattaaaccttttttttgaatgttatttaatttgccaattttgctttttcgtcaaaattttcaaaaaaaaaattgcaaaccaatagggtcactcttcgtttgtgaaaaaatttatgccacttaaaccaaaaaatgtcatcagttctaatataccaccccagccagtccaatccacacaacatttggcggaaccttgaaacgtttgtcctgcaacacttttttgatggcgacgtcctcgttgttgtacaccaacttggccaaatagacaactccaaatgaaccgttgccaatcactttggcctccgaatattgaagttcgatgctccgttcattgccagaaccaggactaaaggccaggaattgatttttgtgacaatttttgtttatttgtatccaaaaaatggggcaaacggaaaacgcaaaattacctggctgcccttacagtttgttcctgaaattgaagggtataattagtggagaaaaaacccatggcttattcgccattcagaaaaattgacgcgaaaaacaaataaaattacaaaattctgtgaatggtcgtccttttttgtacacatacgaatttaaaaagctataaaaatcctcccaatttttgagtttcgataaatttgcaatttcaaaaaaattttagcatttttttttacctgtggtcgttttgtactcatctccggataaatgacaaaatgatagtcggttgttttatggttttgctgtgatcaatgctcggcagaaaaataggtagcaaaatattttttattatataggcagaaatttactctgtcacaaaaaaacaattaggtaattaattgggaggcttacaattagaaaggagtgtgaggcggaaaacgaaagaggacaaataaaataattatgatgatgacagtgatggacacattttgtggatggaacaaatcagcggtgtgatcaaatttgctgttttttcctacttggaccgataatttgatgcgatttgatgtctcctcacaccctcccgccaaatcagtcggttgtgtgacggtgacgatggacggtggtggtggaaaaatcgaaaatgatttattgatcggagaaagttgggattgtgaggggggcacaggggagggaggggacatgggaggagacagggggtactgactgactgactgactctctcattcactcactctcttcggtcggtggaggaggtttattggtcggtcggtcggtggtcggcggaaagaagaaaaatggaaaggggggggggggggggaaatgaaagagaagtgtacataatgagagaagaaagcagcagcaagcatagccatagccaattgagaaaagtgaatgtgggagggaatgagtgaaaattgaggggagaaatgggaggaggcgaaaaatggtagaaaaacatttttttggagggggtcgacggacagaaagaaaaacagccacagaagagcagcaaagaggaggatgcgctttgctgctgatgatggttgggtggtggtgaagaattgaatcccccaaaaaaacatagggggggggggggagaacgggtgggctgggaaaatggaatggagatggcttcttcgcccttttaacccttccttctctcgaacatattttcccgcgcttattcttatgtgcgtaagcaaaaaaaaaaa

SEQ ID NO: 23282 - DNA, 1661 bp, Heterodera glycines
  misc_feature (48)..(48): n is a, c, g, or t
  misc_feature (948)..(948): n is a, c, g, or t
  misc_feature (978)..(978): n is a, c, g, or t
  misc_feature (1002)..(1002): n is a, c, g, or t
  misc_feature (1006)..(1006): n is a, c, g, or t
  misc_feature (1044)..(1044): n is a, c, g, or t
  misc_feature (1050)..(1051): n is a, c, g, or t
  misc_feature (1054)..(1054): n is a, c, g, or t
  misc_feature (1056)..(1056): n is a, c, g, or t
  misc_feature (1063)..(1063): n is a, c, g, or t
  misc_feature (1065)..(1066): n is a, c, g, or t
  misc_feature (1068)..(1068): n is a, c, g, or t
  misc_feature (1071)..(1072): n is a, c, g, or t
  misc_feature (1074)..(1074): n is a, c, g, or t
  misc_feature (1081)..(1082): n is a, c, g, or t
  misc_feature (1085)..(1086): n is a, c, g, or t
  misc_feature (1088)..(1088): n is a, c, g, or t
  misc_feature (1096)..(1097): n is a, c, g, or t
  misc_feature (1103)..(1104): n is a, c, g, or t
  misc_feature (1106)..(1107): n is a, c, g, or t
  misc_feature (1136)..(1136): n is a, c, g, or t
  misc_feature (1173)..(1173): n is a, c, g, or t
  misc_feature (1176)..(1177): n is a, c, g, or t
  misc_feature (1181)..(1181): n is a, c, g, or t
  misc_feature (1183)..(1183): n is a, c, g, or t
  misc_feature (1188)..(1188): n is a, c, g, or t
  misc_feature (1205)..(1205): n is a, c, g, or t
  misc_feature (1218)..(1218): n is a, c, g, or t
  misc_feature (1220)..(1220): n is a, c, g, or t
  misc_feature (1233)..(1233): n is a, c, g, or t
  misc_feature (1236)..(1236): n is a, c, g, or t
  misc_feature (1275)..(1276): n is a, c, g, or t
  misc_feature (1278)..(1279): n is a, c, g, or t
  misc_feature (1295)..(1295): n is a, c, g, or t
  misc_feature (1308)..(1308): n is a, c, g, or t
  misc_feature (1325)..(1325): n is a, c, g, or t
  misc_feature (1342)..(1342): n is a, c, g, or t
  misc_feature (1345)..(1347): n is a, c, g, or t
  misc_feature (1350)..(1350): n is a, c, g, or t
  misc_feature (1357)..(1358): n is a, c, g, or t
  misc_feature (1362)..(1362): n is a, c, g, or t
  misc_feature (1376)..(1376): n is a, c, g, or t
  misc_feature (1387)..(1387): n is a, c, g, or t
  misc_feature (1392)..(1392): n is a, c, g, or t
  misc_feature (1411)..(1411): n is a, c, g, or t
  misc_feature (1529)..(1529): n is a, c, g, or t
  misc_feature (1615)..(1615): n is a, c, g, or t
atattaaaaaataattaagtttagtgcaaaggaaatttctcaaatttntggaagaatacagctagaagtaatatttttatttacatttaaaatttagtaaataaaagttccagataataaaattggatgatggataattaaaatttgcttataaatctaacaaaatgttttaaaaaagaaactaaaattgattaacaatgtttaaatatattaataccaaaaaaataaaaatactatgaaaatctttttattaaatctgtttgttattcaatgaatttggcgtaattatataaaaaataaatatagaaaagttctatttagttttaaaagaatgcataaaattaaatattgttataaagaattagttacatatattcaattaatatttttaattgcattttaaacatgaatttacaatagatgtaatgataaaagatttaatggattaaaataattcaaaaaaattttataaatttaaaaaatgcaatgtgtaaaaaacaaaaggtgactaccgaatagtaaataacaatttaacataataacttttttaagtttagcatatgccttttctaaatgctcacattaagaatattgaaatattaaaatatatacaataatcaaatgaaaaaacaaaaaacattcatttagtttaatgataacaaatgcattaatgtgcatcaatcacatttattatacataaaattttattttccctaatttttctttaaaattcctctttaataaaataaaaaaatcttattcaggttgtttatttagcttatgggtttgttttttacgaacatattattattacgagttagatattttgtttctaaaaaaatatttttttttaatttggcatattttatatatttgtaatttatctgttaattcttttatatgaaatcattttataaagtatagttatcagaattttactttcatttnattaaaattaatattttgaatgtaaatttnaatgaaaaaatttttaatttaaantggnattgtttttgaattaagaattattattatttttttatnaattannaantnggtgaangnngnagnngnaattggnnagnngnaattggtnntggaannannaaattagtttaatatatggtgttgaaatntattttaaatttataattttattatattaatttaagnttnntggntnatggngtgaaaattaaaaaatnaaaaatagggtangnttgttttagtggnttnttaaattatgtgaattaatgataaaagagatatattttnntnntaaatatttagaattnttatttttgttantttattttgtggaattnattaataaataaggttnttnnnganaatattnntttnctgggtattaacantttaatatttnttaanaattttaatatttaatttntttggatataaatgtgaattttattatttaaattatattatgttagattattttattgaataattaatggtggtaagataatattttttatgaggggtctttaaaatatttaattatntaaggttaattttatttttgacataattataatttaaaaattatttataaaaattaaaaatataattggattggaaaatttttttntgggttttattggggatttaaaaatttaatttataaattttttttt

SEQ ID NO: 23283 - DNA, 1397 bp, Heterodera glycines
gtgtttaaatattttcaactaaatttaattatttattcaaaatattttttttattttaaattaaaattttacttaataaaaaatggttctttttgtgtttatgctattatttgtagtcgatgaaattattttaattgtaaaattaaccatactaaatttatgctgtcattcttaagcttttcaaggctatatattgatttttcaattgggatttaattttacaaaatgattatttttgacctcaaatgcttattttttgtttgtcaaatgctgattttgaaaattttcatttggcaaccctgattttattctccattcattgtaaattaaaattattcattataatgcacattttaaaatttatgtcaaattatctttgttttttttgttcaaatatttaaacagaatatcatgtggaatatcaaaagaattttttataaatatgttatatccatttggattgattaattaaattgcatcttccttaaccaattaaaagcgctgatttgtccaataagtttccagcagttaagccaatttttctgaatttagacgattgtcgagggtgtaaaatgaaaaatagtagtaaatgttggaaataattacgatttgcctaatttcagccttttcggggtgtaaaatcacattttagaagcaaattttggcatactttcgccttttggggatgtaaaatgacaaattagtggaaatttttttcatctttaattaatttagttaagtttatttttaaatcttaattttataatgttttgcaataatttttgagtttttttatttctttctaaaaaaaattcttggagaactctccacaacataatgccccagttagtcgctataattctttttcatagttcagtgctataatttaaaatttaaattatccctaattattgagaaatgtttgtaaaattttgtatttgtaaaatactgtatttaatataatctgatattcggcttccgtaaatttatttatttattatttatcaatttgaatatacttaaataaaatatcgaataattagtctttgcatgtttactacttacttactctgcattaatttttttattattatttttgattgtcaaagaaaaacataatatactataatggttttgatcgaaaagctaatgattgcgaaagtttgacaaatcagattttgtgtgttgaaaaatgacaatcgtccaccttttcaacaattctctttcataaaattttatttttcattaaaaatttttaaaattctcacaattcatctgtgtgtctgggctatttaagatttttaaagggaattttagattaaattaatataaataaacattcgaattttagaaaaaatgatttatggataatttttttaattatatttattatttaa

SEQ ID NO: 23284 - DNA, 2634 bp, Heterodera glycines
  misc_feature (45)..(45): n is a, c, g, or t
  misc_feature (60)..(60): n is a, c, g, or t
  misc_feature (67)..(67): n is a, c, g, or t
agagtatgtttattgtaaaatataaaaagttatttattaatacanaagattaaatgtacntttcatntaagaaatctttgtaaattatgtcaaatgctcaaaatttgctaaaatatattaaaacattttttttgttttttattcatttttcaattttttattttattttctcacatttattaaaagttcaaaattctaaaaattatttgattaaataatagagagtgaaattaatattattgctttatattaaattattattttgggatggtaaaatggatatatactttttatttattattcactcttttttaactcatgttccggattgttatattttgtagaggcagaaatatgatcgtcatttaataaatagattaatcaattaaaatttttatttatgttgttatattaagtactctattgatgattaaattataaattttaaataagataattttattcattcatttattaaatatttatttgtgcgctttgtaatttattaagaatttcatcattcatttttactttatagctatttttttaaatcctctgcagtaattatagttttttaaatttatatgccaaattcaatttaatttacgaattttttattcattataatctgagtggccaagtgtccttttttctaagatttgtccttttttggaggggacagatcttagaaagctaaaatatacatatttctaagatttttcttatttcaggcttccacaaacttattaaattttttgtgcttaatgatttatttcgatgatataaatggtaccaaaattcccaattttttcccgggcggctcctatcggcagcaccgggcaacccaaaaaacttttttttccttaaaattggctcaaaatcataaaaattgtcatttttggtgaaactctgttaacaaatagtgtaattgcccaaaaaagccttaaagaacagtagcaattataaaattttctctaaatttttgttaaaaagtcaaaaaaatttgacagtttttggcaaaatgtgttaataaattgcttcaaattcgaatataaaaaattctatacatatcgtggctaaaaccaggagggtattctttgatttttgtggctatttcgtgagtttatttttgattatttaattgaatttttaaacaaattattcttttatacattagtcagtatttgttttatttatattaattaataattgcattgaatttaatatgtatataattataattgtgtatcgtaattaaacggcaggatacatatctgtgggtgaataaaacttcttggaaaaacctcatataaaaaattaaattaaaaatctaacaatcatttattatttttattgaaaaatataaatttgaataattaatgttttttaacaacaaacctattagatgaaaattaaaaattaataaaatattttataaaatttattatgcacataacaatgtttaaaatttaacacacaatttatgttttatgaaatattaatcattcatattatttgataaatttaatttaatgaaataatcaattgatcttaaaattatttttagcttaataaatttgtttaagtcaatataataaaaaataacataaataaataattaataaaatttaataaacatatgtatttacataatggaaatttaacccggaaatacataaataaaaaataatattaatatttattcttcattaatagaatcatttgccattatttacataatttaatataaaattttaaaaaatatttaattcaaaataataatagaaaaactttgggctatcttttcacatcaagtgtggtgtgatacattttttatgtccataaaaatatgaaccatttaagatttctctattattctgttcaattaaaaaaaattttaatgagttttaatcttgtttaaattaaaaattattaataggattaaaaaaatatttggcataaagtcaaatcactgaaaaaataaacaaaaaatattaataaaaagataaattcgtatgaaatagatcaagaaaaaatataaaataagttaataatctaagaacttttctatataatgaaaactttaaaattatttgtaaaaaatataatttaattatgcgagtttaattgaaagttataataaaaaaatattcaaaatatttgattaaataaaatattatagcgaagattcggtatatataaaagggcaatgaaatttgaataaataaattaattattatggactgtacaattaaaaaacacagtatattcttatttaataaaaattgctaaacgttccagaagaaaaaaacgaacgtaaattctatccaaagcatgggattttaaagatgaaataaaaaacaaatataaattgtaatatttccacttcttgaaaaaaaatacaaaaaaacatttttttaaatataaacaaaaactactgataaaaaagaataaacaatttttggaataatgcaaatatcatggaattaataatttctaatgcacaacaaagtcaaaataacaacacaaaccgttttcatttaaaaagattattaattaaaaaaatattgaaaacttaggaaattaatataaaatatggaatgctaaataataaatcatacaaaattaactgat

SEQ ID NO: 23285 - DNA, 2499 bp, Heterodera glycines
  misc_feature (1229)..(1230): n is a, c, g, or t
  misc_feature (2379)..(2379): n is a, c, g, or t
  misc_feature (2382)..(2382): n is a, c, g, or t
  misc_feature (2390)..(2390): n is a, c, g, or t
  misc_feature (2395)..(2395): n is a, c, g, or t
  misc_feature (2398)..(2398): n is a, c, g, or t
  misc_feature (2401)..(2401): n is a, c, g, or t
  misc_feature (2404)..(2404): n is a, c, g, or t
  misc_feature (2410)..(2411): n is a, c, g, or t
aatggagcagtgattgaggaagcgctgatggccatccctttgaaggttgaaggtaatttaataatcaaaatatttctaacatagacattttggataaataaaaattacttattttgttagtgctcaagtccgacttccaaaaatacatcatcgagttcaagccgtttttgttgacttcgttggacaaccacgaggacccgcaggtgtgcattgctgcaattggtgtcatttccgatctttgccgggcgttcgagcagcacattgcctacgtgatggacgagattatggagaaattgcttggcatactccaagtatggcattaaatatatataatatttttggtttttttttgatcacattccattgatagcattttgtcgtttgcccctaattttcttgtttgtttttaggacccaaaggttaaaaggactgtcaaatcgcaggtgctcaacgcgtttggcgatgttgctcttgctttgaacgctcagtactcccggtatttggcctccaacatgaaatggttgtcggatgcaattgcggctgctcaaataaccaacccggttttgttaaatttattttattaaaacagttatattattttgaattcaattgttagacgaacatttaacaatagacgacaattttttcaaaaaatgcttgtaaaaacacacacaaaattgctaaccacaattttttttttaacaggacgactatgatcaggtggaatatgtggaaaatttgcgtgaaagttgctgctacgcattctccggcattgtccaagcgatgaacggcactgacgagggcaaacagcaaattcagcacagcattcagccaatgctgcagctcattgtgctgatcgccaattcgcagcccagtgcgcccgagtcattgtgcgcaagcgcttgtgcactcgctggcgatctgttgcacgcgtttggtgtccaatttttgcccgtggtggacgctgccgactttggcatttctgcactgatcaccaagtgcaagaagtccaggcagaacaaggccaagaccattgccaattgggtgagttcaggaagagttcgtctcaattaactcgacccttctttctatggcaatactgctgaatatgttaaataacaaaacgattgcttattacattttcttacgctttttgggagtttcggttgttgaagcctaatttcattttttttaaacaaccaacaaaatgccgcttttgggaatattgnngtcagaaaacttaatggatatttacgcttaaaaatttggccatgattttgtgtttgtcttgattttttttttaattttcaggtgaccagggagttgtcacgggtcaaacggcaggctgcgggtcaatcgtaaaaagatgtcatctcaacagcacataattaattcgaatcgtatactatcattgttttttgtcattgatttatttttttgttttcgtttgtcggccgttgttttttatatctgtcgtatgcgccgccgccgttttttgtttttgacaaaaattttttgattttttaaaagattatttcatcaatcatttgatatagtatacttatttatttgtccggattaaaacatttttttatttgcctaccgatttttatttgtttgtttgtgcttttttctccatttgattattccaaacaaattttgtaagccccgaaaatggctgatgaagcacaatctccgcccaaagatggtggtggtaaaaacatgcaatggatgtacgagggtgccaaatcggtggtcaatcgggaggactatttgctgggcaaaaaggtccgtctgtcacacatttattcattcgacattttgcgtgtccaagttcatatgtggttcagatcgacaagaatttcgagatgttctctgatgttgttgtccatgaccaggaggaggagaagcgggatgcattcttccagcagagccttctcaagccgtccacttccgcccatactgctgctcctttcgtcgctcgtaatcagcacaaagtgtccgctttggacacgcgtgttgtacgaactgaagacccattggtggccctgaaagtaacgcttatttgtctattttatcttacagaaaatagttattgcctacttgtacagtttgaaattcataatcagcacccaagtgacagttttgatagacataattttcgagaaaaaaaggtatttcccatttttgtgtaaaaattggaaagatatcccaaaatctaagctgattatatgtttaacgctctttattgtaatattttaatgtgtgaaaattagttccaagaagagcagcgacggcgtcaacttttggaaaatccgttgctcaaactgaaggcgcaacgtgtggttcgcaaagcgtttgaaaaagagttgaaaaaanctntcaaaaanaagancancancancaaaannaacaaacaaaggacggtcatcatcaccgtcttcttcatcgtcctccaggtggagaccagaacgaagaaagcaggaacagaaacgacgg

SEQ ID NO: 23286 - DNA, 2394 bp, Heterodera glycines
gatcattataattttccatttttattagagagattttattaaaatattattcttaaatttctgttaatttctaaaaaaactaaatttttttatttgcataaataaaccaaaagataacatgaaaacgactcgggaaaaagcgtcaattttcaaaagtcgaacctcattaaggggggggggaaactgcggtaaaatattcaatttgaccccgaacaaaaacaactccaaacaatcaccaataaaaagcaaaaaataaggacgagagtctcgtgggtcttaggaaaatttccaacaaaaaaataattaaattactaagtgtgatgagcggcccctttgacaggtcaccggtgccaccagcgaacattccttcggcgccctcggcgaagacgaggcgccctttctgccggcgccgtcgtccgccgtctctctgtccgcttctttgctccggcgctgctcccgcctctgctggctgttcgccactttccttctctctttcctcgccctcatctccgcccctctgatggccgcgctgccgcacgccgttggccaattgcaactttttgcgggggacaacgcacaaaggcaacagtggagggaacagctgggcatttgccaagtcgactgtcaggtgggaggaacggacggagaaagaaaggcaccggggagagttgtccatttcggcggaaggatttggcactttgtccatgccttttggcgcttttctgtccctaatttcgccttttttagggtcagcttctcaatttgagtggcaaaacggtaaattcgcttctaaaaattggccctttctaccgttttctcccctcccaaatccatatcttgatggaaagtgatgcggtaccgggacctaaacacggacaactgagtacaactgagtaccgaagtccctattttcccagccaaaatttccctgcttttcaacccgaaaaggtcccggtctcggttaagcccaaaattcccggtcccgctgcaccctagtttattgatttgtaaaaaactttctcatttcctccgggagatttttcattaattaacccgattaagtgccttttaggctgtcgtaaaaatgagtcaaattagcaaattttggctgggtttttcatttgatcactttttactgatcacttttggcgccctagccaaaaaagccgaaaattcacaatagcaaatcgactatgctctacacgaaagaagtgattttaaagtgatctgggtggttacagttccgggaaaagttccttgtgagtcgttatataaaaaactatcaaatgaaaatttttaacaaaaaatttcataattgctcaaaagcaactaaattgttaattcttcaaatcattcgatagtcctaagagttctctactaatctgcaaaatttcaaaaatttttgttaagcttgaacagagctatggccaaaagtacacaaggaactcggttttcaaacattttatgtcaaattaattttgtttttatttctttggtactgaagtgactaatttcattaggactcagttgtccaagaactcatagcttgggcctaagttttttttcactttttttttataacaacaaagtttaaaaaatgttattaattgcatgaaattatctatacacttttgtgttttttaattcaaccagaaagaatggaagaagtaagaaagttgaataataaaaataaaaatgtaaagttttcaaaagatttatttaatgtttaaaaagttttctccaagctatttccgatatattttttaaattcatctttgtaaaaatagccaaaaaagttctgccgctagcaggggtcgaacctgcgaccttgggcttattagacccacgctctaaccgactgagctatagcggcactgttaaaaaaatttttatattaaataaaaaatgcaattgaaatatttttaattaaaaacaaattttttcgacattctattagcactttgatgttaaaaattttatttatcttttttctgtttaatgataaagttgactggcatgttatcggttttatcattatttaacggtctctaatttccatttctggcggaacggaaccaaaagcgataagtcattagcacaataaaattatttgtcattagtccaatggtcctcttaaaattaaagaattgaacttaagaaacaaaaaataaaatcttacaaacttccgttctctgttttcctaccggaaattttagccctcactaaaataatggcagacaaaaacatgtttttcattcttgtaattcattttctatacagcaatcaataaagatttgttttttttaaaattaatttataataacatttcatcttttcatgtttatataatgattatgaatattctcaattatatttaattctaaataaatgaaa

SEQ ID NO: 23287 - DNA, 1573 bp, Heterodera glycines
  misc_feature (54)..(55): n is a, c, g, or t
  misc_feature (58)..(58): n is a, c, g, or t
  misc_feature (61)..(63): n is a, c, g, or t
  misc_feature (67)..(67): n is a, c, g, or t
  misc_feature (1494)..(1494): n is a, c, g, or t
ttgaaatactttttttaatttgtattttttgtcttcattttggggtgcgatagnncgnaannnaggngaaacaaacatcatagataaagagaggaaccccgaaaagcgcccgaaacaagcgccacaaaaagggcccaaacgccacaaaagaaccaagacggggcagaggaaagcaccaaacgaatgaaacaaacaaacaggggaccccaagaaacagcgaacatcgcgagggaggccgagaacatttggtgcaagactatctgcgtgactctgatggtgtgtcactgcgtctgagcatcaaccaacggttgcccgttgttggcgacctgtacacaaaactggtcgagtacgaccgcactcagttggcgctgatgttcgccatggagcgcgacagaccgtgcgaaccgctcgtcaaatatttgcaggtttggctttcggcacagttttttttttgttcattgtgattgagtaaaatggagagataccgtaataaatatttttaagattttttttttgcgatttttttttcaaaatttaccgttttttttttaatttttcggggcgaaattgtcgccccaattcctttgtatttttaaagttttggcttaataatttggcaataataaatgggtgttggttgtgaacatgggctggccaaggatgacaggataagacgccctaaccaattaaatttattaattatttttaagttttttaatttgccaggaaaaaaacgccgccggtgtgatctctgtgcccggcgcagttgtgtacgtgctgaccgatacgccgatcacgcagaagctggtcaaatttttcacgccacgcctttgtcccctgctgacaccgacgcccaaccacctcgtcctggtgctcaaactgactgcccaaccgaccgtgatgggcggtgccaacagcggcggcggcggcaatgccatgacggcagcgccaacttcgtacggactgctcagcgcgacaatggcaccgccaaacttgacgacggcagagatgaaaaaggagttggtggacaccaccaccatggccatgatgacgacaaacagtgttgtgaaaactgaaacatggaaagtggtggggggcgaggaaattgcgccaccaccgccgccgccacaaccaccatcaggaacagcagactacacatgatgatggtgatgatcaggatggcatttggtggtgcttgtttgctttttgattggcatatgggcaattggactctctttctctgtcatcgtttgtcctatcatttcgctgtcgccccatgtttttttcgtaataatgtaccatggatatgtcacattattttatcatccattatttccggaaaacagcagaagttcgtttttgtacctgtgtattattggtgatgggagcagctcgtttaagaaagagaaatttttttcaaatttaagattttttagaaaatagtgtgtaaaattgttttaataatttctcgtggaaagaaaagatgtggtggcnctgatcgtgagggaaacgcctaaagggggggatgtagttcacacttttttctttgataagcatgactctagaggtcccc

SEQ ID NO: 23288 - DNA, 1307 bp, Heterodera glycines
ttcacatcataaaggtcgtccatccattatttctaaatatttaaaaatatttttttaattaaggcgtttggagcattgcggttctgatttttatgcatgtgttgaacaattgagttcaaattttccatcttttccacaaatccgggaggaaattgtcgaaaaggtgaaaaacaaataaaaaaaacattaatattgtgtccttggttttaaggcttttaaaccatttgaaattatcgttttctaagggaggatttatttaatgaaaaacattgaaaaagaaatatgaaaaaaccgggaataagttcgggtcaacaatgaattaaaaccgaaaataagtttggtcaaatgaattagaaactggaggataatttgggtcaactaatatctcagagcattttgaatgggttagtgcaattagttatttggaaatgatttgtcgccaaaggcaaagaacagaaatgacccaccgagacatgacatctcagagcctccgtttaaaaattattttagtatcaaataatatttttaattgtttgcagactctatccattttgtccaaaggtggtggtcaatgccgtaacattgcatttgctaaaattctgttgccaatttttgcttccattggcccaattcaaagggcagaacttatcagcagaattatttcatttgattattttgaccaaaattctgaatccatttccatttgtggtgcgcttggtcaaacaaaattgcatttacatcagctgttcctatttaaggaattggtttccaccacaaaatttggtaatcttctgacaattttttctaaatgcaaagctaaaactaaaatttagatttacggaattgtcaaaattgaaaaagactcatttttaaaaacaaaaattttattctaaaacaaaatcgttaaaattggtcaataaaatctatgtttttttaaaacataaaatatttcctttattttatacagatttagtggaatctagagaggaaatctttcaatttataatgcgaattattcaaattgcaatgaaaaggggacaaatggaaaggtggcgccttttttcaatggctggcaatgctttcggtgtgttttttttttttgtttatattcaagattaatttacgcatagtatttaatacggatattagttgtatcatttaattttttttttttttttggttaaatttttttgattaaggaaggttttgcatattttgaatttttcgagatacacgcatattttgcatttaagaatttttagagtatattctggcatttttgataaaaattaattaaataaaaaaaa

SEQ ID NO: 23289 - DNA, 1574 bp, Heterodera glycines
tcaaagttaacataagttatggcagcagaaatagtatttattttcatacactttttctaaagttgactaattttttcaggctaatagatttctaagtttgattttgaaaatttttttgaccttatgaaaatttactccccgacgagagtgtggtccccggttttttaaatttctctagtcatcccaacaaatttcttcggggaattccgcgccgatgcccgacttttctctccccgagggtcggggcgcttaaccctattttcggtaaaacactcgaggcctaacattttcctatttcttatcttataattttttgaaaaccacttcttggaatttttagggctatcgataacaaagctttttttctattgtccgtccccctgtcctcctccggaaaaattttattcaaaattttctaggggattacatatccgaacagttttcaaaaaaaaatttcccctaaaaaatttttttgaataaaaaaaaacctcgtgatcgcacaagtacaaccagtcataggatgtctatgttgttgttgttgttattgtttgtttgcccatcattaatcacataaatcagcttcatcaagtgcgcgcaactgtccgcgtacaaattgtggccaattaagccaccacaaatgtccccggacacaacaaattatggccaattaaccatgtaatgatgatgacaaccgtgcacatacatacacaacaacacatataacggggcgggccaaccgcaaaaccaatcaaacaaatcactcactaaaacggcctctgatcacccccaccccctgaattcctgttctcccaaatcagcaccaccagcagcaaaatggggtgaatgatcagctcagcaacagttgggcggagggagaagaaagggtgcggtgatcagcgcgaccaaaacattcattccctccccgccccctccggcgcattcacaaaatcagttttttccattgtcctcagggaccaactgttgtaatccttggcccttttttagggggagggtaatgaaaatttttcagtttttgagacaatgtcgtcatctgtagaaaaaaatcagcaactttttacctctgggtatggcaccacataccaatgttattcgggtactctctttcatctcctcacttcaccccccggggggcacaatttcgtctcttcactctcctcccccagggtagtttcgttttctccctcgtcccaggggtgattttcgtcttctcctcatcctaggggtattttcctctcctcgtttttcggcaggtgtagttttcgctcttccccgggggcaattttcgtcgtctcccttttccaatactacccttggggtgatgatgtgaaaatgggggaccgatcacccattctcctgatgctcccacatctcccccccccaagcgctatatgtctgtgggtctttggtcagtgtgccctccattctctgccctctcccccctccagccgatcgcccaaggggtgtcaaggtcaacaaaacaggcagcagcaataagcggagcaagcacaaaagagagcggcgacccccggggggacgacgagccgagtgaatga

SEQ ID NO: 23290 - DNA, 1340 bp, Heterodera glycines
atttcatttttaaaaatcttcccccttcccctcgcattcttcacgtgattttccgtttttaaataaaaaaatttctgtttttctaccagagaaaattgaactcccatcggcgccgtttgccgtcgacactcagcgaattaactcagacacaacgatttggactcatttgtcagcagagggccctcaaaaagcgacgatcgtaatttgaaaaaaaagcaaatagggttactgtaccctctctctctctctctctcttctgtgtgtctctttctctcactgaacaacatttttttgtgtgtggtctatcactgcagagacaacaagcaattagtggaagcggcagcaaaacagcaacaacaaatttatcatcatcatcatcaccatgttcgagaatggcatcatccgtgccgacccgtaagagcaatgcattttcctcaatggcatgggatgggcttagcccaatggggagcggtgtcatggcaaaacgtacaaaatgggtattttttaaaatttttctaaatgcttaaactaggcctaagcctaggcctatgcttaaaaaaatgttttccacgttttgccattgacccctggaaacagaggggaggggggggggcttaggttatgaagcccatccacaaagtttctcttgaaaagaattattttagggacgagctttcaaaatttcaagatttgagaccgagaattgacccccctccccccgagagtcttgacttttgaatgaagggaatcagtcggcttgccggattttcaaaaatcggaaattggtattttggaattttcttgtgattttacttagttattagccaaataaatttttaaaatgtttttaatccccgcttcaaccttctccagaatgtcccatcgtccggtggaattgtggaagaagtatttgcgacagggacgcgtctgtgacccggccaaagtgttacggtaggcactcaaatgctcataaacgaagaagcacacaccctggcatactgtactatcctcagaatttttccgggtcgcgaactcaaaccttactgtaaatacagtatcccctatttgtgtcaaatttttcgagccaggagtgaaggaggaggctgctccagggatttcttggaaatagcagaagatggtcccagctcaacaacaaaaaaaaacaggggtttttaaaacggtgcccccgtcccgcattttcaaaattccggggctctagaaattttcctaaaattgagggctgccacgccacgcaaacatttttcgtcacacggcaataaaacatttccaccctaaaatgccataaaataatcattaaaaaaccattcaggctgaacacg

SEQ ID NO: 23291 - DNA, 1289 bp, Heterodera glycines
tagggctggtcgggaccgctattggggcggcaaatcccggttttttcaggtcccggtcccggcgggactaaattaagcactggtaagaatgggggtctgggtgaaaaatcgagatgaaagaatggagatttgaggttaagaaacttttaaataacatacctaggtaaacattttgcctatttggtgcatttgaataattatttcttttaacattttttcttttctcttattcagaatgcttacaaatggcatcctttaaaattacataattcattttttagtagatcaaactctataaatgtctgacatttggaaatatttcgacaaatcgctgaatgataaagcaatgatgaattttgaaatttttcatataatctatgcattttgatgaaaatttttggaatttttcatttttttcaaaaaaaattcacttgtgaaagttccggttggtcccggtcccggcttttctcgcggtcccggtcccggtcgaagactaattaattttaaattaaaattatcatttttttccaggaaattaattgacgtaatcgtaccaggcagttacatttaaccgaccgaacatttgattaaaaatggataaataaattaaaaattagtgacaaattttgtttgcgtcaatgactttttcactgacaaaacaaaacaatatttttatgtaaacaaatatattgtaatataattgtgaaatgggaatctgggcttttaatgcaattttattttattttttaaataaaaatattaaaccaggctttagaaagtcggggtcggtatttttcggggtcagccagaggtcggggcctggatggacccaaatcagtccgggtttttcggggtcagctcgatctgggtcgaatggaacaaattggtagaggtcgcggttttcaatttttgattttaattaaggtaattaaatgaattaaattctgatgaaaatttttcatgaaaaaataaaaattatataagaattatacatatatacatttcttaaataaacaaggggccggccaaacaggaccacacaaaacgtgtcccatggacgaaacggcactgaaaattgtttaaaccagtttttaaaatgactgcataaatattgaaataaaattttctataaatattgaaaaataaatgttccataaattcgaaaaataaaatgcagcataccgaaataaaaaaaaaatacgaaacaattcttaaaaattttttgtcattaaaataattatttttatggatttttggattgaaatttttaattattttatgcaaatttt

SEQ ID NO: 23292 - DNA, 1408 bp, Heterodera glycines
tatgaaattttggctccggcggtgccgcggaaattttattacaattttaaatgattatatatttaaaaaaatttttatgaatttttaatcatgattttaaaaagtacgaaacaaattttattgtttataaagagatagtaaaaatttcaaataattaaattttggattttccaaatatttataatagggctgtcaattttatgtaaataaatatttttttacctggcttctccaggcactgataatagaaaaaacactttcttttttttgcgaacaaaaaccggcacttatatttacatatttcgagatttttgtatatatttcgggcatttttcttacacatttatgcacatattttgaacacattttgtacatacttttgacaaccctatttataaggctcccggaaaatgcgtcagtgaaaactttaatgtcataaaaacaaattcattgggttttcgttgtgtggtggatggatcatcaatcttgtatacatttcggccaagtccgaccgaactccggactcgaattcgaacaaaaggtcgactcaaaattctcgaatttaacatttttttagttcaaaaatggagatctagtttattttgtttattcaaaccgattttaacaaaaacgctaattccgaaaatttgaactttcgactttttgttcgaattcgggtcacgggttcaaatttcagagagctatgttcttatagaattttacgtttatactacaatacttaattctacagtactttattttacaacatttgtatcactgacgcttttccactgacgcattttccgatcacgatctataaaattaaaaattacattcccagaacaattacaaattatacatggagaatattttttttttacaaaatgataaaaattctataaaatatggcaaaatgcaattataaaatcaattattgatgaattaattttatttcattttttttttgttattcattcatgtaataatttagagctagtaggatttttaggtgctacaaatacttaaataggtgctaaaaactctcaaaatggcaaaatagttgcgaaaaataaattttggatactgattttgagaaaatttttcatttcttaggggtgtattttttgttttattgcaattttgctaaggaatttatggaaaactgtcaaaatagttgctaactctattagtaatttgaaacgagcagaaatttcaaaaattgtatatatttttttttgtaaatttttgacgcaaaaaaatggtgaaaatgaatttggttattattattactttcttcttatatttaatcatcgtactaattgatggaattgaagaagatttatttgatgatttatggaaaaattcactgctatcgacatcaaaaaattatgaacagcaaaaagcaaag

SEQ ID NO: 23293 - DNA, 1277 bp, Heterodera glycines
caatggccctatcgcacaaatgatggaagaggcagatgaaacgactgaactccctgccattttctccccttctttccctcacttttcttcatttaaattttcacattttctttcatttcgtctttgctctatttttttttttaattttaacttatcttacacctctttacccgggcaaaatttatttatttttaatccataaccaatgctcttggacactgcccataaaaaaaacaaaaaaatttgtcccctcacgtaagtccaaacgacaatttcttcaacttcgagcagtacaaaccgcgtaacagcacagcaaacgacgggaaacatcaacagcatcgccatttgtggtcaacagcccgccaagagagagagaaaggacaacagaagagaaagacagaagcgacagaaggaccgtcattcagaaaagtcggctcaattgattgacatttggacaatttgagcatcaccaagttagcttcgaaaagagaactctgacaacagagcaactcttccgtcaattacaacatttgaaacagcggacaacaaaaagaggaagcaacaaaaaagagcagagggacagcaaatggacaataattaagagggaaggatgataaaaaagaaagaaaatgtcatcaaaaaaaaaaaattaaaaataaaaaaacaataaaaataaaataaaagggacagaaaagagcaacagccatccaagctttggttgtgaattaaaaatggggggccattttcattggggagggaggtgtaacatattctaattatcacccatgagcaaagacgaacccttcacacatttccctttttggccaatcaatgttattcatcttttccacattccccccgttcaccattttattcactatttctcttttctctaactctcacaaatccccgcaaatccccgccccttttccgttcaattgtttcccccaccaatcagtcagtcgagtcggaggagatgagagtcggacgtcggagcgatcaaagacaaattaattatttattaatcattcatttattcgcgcatttaatccgacataataaaagagccatacgaacgattggaccctttggacttcttggggatcagggcccgattcctaagattaagacccttcagtcctgggacaatccgtctcctcccatcccgctctggcatggatcctcacgtcttactggtagcaccggatggttcgactttcgagtcgaaggaaagacgatccagcgaggggatgaaatccgactggctcaagctgcag

SEQ ID NO: 23294 - DNA, 2012 bp, Heterodera glycines
  misc_feature (94)..(94): n is a, c, g, or t
cccggtaaaaatgaccttttttgaccgggctaaaacgggtttaaatttcaccagtgaaactgccacaaattttgaaaaatctaataattattgngcgaaatgtctttagctcaaaattttgaagttagaacttcgggattttttaaaaatttgcattaaaaagatcacaaatccacctaaataaaaatttcgcataaatagcaatttttgataaaattgattaaaatgtatgtaaaaatctataaaatttctcttaagaaattggcttaaaatcacaaaattatgagcactttaataaaattttcagtatttttcgtggtgtctaaagtaaaaaagtgccaaatttggttatttttcggcaaaatccgttaacaaatcgcattcctcaaaactgtttgaatagtgcaccgcaaaaaaaaagcattgtgaatggcaaaaatgttcttggcttggcctaatcacaagctgaactataagactaccattttttattttattaatcaaaatcccacaaattttgaaaaagcccgggcccggcgggcgcccggccacaattttagaccgggcccgcgactcgcggtaaaagggcttttttttggaccgggcggcccggtcccggtcaaatggctaaaccaacccggtttcggtactttaaaaattccgggttctagtattaatcacttacaattggagaaaatctttataaacatcgaccgaattaaaaatatttttataaagtccttaaattttaattgcttaaaaacatagctaagattttcaatgaaatgagaaaaaggtaacctatttataataaagttaagtgtactattaccgtaccctttctttgagtgatttttggtatggcatgttgaatatgacaaatgtgttatgacgtaaaaaggacgttgtcaatgattgtctgtcatacagtacgctccttctttcaccgtaaagaattgaacaaatctgtttaaaaaaaaaactttttttgtgcctcttcacattttgaaattattatagaagagatacaattgaataactcaaaaatttatatttaggaaatttaaaagtttaatagaattttgaaattttttaaatttttattgcattttttttaagcattctcttataaaaattttaattttcataaaatagcaatcctaaaattattttaattaccattgaaatgttcaatttcgtaaatttgtttaaatccaaaacgccgtcatttttgcgcatgatttcatagcccaatgcagaaaatccgatgactgtcttattgaaaattccaagatgttccaacatatctaaatttaagatgcaaaatattaaaattagaaaaatttgcattttattgtatttaaaaactttcataatttatatttttaaattaaaaaaatgtaaaaaaggcaagaaattatacaatatcaatacacctttttggtatataagtgtgaaaattgggttcgcgccatttgaaacgaaaagtggatttagttgaactgcgtcgatttttgccgttggtccaatttcggaaatttcctaaattaaaataagaaaatttttataggcaaatatataaaataaaaaaaacaatgtaattctgctatttatatttcaggaagtcagcagttaaaaattgattaaattactctacattttatcagaataaaccaaacaaaacatcggttttttttcactaaaatcattaccattattgaatttacggagaaattgtcccggtccgaatggtccaaaattttatatctcgtaaaagattaattacaaataaaaatttattcattaaattttacaaattcaaaaaaaaccgaaaaatcgaaataaaccgaaaaattttcttcggttttttcgatttcggtttttttcgggtttttaaccgaaaccgttcgaccgagaattttttgagtttttcggtttttttcggtttcggtttttttcggtttttaaccgaaaccgttcgacctaccctcttgtccggtctctaattacaa

SEQ ID NO: 23295 - DNA, 2030 bp, Heterodera glycines
ttttttttctccagacactgatcaatccgcctatgactccgatcactccgctgcatatcgaccacgaaccaagcggaccgcctttggcaacaattttgaagttcggatcctttctgacaattcgttggccaacattggcacgaaagcaatgccaaaattgaaagcgtttaatgaatgccgatttatggcattaatttttaaaaaatattctgcccattttcagcccggtggcatttgccaattgcgaaacatgcgcaaattgtacttaaacaaaaacggaattggccaactttcaccccaatttttcaactctttggccagcaggtgacaattggaattttatggtgatatatagtatctgagaatgcgattttgtgtatcgcaaaagataaaaaccgataattaccaaagttcaaaagggtaaagtttttaaattatgtatttaaaaaatattttaactccatttattgaatttattagcatttatttcgtaagacacgatggattttcccaaaaaaaaaaaaaatttctgtaggttgtttttaccgaaaatcactaaattatcagtatttcttccgttttttcaaaccgaagtgccaattcccttcaagggaagtgctgcaaaagttggaatttcgtggcaataaattgaccgatcagtcgctgaacgaaggcggcgcagcaggcgaaggcggccaacagcagggaatgttcggggcactgaaaaatttgcaggaattgagcctggagacgaacggactcagtgcggtgccgagcgtcgcactgagcgcacagcgcggaacactgaccaatctgaacttgggactgaatcaggtggtgatcagcagggaatagcgggcaaaagtaggcgtataaagcattgatcagagcagttgatcagaaagagaacgactgatcagaaaggcagcaactgatcagaacggaattagatcagctgatgataaaaagaataacttatcagggttagagcaactgatcagaaaaaaattagctgaccagaaagaaagtgagagggcaataggccagaaagagagcagaaagagaccagatcacatgagaaggcaagtgaacagacttagagaagctgattagaaagagagcgactgatcataaagaaaacaactgatcagaattagagggaaattgaccaaaaagagagtagaaagggaaaagtgatcagaaaagagaaacatccgatcaaagaggcaaggaattctgaatagaaaggatctgtcctcgaatgattcaaaattgaatgcctttcattcgttgtccatttgcagatcaaagaggtccccgtcggtgctctgaactttcccgagctcacttccctctccttggagttcaacggacttccgatgattgtgccgcacgcttttcagcacgtgccacgcctccaatacctttatttgacgggcaacaaattccccgcctggtcccccgacatgttccgcttcgtccccgacttgcgaacgctcggcatcggcgaaactccgatttcagtgattccggcaaacgcattcattgtctgtctgtttggccttattttgaaggatggtcattcattccagcacacgcccaatttgatgcggttggaaatgtccgaagtttgtcggcggaaggcctttcggcattttgtgcctttgcgacgaccgttcgttcacttttaggcggccgtcgattcaattgagccgggcgcctttcagcggactccgatgattcaggcgattgtgctaaacaaaaacagactgaccaggcaatggtcaatgagcattctcaatattcaacagctgttcagggtccgggccgacatattccagggactgggcgagttgtactcgttggacttgcagggcaaccgattggaggaggtggagccccgagggttcgccaatttggccgctcttcgccatttggacatcaggtcgggttttggtgtgtggccttgttaatgcgtccattgtgctttcctgcctgctccgctacaaccttccccaatcccctcccca

SEQ ID NO: 23296 - DNA, 1783 bp, Heterodera glycines
gtcattgttgtcgacagcaattgatgcgcgttgccgagcagacgcgtcgtaaattggctggatgaagcagggctcatcaatcgtgtgagggccgtcgcaccgtcgacagttcccgttgtcggcaggtcgttgacgtggacattggtgttttcccacgtaggcgatgcgcccgcaatcgtggcacactcggcgccattggcagatgggttgacggtgacgctgtccacggccatccattggagctggagcttgctcaatcaggtggtagtcgtagcagtcatcgttgggaaagatgaactggcacgcaccacaacgtcgggcagtgcttgcgccgtttagaagcttagttattattattattatgtctttctatctctttaattttatttcgaaaaatacctgttgtgcttggcacggatatccgggcccaaatcgcaaacaaaggcggcacaccaccttacaaccagagaagtggtagcgcaagtgcgctcgccgctcacagtcgatgcagtagcgctgcacatcgaacagttgttcaacgcggccaatgtagttgaaatggccgcgctccagcagcaggcacaaattgaatttggccgccatgctttaattagaccaaaatttgatatccattatttaagacagaaatttacccctgacccttatagacaataaggtattcccgctccttttcaaacaccgccaggcggatttggccaattccatttgtgttgtttaacatccgctgtagtcgagccacgtccaccagcgtgtacatccctttgtcaaggggaatgccggcacgcgtcagcagctcttctgcgtcacgcccatgttgctcctgatgacgcgcgtactccgtaaatgttgcacggccaccgccaccagccattctcgtttcgcggtcccgaagacccagaaggacggcacgcgccaggcagagacggtcgtttgggttaacgacacgcaccaatgattgcacggtgtgcgaagcatggtgttccgcctccaaatcacagccacctgtttttttttttcaacgtaatgtgcttgaaaatcgaagaacaaacctcctctttgtgggtccgcacgaattggctcgagtggccacaccgccagaactttggcgaccgttgtcccagcaaacaggtcaatgccggctgccgactgctcattgagccgctcaatggctgccgccagtgccgcagcgttgttctgctcgggcgggcgaaggcggatgacgtacggccggtcaaagcctggtgggtgcagctgcagaccaaccagggatggcggcgggtgaccgtccagcacacggtctagcagatgctggatgagcacctccatcaacaagtcgggccgctgtgtgtcctccagcggcaagaagcgcatttcacaaatttcgccacgagtgttccgtggcacattcctcatttgcgtggtgcgctcaatgacgaaactgtcctcaatcgccttaacagagaacaacaaaaaatttattcatggcaataaaaatttacaaacaggacatgagcgctgaatcctaagccatggtacaatacatggggcatggaaaatatggaaacaatgggagtgaggggggcacactccccactcacaaaaggacacatgcatatgtgacaggaaaggaatttttcaacctgaattgtcgaaaaatcaaaaggtgggcaatgcacgaattttcacggcaggaaaaggggtctttgtttttcaatacccccatttcttctaattttggaacacaatcaaatcggaccctcaa

SEQ ID NO: 23297 - DNA, 1918 bp, Heterodera glycines
ctgatttcattttccgttttatgattttctaatagacttcttttacagatcgcagcgcaaattcgttccccaaaacttttggatttagaaaaatcctccgttttgtttcttaaattgaaaaattgggttcaaaatttcggctttgacgcccccagcagttttttgtttgcttctgagtttaaaaaatttgcattttgaggttcacatttttctaagaaatttgacaaaattctcgagtcaattttaaattattattttttaaaattttttagccctttgccattttttacgtataaaaaattccgtacacaaaaaatcgccgctttttctccgcttctccgctctgctgttgttgttgtgtgtgcagtttcatgttaccattttttgcattaattggacagcgaatttgacacttttattttattcccccgcaaaaattgggggcaatgcgacaaaaaaaagcgggggaaagaaaagaaagcaatttttgctgctgtttttcccctgccggcgggggatggcatttctcccaaatttgtatccacaaatttactgctaattaacgtccactaaaacagtaaaaattgaattttaatgcattttaaatttaatgtttttattttagtaatgggataatttggggattaaaaaattgtagaaaacattttaatttttctatgttaattaagtgtctgactaattgtgtaagcccaaaaaaggattaaaattttggcatgctcaaaaagcatgaaaaatccattttaaaattttattttttaatttgaataaaatttttttatttaaatccctcatagattggatttataatttgttctttccatacatcaaaatttgtcggggatggcagtgtagaaatttaaaaatgtcgggttgtcaaatcctcgtaatggagcaaatttttataaaaagtcgaaaaatgaaaaaaaaacaaaaattttgcgaaagcaaaaatctgaaaattcttttaaagaaaatctcatctaatttggaggtaacaagaagacatttgtaatttccagaattgggtcggggcttaaccttaatataaccataaaaatttttcaaaaaaaaatgaatttttcaaaatttcatattctgaattacaaataaaaataaggctcttctcggcttattgtaaacactttctttcataagaatatactttttcaatttgtaataaatattttctatttaatttaatttccatcaaattaatttaattgaaactcaaaaattgcatttgtccgcgctttttgtccccccgggggtcggtcgccccttttggtcgtcgccaattccgttaaatgaccgccggtcaccggcgccaccattttgcgcaccaaatttggtgcttaatgtaagccaatttgcgctgctaatggtaagtgccggctgaatcggccggcgatttgggctgatcattttcttcccccggcccctccgatcagtcggtgcattttgtgcagcaatctttcgcgcatttggtcacccgtcaaaatccgattttgtaacaattttcttaaatccatgaactcatttttggggataaagcattgaaaagaggtacaaaagccgagagagtctctctcgaatgaagcttaaacccgagattctcggttcgtttacagtagttttacctctgaacttggcattctagctagagcccggtgcggacgggatcccgtacgggatttttcggggatcacagtctgcgcaaacgcattttttggaaattgcgggactgtgactggattaatcccgcgggattccgtcccgcaaaaattttttgagttacaatcacacagcgggatcagctaacttgaaatttccgagctctaactaaagccaaaattttcggcacttttgccgtcatttttccaaatttggtcatttgcca

SEQ ID NO: 23298 - DNA, 1547 bp, Heterodera glycines
aaaaaagtccacaaaagggagtaatccacttactctgcggacgtgtcatagattaaatcgtcctcgagtaatatggattaaaaattaaacaaaaataaggattcacaacaaaattaaatataagaatgaggccaatcatcaataaaaccaaatcactatataaaatatataatatctttaattaaagagataattcacttttccggtcattttatacgttaacaaataaggagtttaattttagttttaaattgatttaaagaatttattttaatgatttctttatccagctgattccacaattttgtagccctccccgcaaagggaataaattttttgcctaatttatattttgtgttaaacctataaaaggggacattaaagcgttcagaaggtttgaaaatttttaatatatctagatctgttcggccataaacaattttatgcgccatgaacagatcaaatagctttcgccttttctcaagtgttggtagttgcaggtattctaatcgattttggtatggaattggcggaaggctgcatttaaaaaacacccgtttggtgaaatatttttgacacttttcgatttttttaatattttttgaagagacggattccaaacctccggagcgtattccaataaaggcctaatataagttttatataacgtaatccaaatcttagatgatttggatttaattattcggaacaaggaacgcatacataaatacgcattccttgttatatgattaatatgatcggaaaattgtaatttgttatcaatgtttactcctaaatccctaattgtatccacagcatttattgtattcccatcaaatttacgaaattttcacgtttttgcttatttttaatataaattacccaattttcaagaaaatttaaatttaatcaatattttcgacaaaatttgctaaaaatgtctttttctgaaattttttcggtctttaggggtcaaaaatgccaatttacctgatgggggccgttataataaaggttttttggaaaaatgccaaaatatggacaaatatggaaatattgacataaatcgcgaaatatggatatagaatactctgtccaccgctctgctgctgttgaggatgaaaaattgcgcttccaattacatagttattacgataagcaagaccaatatcgcatccaattttaatcccgacaagagattcttgagtgtcgttaatccatgttaaatggttttttaaattgaatgatttatatgccggtggtcgtgtgccgaagccgagcacaatcggcacctcacaaacggacagatgcgtttttgtgatcaggaattccttctgtaaaaatgagagttatacaagaccgggacctggtactgaaataaacgtacaactgagtacctaagtcccggttttcaaagttctgactgggaccgggaaaagtccggggcctattcaaattagcatcgtatcaacgatgagatgatacgatgtgatggctcatcgtatccccgatgcgcgttcaaattaaaatcgtctcccgcatacgat

SEQ ID NO: 23299 - DNA, 1336 bp, Heterodera glycines
  misc_feature (1323)..(1323): n is a, c, g, or t
atcaacaaagggtctaccgccactccctgggcgagatatgttcagtcaaagcagagtgggtctaataaaacaagaatttttaaaattttcggcatttgctcttatttcgagcctgctctacgtgtgcttcttttgccaatatggccctgctatagaaatcttgtaatggttcacgactaagtgatgaaatatttttagcccatttcttttctatccaagcatgcgaattgtttattgcattttatagccttctggaaaaagatagtcagtaaaaataaagcttgttttaggaatatttgagtatatttacaacaacaatttttcggcaatttctaaaaatgaaggaaaataatttttttatcaatattttatattaagttatgtttttgaattgattgaccctatcaaatgaacagtgatgcagttgtaaaatttttcggcttctcgcgcaaagtttttcctggactgtttctgacagattgttgagataatttttctagatgtttgttcatatctcaatacattatttatcgcttttaaattgaatggaaatgaattgtcagtaacaaaaaaaatattttgtgaacatttataacaaaaattttttaagcattttctaaagaggctttttgacttcaatcataattatattgtcaattgtttgaaacgcatctgttgccgttggaagaggccgatggaaaatttttcgcctttcgcgaaaaagttttcccagaaaatggcgtgggacaaataaaaattgtacttttattatgagcaatatatatttcctatcaatttcgggtttgctttacacgtttgccaatgaaaaaatggagttttgtgaatgcaaattttaacggattttctttcgacgtgtcataagcgggttgtttcgggacaaatgcaaaccaatttgatgctattcgaatgagctaggcgcgctctaccctttcaaatgtatcaacaaagggtctaccgccactccctggcgagatatggccagtcaaagcagagtgggtctaataaaacaagaatttttaaaattttcggcatttgcccttatttcgagcctgctctacgtgtgcttcttttgccaatatggccctgctatagaaatcttgaaatggttcacgactaagtgatgaaatatttttagcccatttcttttctatccaagcatgcgaattgtttattgcattttatagccttctggaaaaagatagtcagtaaaaataaagcttgttttaggaatatttgagtatatttacaacaacaatttttgggcaatttctaaagatgaaggaaaataatttttttatcaantattttatattaa

SEQ ID NO: 23300 - DNA, 1708 bp, Heterodera glycines
  misc_feature (1566)..(1566): n is a, c, g, or t
ttctttgagtttttcatcctctttctctgtctcatcgaatctggggggagagtgaagcatttccagttcatcctcctccccaacatatcttggcggtgaaggcagcaatgatatgtcctcttcaatttttgatctcttaagacgcttagcgtgtggaggagaaccaagaatcaccggcttatgaacatgcccttcttcgtgtgcaagtggttgtagtcttactttttgctgactcttcaaggttgcttgtaaaaagtccttgagttgctcaacttttttatgtgatgcctgcgggacaggtactctgatgacacgctgtcggtcctcatcaacggaatggagattggtgaaatggatgtctatccactgctcatccaaggtaccaattgttgagtgccaggaatagggataactgatgctatgcaacccgcaaacccatgacccattaaaatgcaatggttttggaagacgcactctgaatttgttcggttgattgtccgtgtaatccgtcacattgctcggcaagaacacaaagaaactatttgctgtcatttattaaaatttcttcaatgacaaaataacaaaaataaaatgcttttatacaagctgggattcactaatccattccctttcgggatagcctatgaattttacgagcatctcagtagatccatccggttttcttctcttcttcaacactttctctattctatagcttgtctcttcatccttgcgcacgcgtgccaactcctgctcataaaaggtacccctgaacttttcgccattgtcatcgcgcagtttgtaacggatgggacgtaccgtcttcagcacttggtcaacctcaaggatttcgtcaccgtaatttggcaggtaccccttctcgaactgccccttctctctgctcatttgcacaaaatcgtctttacggaagcggggagattttttgacaaatgattgtgggccatacattcgcttccataccttctgtgcgttttgaaaattcacgccaattggtcgtatcccatgaacacgagacggtgcattgttaatcccatccacaatttgctgcacagtatccacccagttgagagtctgtttttgcgcaaaatatctgtataatcgttgctttacatttcggatggcgcgctcagcaactgacgctttcactgacgaatggacgggctcgtgcttgccaatctcttgctcctcgaaaaattctttgagtagtctgtttttgaattctgtgcctttgtcggagaatattcggtgggggaccatgggcatttggtcaataagcttcttgaatgcctccaacatctcctcggctctcttatttttcagtgggatgacaaataatctttttgagagaacatcaatcgctacgagcaggtaccggtggcctccattatgacgagaaagcgcttgaaaatcagccaaatccacttgcacatcggtcataaacccagctgcaacagttttggctctcggaaagtgcacacgccgggggcgcatcaatgtgtaagtgcggtgtccatccaagtaactctgcacttgatcttttcgtanatgcttaatctttttccgcgcctctttccacagtgcggtaacgcctgcaaacgccgctggggaggatgggtcattgtacattttgtcaagaatggtgttgatcaactccattttttcgggcgaaactccttcttgattgccc

SEQ ID NO: 23301 - DNA, 2249 bp, Heterodera glycines
tttattattgctcgaattatttcatgcagtttttattgttaagttattaagcaacataatcaatttttattgtaaaaaaagtttattaataaattaaattatagttatttctaacaaaaataaatcgaaatttacggcatcgtcttatgattatgttgattggtggaaaaaatgtctcaaatattattaattctctaattgggacatttgcggacggacacttgcgaacggacaattgcggacaatttcggaaaaaaataaaaaaatttctttaaaaaatttatgaaaacatggaatggagacgactgcaaaacaaattaaaaaattttttatttataaggcctcaatctttttttaacttttaataattaatttcaatcgtcaaaatgagatgctggtgtgtctcttaacttaattttttagaatttaaaaagatttacttcccgaagagtatttgcctacattttttaaatttctccagctatgccgacaagtcttttcgggggatttgctatctgctcccctacttttctttcccatagaatcggggaagaaccctagataaatcttgctctagggttcagcgaggataacattccgataacccaaaaattttcgtaaagaaatcggaattccgaggcccaaaaaatgacgggaatcggaatttagtacagctggtgttcagcacttatataatatgctgcacattttgaaattgcaagtaaattttgttcgcgattaagcatgtctcaaaaaattaaaatatatttctgtatatctgaaatttgaagtgatataatagcgaagccaaatcttctaatccatttttacaaaaatttttgtttaatttttcaagaaatttttttattttttcctgaaattgtccgcaaatgtctgtccgcaaacaattagaaaagaagcttaaataatgatctagcgcagctcgaataaaaccaaccttatttcaacatggtaataatagaataaaataaaaaatttttaaaattaaattttaatctttcgagtctttagcatctaaaagataaaataataaaaattacaaatcatgagcagtaacattaaaatgttccttaatggatgatatattaatatgtgtgaaaacttagaactactactgaatagaaataacaaaattaaaaattataaatatagagaaatttaatgtaattaaacctatttaaaaataacgaataaattatcattgacttacttttatggctaaatagaacttgcaatcaacataacattaaacaaaattaaattaaacttataaatattttggcattaatgtacttcaattaataaaaacgaaaagatacccacccctaagaaatgaaaaattctcaaaaatatattttacgctataaattcctaatgaattttttatgagattttttgtaataaaatataaaattaaatcattatttataactttaatttttttagggaaaattaatattttttcaacatttttttcaaaaggggtgacaatgaattttataatagtatttttactaattttgctaaagcttaaagtcgtaaaatatttttattgcattaatttcggcagaaagaccaaaaagataaaaattttaataaaatttatttgatattataaactagggttcagccccgacatgtttcgggaaatgaaattacgaaagtcgtaaattgcacttgaaataagatggaagtatctttaaatgagttttaagacttttttgttctggattttttatatattttttttagactttttatgaaaatttcctccccgacgaaggtgttgctccccgacattttttaaatttctacagccatccccgacaaattatttcggggaatttactccccgtacccgacattttgctccccgaaagcttggggctgaaccctattataaactatctgatcaatgagcatctattaatttaacttttgtgtttagaataatgaatatcattccttgtattgctttgtcctttaattaaattttcattttttctattcgtataatatggcaatataattaattaaaagaatctatttaacttatttcatgatacattttttcaatttttatatcattagctcaatatgacttacctcatgtaatgttgtaccctcactgtagttctgcccatgtttattaaggttttattagaaaaaaaacttgcaacctttagattatgcgtgtaataatggtttttctctttgtctattttagt

SEQ ID NO: 23302 - DNA, 1888 bp, Heterodera glycines
gggccctttgcaatgtatgtgatctctgcataatcctttcacatattctgaccctgaaaggcgcccggggcatataaaaaattaatgcatagaattgcaaaaattacgcgcctaaataatttcggtgatgcataaatgcatcaatttaaagcaagaaatccttcgaatggatctgcataacttttctaaaaatggcgcttgacgcaaacaaaaatactcttatggtgtttctaatccctacaggcgccccatgccgagttcgtcccaattgctgcaccacaatgccaaacagtacatgctgtgctgccttgccaccaaaacaatgctttattggcaccaccactgttagctgctgctgctggtgctgctcaacaacccattccaccgctgccgccaccgcattcatcggccatgctgttgccagtgccaatagtgccaacaacatcaacaccagtggctgccatgcctccgcttcggccgcaacaaattggtgatggtggagtcagcggtggcgattgcgaaaaatcacccattaataataataacaacaaaattggcggtaacaatggcgattgttggagcacagctgtgacaggtgtgtgtcggaggactctcccaatatttcaggcccgtaggcagaaacaacaacaacaaaaaaattcggaaggcgggaatccgaagacttttttttccccaaaaattcgtgttattttaaaatttacagcgccatgcagaaaaatcaggaattttggtcgtttttttgccaaaaaatgacaatttggccattttcgtttcaatgttcaaaaaatatgattaattgaacagctaaatttttaaaaccacaattttttaactaattataagcaaaaaatattatcaaacttttgaaaacgccgaaaaaatgataaattaagagatttttctttgtttttaacagcattaattaattctctctgtttttcaaaaaaagatttaattattttagcttattgttagatagaaaaaaaattattattagaaaattttttttttttataaatttttgtaaaaatattttaggttgggaacaggcggcgatcatcaaaaacaaaatcggtttgctgatcaacggacgctttcgcattttgcaaagcattgcctccggctcttacggcgaaatttttgcggccgaagacttacagcagcggaggcaccgagtggccgtcaaatttgacggaggtcattataatgctaatggacccaaatttagtcgcaaatttcgcgctatttttttgttgtatttagcctgccgcgacaaccacttgagatacgagtatcaggtggagttttgtgttcttcgcttgaatagggcattaaatttaaaaatgatttaatatcgcaaatcaaaggtgtacaagtctgctttgtatgaggatgggaacggcaaagtggacggctttccacaagtgtattggtacgggcacgagtatggccataacattttagtgagtcaatttgttcggcgaaattgaattgtgcatcaaaggcttgctgattcgcggaatttctcaatttttgaataatctattcccgacgcccgacatttgcggcagcggtccgacattttgcgcctttgtccaaaatcgggttcaaaattatgttttttcaatccctgatcgcataaacagcattaaataagcgattgaaaatgattgtagccgatcatttgatcttcaaaaatttttttgaaaaaataataaaattttcaaacaacaaattattgatcataattaaccaaaagaaagtgttttcttaattttaatgctgattaggccttgaaaaaaaattcaactttgagtctgattttgggtataggcgcgaatttcggggccgcaaatgtcggggctcc

SEQ ID NO: 23303 - DNA, 1422 bp, Heterodera glycines
tatggaagttttgtttctatagactgcttaatttgccttctattatgtcttcgccttgggattttaattgcaaaatcattcgatcaattagtaaaataaattttcttaattcaatcgtggattcaataggccttttcaagttacgtaattcactgtgaagattttctctgattaattcggggttaccgtaacgtgatttcagcaattttattattattgggtaatttttattaataagggggtatggggatacaattcgataaggctcatcatgtaacagtccacgaaggtacttaagtttttgtatattttccatgttcggatcattatgtactgaggatttaaaatcgtcccaaaaactgggccattgggaaaattttcccgaaaaatgagttagagtttgtgccggaagctttattcttgatcgttgatgagcaaatggtatgcgattacgatgtatttgatcacttgaatgcatttcttgtgattcgtcctcttgatcactatcatattctttttcatcttcatcttcttcttctccggcttcttcatcatcgtttaattgctcttcatcaattgattcattctcttggtcggattctgaagggaatttggtttgagcgctttcagccttctttttacctccaaatttatatccttaattgtgtcaaggatttcgtcaatttccttaattgtttttaaataattatgcttttcccggaatattttttgtagtttccattcactgttccattctgttttattcatttgcctcattaaattttgccatttttggtgcaaaatttttaatttttcaaaatttggttcaattctttgaatgatttctttagttttattaaaaattcgagaacaatcatcaaaattatttttatcatactcaaaattcccttcttctatttttgacttaattttctgtatttcttttattaacactcggttaagtaacggtatttttgctctgagttgacccgacatatttaaaaaatatacttatgagttgaaagtacaagaattggatgatagcaatatggacctcactgttttttaatctgcttagatattcgattttctattctcttgagaaattttgttaatttgatttttctttggtccgtttcgattgagtcaattatggtttgttctgttgtgtgtaaaaagtctgatagtatgctatttgttacttcttcagaaattgtttgacagaaaatttctatattacggtgtgacaaatttttgtgtacatgcacagtgagagcaatagtaattttaaatatatatttagaaggattaaatttaaattttttgactttggtaatattgtcttgattaatggtaaaataatttgacaatggttcagtgattaaagccccgtagaaattttcaaaaaataaatcgtcttga

SEQ ID NO: 23304 - DNA, 1653 bp, Heterodera glycines
aaaaattaataaaaataattttattttgtgtgggggttcattcgaaccaattcaaaaatcaaaaaacgattggagcttcagctacaaggttaatgtttctgtttgttttctattttaaaagaaatgattaaattattatttattttcaaataaattttctttttctcccaatttaaaaaaatattttctctcaccaattcacccaattgaaaaaccaattggatattttcattgctttggaaaaacctgcataggatacgtattgatttttacgtgtaaaatcgcgaaaataaattatgttattgcatttttgcctaggggtattcacaattcattcaaaaatatcttatataataaagttgagtgtctgtatcatgtgtccagtgtttgaatttgtgtggcgttttgtttgagttttgcgttagaaaatgatttgaaaaaagaaatgtttggttttgctttttaattttcgttttgtcagtttttgcaaaaagcacagttaaaataaatttctcttttttttcgtttttaatgacaaaatagtttttgtatgtttattaatgataatgaaatcgcaatgaatgctttctattgcatttcttaagagaaaaagtttttgtttttgttattatcaaaaagcgtttggaaatgaatgctcttaacacttttgtaaagaaaaagaattgtttttgtatatgcaaagtcaatggaaatgatcttacacttagttttgatattgtattgaaaaagttttggttcgagaaattgtttgaccttgaaatggagtttttttgtttttgtaattaaagcggatgtcaattatgcctcttttaatggatacggttttaattggatggatttatcgcacttattgtttgttttgacaaaaataagtttcttttaacgatataaggtcagtttatttgttctttttttgtatgtagatgtttatgtaaaagaaattattaaaatgtaagagaacaagtatttataatgaaaaggattttctacgcaaattgtatttcataatagaaatacgtttttaaaattccaaaattatgctgaacaggtctgaattaagtcccgtgattgacatgccgatgaatccgtaaaattgagttcattgtttggaatagtgaaggattgagtcctcggtgattggaatggcggagaactgagtcctcggttattacgatgccgaagaatccgtgaaaagtgaaggattgagtcccagtgattggaatgcaggagaacagagtcccagtgactggaatgctggtgggattgagtcccgggaattggaatgatggagaattgagtcccagttattggaatgtcgcagaattgagtcccggtgattggaatatcgcagaattgagtctcgatgattgcgatgccgaaggaccaggtgaggttaggtcccagtgattggaatgcaagagaattgagtcccagtgattgaaatgctggagggttgagtcccagtgattgaaatgcaggagaatgagtcacggtgattggaatgcataaaaactgagtccgggtgattgaaacgcaggagaatagagtcccagtgattgaagtcctggagatttgagtccctgtgattgaaatgcaagagaattgattcccagtgatggaatgcaggagaat

SEQ ID NO: 23305 - DNA, 1844 bp, Heterodera glycines
  misc_feature (1356)..(1356): n is a, c, g, or t
  misc_feature (1359)..(1359): n is a, c, g, or t
  misc_feature (1362)..(1362): n is a, c, g, or t
  misc_feature (1367)..(1368): n is a, c, g, or t
  misc_feature (1373)..(1373): n is a, c, g, or t
  misc_feature (1375)..(1375): n is a, c, g, or t
  misc_feature (1381)..(1381): n is a, c, g, or t
  misc_feature (1383)..(1386): n is a, c, g, or t
  misc_feature (1389)..(1390): n is a, c, g, or t
  misc_feature (1395)..(1395): n is a, c, g, or t
  misc_feature (1405)..(1405): n is a, c, g, or t
  misc_feature (1410)..(1410): n is a, c, g, or t
  misc_feature (1412)..(1412): n is a, c, g, or t
  misc_feature (1418)..(1418): n is a, c, g, or t
  misc_feature (1432)..(1438): n is a, c, g, or t
  misc_feature (1441)..(1441): n is a, c, g, or t
  misc_feature (1448)..(1448): n is a, c, g, or t
  misc_feature (1451)..(1452): n is a, c, g, or t
  misc_feature (1455)..(1455): n is a, c, g, or t
  misc_feature (1457)..(1457): n is a, c, g, or t
  misc_feature (1461)..(1462): n is a, c, g, or t
  misc_feature (1465)..(1465): n is a, c, g, or t
  misc_feature (1474)..(1474): n is a, c, g, or t
  misc_feature (1476)..(1476): n is a, c, g, or t
  misc_feature (1484)..(1484): n is a, c, g, or t
  misc_feature (1486)..(1487): n is a, c, g, or t
  misc_feature (1490)..(1491): n is a, c, g, or t
  misc_feature (1493)..(1493): n is a, c, g, or t
  misc_feature (1498)..(1503): n is a, c, g, or t
  misc_feature (1505)..(1507): n is a, c, g, or t
  misc_feature (1509)..(1510): n is a, c, g, or t
  misc_feature (1513)..(1514): n is a, c, g, or t
  misc_feature (1516)..(1516): n is a, c, g, or t
  misc_feature (1519)..(1519): n is a, c, g, or t
  misc_feature (1525)..(1525): n is a, c, g, or t
  misc_feature (1530)..(1534): n is a, c, g, or t
  misc_feature (1537)..(1537): n is a, c, g, or t
  misc_feature (1543)..(1545): n is a, c, g, or t
  misc_feature (1550)..(1553): n is a, c, g, or t
  misc_feature (1556)..(1556): n is a, c, g, or t
  misc_feature (1559)..(1563): n is a, c, g, or t
  misc_feature (1566)..(1571): n is a, c, g, or t
  misc_feature (1579)..(1581): n is a, c, g, or t
  misc_feature (1586)..(1586): n is a, c, g, or t
  misc_feature (1589)..(1589): n is a, c, g, or t
  misc_feature (1600)..(1600): n is a, c, g, or t
  misc_feature (1602)..(1602): n is a, c, g, or t
  misc_feature (1607)..(1607): n is a, c, g, or t
  misc_feature (1611)..(1612): n is a, c, g, or t
  misc_feature (1619)..(1622): n is a, c, g, or t
  misc_feature (1624)..(1626): n is a, c, g, or t
  misc_feature (1633)..(1633): n is a, c, g, or t
  misc_feature (1637)..(1637): n is a, c, g, or t
  misc_feature (1640)..(1640): n is a, c, g, or t
  misc_feature (1642)..(1643): n is a, c, g, or t
  misc_feature (1648)..(1648): n is a, c, g, or t
  misc_feature (1650)..(1650): n is a, c, g, or t
  misc_feature (1654)..(1657): n is a, c, g, or t
  misc_feature (1663)..(1666): n is a, c, g, or t
  misc_feature (1668)..(1670): n is a, c, g, or t
  misc_feature (1675)..(1678): n is a, c, g, or t
  misc_feature (1681)..(1681): n is a, c, g, or t
  misc_feature (1684)..(1686): n is a, c, g, or t
  misc_feature (1689)..(1690): n is a, c, g, or t
  misc_feature (1692)..(1692): n is a, c, g, or t
  misc_feature (1696)..(1696): n is a, c, g, or t
  misc_feature (1698)..(1698): n is a, c, g, or t
  misc_feature (1707)..(1709): n is a, c, g, or t
  misc_feature (1711)..(1711): n is a, c, g, or t
  misc_feature (1718)..(1719): n is a, c, g, or t
  misc_feature (1725)..(1725): n is a, c, g, or t
  misc_feature (1727)..(1727): n is a, c, g, or t
  misc_feature (1730)..(1730): n is a, c, g, or t
  misc_feature (1737)..(1737): n is a, c, g, or t
  misc_feature (1744)..(1744): n is a, c, g, or t
  misc_feature (1759)..(1759): n is a, c, g, or t
  misc_feature (1769)..(1770): n is a, c, g, or t
  misc_feature (1776)..(1776): n is a, c, g, or t
  misc_feature (1781)..(1781): n is a, c, g, or t
  misc_feature (1783)..(1783): n is a, c, g, or t
  misc_feature (1785)..(1785): n is a, c, g, or t
ccaccgccgacagtgtcgcggttcttacgccgaccattttctgttcagcaaatacataatcgaataatattttaggacaaataaataggagagtgaaacaaaagtttcggggatctcgacaaatgataacggttatgttgtaaatttttggcactttttatccataaaccaaaaatttatatattttttgaatattattgcgcaaccgacctgcatgtggaggaggccgactggtgttgatgcgcgggatggtgtcattgtcgttgttatttggcaaaaatttctgcacacgtgtcgacgtgtactctctgatctgctccgtgctgttactgccgccggcgagcagttcgcgctcattgggcgaggaggaggactcctctggcataaacttgggcagtatggacagagaaatgtctgtggtgaggggatgaatagttttaatgttcgttgtaacggttaaaaattaacggcaatagtaattattgaattcaatattccgtattgcactctctaatagaaaaaagttttaaaatactggagggaaaaaataacaatttcaaatacatgaaaaaatatttttcaattagtttaattggaagtcaaataattcctttaagttaaaattgagttttctctatagttcatttttattcattgcattaaataccattgccagaacgctgtacgataccattattcgtttcatcatacagcgagccagtgctctgcagaaaaaaatttatttgttaaaaaatatataatattaaatgaatttgtataatttaaaagtacatttaaaaaatctatttgttatataattgtaatacataataccatgtccattttgaaggtttcgaacagttcgcccatcaactctcgcgccacgattagtcctgcatggctttcaatgaaccaaaaaagtaggagctaaaaaagagaatgatttggcatttttaggaaattaatataatttctaaatttaaatttgtaatatttaaaaaaaaaatttgagttaaaatttgccaaaaatgactgcagcactcggtggtgttggtcgaaccatttaatttttagcgaaacagaatcattaatagcttttttctcatcgccgtgcaaaaaatttaatacacatgcatccaaactgtacaacaccaccatgccacatactcactccgtccttgcgcagtgcgtgctgggaaaagcggctgaaaagtgggtgttcatggtgtttgttgttgtagaaaatttcaagatgcttgtcctgcatcaacatgtcgcggaccgagctctcctgcgtcgacggaagcagcagcagaacaaaaacatagtaggcaaaatttactgcagtaagccctncgntcnggccnnggccntncctggngnnnnggnnccggnttttttggcncttcntntggttnctctccctgctccnnnnnnntgngtttgtnttnngcntnttgnnccnttgttttgncncgtttttntnnttnntnttttnnnnnntnnntnngtnngnggnttcttnttttnnnnntcntgggcnnnctgcnnnnctnttnnnnntgnnnnnnttcttctnnntttgnctnttctttggtcngntttgncgtnngttgtcnnnntnnntttcttnttcntgntnngtcgntntttnnnncccgtnnnntnnnttttnnnntcnccnnntgnncnggtngnttgtctcgnnntnctcgttnntgcggngntgnccttggnccgtgtngcgtgttgtgcccgncaaaagatgnnttttcncgtcncncntcgtctgtcgtggaaaaaacagggagtcctaaaagcacacaaaaagggggaaggaaata

SEQ ID NO: 23306 - DNA, 675 bp, Heterodera glycines
acatttattttgttttttattgtgtctgcaggcagggccgaaacacattttctttagcattctgacagggtctgtactgatgaggcccgccctgtcataatgcaattgctttacaatttaaaagcaaagattactctattccaacaaaaaaagcaaattctttcaaagttgtcgaaatttgtccgattaaaaaaatatcggcggcgttttgtcacggcaaagttacgacggcacctttttgtcctgttccgtgttcgtcgacattatgggactattgaatgtctcgtgccacgtcttgtatagctaaatatgcaaaaatcgccctcaactttaacaaatatttcgccaccttagcgcttttagcttagtaaaaaattttttaaataaatcaacataataatagtccacaaagtgacaaccagggatgcaaaaaacgggaatcggtcgttttgtcaagaaattaaattgcatttagtataaatttatcctgaaaatttgagaaaaattcacttttccggaattgttctaatgctttgtatatgtcggcacagctaatttgtttgcaaatgccaatgaatgttatttctgccaactcttcctcgccaaaattgccacttgtcgtcttgtataatatggcatctcaaaatttgatgtgaatttcctgctggtcttatc

SEQ ID NO: 23307 - DNA, 931 bp, Heterodera glycines
taaaacaaaataaccaaaaatatacttttattgtatttttatcgttaattaaagtaaaatttactcattaacacagcaataatttctttaatcgtttaaaatattagaaaaaataaatattttttagaaaacatttttttcccgtttccggcaggattcccgttaaaattgacgggatttttacgggaacgggaaaaacacgggaatccagttcgggaatcccgtcccgttctttttcgttttcccgttcccggaaaattttttttaccggactctaccagataccatgaagcagagacctgatcaacgtggtataaatgacttttctgaccaacatgaaaagttggcttaacaagaatttttaagggctttcggtgtgctcaaatttgaggctcaaatagtgcttattaatagggatgagaatttaaatcaagaaaaatcttcaaaatatctccaaaaagtcatgaaaaaatgcaaaaattaatgaaaattagcgaaaagtaaaaaaaaaattagatagttgtccgttaccaggtcccggtcccgctcaactctaaaaaaataacctattttggaagtaattatagaaatgtatcattttataaaaatgattaatttgtgatcagcgacaccgaaaactcaagtatatttttcattatattcaagcacagaaaaaataaaaaccagtccttggcgccaaaacgtggggcaaaacgaccccgactctttttttgactataacattttatttatttttaacccgtcgacattttggctggtgagattttctcctgtttcgatttataagtgttgctccagagtccgtatacgtttcactaaatcctccattacattatgcattaaaaatagaatacggctgacctattttcaggtttttagggactcgttgcccaaatccgtatttttagac

SEQ ID NO: 23308 - DNA, 1512 bp, Heterodera glycines
  misc_feature (1462)..(1462): n is a, c, g, or t
ataaaggggtcgacgatgcccatttgagaatggaaaaaaagtcgactcgcgaagcgatcggcgaacaaccaaagttttggacggaatcttctgattattgaaatttatgaaaaagcgatcaaataaaaatattaatgtaatttcattttaaattgtattgtatgggtttatttttttaaactttggttattattagggcacggatttttatgtatatccatattctttttcaacttatttcggcctaaaaatgaagtaaatagtatttttagcttggtttgatgcattggatgtctttttatttccatatttttccatctttcatattttgttcatatttccatattttacttcattatttaggcatttccacaaaaaattcgaaaaaggaactcctaacgatggaaatttttggaacgtccctaaaatcaaaaatttttgaaataaatatcaaaaattaggaaaatttttgagaaaatatcgcgaaaaaaaaatttttttttttttttacaaaaattacgtcaattttttctccgtacttaagaaataagaggtctcaattatctaattctatattcctgttttaaaatttttttttcttgacagaaattttatgggtttaggaattttttttcaaaaattcaaacctgttttcagaattttttgtccattttttcgtattttttgtccatatttcaacgttttggtccatattttggatgtccagcatataaatccgggccctagttattatccttatctcatttttaaaaaaaaatttccattaaaacttcaattatcagcgaaataaaatcacatttcattttagcagaatttcttcgtgttaccggtcctctcaggtcccggtcccgttggaataaaggacaattgaaaaaaattaattattttaaagcaaataaataaaatttgtgtttatcctagtggctagctaaacttatgtctttcatttttatttcgtttaatccccccattagaatatgagagtttttcaataaatattcaataaagtacaattgtaattaacaacgtatattatatttgaatttttttcagcttaaaaattttgaaaaattcacatgctgaatggaacccactcattgaacagcattaacaatcgttatggaactgtaatttttcatatgttaaaataaacagatatctttcatcagtagagaccggattttatgtttttacttttttttgggcttagtttggcgagagaagccaaaaaataacattttcaacgaacaattttttgatttagagcgacttataaatacataaaaacacatttttggcgctcgcacacatttgggcgattttggaattttagcacctcttttggcattttttggaaaatctataaagaaaaaacaagaaaattgaaaaatacacccctaaaaatcaatttcttgcattttcttattttgccttttttttngttttttgcacatattttattacatttttcaagattttttgggggcactg

SEQ ID NO: 23309 - DNA, 553 bp, Heterodera glycines
tactgaagtgtactttttgagcacgcttcagttgccccccctcggggccaggggtttgctcaaaaaaatttttaaaaactatcaccttgtagaggacccttaggcggagtgccctctcagcgggcactttttgattagagtttcagaaaaaaagttacgagccgtcaaacgcacgaaaaaatgagaaatcagtccctggtactcagttggcccttggaccggaaaacctatatttttcccggatgcgcctcaaaaagttgtaagacccttccaccactttcagggcgctcccggccttcggccgggagaaaatggttttagcaacgaaactccttgtcaatataacgtatatagtaactagcgggtgcgtgaaccgtcggctatttagctgggaaaaagcgcttcgcgctttgggagcttcgctacctagataagctatgggttatgaagatatttggaattttaaaagattatctgggatttttaggccgcttcgcggcctcgaacgggcgctttgcccccgtttttcatattttgttttgcttttgacggg

SEQ ID NO: 23310 - DNA, 1193 bp, Heterodera glycines
  misc_feature (1108)..(1108): n is a, c, g, or t
  misc_feature (1130)..(1130): n is a, c, g, or t
  misc_feature (1135)..(1136): n is a, c, g, or t
  misc_feature (1150)..(1150): n is a, c, g, or t
agcgattagaagagtgattagaagaggttcaacagcgattagaagagtgattagaagaggttcaacagtgattaaaagaggtacagcagtgattaaaagaggtacagcagtgattagaagaggttcaacagtgattaaaagaggtacagcagtgattaaaagaggtacagcagtgattaaaagaggtacagcagtgattagaagaggttcaacagtgattaaaagaggtacagcagtgattaaaagaggtacagcagtgattagaagaggttcaacagtgattaaaagaggtacagcagtgattaaaagaggtacagcagtgattaaaagaggtacagcagtgattagaagaggttcaacagtgattaaaagaggtacagcagtgattaaaagaggtacagcagtgattaaaagaggtacagcagtgattaaaagaggtacagcagtgattaaaagaggtacaacggtgattagaagaggacaaaaaaaatgcattaataatttgaaaatattttttaacaaatttaattaaaaaaatagatgaaattctatcaattaaaaaaataattaatttaaacttataaaatttatttatcaaaaaaaaattaatttaaatataattttttatttattaactcaacaaaatattttaaattaattaaaagcattaaaataagcaaaaaataaatagaaaataatgtacaccgcccggattcgaacttgccccccgccccctcaaaatgatgcctcagaatccccaatcacacagggattctaaggtcttaacgatgtaacaattgaaatctgatcacgtattcgtgatcagcggcccaaataaccactaatgacatgtttttggaagatttttggtgaaaaaaattttccactcaaaaatcctggtcacccccctttggtctggaatcccaaaatcacttttatttttataacatttttcaaaaaagtgataaaaatgtgaaataaaatttatataatagagcaaaaaattgcggatttttgtagtattttacttttagagtatgacttttcagaaccgagttatgaatttttttctgaaaattcgaatttttccagaaattctggaatactntttttctttttgacatttatanaccannataatctcataaanttctcccgattttttgctatttttaaagctttaattcacttaa

SEQ ID NO: 23311 - DNA, 2901 bp, Heterodera glycines
cagtgtcaccgggactaagtgaccaggcacagaaatggttgttgtccgaagcggagaaatattcttcactgctaatgaatattgtacaggtggcagtataaaatatttgagattaattataagtaatttatgataaacagtgatcctcaggttgatttatttattttttaatggattttgtttttatattcatctgaaaaaatttaatgggtaactgatatctcgagataaaaattgaaaatttctgactgacatgaatcccgagagattttgccgtgactcccgaccttgttttttttgagaaaagggcaggaccgagagttacgtgagaaaggaactaatccaggatgtctataagatctgaaagttggaattttcaattaaatttaaaaatatcaattgagggtatgtgattagtatatttgaattggtgaattattattcattgttaaatcttttttctctatttattcctatcagatcaattacggtgccgcggcgggtgccctacggtacgtggaactgatgggactgatcaacttcgctttcatctctggcacaaaacaccgccattttctcacttacatttcaaatgtgttggatccgaattttgacagagtgatgcctcccgtgctggccaaaatatgcaccaaaggcccagtggaattacaccaattgttaccctattaaaaatggcatttatctgctgcacgcattttctatgataaaaatgaggcaatttgcgcgattgatattttgaaatgcgacttcattttgattttaaaaaaaagtcggttttaaatagagcccggcggaaacgaattcccgcgggaaaactcgggaattccctcacagaatcgggaccccttatgttctattgtatggagaaatttctgagaaaaattatttagttaatttctgcaatagaacaatgtcctgttgtccttcaccagtttttttatgttaaattattggtaaattttccagacttaaatatttaaacaattaatttacatttctttactttttaaaacaaactaaaattgaaaatcgaccctatgattctttaatttttatttggacattttttggagaaaatctaatcaaatttagcaaaactttcattcatttttttaatgtgtgttattttttgatatttggcgttttttttttttttgctttcattatgatgtccttagagagcgtgattttgagaaaatacggatcaggactaggattacggactagccattcatacggattacggacttacggactaaaaatccgtaaaatccgtatccaggaaaaatacggatccgtatacggataaggatttttttaatttttttttctttttcaataaaaaatgatttataaatacgaatctcggtcttaattttacgaaataaaaaatgctcaatttttgcttttcatcccacttttttgcggcgcgcttttcccaaaaagatttttgaggaacggggggggggggggggggcggccgtttccccctagacgccgccgggaaaaattttaaaatgcaatttattgacagattttatcggccaaatttgcgctttttaaccgatttcatgaatttttatcagatttcattaaaactatctataattttgaaaaatttacaaaacgaacttatgtaaaacttcataaaaatttccaagaaatctaaatcaatattgtaaagatttcgagtttttaacataaaacgtttgcttttttccaatttagtaaaattttccaattgactgcacaaaatttattaaatttcaccttaaaaatgttagaaaaaaaaaatccgtaatccgtatcataatttatacggatcagtatcaggattacggacttgcatagatacggattacggatttaaaaatctgtaaaatccgtagtcagtaaaaatctgtatcgacccaaaaaaacagggattacggactacggatccgtaaaaatccgtatacggatccggtccgtacacgatctctactgtcccttcttaattttgtcgcattgtccattccttcccagcagaaaatgttcccccgtcgttcgttcaatgcattcctttttcagtgtaacatcatatatttgtatttggtgatttttgagttttatttttaaaactttcttcaaaaaagagataaaaatataaaataaaatacctcttataattcaaaaaattgaatgatttttctaatattttaatatatgaaaactccctttcagaatggagttctgtattttttctaaagaatcggaaattttcagaatttcctgtaaatttttttttcatctttacgctagaaaaaccaaataaaacacataaaattctcccgatctttctttattttttaagctttattccactaacattttccaaacccttcgccgtcattgaaatatttgtacaacgaagaaaagcagtgcatttccccgacaaccagcttgttttacacgaaagttatctcaaaagcacaaaactgttgacatttttggacaaattctttaactaattaaaatgtatattcaataaatagtttttgagcccatcattagagaatgtgtttttcacgttgaaaaatttcaaataaaatgttgaaaacaaaaaaatattttatatttttatccccttttattattgcattaaaacaactaaatttctcgcttatggaaaattgttcatttttaagatatgtttttaaaaacatttggttttatgctgcaatataaaaaaaatttttgataataaaaagtagtaataaaataataatttcgctgaatattgattttaaaaaatgtttaaaataaagctaataatattgatccaaatggatttcaaagaaaatcaacatcacttatccatcatgttttatttcattcatt

SEQ ID NO: 23312 - DNA, 987 bp, Heterodera glycines
atttaagcctaaaaaatttgtctgattattttaaatagtttttcaaaaaatcgcccttataaattgcattggatattttcaagacaatttagtcctgtactggggagtatccctgcaaaaattcccgaagggttctgatcgcttttccaaaaattacttggaattaaatttttactaaaattataagcctaaaaataagtctgattattttaaatattttttcaaaaaatcgcccttataaattgcattggatattttcaagacaatttagtcctgtactggggagtatccctgcaaaaattggtggggttctgatcgcttttccaaaaattacttggaattaaatttttactaaaattataagcctaaaaaataaggttaattattttgaatattttttcaataaatcgcccatttccggcactatgccaagtttgggcgggacagacctaacggggagatataaagtatagggaatatcaaatctattcccgaaggattcatcctcccgaaactgtctgactgttcgaaaaaattttttaatttaagcctaaaaaatttgtctgattattttaaatagtttttcaaaaaatcgcccttataaattagcattggaatattttcaagagaattgagtcatgtactggggagtatccctgcaaaaattggtggggttctgatcgcttttccaaaaattacttggaattaaatttttactaaaattataagcctaaaaaataaggttaattattttgaatattttttcaataaatcgcccatttccggcactatgccaagtttgggcgggacagacctaacggggagatataaagtatagggaatatcaaatctattcccgaaggattcatcctcccgaaactgtctgactgttcgaaaataaaaatttttactaaattaagcctaaaaaatttgtctaataattttgaatattttttcaaaaaatcgcccttataaattgcattggat

SEQ ID NO: 23313 - DNA, 1274 bp, Heterodera glycines
caaaatatcgaatcgccttaaatacatgaaaatacgaaccgcgaaatgtcatcatccctgggatatagtatgtaacattctatgtaagaggaaagttatttttatttaaaaatttttgtctttttacttaatgataaaaatgccagtttgcaacaaaaatcttaaaaaatgttcaaaaaagaccgatatgtgaaaagaattgaatgagaaaagaaggaaataaatcacataagaatatccagtagaccaggccacaggagtgataaatagggacggccaatatagctaggctttagactctaaaaaccccaaaaataggcactaaaaagtctcaaatttaggggtgtaaaatgaacaaaatttattgaaaaacgaaaaaaaattaagccaaatcagtattgagttacattgtttttttttttttgaattcttctggccccttttttgaatctaaacgaaatttttgaaatttgcaggctactaggtgacacttagggctaccgaatgataccaagattgttggatttggttggcaaagaaaaaaattatagccaaaaacttgtgctcgtatgaaaacgaccccgacccaaattaaatgcattaacattaaattgtacgccaaaaacaaaaaaaccaaccaaaaattggacttttcttgaccaaagttggcaccaaaaagccatcaaatttggcctcaaattgagctccacaattgatttcgccttgcaccattgacgcgtattcgttggtcttaaaatttgcatttatgaatttaaaattattttcaattttaaattgagaaaatgaataaaaatattttttttaattaccgcttccggcgactgacactcgcgcggaatgggcgaaattggccaggcgggcaatttgttggcgaaatgtctaaggaaaacaacgccaaaaacccataaaaaatggtggcgcccaattaatttaccgtaatggcaccaaatttccgttgttggcatgcgcaaccgtagccgacgattggctgttgagcattaggggcgtctgtgcgtctaaattttaaaatattataaaacttttgaaaaacaaaaaaaggaataattaatcaaaaaacaaacaaacaattgaaacagaaatatttcaaaaaaaactttttaaatttttcataataaaattttaaggaaaatttttttgtgaccatagtaattttcatcggtaatttagaaaaatcgttagaaaatttcaaaatcttttgttttttgaacattaaaaaatgtcggagggggggg

SEQ ID NO: 23314 - DNA, 2987 bp, Heterodera glycines
  misc_feature (5)..(6): n is a, c, g, or t
  misc_feature (29)..(30): n is a, c, g, or t
  misc_feature (2802)..(2802): n is a, c, g, or t
  misc_feature (2824)..(2824): n is a, c, g, or t
atcanncggtcactgattcacggtaccannattcacggttccttcacttgaaaaatttacactggataaaaccgaaaaattttaccaattacatattgttttcatatagaaatttaaagccttttttggcatgatgatattttttcattctattttaatattttttcatttttttagtggatttttgaacctggaatttaattacacttttagaaatatggattttgatgacgaagtttttgatccaaatttaaacatcgatgagcaaaacaacactgaagcggaaggacaaattgttgagagggaaagaaaattggaaattactgaacccccatcatcgcttagacactattttgtctatgtaaaaggacaaaatgatgccaaatgtcgaatctgttcaaaaaaactaggccggaaggatgggacaacgggaggaatgcttcgtcatttgaaaagtgcacataattcattgttcaaaaaatacgaaaaagctaaatcaacaaaaactgagacaaaaaaacaaacaagaacgagttcatcattcgcagggccaccaccaaaacaactccgcatggacgaattgcatgtagtgaatttatttactttttccattttccatttatttttagggaaagaaagcggaaaaaacggaaaaatcgccagaaataattgacgatctgcttttgcgcttcatttgtttgagctgtcagcctttgagttttaccgaacaaaatggattttcggattttttaaaagcagtctgtccaaggtaatcaaatttaaatctcaaaacccaaaataaattttagttatgaattgaaaaaacgggatttttttacgcgtaaaatggaagaaaaatatggccaagtcttttctggtatcaaagagttgatgaaaaatgtcaattatttttctttttccactgatatttggtcaaataagcgaaagcggaacagttttttgaggtattttaaagtaaatattagccaataaaattcttgaatagtttgacagtacattatattgatgaatcgatgactcgccgtttttttgtgcttgccactgaaccatttgacaatgcacacacaggccaaaatattgctgaatgtttcagacaattgttaaatcaattcgaaattcctaatgacaaggtgcatttggtggctacatgtcgtttcaatatatgtcatttcaatactcagtgaaaatgtgtcatttcaatactaaatcgtttcgattcgattcgtcgctcaattataacgtcttttcgtgactgccttatgttaaccgaaaattttaataaataacaaaaaatgataaggacaaaggtgagaaattgattttgaactgggctttttgagcaagaaaagaaagaatcgataaatcggtagaaatgcaaaaaaagaagacataaatctagggatttggcttttgttttgaaagaggcaaaatttgtatcactgatcatctgattcattatcaccatcattttcgtgacgaagaacgggaattgcttgtacatatgtctgcatatggtgcgataatgtctttaaaacccctcctagactgggggataattgtagattgggggattaatggagattgggggataattagagcaaatacggtatgtcaaatccaataaaaatatcgaaaatggagcattttaactgagtattgaaacgatttagtattgaaatgacatatattgaaacgacttagtattgaaatgacatatattgaaatgacgtatattgaaacgaagtgcaccggcatttggtgcttagagatgcacagtcttctatgatttctgggatggaatcgcttgaatttgagcattttgattgcatgatccataaaatgcaattggtaagacttcctatctaatttttactgtcctaattaattttaatttatttttttcttaggcaattcgagacggaattgatcatcctaaaaagggcgttaaatcaatttgtgaaatgttacaaaaggcgcgtaatgattgtcgctgcaaaacaataagaatttaaccgaagtgccaatttccgagtctttttgtgaacaacaaaaagcccttggcatggcttcaaacgttttgttgcaggtgtcaactatttttatttaatccattttttataacaaggatgtctgcacgcgttggaattcatcatacattatgcttgaacgtttgtatgaacagcgccgcccgcttatgcttattaacgaagaatacaatgatctttctttacctgattttgagcttgtaaaaaacatttgccaggtcctttataataattagtcttattgatttatctaatttttaggttttaaaacccttccttatatttacaaatcaattatcacaacgtgactaatcgctttcgtcagttatttcggtctacaaatgccttcaaaattatctccgtgttaatggcgaagaaaatgagcccattctgagtttaaaaaatgtcataaaagatggattagaatcccgtatgcgagaacaccaatctaaaatgtaaattttggattcttatttgtcatatttgctaattataatagtttaagctttttgcgcatggccactctcgttgaccctcgtttcaaaaacaatcctaacattttctcgacaaaagaacgagctcaaaatgaagtgttattgcttgaaacagtaaaaatggtaacgaatccatcacgtcgagggtctgattcggaacaaccgaaaataaatagcgactcgcctaatttgttggcattttttattggcgccactcagtcgattgagtttgctgattctcnaacaaacaaaattcctgatganatgatgctctaccttcaggcacaaattaaatttttttaataaatagaaaatttagtcgatacttcaaccgttgtaatcggacccactgcttttttggaaggaaactcgcaattccctacataaaaagcttgtcccaaaatttttatgtcaccctccagcagcg

SEQ ID NO: 23315 - DNA, 960 bp, Heterodera glycines
  misc_feature (878)..(878): n is a, c, g, or t
  misc_feature (892)..(892): n is a, c, g, or t
  misc_feature (901)..(901): n is a, c, g, or t
ttgatattggtggcaacttcacaaaaactccgtcgctttcaacgaattctcacactcatcgcaaattcactcgtcggaaaagcgacgcgcgacccgccggccaacaaatcctccattgttttttgtctgcctgtcacttatttttgtgtgtgtgccaacgacagccttaggccttggcattcattgccttcggtgctgccgctgctgactgaggtggtgctgttgctgccggtgcccgtggaatgttcggtggcggcggttccgggaagggccgtggctccttccgcaagtcaatttacaagcagctgacgcggcctaacacggccagcagcaacaacgacaatagcaacaacaacaccgcttcgtctccctcctcctcttcctccgtgtcctcctccatcgaagcccaaagaatgacgggggtcgcaactccgaggcatcgtccgcccgcgctcactttcagcggtccgtccagcaccatgcaacaacaaaatgctgtggggatggccagcattgctgactcaaaacatgccttggccaagtctagccccgcggcgctcacgggcacggacggcggcggtaatggcacaacaatgtccccgctgttgcccccggtttgccccacggcgccgaagactcgctccgcaccggccgactccaaattgaccaacgctccgtccggtcgtcctcggtgtgtgagtgcgtggagttactaccaacagccgttccacccggcctcgtccgcgttcgccaacgcgcctctcctggagaacatcactctggtggttgatgtcaaccaaacccgtggcggttctcagtctggtccgccctcctcgcgctcggtcggccggagcaacgccgcgcgtcgaatggtcggncaagaaacaatggngcatcaccnacagcagcaacaacagacgcagcagcagcaccatcgcagtatcagcgcatcgccacact

SEQ ID NO: 23316 - DNA, 855 bp, Heterodera glycines
tgttgacgccacaaagccaaaatagtcagaaaaaaacggataaacaatgaccaaaaggtctccaagaggatttgctgcgaaaatggcacattccgccgacgctgccattcggggatcggatttaaagcggattttgttaaggaatagccacaaattttcaaaaatctcccggcatttaacagtcgctttaatatccgtataaaacgaaaattcggccccgaatttgcttggaattcatttactttgctcgcttccttttcagccttcacaaagctgcgcaacttttgtgcgaacacaaaatccatcggttgcccgttttggagcattcaaccggaaacattttgtacattctgacgcacaaacggttgatcaaattcctctatctttatgtgagtgaggggcgctgcccaattatttcctaaattattatttttttccctaattaccactaattccccccccccccccattccgctgctgcttcttcagatcaacgatttgccacggcctccgtttatggacaaaacgccgaaggaattgggcatcggttcatggggccacatttgcacgattagcaaagatacgccgctgatcgaggcgatgaaaatctttctcgccaagagagtgtccgcgttgcctttgctcgactcggacggacgggtaaaacaaataattggcatttgagaaaattaaatttaaattatggaacgaaataggtaattatgtcatgatgaaaaatcgaattaaacaaaatggtcaatttatgaatgggtttttttctccggcgcaaaattaaagggaaattgttgtaggtgggagacttttttgaattttcccctgttttttttgttttgt

SEQ ID NO: 23317 - DNA, 2825 bp, Heterodera glycines
tttcattaaaactaaattaggattaaatttggtttcgttaaaataataaagacttttatgaacgggatattcaacacctgtatattctttgtccttcgcaagtgcatttttgcaaatcatggtaaaatataagcgaataaattttttttaaaaaatgataataacaaaataggtcttcacaattgccgttttagaaaaaaaaatgacgaaatgattttgcaatttgttaaagttcttaaaatttttttaagattttacattttttgacaaattttattccttctttaattttaaattaattattttcatgaagagaggtcattaaaagttaaaaaaaacccttctaaaataataatttttgtaacagaattcatacatattcatggtcagcgaccccaaaatcccttaaattttttatggcattatattttctgttactagatttttgcatcgggcaacctaaactggaaaagtgccaaatttcaattggaagttttaaatagaattttctaaaaatggactctgatttatacgatgaatttggaaattacatcggtccggagctcgatagtgacgacgatgaagaaatacaaccagtgggtggtaatgaggaggaggaggagcagaaagatgacattatggagcaggtcaatttgattgttcaaaccaaaaatcacttccacaaaaggaggatgaggaagaggacggagaatcgccagttgttcctggcagtcaaattgtgctgcacgaggacaagaaatattatgccactgccttggaagtttatggggaggaagtggagacattggtccaggaggaggacgcccaacctttgacagagccaatcgtcaaacccgtcaaactgcggcgatttcaggtggccggcattacttttccgcagaaagacaattaatgtaagcaaatgccaggcgcaagaacaccttcttcccgagactgtctacaagaaagattttctggtcgatatgacgaaccatcccgaactcatccgaaacattgccattgctgggaactttcaccacgggaagaccgcgttcatcgactgcatggtggagcagacccacccggacttctttcgttatgaggaccgagacgttcgcttcaccgacactttgttcattgagcagcagcgcgggtgctccatcaaagctctgccgataacacttgtcatgcaaaactctcggaacaagtccttcctgctgaacatttttgacactcccggacatgtcaatttttctgatgaatgcactgctgcttttcgtcttgttgatggggtggttataatggtggacgtgcacgagggattaatgatgaacacagaacgattgttgcgacatgccatccaagaacatcttccgatcaccatttgtctaaacaaaatcgaccgattgatcttggaactgaaattgccgcctgctgatgcctatgcaaaactgaaattcacacttgaccaaatcaacaattttgtacagtaagttcaaaaactcagtttctttccccaacaaaagcttttaatttatttccatcatttaaaaactttcagtcgcttgtttcgaaatgctttttcagaacattcggcgaggatgacatacccctcttctcccctctgatgggcaatgtgattttcgcaagcggtcgctatagcatttgcttctctttggaaagttttgctaatatttacgctgccaaacatagccaattaaatgccgagaaattttcgcgtcgcctttggggcgatatgtttttcgacacggcgctcaaaaagttcaccaaaaagccacaattgggcggagcaacgccaacgccgcgttcatttgtgcatttcatactggagcctatgtacaaactgttctctcaggtcccccctccttcactgtttgaccgtcgtttcgcttttttaggttgtgggcgacgtcgacacgtgtctgcccaaattgcaacaacatttgggcataaagttgaacaaagaagagcagagaatgaatgttcgtcctctcatcactttgatttgtcaacgttttttcggctcattcacctgtattttagtagcgaaaattaaaaaataagcttttgcactttagcatttgtcgatttggttgtcaacaatatcaaatctccgattgaaaatgggccgagaaaggtgcaacattgttacagcggagacgccaccagtcaattgccaacggaattggccaattgtagcccaaatgtgagtcgaaatgcgaaggaaacaaacggacaaaacattgcaataattcccacttttagggtccgctatacattcacacgactaaaaattatgccacgcaggacactacggcatttcatgtgctcggaagagtgttcagtggcacaagtgggcaaacggcgggggaagtgcaaaacaggcattttgatgtcaatttccagttcattctggcgacgaggtgaaaatattgggcgaaaactacagcatccaggacgaagaagactgtagggttatgacagttgggagactgtggctgcccgtggcaaggttggcattgagcttttccattgttttttcttttgggtttcttatttatttccacatttaggtacactgttgaagtgaacagcgtcggcgcgggctgtttagttttgatggaaggcatcgatcagcctgtgacaaaaacgtgcaccatcgttgaaaaggactacgaccaggacgaggtgagccgaatggacacgaacattgggtttaaccaaccaaaggacccacaatttggacccttcgcagcgggaaaaaaagagggggggggggggggtgaagcgaggaaatttcgaat

SEQ ID NO: 23318 - DNA, 1540 bp, Heterodera glycines
cgaaattaatctgaaggcattcacaaaagggaccaccacccaccgggcaccaaaactataaataaaaaaccttatgacccccccatcattaactcacttttccacgtgaagaaatttctttattttgggatggggtttagctaacatacataaaacaaaatttttttgttaattaatgagccctctgtaatagactcatttgtcagttaggtaattagactcaaccgactgagccctgctgctgattttcatttgaattcaatagcagaattgcattcaacaaaaacaaaaataatttgtttggacccgggacttttcgtttaggctcactttgagacaccgacaaaaaggaacaaaattctattttcctaaaaattagtaggaaaaggggaagatgttattcagtctttcaaaatcgaaattttaaaagcagccgatgtaaggtactgattagctgattacccacggttgtgttctttcacactcacctttatcttcgtttggtcattttagttcgaatgatttccaaacttttacattcaaccaattccaattctaatgaaccaattaaacatcgccatattttttttcttctttttgttgtgaatcctttttgtgctttatttttttttacactttttttagattataaagcaatggaaaacgaggaggagcctcagcttcatattgacgtgttgcttaacgttgcagaaaagctaattttctcggtaattgtcgagaacacttatcgttagctaagctgacaaatgcttcacttttagcctgacaatgactttcgtcttgatttgagagacccaaacgccgacatcgtcaattttatggtattctttcccgcatttgtaaatgctttgttcaaatgttttagttgaagagggtctcttccttttcagttcgctgggcccgcctgtcgttggtcctttttctcgcagtttcggaagctcacccaagtcagtgtcaactcggccgaactccaactgtacgcgccgaagccgattcagggcattcgcggcactctttccaacaacaaagaggcgagtggaccaatggcaaatggtgtcacctttgtccggccccccccccctccctttgcagttcttccaagggcccttcgtcgtcaccgatcagttcttttacacccttttctgtcgtggcattctccgacccaccgtcgtggacactttcttcatcttcggcaatgacgtcgtcaccttcgacagcgttccgtcttcttcggcctccataatgatgaacgattggagggaacaattggaggacggagaagaaacggaagagggagagattgtcgagccgatgcacggagacagccaatggcatgaagagaagtgcgaaagcaacttcggcccttgcgaaatatctttcactgacggagagtcgccggccgagtcgttggttcgtctgtttctggtcagaggtcggcaccatggcaaataatgaacattacacctttcttaggcaaagcaaattcagattcgccagattgtttggaggattgtccagc

SEQ ID NO: 23319 - DNA, 949 bp, Heterodera glycines
  misc_feature (29)..(29): n is a, c, g, or t
  misc_feature (64)..(64): n is a, c, g, or t
aatcgcattctcaatttgacgcgaaggangtcctctgggagattcgaccgaactgcggcgacantgtcaccaccgttgccgaatatcacttcccgtgggtacatttcacccgtcccaattcgccgtccatcgctttcgcgtcccattgttttcagagtcattgctgaccgcacttccaaattggtgttcgcctacacaattgacgttatcaacccggaacgcgactgcgcctttcacttccctaccaatgaattcgtcgcacttttatgttacatcgccgcttgttgtcccaatttggacactttttcgttgtcctttttgttgcaaggcgagttctctgacgaagacttcaagcagctctcttcatggctgtaccgcaccatccaaagtgttctttcgcttcgttgctccattctctgcatcgattgcaatttgaccatcgaattccgtgcttttttccctgaggctacacttatggcacacttttaattggccatccgagtaaagctctctctttgcatttaggaggccaataagacgggacacggtttggcaacgatgggcgagcaacggcgcacggatgacagcgaaacgacggaaatggacgacacgccggacacttattcaatttcgagaaagattcaaatgcgcgacgagccgcccattcaggtgagtctaaaagaggaggaaattagcaattggtattattttgttttaggtgctgtattcattggttgggctcgaggaggacagtgtgaacgacggatggaacggctattaatttgttggattgtctgcttccgctgtctttctccgtcttgtcgcagtctttcctattttgcttctctctaaccaaggctgcctttggacgttccgttgtatctgtccctccattcccttcgctctgtgagggcgctcgtcatttttaaatgaatcgttctaaaaacga

SEQ ID NO: 23320 - DNA, 2112 bp, Heterodera glycines
  misc_feature (2095)..(2095): n is a, c, g, or t
taggaggacattttagaatatcgaaaataacatcaatttgccaaccccattgttaagggattgaatattcgggagagacaaattgagacactgcgcgcgctgctgattaaacaccacgagttggcccgggaccaagaaaaagaccatttccacgccctgcaacagctgaagcaacggaacttggaggagcagcactagttggagctgaacagccaaaaggacttcaaccgaagggcgttggagcagaagacgaaagagcacgcgatgcagtccaagcagcagccacgggaattgaaagtagaaaatgggtggaataatacattaattgcttgttttgggatgctttttttacttaaaatcgacgacattcgtcttttaaggccaaggaaacgatcatccgaaaacagtttcgacaagcggtcaaaattcaaacgcgccaattcaaagcgtaccaatcccaaatgctccaaatggcgccccgggaggagcacagagaactgctgaaccgactgaaggatgaacagagtcggaagatcgcctcccttgcggaccaatacgaagcgaccattgaaacgatggtcacggaacaaacggtgggaatcttgtacaattatcacgcatttgaaagggggtgggattttgccggtggattacgccgagattagggccatgatggcataccatactttccaaaatttactgataatataaaactgggtcaatctgaaaaaaaattcgcttttcactaaagatttacattttaagatcaaattggacgcccaacaggaggaggacttgcgacagctgaccgaaaaactgaacagggagctgagcatgttgacggagtaccaggagaaacagcgggttgaactgagcgcacaaattgagcgcgagcgagtgcaactgcaggaccgcgtcaaccttcggcttgctgtgctgaaacagaaagtgggaccacaagacaatttagcctataattagttaattaaatgacattggaatccgttccattttttcgaatcatttttttgtaaaaataaatgttttttatcgcagatgaacgaagaaaaggtccattttgagcggaacagagagcgacagttggcgcagttgcacgaccgacaggcgcaagcgttgagtgccttctccgtcgatgagagacggaagaaaagttccatgggaagtgacggggggcggaacgacgcgtcgtccacaaatttgtgaattgggcccagcgggcattcgttgccttttctctccttttgtcgccttcaattttcaattgtttcgacaatttttacttatctttttctttctccaacgaatttttgtatgtttttgtctttacttatccgctttttctcctcttttttttgtatgtgagtcatcatttgtgctcctctaaacacttttgttacacttatttcaattcgatcgcactaacgggtatcgccggatcagtcaccagcctctccttctctttatccgtttttaaccaagaattttacagattgtcaaacccattcattcattcatttgcactcccaacgcacgcacaatttttgtttttttttattattattggatttgtcaattctgctggatttgctgctctcctttttaaaacaccaacaaaaaatgatacattttttgtgcagcttttgctaattaatgtacacttttttccattgtcactcatttcattcactgctcattgtcgtacaatttggaaaagtccacgcaacaactcagttcaaattgataaatttgatttcacctccaattgtctgctccactttatcgttacgatttccgtttacattttcacttttaagttagaaattatttatttcccattcattcattggaaacagggaatacatactgtatttattttattgtacggtatctttgaggcaataaaaaaacaattccacaggacaatgcctaacataaatcatttagatttttacaaaaatacacatttaattgaattggcaaatgtcccttcgcttcttcggtttccacgattcggtcagcgaagggaaatttctgtgggagattctcacgcaactgagagggctcggagttggancggtgtgtgaccaaaag

SEQ ID NO: 23321 - DNA, 3041 bp, Heterodera glycines
  misc_feature (111)..(111): n is a, c, g, or t
  misc_feature (118)..(118): n is a, c, g, or t
  misc_feature (138)..(138): n is a, c, g, or t
  misc_feature (149)..(149): n is a, c, g, or t
  misc_feature (174)..(174): n is a, c, g, or t
  misc_feature (193)..(193): n is a, c, g, or t
  misc_feature (215)..(215): n is a, c, g, or t
  misc_feature (234)..(234): n is a, c, g, or t
tgtttttaggtgcatcgcctaacttttgttctctgtccccacaccctaggactttcgacttcctcacccatggaaagttttttctttggaaaaatttgattgttaaagatntaggaanaaaaaggttattttatgagnttgaaagaaanattgattatttagattattgatttngttttgtgatgagtaaagntatagttatgaggaggattggntgatttgttaaaatgtggnaagatttttgggggtatttttcgcgcgtcaaaaaaaggaaattcgttggtgaagacagcgcaggcaatcgcttttacgaaattttggagggaaaccgaagaggaaatgtgaacaggtaggaaatgttttttttgctttcatattttttattttaccataaatctgacggaattgtccagggaatgacggcatttggttatttttgtcaaactatcgcctatttttcaatcatttaatttttatgggaatggtccgcagtaccagagaaatatgtgattttgtttacagaacaataggactaaagcatcacacacactgagaaccccgcttttcgtttaggggttttgagccgcccccggacgtcgaagttccgtcagaaccaccggtggaatggcgcgcgtggctcaacaaaagcaggcgtttccctccgtcggaagaagaaattcagctgaacctactcaaacaacaagtaaaaaagcacagaataaacaatgtaacctctgcgccattctaaaattgcgacaattgcaattcaaaatttaaaaaaaatcgttgaaattatcttttttttaattgctcatttcccaatagcaatgtttatttgttactttttaggctcaattggtacaaaacacagaaacggaaaagaaagcgccaatgattgtgtcgacgggccctggggcagcggaaactgacaaaaggcgaaataaggcagggaaagaataccctaagtacaccgaagaagagtacgagggaattgcgggggcaaagacgagagagcaattggagagggagcagaaggagggcaagtggaagtacaaaaaattctttttcgagaaataattggctggcaaaaccatcatgtttattgttttagctgttgtttttaataggaatattgataaaaacaaatgaaagaatattgatgattatcaaacattaaaattgttttattatttggattgtgcaattaaagaacaatgaaagaaagaagtcgaatccgacataaaaggcagtgaaaatgaaagacaaattctctcgaaagactaaaggaaagtcgaaggttcaaaaaatagattaattgctaatccgaaacgtctttttcaaccttattggttggtcatcacttttatttttttttgcaaaacgaagaaaccctgctttattcggtgctttcgcttttgttgaaggagttcgcgttgctgtccacgatcatgtccctgacggaagtgcccactgaccaaacgaattccgggtcgtcggcacattttaacgcggtgacgcgactgtcctcgtaataggcaccctcacagagatcgtcggagaaagcgacgtccaacacgcgagtcgcggccaacagcggcgacctgcgaaatttaagaggaaaagcaaactaaagaaattggcaaaagaccaaagcaccaacctcaaaaatggtctcaaaaatccgttgatgaataatcggaagggccaaaaaacatttcggtacaatttgccaggcacaacgccgggatggacactgacaacggcgattttactctgtcgaattctaaaatacggcataaaatagaaaacgaatctaaaatactttaaaacatggctcaaatgtttgacgtaaatgccgagcaacaattttgagtcggcgtacgatttatagtcgttgatgcgacggcaccaaaacttttctaaaaaaatctcggtgaaattaaattaaaataattcaagcgggtaaatttcattttttaatttgttaaataatgatgccatttgcccttcattcgccgtgccttcgttctccaaaagtagtgacagttcgccggcatgcgcagtgcacgaggaaaggaaaacggcgcggggcgaacggaagcgactgcactccaaccgaccggcaaaggaggcgaaaagctgcgcatttgccagcacattcaccgcgagatggggctcaatgatggaacagccgaagcgaccgatgcgaaagggaagccaaccaaaaagagagggggggggggaagaagtaaatgtgggaaaagcgaaagcaccggcatccggacaaagcatcatcgccgcattcagcaccaaaaggtcgacgtgggaacagcaaagcaaaacggactcaaccgcctcgaaaacctaaaaatggagacacattatcattttggatgcaaatataattcagactattaaaatgaaatatccaaggcaattttagttataacgcataaatctgtctaagcgatttgtgagacaataaacaaaaggtatgctaataaaactacgccaccaaaaatctaaaatgtttctgaataataaactgttgccatggcggatacaaacaaataatgcacctttcctttggtgtgagaaaacaaaggcagttaaacagttcattttcgatactaggaaattaaaaattaagctcgcctgatttttgtcgctcagatcacacgaaacaaaaagcatctgatcagaggccaattgaggagcattcattccgatgacaaacacaaaaaaatccaatgagagcaaatagtcgagaatctgaagaggcaaaaaaaccaaaaaatattttttatttatggaattctgtttaatgatgaagacgaaatagcactcgcctcacttccaattgtcccatcgcctcccgtcaaaactgcaactagtgaatttttttgctggtcattttgttgaacttcttcgccttcattcctcttgggtttgcgttcaatatctacaggtaattgcaacagacttttcttccattctgccacttagaaggaaaaaaatgtttttggaacaaatttcagatt

SEQ ID NO: 23322 - DNA, 2206 bp, Heterodera glycines
  misc_feature (2139)..(2139): n is a, c, g, or t
tttaatttttgatattttttaaatataattttttaaattttattttaatttttattaatttttaaatttattttcttaagtttattttagtttttaataatttaaatataaataattttcttaattttattttaattttaacaattattaaatataattttattattttaatttttaatttttaataatttacctttccaatttgtcaatgccaatgggatttgcttcaaatatttttttgcatccaaaagccctgtcaatttctttcttgacaacccttcaccaccattatcagcagcaacaacaacaatagcttttgattcatccgagttttcaaaaatttaataatcaaaattaaaatttttccaaaatatatttttttaattttctgttttttaagaactaaagtttaaatttttgaaaattatatgagaacaaatggcaaattaagaagggaaaattatatacaaaaatatgtaaatacaaattttaatagtaattttggacgataaagtaataaaaagcataaaacatgtaaaagatgctgcaaaaaagaaatattcaataaaaatttattttgacagtttttcaattttgattttttgggaatatttttcatattttttttttttgcaatataatattcttgcactctcaaaagttgccgaataaaaaaaggtgccaaaaagtgggaaaatatgcacaaaatataaacatattttttaagtagaaaaatttctaaatatataaaaattatattctatgggaactttgttttacactatgacaaaaaatgccaatgggtaaaaataataaataaatttaccctttgtttccaaactgcccgaatttgtgccaatgtcggattccgatgccacggatgatctgttgcttctggattttttgatccctcctgtttttaaaattttataaattttctttttgtttttctttttattttttggcaccggcacagcttggcaatgccggcggcatttgcttcaaatatttttttgtatccaaaagagcggacaatttattttttggcgcttcttcgccgctaccaccagcagcagcagcatttgattcgttcgtatcttctaaatacggggaaaaaaaatttgattttatggcaaaataagtcggacttttagtctggaaatttattttttttgagtcgaatatattttcttggcttatttatattttattgaattttttatttattaattttttgtcattattaaaacttcaaaatttgtccaaagtaaagccctgaaacccgaataatggcaaaaatatttgtctgttgattattactgtaaaaatgccaaaatttaaagttgaattcatttaccctgtttttcagtattgctagagttggttgtgcccaagtcggattccgatgccgttgatgaattattcttattgcttttggagtaagcaatgccggccaatgtctcacacaaaaaataggcaaaaaatgcgcaaatggcaaagtcggctctcatttaattttggataaaaactagtctttaaacatgcaatacatattattctcaagtctttttagctttttttagtcaacaaagttttttaagttatttaaatttatttagaaatgaacaaaaaaaaaattgtttaataattttgaggagaatttgaaaatttaaattgtatttattatgaagtaataaaagaaataagaatatttatttatttttcttcacttttctgacaaatccaatcaatttcttatacaatttattgatggaatgacgacaatttgtaaacatttacgtaacattttttaattaaaaaataattaattgcccggaattccgcttttaaaaaatttagaaatatttttttacagttatctattacaacaatcttccccctttttttactttgagcctttccgaggtgctgttatcagccgattatgtgtcatcaaattcgtgtgagccgaacctaaaatgaacataacttaactcaaacttaatcaaattaaccaatcttggtattaaacgatagctctacgtgtcttctattgttatgccagaaggaagcggagtgtgggagaaagtgggaaaaggagcgcccgtagctcagtcagagcacggcacggattgctgnggtcatgtgttcgagtcccaccggcgagttacctttatattctgctctgggtggatccctgcacact

SEQ ID NO: 23323 - DNA, 1910 bp, Heterodera glycines
atgaggatccggagagcattcgacagttttgtcaggcgcactttttgctgaaggccaaaatgagtccccgtcggactgtttttgtttgcaaatttaataggtgaacaatggaaatttgaccataaattgggcaatttaaaatattgtttgattgatctttagccttaagtaaagcgacactttccgggtcttttttgtcgctgatcaaaaaatggccaattccgggcccgaattcgaacaaaaagacgaaattggcaatctttcggttcattggtcccgatttttttttaataaaattttggaaacacatttctaaagctaatttgagccgctgtgtacgaatctgaccaccttttgaccaacttcaaatcccggacccgaattcgaacattttttaaattttaatttcatcaaatacgcctaatgtccgggaaaacgcaccaattgttgcccagttatttggacgaattatatgtatgtggcggcgatagattaactgaaaaaagacactggcatcgtttgataaaatattggatcatatttcagaatttacctcgtcaatgcttattcttaggcgtatttgaggaaattgaaatttttgaatttaaaaaaaaaaatcgggaccaacgaaccgtaagattgcctcgaaattctatttgatttcgaccttttattttaatccgtgcatttgttcaaatttagcagaatgaattccataggcgtggtcagcgaacacggaaactcgcgggaaaacacgacattcaaattagacaattttatgccaaaagggagggagggtcgtgagaattttattttcaggggtccggcggtgccgattggcgccatcgggataaattttttaatgattttttaaaagaaaatgtatttggaatttcactaactttctcccctttcatcccttagccggcgacccgccccccgcccacctctttcacaccggcccccctcactgcgaagggatcccccattttgggggcctttgcgggcgaaagagggtgggagggttggggctacccgactttttgggacaaaatgacattttgatgattttaaaaataaaattttattaataaaacaaaaaaaaagaatgctactttctatctgttgagtccggaaacagagttaattttaaatatttttatttttcacaaatggaaattaactttggtaactttgggctggctgaatacttaattattaattatttataatatttttttccattaaaatcctaaaatgtcggattccctaagtgtcgagtccccaaatttcaaaccaaaaagtcgcgccacgatgggtcgatctccccttattttttgcttgtcgaaatcctttgcttatttttgaaaaattagtccaatcccgtcgtggtaaattttactgtttttagcgagaattagttttttagtttttcgccaattgccaattttgttgaatcttttgttcctgcacagacgcagttccattcgtgccattgtccggtgcccttatcgtgccgtgtttgtggcggaacgatgcgcgatgttcgctcttcagtcgcacaaccatccgccgccggatgaggagggcaacgacaccacggcaaacgaagccgctggctgtttcctgccatgccaaccgcagcagcagctacaacagcatattattgtgacagaggggaaggggggtgtctcgggacattttgcatacgaaggtccaacttttttctccggcggcgacccttttttcaacccatctttttttgcgcaggggcgtccggcggtgccgataggcatcgccgggggaaaaatttataatttttgatggaaattgttaaggagtttgttaaaatttaaaatttcttcctcttttcccccctttcggtacagtgcaccccgccaacccccctc

SEQ ID NO: 23324 - DNA, 1407 bp, Heterodera glycines
tggaattttttttcagcgcatttgatcgtgaaaatttggaaaaaaggctttctctttttttggtctacagtcaagggaattccaaccgcactctcagcataagacgccgatactaattgttctggaattattttctcagcgcatttgatcgtgaaaattttggaaaaatggctatctctttttctggtctacagtcaagggaattccaaccgcactctcagcataatgacgccgatactaattgttctggaattattttctcagcgcatttgatcgtgaaaattttggaaaaatggctatctctttttctggctacagtcaagggaattccaaccgcactctcagcataatgacgccgatactaattgttctggaatttttttctcagcgcatttgatcgtgaaaattttggaaaactggctatctctttttctggtctacagtcaagggaattccaaccgcattctcagcataatgacgccgatactaattgttctggaatttttttctcagcgcatttgatcgtgaaaaatttggaaaaatggctatctctttttctggtctacagtcaagggaattccaaccgcattctcagcataatgacgccgatactaattgttctggaatttttttctcagcgcatttgatcgtgaaaattttggaaaaatggctatctctttttctggtctacagtcaagggaattccaaccgcactctcagcataatgacgccgatactaattgttctggaatttttttctcagcgcatttgatcgtgaaaattttggaaaaatggctatctctttttctggtctacagtcaagggaattccaaccgcattctcagcataatgacgccgatagaaaaaaaccgcggccgcgcattcttttctccgcggatcgcggatcgcgaatttattaaaaatttttccaatttttaaccattaaaaaaaaatttttttttggggggggggggcccggaataagcaattcgtaacctcagcgcattttttttacggcgaatgtttccaaaaagttttgtccagcggtgccggtaggcgccgccgggaaaattttttaatttttaatgcgatttgttaacagatttttgtccaaaatgaccaaattttgccacaaagctatattttcttcgtaaaatatcgatattctgacaaaaaatttcaaaagtatcttgctttttacataaaaaatacttatttttaaattatatgtattaaaaataaaaaacaatcgcttcgaaaaataattttttaaattagtccaaaattgcggcggagtctcaaattccgcgcatcgcgcaaaaaaaaaaccgcgcccgagcatttaatttgccgcggatcgcgcaaaaaaaatgccgcgaatcgcacatcgcggcgcggccccagccc

SEQ ID NO: 23325 - DNA, 653 bp, Heterodera glycines
ctcttattatctgttctcttttccacacactctcactgtctccctttttttctctagtcagttctctaattgtctgttctcttttccacacactctcactgtcttccttttttctctaaattgtttttctctagtcagttctctaattgtctgtttaattttccacacactctcgctgtctcccttttttctctaatttagttttgtcgttttagcgtgcccacttttccactattgcattgatttaagcaaaaaattctataattctgtttaaaaaaaacaatattttataaaatttaattaaattattttttaattttaattttctaaaaaatatatttaagagaaataaggcaacgttcaaattaaattattttttctttttaaaggactccctgctgttgctggacggctcacctcctccgaccaactcgtcgtcggacaattccgcgtccgccgatgagtccgaaactgaggctcagttggccgagcagcaagaatgcctggaacgcccccactgctttgtgaaggtgaagaaccgcacaaaggagttcatcggatgtaccagcatgagcgaagcattccaccggttggacttggccagggcaatcaaagacatccgacgcttcaattacatatgcaaagtgaggagg

SEQ ID NO: 23326 - DNA, 1241 bp, Heterodera glycines
  misc_feature (54)..(54): n is a, c, g, or t
  misc_feature (56)..(56): n is a, c, g, or t
  misc_feature (90)..(90): n is a, c, g, or t
  misc_feature (98)..(101): n is a, c, g, or t
  misc_feature (106)..(108): n is a, c, g, or t
taatgtaaaaattgaaaaatctaataaattggaagcccttagaggggggccggngnaaaacaggggaggggaggggacttgccgcgacgnaggaaaannnnaaaannngaataaatttttaaacaaaattcattaaaaattccaaaatttctccccggcgtcgccttcgtcaccccccccccctgttgcctaaaaattttctggaaaaaatgagccgcaaaaaaatggtttgaaaaataaaaaagaaggacaccgatttacatggccggacctcttctcaaaactcccgctcgacctccctcccacctgagactccaaaaatttcggtagcccccccctcccccgttttttcacatatgtcatccatataaattgcatccatactctctaattatataaaattttaatttttacacattttgccttttcagcatcaccttcctggacatgccaaaggaggtgcttcgacaaatcttggccaaactgcccgaccacgtgtccatgttggaagtggccaaggccaacgagacattccaagcactggtcgactgtgagcagaagcaatggcgaagcctgtgcatgtgccacttcacacaagcacaaattgacaaacacaaggcgggaaatggggaaacattttttttgacaaattttaattaatttgaaattaataaataaaagcgggggggggggggggaaattatagggccctaaaaattcaaattaataacgtccggcatctatcgggcaccaggggtgggatgcacactaaaaatgtcgcggtcggcatttttgcaaaattttcatttacctccaaaaaatgaaaaatagacaaaatttgattaatgaaaattataattattaatacaattaattttcagagtttcgacccattcacatggcgtcaactgtttttttcgctcaaaaaatactacgggctcaaagaagtttatgcggatctcattcacatttgttgccattgcaaggctttattttggaaggtgcctttttagcaaataatattaaattaattttgaattttatattttaaaacattatttaaggaccatggccatccgtgtgtttccaaggaaactgctccatccgtgcgggtaactccacaacaatttgttgacagtaagcaattcatacattatttttaaacaattatttaaattaaaataattatttatttagtgcaattatttctctgatcgaacaacgaaaaaacaattaaaaca

SEQ ID NO: 23327 - DNA, 1398 bp, Heterodera glycines
caggacaataattcgtaaggagttaatcttagttacccgtaattgaataattttgtcattataaatatgtaatgtgtcaaaaaaaattccattattagtcaatccattttctagtcaaatcccactggcggagcttcgtagtccttcggcatattgttgctgaaattattttaaaaattttaaaatgctttttaattagctaattttttcaaaatttatataataaagctaaatttttataaaacttttgtcccacccattgtaaattttccactgtattattaaaatcactgttctttttttgaacccacatgcactgttccggcttcgtcgccccacacttttggcatgcaatggcacagttttgtgccatccaatgcgggttccgctgacattcgttcggcgtgccaacagccttttcatggtaatgggcccatctttggcattccgaataaagattttgacaacctgaaacttttgttataggtaattctgtccacacatttatttgggcatgcgaaattgagtgcccagcccttgctggacacgtgtcgtgccattctttcccacttgcccggtttgccctgctctggatggggtcggcacccgtcgaaacggcactgggccgggcaccacgtgttcatgaagcgcggtgcggtgcggcacgcatcgctggccgcccagtgggcacagcactcgtgtgtgtcgtggcagacgcgctcctcctccagcgatggggaagactaatgaaaaaccaaattatagtaaatttgatatttccgtgtttttccaatttgggaaaatggaaagccggcggaatcaattggcacatcgccggaaaaaattggaataaatacgaaatcgaaaaattcggcatcggaaacgaaactttttgacggactgaaaaagaaacataaaaatgtacgaaaaggggggaggacactagaattttttcaaaaaaaatcttaggaatttttttaatttttcgggggggggggggggggtgggacgacctgctccgtcaggtacggtacgaaggtaaaaatcttcatgtacacaggtgccgtttcattttttacttacagtaggcaatggagtggtcaacagcacgccccaggcagacgctgttgccttctcggtggcggaggtggcacgcggcggcatcggaatggtttcgactacggtgggatattggtggtaggcgtactgtggcagcagatgttgaggctgctacagaattttggtaaataaatcacatcaatcatttaccggatagttttttaaagaaaagttcgaaaaactagaaatttttttataaggaagtttcaggaaaaaatttttgaaaattttttcagtgaattttaagaaaattttgagaaaaacagtaatcatcataaa

SEQ ID NO: 23328 - DNA, 1212 bp, Heterodera glycines
agtatcgtttctattagggaaataatgacaaggatttcgggttaaaacggggtttgatcttttttagcgctttttaggtatacatttgagacattggggcaggacaagaaaagaatgaagttgatgcctcatgaaactcggattggacacgttttgtcgaaaatatccttacataatatcataaaaaatacaaataattcaacccacctattctatgaccacattctgaaaaaaatcccagaaatacgaggaaagatatgcttggtcacaataaaataaaaaatggctagtatgtaaaatttgcggtcaaataaaataaaaattggctaatatgtaaaattggcgtccagaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagttgatgcctcatgaaactcggaattggttatgtttagtcgaaaatatccttacataatactcataaaaaatacaaataattcaacccacctattctatgaccacattctgaaaaaaatcccagaaatacgaggaaagatatgcttggtcacaataaaataaaaaatggctagtatgtaaaaatttgcggtcactaataaaataaaaaatggctaatatgtaaaattggcgtccagaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagttgatgcctcatgaaactcggaattggttatgtttagtcgaaaatatgcttacataatactcataaaaaatacaaataattcaacccacctattctatgaccacattctgaaaaaaatcccagaaatacgaggaaagatatgcttggtcacaataaaataaaaaatggctagtatgtaaaaatttgcggtcactaataaaataaaaaatggctaatatgtaaaattggcgtccagaaatttttagactaatccgaagcaaagcacgaat

SEQ ID NO: 23329 - DNA, 1396 bp, Heterodera glycines
cgatcagcaaatgtcaaaatttcaaatattttcattctttaatgtaaatttcaaattaaagaaagcaataaaaaggactctgatagtgtgataaagtgataggattaagtgaaagatgtgagtttaattacttcaattcatttaatttgtatttgatgaataaatatttttcgcagataatttaacgttgggtgctttttcttattttgaatttttaggggtttttctttctttttttttgccccaatttggaaaaattttcgagattttgttgagaaatatgcaaaaaaaaagaagaaaaaataataccatcttatccgatcagcaaactttgtgaagaaacggcacagaaaaagccaagaaatgaatgaatcatccattcacgtacacaaatgtgtaaattcattcataaaacaaacaaaaatggagttgaaaagggaaagaatgaagaaagaaagcatttgtctccataaaagtgtttagccatgagatttaggcacacatttggcgaaaagtctttcactattaaatgccaaaatcagtcgacaaaatgcaacccttattttattatttaaataatttttattaaaattatttatttttactgttcttggtgtggtaatgttgtgcaaatttttagtcatttcatactttggcatttttctattgtaaaaacagaaacattttgcgcaatgctttttcctcaattctttctttcatttttgttcattttgttattagcggacggaatggcgcaacaatcgaacaaagtgacagggccaaggcaacaatttatcattcaattaattaattatttttaatttgatttcaaatgctaaatgctacacattttgcatttgcatttcaggtgcttttcctgtgcgtcgtcggcactcaaatcgcaatggcaagtgaccggtaggtaaatgtaccgtattatctctaattattaggaagcaacttttagtgacgaaaaaccccaaaatagttaactaaaatagtgagtagaaatgccaaaatagtgaagaatagtgacaaaacgtccgaaaaagtgacaaatagtcacataattttcagccaaaaattgagcaaaaataatttttattcactgattgcagttgcaaatgagtaggactgggatttgtaagaccaaaaaacccaaaagagttacctaaaaaaaattttttaaattaaaaatttttgccaagaaagtaaatttttgagaaaatttttttttcatttcataggagtatattttgaaaaatcttagctcgattcttaggggtgtatttttttgaaatttttttaggtcgattcttatgggtgtattttttggttttattgcatttttgttaaggaattttccaaaaaatgtcgaaatagtgacaaaacccca

SEQ ID NO: 23330 - DNA, 914 bp, Heterodera glycines
ggattttttctcccccaaaatttgtttgagtccccccaaacgatccggaatagctccctaatagcctgtcttttattttgcgtgggattttgcccccccataattgtttgagtcccccaaacgggcccctgaaaaaaaacgttttttttgtttttgggggcagtccccccgaaccgatgcgcccagatttatggggagaccgaatccttcgggaatagcttccctatagcctgtactttaattctgcgtgggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggattttt

SEQ ID NO: 23331 - DNA, 663 bp, Heterodera glycines
ctcatttgccccccaccaacagggctccgatcactcatttgttcagcgacttcggtggcactcacgacgatctcttgactttccgttgcgcctttttttcctgtccatggcgaccaattccatgagtttacatcacttcgattaggtgcacagagaattggagcgtcagaccaaaatgggcacagtgacccttgtgttggtgggcaaaacggtcaacggcaaatcgtacagtgatctacgctatccacctttacgcacatttttatttcttccccccccccctcaacattttgctctttttcttccccccctcccctcaacattttgctctttttcttcccctcccctcccctccactcaacattttgatttacaaggtagtattaaggttagtttatttttgatcattatgaaaaaattatattggaattttgaacgaacaaataattatagggggggggggggtgtaatttttttaaatatgtaattgtttctgttgcagtatttttcaaaattggatgagctcccagcacttgaagacgcctgccttctcgaatccgctttcaagagagctgtaaaagtgtgactaatgcagttgggggaaacgatggtaattaaaatatcgaattaataaaaaactgaggggagggggggggggaagaa

SEQ ID NO: 23332 - DNA, 1862 bp, Heterodera glycines
gttgggcgccagcacaggtttttccactataacttttttctttctcatccaaatccaacaatcttggtatcattcgaaagctcttcagatgctctactagcctgcaaaattccgaaaaattttgttaattttgaaccaatttatggccaaaaaaaaatttggttttttgaattcttctggctataacttttttgaacctaaactaatttttttaaaattttgcaggctaatattcgggacaagtaaaaaaaaatccacttttatttccatggcttttttcgtagcccagggatttttacaatttttgaaaaattttatttaggattatatttgcttgctttataaaaatccttacaatctgtaatttttacaacaaaactaaaaatttacagctcgcgctccttgacatccacaggcagaccggagacgaacaaagtgcgaacctgaaaaatcgtaaaatttttcactgaaattcattcataattttcattatttctgaattttcaatttcctataaattgcattaatcttagaatttatcgctttttaacatagaagctctgaactctcctagaaaaatgcataaaattttcgaatatctcatcatttcttgaaaaaaaaaacaattttttttttcaattacacgacaactctcaattttgctaattcccattaaatttttcgtaaaacgtccctgcccgtgtctttagcattgacaatttgtctgtctttttttccagtgccattaatacgcggcgcacctgtgcttgcgcatcgccaccgcccgccacgcttccaccactgccaccgccgttggtggcggacgcggacgagtcaagcgactccatggaaacggcattgaccaacattgtcgtcttggcgcttccaccaccaccaccactgttgttattgctgttcattgttgttgtcgatgatgccattgtttggtgggtggtgccgttggtgaaaaaacagtcatcattgctgctggtgctgttactttttgtcattcgttgttgctgttgcagttttgttgtcaccaaacacgtaggtatttaaccaccaatttgtgtgtgtgtgtgtttattatgcgtgtggtgtgttgtttttgtgccgtttttttggggggggggggttaaatttttgggtggccaagaaaaaaaaaatttgtgctccggcagaaaaatttattgtgcaacaacaattttttttgtgatgtgatgatgtggtgtgccgagatcagaaaaaaaaaagaaatcaaatttaattgctaaaatatcaaatgtcaactcaaagcattttgatgtgttcgttggtgagtgggtgggtgaattgaatggtttagcaaaatgacacaatgcacaaaacatagggaaaaaaacaatggtccactaaatcagggatgctctgggtcgagaaaaaaaagtcggatttcgtgtctcggtaatccggaacatctctacgccatatagaaatgctcgtatgaaataaaaatttcaggaaacgtggaagaacaatagtgaaaattgagcaatggtaaaaattgcggtccctaatttaatgtttttattttgtatttaagatcagtttacggggggttttcgaacgctctgatcacgaactgaattcagctttccccaattccgaactccggattcgaactcgaataaaaaatcaaaacaaaaaaaaattagggaccacaaattctttatcaatacgaaaaattggaaataatgaaattgtagcaataaaaatatttttggaaaaaaaaatttttttttttttgtttcaggcgcgggggggggcggttttagtgcgaatttaatgctggacaataaaaaatgcgaaggaaaggacacggc

SEQ ID NO: 23333 - DNA, 1104 bp, Heterodera glycines
tagagcatttttcatggtatttcaagaaaattgtgcaatgtgggcgacccggaacattttagacagtttccaaaccaaacactcatagtaaaaaattatttcgttagaatacgagaaataatttgaaacgaaacactggttactaatttgcatatatctctgcgaaaattccagatccaaaaaaatcagctataccattcgaaagctgctttcaggcgctctcagaaaacagtaaaaacgctcctattcatgcactaggcgctgagatatatgcacttgactttctgcatataattgccattctccgcagcaaacttcgcgttctcaagcgtgaatagttaatttttttgtgctgaactgtgttagggttctccttgcagtgcgctcaactaagtctcttggagttagagcatttttcatggtattttcaagaaaattgtgcaatgtgggcgacccggaacattttagacagtttccaaaccaaacactcatagtaaaaaattatttcgttagaatacgagaaataatttgaaacgaaacactggttactaatttgcatatatctctgcgaaaattccagatccaaaaaaatcagctataccattcgaaagctgctttcaggcgctctcagaaaacagtaaaaacgctcctattcatgcactaggcgctgagatatatgcacttgactttctgcatataattgccattctccgcagcaaacttcgcgttctcaagcgtgaatagttaatttttttgtgctgaactgtgttagggttctccttgcagtgcgctcaactaagtctcttggagttagagcatttttcatggtattttcaagaaaattgtgcaatgtgggcgacccggaacattttagacagtttccaaaccaaacactcatagtaaaaaattatttcgttagaatacgagaaataatttgaaacgaaacactggttactaatttgcatatatctctgcgaaaattccagatccaaaaaaatcagctataccattcgaaagctgctttcaggcgctctcagaaaacagtaaaaacgctcctattcatgcactacgcgctgagatatatgcacttgactttctgcatat

SEQ ID NO: 23334 - DNA, 3007 bp, Heterodera glycines
tttaaattttcaatgatagggcaacgccgaattttgtctttgcgatttataatatttaacttacaggctataataattactttaaatttggcattttctacctttttgatcaggcacttttttggcgtgacaagtcttcttacttcatcctccgcttctgctaacaccgcatcttcattaccttccgttatatcggcaatcttaattttaatatttaaacaaaattagcttccaaatatcaaaagtctaattgtaagagattagtttgaggcacatgttttttttgttgcaaaatgcatattacgatttacgcactaaaaataatttatttcaagagttgtttcgaaagaattttaggcaaataaaaatcacggagtttaaaaaggctggttttttcatttcgtactgaaccggttcctagccatttgctcttcaaaatctctgatgcaataagaaatttttaaaatagggttaagacataaaataattcaatatttagcccaataatgcatttgaaaattcatctgctgcatttaacataccgatgtaaattcactcgcatattctaaaaaccaatagcatatgatatggcctgattcgtgcacgctgtcgcggctcgtgccattcgtatgttggtttttttcaaaatccattgcctcgctgaactctctgtttctgttccatcgcttgatagctgcacatcttgcatgtctcgttttgttcaattttttctgaattgaaactatatttatgtaataatcatatggaatagtgaatgaaataaacttggttcggagcgtgattgtgtggtgcggtttcatgaagcgttctcgatcgaccttcagactcagctctcccgtcacaatttcgtgtcgtacacgcccatacctgctcaaattgttttttaaacaaatgcttcatactcaaattgttttttaaatatttaattacttgaatattcccatttggtcttccctgcttttgcattctgtatccattaaaatagattattctttcattgtaagaaatgacatctgtcacttgcagaaacagaattattatgaaaaaaaagtcaagtccggtgctcaggtgcctgatcgaatggcttggagccggacgatttcggtgcaaaaatacttgggccattgtgccaaaatagatttattgatttaacctataattaattacaaagttggaatcagttattttttgacaaaacttattattagctcaaacataaaatttcggactggaaaaaattccgccagtttattttaaaaaaactcggcctaaatattttgcaaaggtcagaaatggttagatacggcaaaatcttggttaggtttaatgaataatataagtgatcggttgccagtggaatgtgacaaaacctaatttccaccgctttaaataggcacaacaaaggccagatgaaaccaaataggagttgttacacaaaagaatatgattgttgtaatcattttgttgacaatttgttcattttggttttagcttcgaccatcgttaaaattattacatttttcttcacaggaaacgatttatttttgccatcaaattgtgcgcaaaagcactggtttagacctgttcactcatttcattttttccccgtcccaaatttgcgcaaaagcactggtttttgctgtctttacatttaattttggccgtcacaaaattgcaaaaaattatttttcattttacgcaaaaaataatgcaaacaatatgtgatagaaatataaaaaatcatataaaattaaatagatatatttttaattttcattttttaaaatgctacctaaatccatgatgccatttagtcccgccgggaccgggactggcaaaaccgggactgggattcctgtttttccaaaaaccgggaccgggaccgggaattgttaaataatggaaatatttaaattattttaaacatattatcgttattatcgttaataattaataggtatttaaaatgaaatttaatcaattcaccaaatcatatttttttgaatcttttcttctttcttgcttaactttttattttatcttattaagtttttcaataattatttttctttttctctgttctttctttcttttttctttaatattttcttcgtctttttctgcccattttctccaaatatctcatcaaatgattttatttcaattttttcttttctgagccaatttttatttatttggatggacaaacaccaaattaaaatcatgcagtgtaatccaatctattactattcatgaaaaatcagagctttcaattgaaaatttcaaaattgcaaaagcatgttttaacagatgttgaccaaaaaatgaccagcgaaaaacaaacggagcggcaaaaccctcgcccgtcaaaccaatgccccagggcaaaagtgacaggggcagcgaaccgccaccccgccagcgcaaaaagaaaaataacgaaaaaaattgttataaaattttaaaaaccgggctttttataatattaaatattaaatcattgcatcgcccaaggcactgaaacagcaaatttagtagcaaatgcattaaaaatcctaccattaaaatttggattggtgggtattcaatttaagttaaaaatttattttctgaaaattcttgtaaaagccttatttaaattaaacaatcaattaaaatgagaaaagtctcattttaaaagttttatttaaattaaacaaccaattaaaataatcaaattttgaattttccatcacccatagttgcttttctctcagttttcaaaaataattttgattattctttgcttttttatgtgaataaatgcataaataattatgcaattttactccgtaattggccaactcacaaaccagcaaaagcaatggctaaagagtgtcttagctatttttagaataaaagcaaaagacaaagtcaacagtggatcaaatggccaaaagtggccacatttcgcgaagtgattgtgttcaaaaaaaagcggcattaa

SEQ ID NO: 23335 - DNA, 1680 bp, Heterodera glycines
cttaaggagtggtggaatgattgcctgttaaatttgaagtcaatcgtacaaggggtgagcgagttttggtgcgcgagtctcggtgtgcgcgagggggcggggcgtcgggacagtactgcttgaaatggtgcctgaggcgaaattctttcgccgttcagcttaggtggtggtgctatgacggcctgtgaaatttgaagtcaatcggacaagggctatgcgagttttagcgctcagacccccccccccagttctgtactttgctaaacgttaaaattttttttatcataatttaaattgcaaaaatgaaaaaaaaaaacatacgaaaatgataactgattggtcctcccttttcattgctgattctctgcgtattggcgcaaaatttcggcctcgcgttcggcgcgctgaagaagcgctgttcgattcgacggtgtccaaaaagaaacgaatctgaaaaaatgtgatgaaatttaaaaaatgctaaattgaaaaaaaaacaagcttacaattgtcgggtcttcacgccaccaattcaagagcaaatcctcttgagtctttttcgattttgtcatactgaagagagatttcattgtcagttttctctaattttgcatcattttgttgcgaaaaatattggtggttgtcgagggatatttttcatctcttccattactgtctcggcctcgctgggcgagaggtgaccgtgacttttaagccaccgaattaaaacgaaccaaaaaagcaaaaacacaggaaatgcaagaagataatgagaaaaaagcagtacatgcaaaagagtttcattaggctcttctggggaattcaaaatttgtatgtcaggttttgttgtgttggtgttattcattttaacattacataatattttttttatttatttatattttatccaagctttgagtcggtcacaatgtgccgattataatcaaccataatcatttggtcaaattcacccaagacaatcatctccacaccgccaagcggaattggtgaattgaatgtggcccgtacgtttgtcgtaccgcttctcatcagctcaaatccacagctgtcgtcaagcgtggatgtcaatggaatgacaaaaaaggtccaccctttcttgaactgggccattgaaatgtcaaatgaacgttccgagtttgccatgcccaatgcctcatacatgtcaacaaaggcgctgacaaagtgatcctttgaaaaattgtttataaggaacagctgggtaaactacgccacctgcatgtatcgaaatttcacgcaaatcaaacggctcaaagaggaagggactcaatttgtagtcaccatgaaatgctgagtttccaaccaactctattgtcacacgtcgaggaatggttgcgctgaagacattgtactcaaattcgtatcgaccaacactgatgaatgacgatttgatttcggttttgcgtactgcgtacgtcgcgggttgtttttcaagtgttttgtaaaggctcatgttcagggagggttggacctcaaccattttggcataaatcttgacatcgtgaactgtcaaacgatatttggttgcatcatttgcttttaaagtttgcaaaagaaagacatctttggctttgtaaattgtgaacagcaaatccaaattgttttaaagataaagctcctgggtttcccaatcaaagtcga

SEQ ID NO: 23336 - DNA, 965 bp, Heterodera glycines
ggttgccaacggcaacagagtgacgattcaaatcaatggatggggcaaatcgagagaaagtcatttaacatttataataattttaaatattaattcatgaaaaattcaatttatcaatgactcacttatttctcttcctcatttttctcctcttttcatttttctttactaacttcttttctctttctcttcctccttttccttctctttttcttccttcttttcctcctcactttgttcttccaattccaacgcaattctcacaatcggataggtcggattggtcaaatactgttcaggggcaaaattcgattttcggtctgtccgatttgtgcttacgtcgaactcctcgtcctgcaaattgtgcccttctcgtgcgcccattatcggcaccactcggctgtgaacgcccgcttgaatgctgacattcacctgacaacatttgctaattggttggccaacccaccgattgattgatggcctttgtttgctttgtcccctccctccatttccccgtccccatttttaattttttttattccccccccccctccatcgctccctcccctttccaccggccgaccattcgttcggcactttccattcgtgctgccaactcggccattttttccaactgctgcttttgcctctccaattcgtccaattcgcgcctccgttctcgcaagaattcggcgatgcttctcaacgacacatcgtacagagaattgggctgttttttgtccctggccaactccaaaaggttctcaatccattgccttttatttttcgattttcaattgtttattaattataatgacaaatcgacctgaaataatgcaattggctttggcctaattgtggtgggccgggcgcaattggccacggctgaatgcccaacggctgagcagttatgaccgcttcattcccttccgatatattgatcaatgtgataatccttatgctac

SEQ ID NO: 23337 - DNA, 1171 bp, Heterodera glycines
  misc_feature (19)..(19): n is a, c, g, or t
  misc_feature (47)..(47): n is a, c, g, or t
  misc_feature (57)..(57): n is a, c, g, or t
  misc_feature (97)..(97): n is a, c, g, or t
  misc_feature (103)..(103): n is a, c, g, or t
  misc_feature (144)..(144): n is a, c, g, or t
  misc_feature (240)..(240): n is a, c, g, or t
  misc_feature (254)..(254): n is a, c, g, or t
tcttgcttcttccgtccgntctttcgttgcctttcggtttggtttgnttcttgctcngtttcgcttttggttttcgtttttcgtccggttccttttntgctgntggcctgctcggcttcttctcttcctttcgtctcctgttgntttcttgttttttccttgctttgtctgccgctcgttggttctttttctttcgggtctgtttcgttcctctgttgctctttttcttcgtttgcctcnctttccttttcggntttccgtctcatctgctgctctatttccgtttccttgtcagtttcttcttttgatttcattgcttcttcactcccccttttggcctgctgatcaatttcacctttcagtttggttagctgatcagtcccccttttcacctgatgatcagtttcttgtttggtcttcatttcctgatcagtctcccttttcatctgctgatcagtttttatttctttcttggtcttaatctgcggatcagttccccttttcatctgctgatcagtttctgtttcttccatgctcttcatttcctgatcagttccccttttcatctgctgatcagtctctgtttcttcattggtcttcctttcctgatcagtgccctttttcatcagctgatcagtttctgtttctttcttggtggtcttcgttttctgatcagtcccccttttcacctgctgatcagtttcttgtttggtgttcatttcctgatcaatctcacttttcacctgctgatcagtttctgtttcttctttggtcttcgtttcctggtcagtattttcctgctcattctctccgatttgttggattgtttgttttctcttctgctgcgtttgcttcttcattttttccttggaagatgatgttacttcttcgtttctgctgaatttgcatttttctctgtgtgtcactgtgttttcttatttgtttttacctctttccactctctccgtccattgctgtctttggtctttctctgtccctcttccccctccaaattgccacaactctttccacaattctctgccccctttttgacttctcttcctcttctttcgttgccttttcctccttttcgtccatttgtccttcagtttgtgtccgtttgtcccatttgatgatgtttaaatttgtccttctcacttcatcgaactgt

SEQ ID NO: 23338 - DNA, 2184 bp, Heterodera glycines
gctgaacgagcatttggcacccatcaaaacaacagcaacaccaccgattgactgacgcacagcaacaacaaaatccaatggccccttcaagcagtacaacaggtggaacgatatcgtcatccttgctgacgatgatgccaacttcagctactgcgcaacaacttttcacttctgctggtggttgtggtgactttcatcctgaaacaatttcgaccgtctcttcctcgtccacttttccaccattttcaccggcaacaacagaagctgatcagtttattaaagatctgccaactgatcaacgaaaacagcagcagcagaaacggcatctgaatcggctgtcaacaatgcttccgtttccgctcaaatggcctcataatgccagcaaatgaacaacgttcacacgggtagcggaatgccctcccaagaattccccgctttcgattaatcaacaggactatcctctatttcttctagtctgattatcgctgacttctagtctcttttcatataaatctaaatatattttgtcgcttttatggttaggtactttaaccttaagggacatactgtaatcgcccccgccccgaaaaaaacttaaacagaatttttaaaaattcaagaaactggctatttttcaatctttatgaagattacttgtttttgaaaaaaatttcttgaaacttcttattaataaaactaagatttttttttgaaaaataagtttcaaattttttgaatttttctggtgacaagctgtgagcggaacataatgactgcacccaaaaaagcactggtaagaattcgagacagctaaatattaaggaggtatgttgttgttcgaatgcaaaattttcagaatttctgacaccggtttttctgtttccggtcaatctggtcctggttttaacaaaaatcaaccgaacggtttcgtttaacacttaaatacaataacaaataaatgaataaatcggctagtctaacttcgtcactcacaaaaacccggtcttcgctatgaattccctcattagtaaatggccatttttatttgccttaaattttgataattggttaacaaatatattcccattaaccaatttccaatcgatttcttaatttgccttaaacaattataatttttcttatcattctgaacactactgtgaacattcgtttgattttatgttctgtttatttgtttgaaatttgtttggaataaatttatcattttttgctttttgggactctctttcatttttaattcttatggccatataattacattataattatcgggtctttcagctcccagtacctgttcaaaaaagtaaaagatcgctatcggattttcaattcgacggcaccggtactaaagaatcactggtaagaaaactgtagtccgtgcggaaaattattgaaaaaattgtggaaaatagaaaaaaaaacaatatttaatgtgcctgctgcggattgtgagccacaaatgtccgaaaatgccctagccttggccgtaacggattttaaatatgcaattgcaattttttgtttctcctaatgtcaaataaaagcaatttgctgcttccggccatggcaaaactcgtggccatttttctaccgactttggtcgtcgtcagcgcagcaactgtgcccattctgccacaacaattgctcagtgccaatgatcaaaattcaaattcattaccaaatttaacaaatgttcttgctgatgaaatttcgctgagtgccattgattgtgccgcgttgccaccggcactttggtgtaccaaatttgtccgttataaatgcggcaccagtaatttgtgcagaaagcatgacgatgccgtgcgttacaaaccgttgcacatcactttgctttacgaaagcttatgtggggttttattacatgcttttacatcagttaattaattaattaataggcgaaaattgattaaatcgatattttaaatttggttagcattcaaatgaccaataagctacagtacccctttaatatttaggccctttttgccaacggttcatcagagacacactgttcaatgtgtacaatcgcttcagaacacacattaaattggagctggtcccttatggaaacgcaaaaacagtgagcaaaaattttgtgttttaaatttatgccttttttaatttaagtgattttttcagaatggt

SEQ ID NO: 23339 - DNA, 2238 bp, Heterodera glycines
taacgcatttttgagttgtaaaattttattgttatacatagaatagaagaatttgcttttttaattttgtctttggattcttagttcttacaatttgagaaatgtctgcgagaccaaaggtttttttcgatgttatggttggcggaaaatcgacaggttataaactcggacaacaaatcgccctcattctctgttcaaaataggtttaggtcgaattgtgatggaattgtttagtgacatcgttccgaagactgccgaaaattttagggctctgtgtactggcgagaaagggatgggcaaaagtggtaattaaaaagtcttgaccgtgaccgttattgattttactttaggcaaaccgttgcactacaaagggtcgaagttccaccgcgtcattccgagtttcatgcttcaggtataaagttgtggcacttccgcgaaaaggaatccattaacggactccgttttcacattttagggtggcgattttactcgaggcaatgggaccggcggcgagtcgatctatggcaagtgttcggacgaaatgcgaatgaatcggtcctttaggcgagaaattccccgacgagaatttcaaagagaagcataccgtcccgggactattggtaacgtttctggaaatttaaggaatggaacactcgtagcccatgggccaaaaaagcgtcatttttcaacttatttttaaattcagtcgatggccaatgccggccccaacactaacggctcgcagtttttcatcaccacagtgaaaacggaggttggacgaaaggcgtatttagccattttcgagattcatttttaacacaaattaatctagcgaattcaagaaatactggaaaatgcctatacttggaaaattcttttttccgctctcctattcccggaaattgcttttgttattttcggtttagggtttttgatgattgttttcattgcagtggcttgacggcaaacacgtggtgtttgggcgagtcgttgagggcatggacgtggtgaagcaagtcgaagcccagggcaatcagagcggaaagacagcgaacgaagtttgcccatcctttcgctgttcatttcgccgtgactttgcctccattttcagattaccatcgccgattgtggccagctttcgtgaaagcgacaaatttgtgcatcgttacagctcagttttcgaaatattaggtattgttttctcagtttttggattctgttgttcaagctttggctcgttaatataataaaatatttttcatgtcccttaattctttaattttcgcctaaaagtaaatgaatgaatgaaatatcaaaactgacttttatgaagcaataaattatgaaaacaactgacagagagtcatcacattaatgggtaccaatctttgttaagaagtgtggggaatggtttcgcttaaggggggggggggatatgcaaaagcaatttggtaattgtgggttgaacaagcgaaacatgggaaggtctgtcccccgtggtcgtaagttttgtcgatggttcgtccgaatgtccgctgctatttgccgtcgctgttcgcctccaattcggtccattcgtccgactttggcttttggttgcggatgatcaccgacccgtcgtcctcgtcgctcccttccgactctcccaaaaacgccccctcccgcgcctcggagtgtccgttgcgcgtctccgcccggtcggcttcttttccggtgccgttgccttgcttttgctggtgtccttcggcattgtttgtttccgcttgtgcctccgtttgctgtgccaatgaatgccttcgatttgcccctcccctcccaattttacctggcgcccctccaattgcgcttcgttcgccctttccccttctccgatttcccctcggcccttttgcattttcggactgtccaaatttgccttaaaaagtgttcaggaggttccttttttatttctcctccgtttttacctcaacagaaccgccatgttcagaggcagaagtgatttggatgtgtggctgactgatcagctgattggcaccgattgtctcaccaaaactttgacgaatttcctcggctgtggccggacgagtgccatcatcggactgtctgggggaaatgccgttttcggcagaggagtgatgacttgggcggcgttccaaatcttccattcctgctacgccttcgtgtcccattttcgccgcttcattaacattctggtccaattcgcgtccactcgcttca

SEQ ID NO: 23340 - DNA, 3482 bp, Heterodera glycines
  misc_feature (2209)..(2209): n is a, c, g, or t
  misc_feature (2259)..(2259): n is a, c, g, or t
tcccttgtctgtggtcttttgtctgtggtctttcgtctgtggtccctttgtcactgcaccatttcgtccatattttggatttttttgtccatataaatccgggccctataaattaaaattcaaaagtttaaataagcccgggacgtggattttcgatcaaaccggaattttttgcaagaaaaattcaaaaaatgaattaattattttttcaattgaaaataccatattgaaaagttaaatttttttaaaatgcgtcagtgatataaatattttaaaattaattctgtatcaaaactacatattggagtataaaagtaaatttatataggaagttcgttctgaattctgaaccttggacccgaattcaaacaaaaagtcgaaaatctaaatgttctaattattcgcgtccggggtttggaattggccgaaattgatatcggattcgttgatcagtgatctcgaaaacccagggaacttgtttttatgacattaaaattttcactgacgcctttccgggagcggataaatgtgatttgaaactaaaactctgccgttcacttctgaaattctcgaaacatcgtctaaatttccgaggaaaaaatcgaaaaatttttaacattcaaaatgctgccgatatttactttcgaggtattgttttactaaacccattttccactgacgcattttcgtgaaccaaatttttttaaattcattcagatttatgcaaaacaattttgataagaaggtcaattcgctctgactgatctgactaataatttccaccgaatttacttcgtaaattttcacaaacagaacattcgtcgggcaacatttggcatttcagtttctcacagtaattctcaataccatatccatagcttaattgaaaatacagagtaattaatatttaattattattatattaaataatttcagtgtcatcttcaccatggcacattgtttcctatgcattcacaacgtttgtgttgaacattgaccacattgtgctccatatagcactcatcgactgctttttccacttccttttcacttgctttgacggcacagcttaaattagcagtttaaaattaatttagcgattaatcatttggcttatgcaattactttttgtcggcaaaacatctcaatttcgactgtttgtcaaaggcacacactttggccgtgtcgtgccatttttggtccaatttcacaagcgtatggttgtcaagtgctgtgtgaattttaataatttattagtaagatgtatttaaaatgaaaaattgccataaagtcaaataatattcaaaatggtttcctctctctgtttagttaatttcaaattcaaaaagaattcgccaaataatttcactattagagcccgcccggacggaaccgggggcccgccgggattcccggccccggtcccctttttttggacaaaccaccggaaccggtagtgccggaaaaacggagttccctccgtccattttccaagtgccggatccagtcccggccatttcaaaatttcgggcctattcactaccatagagagggtccattcgctgtgcaacattttcgccgacactttttacgaatatttccaagaaatcattcgatgttattttaacatataattttgtgggcaaacaactaaaaattaaagcattaaaatttaaaaaatattaaaaattaacttaattgtttgaccaatttcgcattaacacaagaaagccaatcttttacaaaatttgtgaatttgtaaaaacacggcgcagttttgttcgggtccgcatgcttaaaaatttttttaaaataaataaaaatttaatacggacaaatctctccaaaaatttgtcaattttattcttcaatttcatctagaaaaataatcccaaaatttaataggctaaaatatttattcacacaattttaaaactaaggagagatttgttagcctgcaaaagttttaattcaaaaatattctttaatatttggcaattagtaccgcttttattaaatccgccttcacttcatcgtatgccacttcaaagcattttgccgtctcgtcaattagtactccaaaacattgattctgttcatcacaagaacactaaaatattgagaattaattagacaacaaaaaaaaaataaattttctttacttaattacctgacgatatatgcaatcgccggatccttcctgaacganaatgcgaggaagaacaaaatgtagattatcatttaactaaaaacaatttntaatttctatttcttaattgaacttatggccaatttttcatgaaattatcgctaataaataaacaaggaaatactaatttgtaacaaatgccacttttccatttaaaagaatttttcattgggaatttaagtaatgtcatgaaaaaagtaatatttgttaaatgtaagagttttaattatcatcatcaataggatgaggatttatatttataaaaaaataatcccgaaatatttaaataaatatttaagaaaaaatgccaaaatatttaagaaaatattgaccaaaaatgagaaatttggagcaacaaaacaaaaatttatcaaaatattgattaaaaaaatgcaaaataaagtctaaaatatttttttatatttatggatattgacgttaaaactaaacattttcggcggctaaaagtgatatttttcgtgcatttctcatcaaaataaagcagttatttaaataaacaaaaaccctcaccctaatcatcatcattgtattttaacttttaaaattttggataatttatgaaaaatgttaagggaaaaattttaatgaatttttcattggaacagaaaatgctaaaaaagcaatcatttttttacttcttgataatcattcgatgctccaagtgttctttaacctttttcgtcctcgccaggctctcgccgttgcgcttaaatactccgccggccgccgctctctccacccgcttatcaattagcggtgatcatacacaacgccatcaaccaacaaaaattatcatcaaatttgttccattttgccccaaaaagtgtcttcccaatggctcgctcctgtcgcggacaaattcgccatgtcaacgacatccaaagcgatggcgaagaaaaagcgattgttttacggcggtggaccaaatattcacctgctgttgcagcagaaaaatattacaaataaatgtgccccactcaaatcacgcgcggacttctttcgtagtctcgcgcacctactggccgccgtagtggaaatgcgctggcttttagcacataattaaaacctaaaccggaaattatgtaatgtttcaagttacaattattttaatggtttcatataatgttcttcggggttttgagccgtgttgcgatttttgcgccgcgacacttgcgacgcgaaatttgcgctgcggacatttgcgccacgacacttgcgccgccaagcaataatggacttttgggccgctcag

SEQ ID NO: 23341 - DNA, 981 bp, Heterodera glycines
cttcttcttcttctttttcttcttccgttggtggcaacaatggcctaaaattaattaaatattttatttttcgataaaattcaaatgctattgctgctgctcactcaatggatttatcgaaactccacagatcaaatctgatactgttcaaattggcactcggatttaagctgtctccccatttaattgctggcaccctcgccgtctccccaattgggcaccgttgcaacagccaattatacacatttacgtcgaattcgtcgatctcctgtttcagtgtcagcttttcattcgtccgtttgttcaccaattcaaatggttcagttggaattgtgttcacatgaaaataaagttgaatattgtaactgacagaagtggtggcactgataaatgtctaaacaaatttggaaaaacaaaaacaatttatagaaaatatggctagacacacctctttgaagttgttgacccattcgagattctgtggaccaaaataattattgcgatacaatcgcttcggttggccatttttgctcggagtgtgaagccatttgaccaaagcttggccagcagttgcatttggtccatcgtcagcaattccatcggggaacagttcattggaatcaattgaattcaattggtcaagaccagtgagaattgtcggcgagatcagacgacgcaaattgtcaaaggcatcgccactggtaaagcccaactggcgaatgcttttcgcaaaaaactcaaatttggtgcccattctgtcccaaattggcttgtttgaacggataaatgtgagcacagaatggtcaatgtagctgaaaagggggaacaatgatgaagatgaccaaccatattaattggtttctgtatagtttttgatctactgaatctgaaggaaacgaaaacggattttgtttggcagcgaatggtccggcaatggaaatcccacaaatttgccatcgatcgccacagacagtttcgctt

SEQ ID NO: 23342 - DNA, 1178 bp, Heterodera glycines
aaaatttttaaaatttattcacctcccttattgatagaaaaagcatcagagaatcttattaacttgtaaataaaatttggtgtgtttcagaaccctttctgaaaaaatatttatgaattaattttgcaaaaaataaataaaaacgaaagactcagatttccgaaaaattttttagagcaagctagctcggcgctcatttcagtgtaagttagtcctttaccggggagtatccctgcaaagtttagtatgcttctgctcaattagcaaaaaatatgagtgatcgaattttcactaaaaaagttaagcctaaattttttggcatatttaaaaagcaattaaaaaatttttaaaattttattcacctcccttattgatagaaaaagcatcagagaatcttattaacttgtaaataaaatttggtgtgtttcagaaccctttctgaaaaaatatttatgaattaattttgcaaaaaataaataaaaacgaaagactcagattttcgaaaaattttttagagcaagctagctcggcgctcatttcagtgtaagttagtcctttaccggggagtatccctgcaaagtttagtatgcttctgctcaattagcaaaaaatatgagtgatcgaattttcactaaaaaagttaagcctaaattttttggcatatttaaaaagcaattaaaaaatttttaaaattttattcacctccctttttgatagaaaaagcatcagagaatcttattaacttgtaaataaaatttggtgtgtttcagaaccctttctgaaaaaatatttatgaattaattttgcaaaaaataaataaaaacgaaagactcagatttccgaaaaattttttagagcaagctagctcggcgctcatttcagtgtaagttagtcctttaccggggagtatccctgtaaagtttggtatgcttctgctcaattagcaaaaaatatgagtgatcgaattttcactaaaaaagttaagcctaaattttttggcatatttaaaaagcaattaaaaaatttttaaaattttattcacctcactttttgatagaaaaagcatcagagaatcttattaacttgtaaataaaatttggtgtgtttcagacccctttctgaaaaaatatttatgaattaattttgcaaaaaataaataaaaacgaaagactcagatt

SEQ ID NO: 23343 - DNA, 1618 bp, Heterodera glycines
  misc_feature (1548)..(1548): n is a, c, g, or t
  misc_feature (1589)..(1589): n is a, c, g, or t
ctttttatttattttttaataatattaaatttcacaaaatcaaacataaatgaatattttaatttgattttttggtgttgaaaatcaaatttaaataactgtttttcagttattttttaattattttaaacaataaatttttacttcatttccttcagaattcattcataagtgcccgttcaacttgaaaacaaacacaatggtgattttcatttttgtcatgaattttattttgtttttacaattctaatttttttttaactatttagaatcaataaatattaattttgaatattaatctgcaaatattaatatttcaattatatggattttgaagtcatttcttttgggtaacataaaattttttaatattcttttataataaaattaattattttgcgtttgtaagtagcatatatgaaataaaattattttattttgaagaattaaaaaaaaatttattctcacctaaataacatattttttaattttcaatttttaaaatagggtttccgtattttattaaaataatttatgcgtaaataaacttgtcaatattcctctcaagtccgtcgattttcttgttgattcttttactaatattcgaagaaaagagaaacatttgttatttgttgaaacacactttttaattgtacgtttttcattaataaagttttattgaatgtttagtatgattgattgctgctgcaagccattaactgataaaactcactaatttcccttagaagcgtaaaagcattctgtgtcgcaaccgtcgttcccggcaagtccaggaaaacctctatttccgtttcaacattatctgaatttctttttttaattttggttttgtaatgtatatgcgagcacactcgaaatctttattttattgattaaaaaatggtattataacaaaacattaattattaaattgtataacctaggctgataaaataagaaaattctaaataaaaaaatacaagttttataatattttcgccgatttatatatgtacaattgtaccttttttgttatgaactatttttcttgcattttcgaccagctaaatcttagtgaattaaattaatttaatttatttatttgattggcatttacggttttttttctcatatagatatttattttagataaaagaatcattaaatgtatgatgctttaaattatcaagccattctagagaattatattaattaaggaaattaattttttcttattttatataaaaatattattttatttcagaatcgttattgctaaactatttattttatagagttaattcgatgaaaatttttaatcataaaatatatcaattatatggattttgaagtcatttcttttgggtaacataaaattttttaatattcttttataataaaattaattattttgcgtttgtaagtagcatatatgaaataaaattattttattttgaagaattaatttagaccattttttaaaattaaattttcttggatttatgactctcagtaatttaatcagtttgtattacgtacgcttgctgngcagctttttcgatcaggtccacgtgcgacaacacatccanaggcagcagtagtgacgcagcccccactg

SEQ ID NO: 23344 - DNA, 1397 bp, Heterodera glycines
  misc_feature (1379)..(1380): n is a, c, g, or t
  misc_feature (1392)..(1392): n is a, c, g, or t
ttttgaccctaacttttttgaaactcaataaaattttttgaaatttatcagaataatagagaaatcttttggctatctaactatataaacaaaattaaaattggttgtttcagaaaaaagttatgaaggaattaatagtgtcatatttttatggctatccaaaaaatgtatggtcgtttaaatgcatgaaattgtttaaagatcaattaattcacactgcactttatatgaaaagatagcccaaagatttctctattattttgctaaatttcaaaaaattttattgtttcaaaaaagttacggtaaaattgttgagcccaaacttttcgagcttttttgtttacaactttttgtaaatttctattaaatttttaaaaattacatacctccatttagaccatttcaatcccggacccgaattcgaaaattttcttaaaattcataaaaaatttgttgtagtgttgcttatgcattgatgctaagaaaataaatcgatgtcacgcattcacgagtagaacacataaacagcaacaaaatagtgacaaaaaggccgaaacagtgacgaatagtaagggcggggaccggtaaactggacaccagaaaattggacaccaagcggaaaactggtcaccgttggaattttggacaccgaaggaaaattggacaccggaaaactggacaccaagttcctaaaataaagccaggaattggggtgaaaaataaatttatgaagggtaaatggattaatgaattaaggcacttagactaaatcaggcattcaacatgcacgatgattgatcaatagtagagaccggaccgggccgggcccggtaccggtttttaccgggcccggaaaccggaaccggtgatttttggaaaaatccggtttgaccggtttttgagagaccgggcccggaaaccggtcgttttttaaaatgcaacccggcccggaaaccggccttttggaccggttttgaccggttttataatcaagccaaaaatgtttctttttgttcatttttctttgaaaatgtctttttggcataatgtttttaattttttttttgtcagtgttcaagttgaattttttaattctaatgtttgcttctagagtagagcgggaccgggaccaaaacacggacaactgagtacaactgagtaccgaggtcccggttttgaccggaccgggaccagtcccgggttttttcccggttttcccagccaaaaattcccggtttttcaacccgaaaaggtcccggtcccgggtttgcccaaaattcccggtcccgctctactctatttgcttctttataattatgaaataatgtcttttttgtttagattttatgcaaatgagtatgatttggcaaattggcctnnatttaaaaaaancgtcc

SEQ ID NO: 23345 - DNA, 2553 bp, Heterodera glycines
  misc_feature (2465)..(2465): n is a, c, g, or t
cttgctttcattctcatttctcctccgctccttcatttttttcatttttccatttcctttttcaattttcaatttttctttttttagatgcaaaaacctactccttctaaccgccccaattcctctgtctccaaaacccttgcctgcgggcttgaaaaaattgtgaatttgagtggaaatgagccactctcggtgccggtgctggcggatcggagtgatccgctggggctcaagtcggtccaacccgacccggtgccaatggaaagtgccgaggctggcacaaaagaattggaagtgatggaagtggatgaaatgagcggagaaaaagggaaaaagggagaaatgggtaaagaaaaggtgaaaagtggtggaattgaagaggaggaagaaagtgagtgcagtgagggtgaactgctaggagacggtggatttggcaatttgcaactaaaccccagcctgagggcgggaaataaagcagttgaaaaggaagataaggggaaaccctatctggtcgcccaagtgagaagcgacggtgtgatcgcggcacggatgaaacttttctgggatttcccggaattggtctttgtcccttttagcctcttcgacaacgcccagccgatcgaaatcggcgatttgttccgcttacataagtgtgagtggacgaagagcgaaacaggatgggaagagcgcggagattggctgtatgaagcaaccggacggctgaactaccaagccacggcaacggacgtgagccaattgcgccagcgcatccccactcaggccgtcggcattttggtcgatgtgcaaagagcccgtgaccgacacgtcaaagtggccatggtgtcagcacctgagctgagctgcgtgatgcgcgcctaccgtcgccacttcccggccgatttcacggataccgacatccgctaccgctctgttgttcgtcttcaacttcggcagatcaacagtccgccatgggtgctgtattcacagcagtttgcgtatgttttgccatctgattttggtaaaaaaaaggggcgatgaactgctcgttcatcacgcaaacgtcattgctggcgttgagcctgagccaatgggctatgagttccctttcagtgccgaactgagctgggcgaaggtccagctgggtgagaaggtcatggcggcggctgtcgcagcgcagtcgttcgatgtgaaggctgatctgcggaagcacactctgttcgtcgagccggtcgtcatcaatgagatctcgacaagaagcgtgatcatccagttcgtcatgccggtgccgagcatcgaagagctcaccgaattgtgcaaaatctgggaggtcgatttggcggtgggttgcaaagtcaatccggcagccaaggcaaagccttgtgcgcatgggtatgtgctaagcatcgaaaagcgggcattctgtgtaggatacgagatcgatgtaaaagtgatcctttcctatcaggcagcgaaggagcaggatgcccaggaggaattcgatcagctgcgcaccggcgaactcgacggatgcgttgaactcatcccgcagacgtccgtcagggccctacaggaacggatgttcacgctgcggtccaatgactgctcgaaagtggcgaaggatgaggcaaaggtgggccgaatcatgtcgattttattgggccgaccggtaaaaccggaaagcccaaaggccaataacccattaatgacttttggggctctttcaaaattgaaagagggacagatcgacaccgcgctgtgcatgctcgacgaggtgccgcgcctggtcttccaacaggctgggcccggcaccggcaagacgttcagcgcggcgtcgatcgtggccacggtcctggccacggatcccacggctcgtgtgttggcgctggccccgccgaatgtcgccgtcgtcaagctggtgctggagatgcaggatgccctggccgccggaaaccacgtggagccaatgcttgccttgttctcggggacaggtaagttgagatatgccaaggaagttgagcggatttcccccacctgctcgccaccgcggtggaggcacaggactttcaggaactcctacagaaggaccaagaacgcgtcaaggtggagcggtacctggacgcctgcgagcggaacccacgcctggcccaggaaatggcagtggcgaaaattgtgcaggagcacaaaaatcgccgcttgtgcttcgccaccttgtccttctgtgagcagctgccggcactgttcggggagacgacccatttgatcatcgacgaggccggacaggcgccatacgtccaaatcctcaacttggtaagccaactcccctgcctaaccaaggtgctgatcaccggtgatcgccgccaactgcgtgtccatttgccctccctgccgatcgcaatccgtgaggacttcggcatggacacggtcatccaaaacctggatgtggcgcgaggggacggacgtcacancattgggtcggtctgttttcgctcgcattctgctctcgtcgctgcacggagggccggctttacaaccgcacggtgagctgctgactcc

SEQ ID NO: 23346 - DNA, 1322 bp, Heterodera glycines
agtccttctcccttcctactcgcagctaccattagtcatcatttatccgttaatccctccccactttagaatgaaattcaggaaaatatttatgttgataacttacttctctcttcaaataatcccatagaagcacagaccaaatgtttggattcaattgagctttttgcaaaagcatcaatgcctcttagagaattttgcagtaactccaacgaagcgctttccctactccctcgtatcattaaactgaatggccctgatcaaaaattcctcggaatcaagtggaacaccgattcggattgcttaattttatcccatcaacccccttcaacctttaaccccacaaaaagggcggttttgtcctttattgcagcatgttatgaccctctcgggcttatctcaccagttttagtgcctcttaaattatttttccaatcgatttgcaaagaaaattataattgggaccaaccattaccatttaatttaaccgatcaatggcaaaatttgtttaaaaattggtcctttgccgattcaatttctgttccccgctatcaatgttttcttcctgaccttaatcggaaataccaattacactgttttgttgatgcctcgtgcttagctatgtgtactgcattatatctaagaattacccatccatcttcccaaaattctgtaattgtattaatttttgccaaaactaaagtcaaaccaatgcataagggccaaaatttaaccatcccccgcctcgaattaatagaacactgattcagtttatatttcgcgaagaatgagctgtaattttgcgaattagacaaaaatgatcataaagtaacaaatgagagaatttcacattctgctaattaggctttaaatataaactgtttaagtgttgcagacggatcaggttgataagcgccaataacctcagatttactattttcgcgaccccactttttgaattctgtcagctcattacgctctaaatataaacagcatcagtgttccggaaggatcgatttgaaatcgccaataacccccaaattacaatttcctactgtaaacttatacagtttacatttggatataagaaattgaaatattgagaatatcacaaaagtgatcatgaaaattgtaaattggagattattgggacttatcagctcggtcctccgcaaacactgattcagtttatatttagaggataaggagttgaaatggtggaattccaaaaaggtgacaaagaaaattgtaatcgaagattattgacgattatcagctcggtcattccgcaaacactgattcagtttatatttcgcgaagaa

SEQ ID NO: 23347 - DNA, 1234 bp, Heterodera glycines
ttaaatttttattttttcgtgccaatcagcagaagcgggacgtacttcgcctgtgtccctattcctgcatttgaacacgacgccgtacgacccctcgccgattttgccaattttctcgtatttgtccaacatcaaaggcattttcgacggttgttccgcgtggtgttgtgccgtacttacgcctcccaccggcggttgttgatggcttttgctgttggcatttgccttcaatggcaccggtgaacgatacgaatggaatggacgtctttgctccccggcgggggacgatgacgacgccgcgggcgcgcattgcccggcgccatacccggccccgccgcagttgtcctcctccgtgtccgccgtcagtgacggcgagtgaccccccgtgccatttccgtcacccaccgccgccgtcgccgcggcggtggtaaattggtgaaaattttgtgccggcaattcatccgtgccaccttctgcagccccttctctgtcgcttatgccagcactgtccatttgcggaaagggcgaggggaggggagggggagggattgttgtcggcaattaatggtcgttggaccaaaaaagcaaattgttgacgaggaataatgaggcgattatttccgcaatttagtaaaattactataaattctctgtttttaatgtgtaatatttattaaacattgcatttcatttcattaaattgtgattttattattcttttttttccattaggcacaaaattaaatgaggccaattggccctcattaggcgggggaaatgcgactgacctcgaaaaatcaaaaggcaccttattataattacaattttcatttatgccgtgtctctctctcaaagtgcccaaatttgttgcccattcacttcagacagcggctggttttgaagcgtatccatggaaatggaagggaaaagcgggcaaattcactccctcccccaggtcacagacaaaagcaaactcaaagaaagcatcagaaacatttggacacgaaggaaaagccgaaaccaaaaaacagcgaagcagacaaaaaatgatttttatttcgacaattttcaaaagtttataaatacaaatttacaaaaaaagaaagaaaggataaaagattgcttgagtagtgaataaaagtgaacagaaagggaaaaacaataaaataattaataaatatgctgcaaaaaagcaggatggtagatcaaatcatgtccagatcgaatagtggag

SEQ ID NO: 23348 - DNA, 2261 bp, Heterodera glycines
ccaataaattctcacattttcctcaaaattcgcttattcattttcatgccacgcggagactttgtcgttttccaaatgtcataagtgaaccgaacgattgctgctgttcattttcaccaatttctgcagaagaaatggggcaatggtcggcggaggaatgttttttcttctttttgacgggcgatgccattgaaaaataataatttgccgaaatgaaaatttttgtatgaaaagaaatgagcaaaatttattctagatgtgaaatattttaaccataaattttaaaattcaattaacaaaacccatttatgtgtcactaaatgatcaaaaatttgtcaaagactttcggcacggatagaaatgaaaaataataattcaatcaaaaattgttaaaaataacattttcacgctcaccgaaggaagtgccaataactaaaaaaacaaaattttcaattttttggtgcaatattttaaaattaaatgatgctataacaaaaaccgcacagaaattaccaacgataaggataccaatggtgaaaagaaaggattttgggtttttcacatgaaaaatttgaaaatattataaagctcaaacgaaccttcagcatacaaacgaaaataaatcgacataaaaaatttcaaaaaatacacccctatgaattgacccgaaatttttcaaaatgcaaccctaagaaacgaaaaatttctcaaaatttttctccaaattttttttatttgttttttggcaaatctttgattttaaaaattatttatctcaattttgatttggcataattttgttgctttttgtataaaattttatgattttacaccccaaaatttgaaagtttttacaaacacttttctcatttttagcacctattttggggttttcagaaactaaaaactaactattttggcagtttttagcaactataaataccatccttaataataatgaatgaataaatggatgtgaatttttcctgaaatgtgggagggttgaaatgcacgaaaaacatgtttttagcttggtttgaagcttctagaatggctttatatatccatatttaccatatttcgctatttatgtccatattttgcaattttatgaccatattttgtgatttttggtccatattttatggctatttcgcaattttttatgcatatttttccgagccctaatgataagacagagacagcgattatagactgtgaagaaagagaaagagagacagacagacaccaaaagaaataacaaaagaaacaattaatgccttctttttggcactttggtgttaccatccgccgaacaaaacacacaatggcaagtgcttatcttattctcatttacggcatgtcttcttcccatgcttcttctgttacagctttttcagtttttataaatatttcctctaaattttcttcaaatttttgtcgctttaaaaatttcatttatttgccattcattcgctgtgccaattaattgtcatttcaaaataattccgttaattagcaattaagcataaaatatttttaatttcaacttcagtaattccataattttttttaatgcgaattttggattcactgtgtgaaattcggcatattccctaacaaatattcattacaaatgtcaaatttttttcattttatgatttttatttatttgatttgaatttattttaataatttttcgtttttatgaaaaattctttcattaattcaatgtgaatttcataatgtgtttgagaaaacaaaattcaaaaaacccatattcaccatttttttatcacaaaaaaacaaatcgtgaaaaagtttattatgcaaaatgcttttatcactgaatgcaattcacatgtttcaaccattttataaggcttttctttttcatctctctgttcacattattttcattaatcgctcaatacttattttgtgccgctccatcgttggcattttcgcttcctccgctgccaaaagtgtcatcatcatttgcggatgggccaaacccggcttgacgtttgccataccacacataggagggataggcgtaggcgtaattgttgtaaacgccccaccacttaagagacataaatttaaaaaaatataaaataataattaaggcgatgattttcaatttttgaattctttaatttatttatcaggttatatgtcggagagaaaaaaacgcatttttaggccggaaagaattgctagaagtatttttcattacaaaacactatttaaaaacaatt

SEQ ID NO: 23349 - DNA, 997 bp, Heterodera glycines
atgactttttaagcccgactaattttcttaaaattttggaaaaaaatcaattagttgataaaaaatcatagataaaaatcaatgatttcaaaatctgagttcacattaatgatcagcgcattttttaagcctagaaaaaatacatccgaaatttttgacattttttttcgtcgggacaccaattcttgaccattgccgtgtttcatattgtgccaatttctcaacgctgcatttacttgttgacgtgccaagccgcgtactgctccgccttcacgacgtcctcaacatgctgcttcagcatttccgtgttcgccaactctctcccacgttcaatgcgagtcgaccccaaattttagtgaactctaaacgaaaacgtaatagtaaaaagcactaaaaactgaaactttggttgacgatcttcgccaaaatgattttgcgcttcaattgctccctttggttaactaaaattgggtttgttattaaattaattcaattcaaaattcattaatttggacttttcaattcattcacaattaaaactttctgataatctcactcgcttccttgacacttcgtacaagttgttcttcgtcttgtttttgcatctgttgactttgaatgtttgtattgaaaaccaatttggtaaatttataatttgtgctgtttttaattgattgaaattaaaaaagagaaaaggaacttttttttggtgtacggacatttcgcctactcgacatctcgcctaccgacatcttgcctactgacatttcgcctactaacccaaaaacattcatttcgcctactaagccaaaaacattcatttcgcctactaagcaaaaaacattcatttcgcctactaagcaaaaaacattcatttcgcctactaacctaaaatttatattttgacaacgagtatcaccgaaaatatatattctaaattggtttatatttagcaaatgttattataataataattaaatttaacctaaaaatacac

SEQ ID NO: 23350 - DNA, 1800 bp, Heterodera glycines
tgaaaatcggcgcgagagtgaaagaatcgggagggaagaaggggatctattactctttgattgatattgtcagcctttaaatctataaataaacttgttaattttttcaaataaaaaatgttttacttaaaattatttctagtttggttcttgttggtcggaacggaaagttgttgcctttcaaaagaagaaaaagagcaatttaccagtgcccgaagaactgtagaaggcgtatttagagacataattaggttagataacgaagcaaaagaattttctttttctgcacataataccatggttgaagcccaaaatataaaaaataaaaaccctgataaacctggtgtaaatttttggcatagcaaattattagatggagttttaaaaattcatgccctatttgacaaaataaaaaaagaagaaaaaaatatgaaaaatattaaaaaaggtatggaaaaatgtctagacagaaaagatttaactatgtgtcaagaattagcagaagaggccaaacaatcaatcgaaatagccaaaaattatcggcaagaaattgggcatatttatcggaccgcttactcgcagccagatttaggtattggagatttggcaaataaactaaaagaaacaatgcgcgaaaaccaaatacggtttgaaaggcaaagacctcaggaagaatttagggatgaatgggtgacaacaagaaatcgttgatgatgctaagaaaaatccgagactccaaactgaatttagagatgaatttattgtttgtaaactataaataggatcaagaaaaaaataccaattaaataaaaatgaattctgaaaaatcagaaaaagctaattctatattattggaagctgcaaaaaaagagacagaaagagcatggcaggatgtagctgcgctaacggatgaagtaagcgattttgccaaatcttctcgcgaaacacttaatcgtgcaataaaatctagagaaaaggctccttactaatggtattcgagaattatatcttaaaatgtccgattcaatttgggaaatcttcacaatcctggacaaaatcaatttggagtcagaaaaagccgaatctacgtggcgtgatttcgagagatgcaaaacttttgaccaggcaacaaagctcgaggaacaatcgcaaaattcattaatggaagcccgaagattacatttcgagtcccgaagggttcagagccaaatgttaaattatgaaaataggctcaaaacaattgtttgggagcacgttggtatataagaacaaaaaactaaaagggcaacagccaaaatggaagggtgttctgtaattgagtcactatgtcatgagggcttaaaatttggctttaaaaaatataaaaccaaattttattttaaaaatcctttcctaattaatgcggaggaaaattttaaactaatactcgcatcaataatcgaaaaaatttataaaaaggaacagggaaaattcaaaagcattctgaagctttcctttgggtttgaatcattttattgccctcttagatgccctagcgaaaacacagccaaggctttgttccaacatgtcatattaaaagaagaattatattcgcttttctatcctttggatgatgtcataacactagaagtaactataatcccagatgtcgacaatagaccaggaaattaattttataaaaaacaaaattacgagaaattagaaaatttctggaaaaagacttaaacgatcaaataatctcgaaatttttgcaagtagagagtttaaacgggtgaaaattttctacatagcggcatttag

SEQ ID NO: 23351 - DNA, 1796 bp, Heterodera glycines
  misc_feature (84)..(84): n is a, c, g, or t
  misc_feature (105)..(105): n is a, c, g, or t
  misc_feature (166)..(166): n is a, c, g, or t
ccccccccccccccaaaaaaaaaatttttttttttatggggggtaaaaggaaaaaaagaacccaaaaaatttttccgcgtgagnaagtctgtaaaggggtgccancaagggtttggcactgattaccagcaatatttcaatttgttttgctcattcgatttccctncagggcaccttccaacaagcggtgctgtgcaacacgtgcggtgagaagttggacacgtgcgtcggccatttcggcttcatcgacctcgagtacccggtgttccatgtcggcttcttccgtctcgtcatccaaacattgcagtgcatttgcaaggtttgcgagcagcaccatggaaaatgaaaagtggcatttcagcaataaaaaattccaaaaattttaacaaaaaaaaaaaatccgcgattcatccaaggaattttgtgggtgaaaatatcggtatgagagtaaaggcgatgtcgtcggtgccgacaaatgtcggggctccaatgaattctttacttttgaaaattttttcttaaaaaaccctcgtacggtgacgctttactctgccgtaaaaacaaagttgttatctacaaaaaagacctgacatcttttccctatcatcccacccttaatcccctcgctttttaatggcaaaatttcccatttttgccgtcaaaataaatttaaaaaaaaaaatttttgccacaattttaaggcctgcagccgcacgctgttgcagggcgagccgaaggaggcgttgttgcgccaagcgttgacgcccaacttggactatttgcgcaagaaggcgttgcacaaacgcatgttggcactgagcaaaaagtgctcactgtgcacccattgcggctttctcaacggtgcgcaattttgatgttttaaggtttcctaccaaaagtgctccaaatttactaataaattgaattttgctaacaaaaaaccgtgaaaccaaaatccttatggtctccccgaaaatttaaaaaaaaactttcaattctaaggctttttcctagtaaataaatttaaaaaaaggctatatttttatttaaaaaaacaaatatttcaaaaattataaaacaaaaacgcttccccccccccccctagagtcaatcttgttgataatttttttggtcccgtcattattttaattttattgatcattttttgaaggcgtcgtcaagaaggcggtgggtgccattctgaaaattgcccacgtggagcccatcgacgcggagagtgtgaccgattttgtgaacgcgcagcagcggggcggcgtcctcggggggacggaaagcgaacgccaaagagaggcagggaaaatgggagggggcgggggtggaaaacggcgattttttgaacgaattttggggactttcatacctataaccggggagcggaacaggacaacaaaacacagccgccgaaacacagccgggaataaattaaaaaaaattttcaaacttagaaaaaatcttagaaaaatttttctttgaaaattctataagaaaaaaacattcaagtgagaaacccattgcaccaaccctgggcttgtccgatttggtgtccatccaatatttatggaacttgacaagatttgggtgctccagacggactaagttgtcgaacacagcgcgaatcttctcctaaacgattcggataaatgttagattagtcaaaataggtgggaattaaccatttctaattgtaatttctggatttgtttggttttgcgggaatgaaaatcaaccaatcaattaattttaaggggtctgtgaaactgcattttctgtgaatt

SEQ ID NO: 23352 - DNA, 1323 bp, Heterodera glycines
ttcagacggctccgccgtctctccaggggccgccctccccacaagcgctttcttctcagtccaactttcaacagctccccctgcaagcacaacaaacggtaccgtaccaaccatcagtctgctgaattggcatgattccctctgtcttttcagcctggtcctcactttcctcatcagccttcgcttttggggccgtccgccgcttctgtgccttcactttcactgaacgcgatggttcagcagcagcaaccctttgccacggtaccaacaaaactaatccccttttacccccttcaaattgccatttcagcctgccaataatgagtccttcggcgatgccctccaacaaatttcgcccactccgccgcgtccgtcaccgacgcgggagcaaagcgacgcgttcaacatcaaccaaatgctcgaacaaatcacgcaacaatcgtcggaccaattcaaaagaccgaacatggaggacccaatggatttgctttcgaaggccgtcgaaggtggcgccgtttttgtttcgttttgctcgatttgtccaattgctgttgcccttctcagaatcgcccgcatcgcctccgatgtttggctcttctgaaatgggtgccgcggggagtgccgacgacgccaaactgattccgatggtgagggagtggcgactgtacgccgtggacattccgacagaaaccgaaggccttccaatgaatttcgacatgaaattgattcaggtcgaattgggaaaggggggaatttgaggaatgttttgagatttcagcagatttcttcttctaattctgacccgcggcttcgaaaattggccgaaaaacaattcgacttggtttccaaaacctttgagaagaagcagcaacagaaaaagtggcattttgaaaacatttcttttttttactttggtttaagtgccgtcgaattgaccgacgaaaacgcaaaaaaagagacagaagaaaatgctaacagcacggaaaaagcaaagaaagaagcggcgacgggcgacccgcgcaaagacccgcgacgcaaagggcgagcgacggagcaacaccagcaccagtgagaagggcacatggacattggcagtacgtcttggctttcccgtttcagcccttctacttcgtcagctgccattgcctctccgtcaatgtctgtggacgttccccccttcaaaatggcaccgtcttccccaaattcggccccctcgtcggatggcactttctcttttcaccaacagagtattattttatccattgcccgtggctaaccaggggaacattccccaactgtaagtcggaaaacatatataatttg

SEQ ID NO: 23353 - DNA, 1358 bp, Heterodera glycines
atatatatatatatatatctatatatatatatatatctataaccgctaataaagcattctctcgattaataaagcattcttagttgttattctgcttacataagattattatcactctgttaaaagaatttagtaggggaaattaactttttcaaatattatcactcagtattttttctattataaataaagaagctggttgagtctttcgcacaacttaagtttgattctcagctcttaaataattcccattcaataactttattttaatgaaggtataagtatatctcattcatgtattgaatatccatttctgaggttataaaaatgtatttcaagttttaattaatgaaagtaatttaaaaacaatcaaatgtaaaggttggagaattaaacgaaagtgaacaaagctggaaatgtgccctttggccaaattttcgatttttgagaccccataactttttcatttcttgatatgggcatgtaaaattaaaaattcgcgacagaagtcgaccctgctcgatccaatgattccaaattatatatgtttccgacttacagttgggaatgttcccttgtaagtaaaatttcccttcgttttcagttgctgcttcgtctgacaacgcaaatgccgagggaccgaagcgaacgcagcaaaaagacggggcaatgggaaaaaaagcatacggacgaacggcggaagggatgggacaaccgacggacggacaatttcagtcgcacggaggagggggaccattcttcggctttcaccaccaccaacacccttcggcaccgccagtccatccttccatggaccatcatcattccgcaagtgttcccccgcctttcatgactcatctccatcccccgcccttcggtggacctttgcctttctgtccttttacaattggatttcgtttaggccaccaaatccattcctccgctgtcggagggggccctttcaacgtccctccgcccgtttttccgatgtccgccgctgcttccgtcgctcccaatgccgccccttccttccaacaacaactcggttcccatgcctttaatgtcggtggcttttcctcgtcctccgattccgtcggtgggccgccccgaccgcagccgtctcagatcagcagcctgcgcgagaagcggaagaacaacgagtacgagtcgccattggcacgcattggctcctcctcggggggtgccggggcattggggcggagaggcgcccgctattgaagagagacagagagagtcactcactgccgatgccccccccccttctccccctcttccgttctctgctcaatttgtcgtcttcccttttatcatatccaccaaaacacaaatttctcgca

SEQ ID NO: 23354 - DNA, 1807 bp, Heterodera glycines
  misc_feature (16)..(16): n is a, c, g, or t
tagagtcacaataaantggctttttaaaaaataattaaaaagtgattcttttattgttttagtaataaattccaaagattttcgcattgcaaattctttacattttttactaattcactaagaatgagtaaaaagtgaaaaatgataagggaaaggggagacactttcaatgatttgatttggcactgccaaagacaactgacaaaactgacaaatgatcatttcccgagaccaaaaggccgacacttttctcgggttaaccccaactttgacaaatgatccgcgctctagaaatatttttggagaacaaaaacattattaaaactcaaccgaaggcccaaattgatgaatacttgggcaagagggacgcaatgaaaaatataacgaaaaccaaaataaacaatggcaaaaccaatgatcggataataaaaaacaataaataaaaaacaccaaaacaacgaatcttggacaaaaatgagttaattttgtcaattaaaggcggagtcacaaaatcatttgggccttttaatagcaaaaaatgtgcaattaattgccggttaattaattaattggtttcgcttaacgtttgtttgtcctttcccccatttttaattatatttttttccaattttgctttaatttttcccatttgctcagcttgaaatgccattttccccacttggcgattgcttcgcgccgctttttccccctgaaaatgtgccgtcttttttggaaaataattccgtcgagggttaggacaaacatttaaaatttgaaccaattagactgataaaatgataagctaattgattgtttattcttcccattcccttattaaagggttcaccaaagtgttccacacgaggacccgttttcttctgattgtcctttgccttttgtgtttggccagcgtttgggccaacattttatgtaagaacaaattaattaaaatatattaacaaatgaaataaattaggttttaactttgccatcatttgcattgatcacaacgaaaaaagtgccaatgaaagaaaacaaacggacgaattggcaaatttattgaatgaaaacggcacagatcaaaatgggtaattttgtggaggtattcgaaatatcgttattttttttctaaatttccagaaacggcactttctccgcttttgccaatgccaatgtaaattcaaatggctccgccgtccccgcaaaaacttcgaaaagttttacgccgcgacaaaaactgtacctcacctcggcggtcgctgcggccgccttagtcgccaattttgcggttgtcactttggtgagtttcggcatttgtattttatctaattggctaccataattctaccgtatccgttttcctttgtttttaattacttttgctttgccaggtgaacaattacggcattcgcacagtgttcgttttgctcggctttctctccgccgtggccacttgcttgctgccaacggccattgaactcggctttttctatgttttggcttgccgaatgctccagggtattattcttccttcactaattagtcccattttccttttaattaccctaatttgtccacaggggtcactttttcctgcacttttcccgtcatcggcgcgttcacttccaaatggacatattacaagcagaatggactgttcgtctccgtgttggtcgcttatgtgcaatttgcgccggcggttacggtagaaattggtttattccctgtaaaattacggtatttataaaaaaagaataaataattatttttaattctcaaaatccacttttaaagttgcctatcagcg

SEQ ID NO: 23355 - DNA, 1862 bp, Heterodera glycines
ccctttccccattcagtcgccggtgtctttgtgcagcgtcgtcgtgcctccaccatcgtcaccaattccttgctgttggcgctggacaagcctctcgacctgagcatcaagagcacggtcattctgcgtgacgaatggcttctgctcggtgcccaggagggactgttcgccactccgatgagtccgcaacagttgcgcgcccccttccgaattgcgggcgtctgctgcgtctatgatgatttaatcaaaaaaaaatttaagttcagaaaaattattttgttgttacaatttttatttttgatgattaaatttagttgttttatgtgtttaattttttacacataatttgttgacatgcgaatgtgatcaaaaaatatgtcagaaagtctaatttgtatagtaaaataattttatccaatttaattaggtatataatatttttattgctggagaatgtcttcgtctgcgatgggaactcaacccggtgagcttttatacttccttcccactcccattggatactttcaaacaaaaaaagtgatggagtctaatttgtgtgcgtcggaattgagtcgatttcatttttattaagctctcttcgaccgttccaacatttccgttgcggtgtcctttttggccgggggtttggccattggctatttgctcggctggcgaaccacggcttcaaaattggcccgatgcaacacgcgagtgcagttgagcaaggacatggaacactacgaacaggaactgcagaaggtgcattattttgaacgagcaaattatattttaaaaaatcaatattagaaatccagcaaattttcggtttttaaaacatttcatgatatttagttgctgttcaacagatcccttaatttttttctaatttttatacattcaatgcaattaaaattcaacctggatctgggttttttcaggattttaaaatgccgagctctacgcgtaatatgatgcatttttgcccataaaattttttttgttacttctaggtcaaaaattgccccaagaaatttgaaactaacaaaaattaattgtttacaatacaatttgtttttccctttccaggaggcggtacgcattgttgagcaaaagtaaataaattcatttttttttggaattttttggccaatttttctctgtctctttccccatagattccccagcaaagtggtcgagttcaacgagttgctcaagaaccccaaataccagtacgagcgcttgcccgagatcactgtgttgtccgatgtcaattcaatgtaaagtttttttttgactccaaattatgccgagtctatgagtttaaagccccctagtgatttcttttcaaaatatcatttgccatttcatactgaattatgccataattgtccagacccttggattcgtggggctgaagtcaaaaccccaatttttaggggtattttttgttttttgaaatcccgaattagggggggggcgtgtcttttacaaaatttttagcggtttttcgccaagaaattactattcccccctggctacgcccttgccacttagtacaaattttaatgaaaatattacattgagattatccatcttttttcagtttgccagtgccatgtggtggtgagcaatcgagcggcgagggagtaaatttttgattaaactatatagcgattcatttagtctttaaaatttgaaaatttcaacctaaaacggaaaaaaattttaaaactgaaattttgggtattttttctaaattcatcccactcattgtcaaattgaaattttttctacgcttttccctccttttgtagcatgccgaacagttcgtctgttgtcccaaagggtcggtgaattgcaat

SEQ ID NO: 23356 - DNA, 964 bp, Heterodera glycines
aatggcaataaacaatgtccgtcaccgcccccccccccccgacattccgacaattccccgtcccaatcaatccgtcctaaacgattggacccaattaatccaatcagtggcagaagagagaatccaacgaagggaggacaactgtcggatcagcagcagcagcagagagcagtgcttgatcacttgtcttattgctatgtaacaattaaattttgctgaggaaaggccgagggttaaaatggaccgcccgagggccaaaggatgagtcatagggagaggagaaagaaacgaaataaataaacaaaataaatattaaaaataaatacatacatatatcatttgtagggaatttaattccaaattatttatgggtctcaagacttggaattttaaactgcgaacccttcgagagctctggcttgagctaacaataagtctaaaaatcaaaggatgaaagtgatcagagtttgaccagttaaattttaaaaattacgtaaaaattattagttcatagtttttaaatcatgctgaccacgaatcttgagttcataaatatattcgaaaaaattatttgtaatttttttcttcatgtcaatatttactcgagttatttttataattttccgatactttaagctttcaattgggcaaaggtaaagaacattggtccccacaaaaaatttttttttaaattttttaaaatgatttttaggggtaatcctaggcgctgaacatgaatctgaccttatttttgctcaatttcgaaccccggacccggagttgttgaaaacaattaagcgtggttaaagtcgtaaacaaaagttatgaatcgggcggaaccattgaataagaaggaacaataagaatagacggcagaaactggagcacatagactgacccctagaaaatttgagctaagaaacaagcaatttagccataggatatttgtactttttgtgaacaa

SEQ ID NO: 23357 - DNA, 2225 bp, Heterodera glycines
tttttcaagatttaattctgcaacttttttcaacaatacatattaaactctcacgatatttgaaaatgaataagtgctcaaaatacaccaaagagaataaaaacatattttttatttttacaaaataaaaataattaatcttttaaagccaatatgtataggattatttatgtttatttataaaatatttttattttttcattctgctataaaaaaaagttttttacattaaactaattttgaattcgaaattaaatactttatctttaatttatcatcagaatagttttaatcggtaaaaataattccttattttttcatgtaataaatggtattaaaaattaattattattatttttcagtagaattacttttacgtatgtaatttgtaattaagatacaaaacagtaaaattcctttttaagtatattctcatgtgctatattctcttgtgctttgaaatttttttttggagttatgcatgtatagttttacactaatttttattggtgtttaaacttattatttgcatttttatgatatgggtatcaggttttatttaatatttttctcttaggctttgttaactttaattttatgatatattcattaaccaaatatatattttaattataattttttctcaagcttttaagagtataaatatgagtaagtaattttaatatacctaactattttcacaaatatggggtcaacagttataacggccatttttcagagaaccgatcataactcaatggatattattaactgattagaaaacaaccaaaattgtacagatagttcaaaaatatttaactgaatactgaagcctgtaaattaataattgaaaatagggaaataaaatttattatgaaatgcaaaacatctgcaacaaaaattaatctaaaatatgataattggttaattttttattatttagacaatattagaaactaatttaatttcacgatttttaagcagaatgtaacataaatatctaaatgttagatcttatcaagttaaagaaatttgttaactcgaataaataaaaaattaacaaatcgttcatgagtctaatctcctttttaagtatttatctaaacataaagcgatgaacaagccacagaaaagacaaatttcttttaaatagaaaattgtcattgctcaaatattagaatttatttattgaaaataattataaaaacaacaagaaaaaaatatttttaaatataatcctgaaattaatcaaaaaaataagacggattaaaatcatatctattcatctttcttcaattttttaaatagctttgtttttgtcaatcaaaagctaaacatttaataattataccgtgaatattgaaacattaaattttcttctaaaaaataaaattcataataataaaaaagatattagaaaataaaacctgttctataatgaaaataataaatcattaaaactgaatatttaaaaaatatttcatgttttaatgcttcttaataatcttataaaatatgagatattaattagtttcttaataaaattaacttgttatagtaccttaatataataatgaacgttccagaatttttatataaaaaatctaaaagcgtaaattcgcaaacgaattatgcaaaaagttctaaattgcttgttatttttattatgattaagaataaaatttttttgtaccaaaattagtgaacaattttaatcgtttattagatggaaaaatattttaaaaagcttagttttgttactgtcacaattaaatgaatgaatatattcaagaataggttttcaaaaaccaaacttattgagataaattaaaagcgtcaaatttcaactaacacataaaaaaatttattgtgctaaaaagggttaaaacacattagaaaaacaaaaataataaaatcatatgggaccattagtctttgaacactaatacaggaaatacggtaacctttcaatggagaacattgaataactcgatttaactgtctcagtttttctaggcaaaatttaatttaattaaaatccatactataataattttataaataaataaataatgattttttcttatttcaaaatgatttaagaaatttgaatattttccgaaatcgaactaacaccgaaaaggacgcgataagctatttcaaggataaaatgagaaattattttcttaattataacccgtaataataaaactaaaaattaatat

SEQ ID NO: 23358 - DNA, 2395 bp, Heterodera glycines
  misc_feature (2176)..(2176): n is a, c, g, or t
  misc_feature (2258)..(2258): n is a, c, g, or t
tttttttttatcattcagctgactacactcaaattgattgcaattggatagaagaagcgacaaatggagaagtgaagtgcatagaataatgaacgaagttgatatatttgattgaactgaaacttttttaatgcttttaaatgcactaaaatattctatttaaataatttttcaattctttcaaaaagcatatttaaaataaaaacgaaactacatgtaatactctctattttaaattattgagcagagggcaaaccgtttattattttaattaattttgtcacatttttattttaacagttaattttcattccttaaaaatggaggaatgtttttttattttaaaaatttttaataataatatttatttagagattttcaaaccgccaacgaaatttttgaattttattgtacatgaaaaaaacatgagaaaacataatctttgaattgatcaacggattaaggatttgcagaactttgatgtgaagggtgtcttctcagatcagaccaaagtggttcgaagtgatcggcaaatatgaggacgaccaaagaaagtggaccaatgatcagccaaatggtgatcagctgatcagaaagaacagcttagatagaaaattgttgatcatttgattagcattgtgttttctgttttaccacttttctttttcatgggatgcaaatgatgctgataattcgtaagactgggcacacatttgggttttggccctaaaaatggcgacacgaaattttgttctcctggaaaaatgaatccaaagaatttttattggatgatcctataaaatcatttcctgaattttttttcattactcaaaaaaacccttaaattacagttttctaaattcgattagcatcatttgtgtgtgggtaaactgtcttagtattagatttatttatgtaatttttctttgcaatgttattgttttgcattttcggtttttttattaaactttttttctgtcttatttattatttaaaaacacaaaaataaaaatagtatttaaaaaaaaaattattggcaaacagttaaaaaaccaaatttgaaaaaaggcgatggccttatctaaaaaaactaaatttttaaatatcttgagaaaaaatcaggttggtcttgatcaaaatacttgaagaggattgggatttcaaagatggactcgtattgtatttccataattttatttgcgttaaaaatattatgaccgaaataatacaaataaaaatgttatttgcacaaccaattcacatttcaaaatattacaccattttcttcacaaaatttttgctatttaaacggacccatttttggccacttttaatcattgctcacaaataattaattgaataaggcaattcgtctctgatgttgccaattgccactctgttcgtcgtgctcattgcgatccaattttacgcatccgagcaaaattcaatcagcgtggacctaacggtgatgaaaattttaaattaaaaattcttttattgtatttatcttcctcatttcgatttaaacgaattaccaaaaagttccaggtgtatttgcccgattgctccatcaaatgcttgaacagttcgaccccaaaaatggtcacagtgtattgggcaattgaatattcgttctgcaccaaatccgtccactttttcgtttttgcttcctccaattgttcttctgtttctttgaattgttttgactttccgtacgaatcgcaaaatgccgaaataagcgcttgtcgaatggcctcggacggcaaaacattttctgtcgatgctttccagcgaaaggcgcaagccatgctcaaattgaaaataatattttaacggataatggggattagaatgaataggcaatgggatttagttaagacatgacatcctataattgatgcctgtaactcatttggttattatacactttaacaataattttagcagatttaattaatttttttgttggtaatttttaggtctgaaaaagtgagcagaagaaaatacaaattgtaaggcaaatatacctaaaagcgcgcatacgatctgcatacattggaggcggaatcggtccaaacgtttcctaaaaattataaataatttgatttatttttcttattagaattaatttactactgatttacccaaattctccccgtcttcacatatgccatcnaatccttagcatcctttgtttccacattaatataatttttaagaccaccaatatatttttgtttccgagttccactgaatgncatgaaaatgcccacaatgccaaatgtaaggcgcaacttttggttatacaaaaatgcctctgatttcggatggtttctgcactgattacaagtggcattgaaaaatgcattttgtcactaaattttaagggatttaa

SEQ ID NO: 23359 - DNA, 1687 bp, Heterodera glycines
ctaatcaagaatgcttaaattagtcatttttaatttttgaaagtttcttcgtacaattaaataattattttttgttttttcaaaaaaaggcgcaatggaaattaattttaattttcttttcatatattttttaaaaataataattattttttaatttgaaattaattatttttttcccatttttcgcaaattaaattttcatttctcacaatttttctaaaaatactcagaagcgcattaaattttagtggaataatagggaaataaatagaagctaagctaatggacaaaagatgaagctacaacagcgatttaaatttttcattttttaaattaattaattttttttttaaaaaattcgatttttagccgccgcattgaactgcgattttgaggggcagccctgttgctgggccaatgtgccaacaccgactgacgatcaaattgattgggttcaggtggagggccaacctcgcagctccattttgccgaggaatttcacggcggacggaaaatatttggtgaaaaatttatttattatttttaaaatttaaattaaatcgtttttttattttgattaatttactgctaagatattataattttaaaactacagttggccacaacatttttgttttctaaagctttaaattaaaaaaaaaattctataaatttttttgaatttttatacttaaatcaattttttaattggttatttcaagtttcaaaaaatagttttaagattttttcataaaaaaaacttgttatcatttgttttttatcttttgcatgacatcattctaacaccttatatacctttacctaatcagcacattcagatcaaaaataattttgcgagattctaataaattttagggctaattaggcccccctccccctcatttcgagatataattttcaaatttgatcacagattgcttatgccacttccgcgtctccgtctgacgaggctcagctgtcctcatgtgccatcgcctgtgccagctcatcaatccgcgttcgggctaggtaggtatgggttttggagaaaattttcaaaaaattctcaaaatttcaaaaattttcaaggcatatgcaaacaacgaacgtgctgctccaagtgtgccagcgcgagtgagaattttgtttttcgatgcaaaaattaaaattttaaaaaaattttcaaggtcctttccgccttcgctcgggttcaacccgttgctgaactgccaagaatttccgacctcttccgaccgtatgatcaacactgagctggtgttaccaaaagcctcctacgtggatgtttgtttgaattttaaatttggcgcacttttttggcgttacgttttttaattttaagatcatcattgttgcctccaatttcataaatgaacggggcgacatcgctctcctagacgatatccaagtaaactacagcatactgtagttgaatacgtaatggggtttgcattacaaatcaactagattactgtagattgctttacaaatactgtaatggtttcgtgctcaatgcaatataatatagacggcgtacaaaaggcatactgtatgaaatagtatattatacggttcacacttttagatactgtatgaaagtgatccgcccgattgcggagcaccaccacgacgacacaaacacactgaaattgtgccaatgacaatcatg

SEQ ID NO: 23360 - DNA, 1731 bp, Heterodera glycines
tttgtggaaaattgtgccaaataaattattaaaaaaattatattttccccttgacaacataaatggagactggtagactattttttaccattctcagaagggggtatataattggagttcggcaggattaatggagactggcatataaaaagagtatatatggtatttctacaatagacagtccgtcgttcatcgcagtttgtcatttgtggatttttctttgccgtttctctctcgctttttgccatttatttattattaattatctccgttttaagtttcaaaatgttccacgtcacttgggaagtgctagcaaattgcaaaattgcttgcgcttttccgaatcgttacatgggaagcattgcatttagacaactttaacatccgcttgggggtttcggtggacgctaatagtttcaccaattatgttttgctttcggcctttcaattcatacagaatatgcggcgcacaaaagtcatgctgtgtcacttggtttattccacggctagcgaatttagatacgtaatgaactagagaaaatcgaatggtacaaaccaatcactggcgacaacaacaacaactgaatttgtgccaatgacaatcatgccaaaaaagaagaataaagcgggaacaaaaacgtaatgaaataataaattaaattttcaaatacagtaagacatatttacctgagtacagtaagcatctgagcaaaacgatcatggaagttgacagtcacggacaagaggttgacgagaacggcaccgatggtgatgatgtggaggatggtcccgacaaagtgagacgtgccgaaatcatcccacaggtggacggaggccgaaacgcggcacaatcgagtacgagcaatttgagtactgtacagcgagagggagggggcagggaactcgagagtcgagacaataggatgccgagaataaatttgaattatccaatctaatccgatctaatgtatgatgtcaactgaattttttggcgagggggcgggtagaaaatttaaaaggggtgaaaaattaaatattttggaattattccaatacaataggaggccggcaataaatttaaaaactttatagggaaggaaaaaaatcttaactttataccagcagggatggaagctgatcccagtttccgatttacaacatcggttaaagccttgaattttttcattatttaaaaaaagttcctctgaatttttttgaagcctcgaaattaccgtttcaaaaattttagccagtggcacaaatctgcataaatttataccagtgtaccatggataaattgagatttgaacatttcaaatgcttaataccatcaggtccatccgcttcattgcctgccccacgaggcccgcccatttcggcatcaaaagcatgcccggaggtgcaatgctcttttgaagatggtaaatgggtcattaaacataatgcctaattaattagttaattaactaattcggtaattaattaattaataactttataattgattttgattaattttcgattaattaaattttaaatatggattttgaattccataattaaataccattttttggcataataaatgttaggcacaatttggcatttattccaaagatggcacaaaaatttgttcggctcaatttggcatttattaattgctttaggcacaatttgccattattccaattcgtttgacaccggctcaccagcgcatgggctgaacgcacg

SEQ ID NO: 23361 - DNA, 1307 bp, Heterodera glycines
gccactcattgtccaccttagaaaactgctattatctgctctcataataaagaagcattgggtgacattttctccaaaaaaacatacggcgagcgcgaacaacgacgaggtcaggctgaacagcagcaacatcgggacggagagcgacttggctgtctttgctttcctcgccattggccagccccaaattgttgaagctgaacatggcacagatcagcagcagaacggcgagaaaacgaagaggggacattttgttaatttaataatttggtaaaaaatggagtaattaatgaaaagtgggcccaattcgggtggacttttatagtcaaattattttgccttgggtcggtgttttgacagacaaaggcaatcattaattaattaacatccactctaattactggcgaatcggctgacattttaatattctcgataactttttatttcttttaatttattctttcccatgagaaaattaatttttctaaatttgtgcccaaataatgttttgacagccaaacccaaacaaacaattaaaacctgttttaattaataatgagcattttcattcagtcttaattgaaaatacctttagttgatttggttgtccgttcgcattttaattttaataacattattaaaggaaaataaatttagaattataattatttgataaaattatttgattataatttacaaattagcaattttgcaaattaaaacactaaaaagagtttacttttctaaaatgaatatgcatttccaaaatgaaatggaatcggaataattgtttttttgtttttttgtttgtttgtccgttaatgaaccattttaatacttctgtcacagtcatcgtcgcctcatcaggtgttcgttcacatgttcactttaaaatgcaccgccattgccattgccatcatcatcatcttaatgagaattcggcacaatttgaaggcttagaactgttaattaattagcagcagactatttattactatattattatatttaattcttgaataataggcgttttttaaatttgcatttgtcgcaccattttgaatgattgctgctggcgctgagtcggcaccgtcttctccattaaccttcgattggccaagctcagaatctgatggctcttcttcatcatgatcagctggattttctgtttcggcaaatggccggggtcagcaaaaacattgtttaataatgcgcaaaaaacacctgttgtttgagtgagttcttcgtctccatttggttcctcagcaagtgcattggcattggcattttcattctcttcatcgtta

SEQ ID NO: 23362 - DNA, 2460 bp, Heterodera glycines
  misc_feature (404)..(404): n is a, c, g, or t
  misc_feature (2339)..(2339): n is a, c, g, or t
cgtgcggaggaaggtgaaggccggcagctgagaatccctttgcgatcctacagctattacaatgatacatgggaattggaatctgatatagcaagggtaacatttttttaaatttgtccacaaaaagtaagcattgaataaaataaaataaaaaaatcaggaagctcctctcattcatgctgagtggttgcaacagcacgacgcaggacatacgccgccgcacaatatcgaaatgcccatacggcctgcgccttggatgagcacggttcgcagtgggcgtcatctgcctgaggtggagtctggtttttttgtttttttattttatttgaagaatttagaagtttttaatctttttattttttgttttggttttttggttaataaaaaattttatttaagtttanattaacccagggcggaatcctgcgcgacgacgagttttgtaaaaaaaaaatttaaatttaaatttaaaaaaaaaaaataaaaaattataagagaagaataaaagaaatcaaatgaaaggtgtaccagcggaagaagaagaagcagtgacggcaccaccaccagcagcagcagaaaatttgccggaggcagaagaagaagaagcaccatttgttgttgtggaggacgaagaagtgcgaatggcagcagcagcagcagcagaagaagcagttgtggtggagaatgaagaattaggagtggcaccactaccacccccagcagaagaagaagaagaagcagttgtggttgtggaggacgaaggaatggaagtggcatcagcagaagaagcagcagcagtgattgatgaggaagcggtaccaccccctgcagcagcagcagcagcaacggaacacattttggatggagatgagggagcggatgcaatggataccgttttaggtagaaaatatcataaatcaataacaaaataaatacaatattaaatttatttattcatttccagttttggacgatgggtcacctggacaaccgggacaacccggacagccgtcgcataagcggcataagaggggcaaagtgagtgcccaattttttatcattcacctaaatataatttattcttattatagaatgtggcaggatctgagcgacgccgaagacggattgccagggaagccgccgcccaaaatcaatgattttttgagatgaattgttgcatttaattttttaaattgttgacaaaaaataaataatttacatataatgggttaacaatttaattgaaaaaattaacaattaaaaaaaaatggagtaaaatcaataggaaaatagtcacagcaaatgctaaaaaactgattaatttgtaatttttcgtctaaattttctgcttttcagctacatcgatcaaaatgtcatcgcatttcttcgccgttttcaccgttttttcgccatttgtgccatcgatttggacattaccactggcaatgaccgcattttggaatttattttgctcaacatttggccaatgcttcgccattctatgcatctgatgatgtttttgaataccatcgtttttcgccgtttgcgccaattggccccgtcacttctcaacgattgtccatcccttcactatgtttctttcggtgacgtcattctccccgaatttccgcccgatgaaagtgccaatgcgtcggatggacaagcggtgaccaaatggttgttcacgtctcgtccggatggtccgcccaagtggctcagatgctttgcgaattcaccggatcaatggtcgtcaacgatggaacagctcaaagcggtgattatccctatttaattggtttttctatgcttttttgtcccatttttaggcattttccaatgcttcttctccggtttcttttcgcatttgttttcactttccgccgtcttttccgcttgactccgttgtgccatttgatcggatcaacgaagtgactggagagaaattgtatcttctgcaatcagcaaatgacttttggctcacccgttgtccaattggatgggatggaagaaagtgggaaaatatgacggatgcattcaaagctcgacagaacccaattgacattgtgatcagcgatggcggatacgacgatgggtgaacaattttaaatgtttttttttggcttttgagtccaatcgacaattgcttagtctttgtgcttttaaatgataccaaaaatgtacggttaatggacagtattgtgataattaaggagtttagttgtttggactcataaaataccattgaacctataaaaattggtcgctttttcagtcttctcgacgacgcttctcccgggtcgagtgatcactctgatcagcagcagaagaaatgaattagnggtttggtcaaaattagtgtcagattcatgatccgcgaccctgaaaacccctgtaaacgattttttatgacaaaaaaaatttgcaaaacaaaagggtcccccctttggttttttataaaat

SEQ ID NO: 23363 - DNA, 1244 bp, Heterodera glycines
actttttttcatttcaagatataaatttcaatctaatcccataaaattctcctgatttttctctatttttagagctttaattcacttaaattgaccaaaccttaactgagcaatgaattttcaaaatttaacccaaatttccaaggaccaaaaaaattaaaaatattttcgaatttttaaaaaattccaaaaattatgaaacttaaaatagacatcatattcgtactcaacacctcaaaataccccagaaaaatatttttcacaccctttttcgaccccaaaaaaatttttgaaaatttctagggggcctagctcgaaaatttttgaaaattttacatcatttagtacaccattcgatagcatttaaaatgctctacaaaaatgttctaagacaatttttcgctaaaatcaacccctgacgagttatgggcccaggactcaaatgtcccgcttaggccaaaaattttttctatttccggaaaaaaatcgaaaattttccaaaaaaattactaatcgatagagctcgaaaaactatgttttggaagtggtcttcgtttttctgggaaaattcgttaaaaaatcataaaattcaaaaacccgaaaaccgttttttaggcctaactcgaaaaattttgaaaattttcgaaattttaaaatttggaaaaatcgggcttttaaagctctacaataagtctgctggccaccccccgctcagatcaaaccctggcgcggtattcacctggtactgaagtgtactttttgagcacgcttcagttgccattttttgcaggccaggggtttgctcaaaaaaaatttaaaaaaataccagcatttagaggacactttggcggagtgccctcacagcgggcactttttgattcgagttttacaaaaaaagttaggggccttcaaatgcaaacaaaagtgagaaattagccgccgggactcagttggccctcggagaaaaaaacctatagttttcccgaattctcctcaaaaagttgtaagacccttccactactttcagacccgtcccattagccgttaagctcaaattagtttttgaaacgaaactcaaaacctatataacatatatataactagcgggtgcgtgaaccgccggatctgggcttgggataatgcgcttcgcgcttcttgagcttcgctacctaggctgtaaagagactcaaattgatcgaattggaaggagagatttttttgaatttttagaaaattataatggg

SEQ ID NO: 23364 - DNA, 1959 bp, Heterodera glycines
  misc_feature (1850)..(1850): n is a, c, g, or t
  misc_feature (1874)..(1874): n is a, c, g, or t
cgccgggaaaaatttttgaaaatttgattaaaatttgttgacagattttcactaaaaaatgatcaaattttgcaattttgtgccatgaaaaaataggagttttgggggcgcggcggtgccgataggcgccggggaaaaaaattggaaattttgatcatttttttagattttttttttaaattttttttttagatttttttatttttctgtttttttttatttttttccctcctttgatgtaattcattcctgaacttttaaaaaaaaagaaaaaaaaaacaaaaaaacatacaggttttcattgaaaattagccaatttataggtaaaattttgaaaaattttatgggaatttaatccaattcttaggggtgtaaaagtcgcttttcgcaccaaaaagcgaaatgcgaaacgccaaaaaatgcgaataatgcgaaatgcgaaaagcgaaacctaggcacatccctgggtttgcacatgttttttactttcattttcaaattgtctttttattttttataaaaattacaaatattttacaactatctcaattattcaataatatttttatttttttacatacaaatatttatttttttttaatttttataattttttatttgtttgttatatatattttttctaatttgtatgtgttatttttttccattcctctgttgacgtcttgtaccgtccaagagtttggtataacgataattatgtttttattaaaagtttcacatgaataattagtaaaaaatttaatttgattaattttgctagtgaaatttttattttttaagctaatgactttgataatttgtgttagaagaatatactctcttgtcattattgaaaaataaatattatattttacgttttgaaatgttctttgcacaccaaaatttatcaaatgcaataaaatgagtaaagcagcgatgacacagccggggaaatttttcaactattttaatggaaaaaatagactatgagccaaaaaatttgcaaaaaaaaatattcaaaattttgcaaagaagaagaaactcaacattattttaataaatatttaaatttggtgatattcattgattaaatgcctgatttaaaggaacgaaatcggtgtacctatatttcgccaaagtgacatctcgccaactgacatttcgccaactgacaattcgccaactcagccaaaaacattcatttcgccaactcagccaaaatcagacattttgccaactgacatttcgccaagtagtcaaaaaaaagtaaagaaaaaaagtagagtcaggtaaaaaaatttccgggagcagcatcgggagttcaaaattttccgggacgggagtcccgaacgggaatcccgtaaaaataccgcgggagtcccggttccgccgatctccaaaaaaaagtaaaaagactaaaaaaagctgttttggtatcaaatacagccctattccagtttacatgtccaataagtgatagtgtaaagcgctttaattttgcagaataatttttatattatttctaacaaattaatttaaattatgtttagaaaataataataaatattatttatatttgttttctttttgtctcatttttaaaataaattcaattactctaaatatgctttaaacctaagctatggtaattataaaaacttaaataattttttaaaattaatattataaagcataaactaaaacaaaatgcactccgatcccagtcataatggcaaataaatattaaatgaattaaatttttaatgtgttggcttaacactcgtttacataattaaaggaaaattcgtcaattcgttagaatgatagtatttattgaaacagcttaattntcactaatttcggcaaacagttgngaaagtttttaaattaagcggaaatgttgacgactttgacacttttcaccattaacgtggaaaaatgaaaaactattagtttgtt

SEQ ID NO: 23365 - DNA, 1079 bp, Heterodera glycines
gttggaattgtctagagtgttgagcagaaaaagagataggcgttttccaaaattttcacaatcaaactcgcccagaaagaaattccggaaaaattagggttggcgctatcattccgtaaatggggttggaattgtctagagtgttgagcagaaaaagagataggcgtttttccaaaattttcacaatcaaactcgcccagaaagaaattccggaaaaattagggttggcgctatcattccgtaaatggggttggaattgtctagagtgttgagcagaaaaagagataggcgtttttccaaaattttcacaatcaaactcgcccagaaagaaattccggaaaaattagggttggcgctatcattccgtaaatggggttggaattgtctagagtgttgagcagaaaaagagataggcgtttttccaaaattttcacaatcaaactcgcccagaaagaaattccggaaaaattagggttggcgctattattccgtaaatggggttggaattgtctagagtgttgagcagaaaaagagataggcgtttttccaaaattttcacaatcaaactcgcccagaaagaaattccggaaaaattagggttggcgctatcattccgtaaatggggttggaattgtctagagtgttgagcagaaaaagagataggcgtttttccaaaattttcacaatcaaactcgcccagaaagaaattccggaaaaattagggttggcgctatcattccgtaaatggggttggaattgtctagagtgttgagcagaaaaagagataggcgtttttccaaaattttcacaatcaaactcgcccagaaagaaattccggaaaaattagggttggcgctatcattccgtaaatggggttggaattgtctagagtgttgagcagaaaaagagataggcgtttttccaaaattttcacaatcaaactcgcccagaaagaaattccggaaaaattagggttggtgctatcattccgtaaatggggttggaattgtctagagtgttgagcagaaaaagagataggcgtttttccaaattttcacaatcaactcgcccagaaagaa

SEQ ID NO: 23366 - DNA, 2320 bp, Heterodera glycines
cccccccccccttcaaaagaattttcagattccccattcacacaggggattctggaggtcttaactatgtcaaatgtaaattccgatcacgtattcgtgatcagcggcccaaataacccctaaaatcatatttttcgaagatttttcggtgaaaaaaattttccactcaaaaatcctcggtcaacacccctgtggtcccgaatctcaaaatcacttttatttttataaaaattctttaaaaagtgataaaaatgtaaaataaaatttatattatagagaaaaaaattgcggatttttgtagtattttacttttcccgaatagcttttcagaaggcagctacgaatttttttctgaaaaatcgaaaatttccagaaattctggaataactttttttgtttttgtggtataaatttcaaataaatctcataaaattctcccgattttttgctattttttatgctttaaatgagctgaattggaccattttgaggcgagttatgaatttttaaaatttaggttgaattttcaagggccaaaaattattgaattttcaaaatttttttaccaccctccaaaaaatccaaaacgcaatataaagtgcatattcgtgttcagcccctcaaattaccccagaaaagtattttttggcaattttaggagcaaaaaaatttctcacgaaatgcaaatccatggggtcccccctttggttttgcgtttcaaaatcacaattaattttataactttttttaaactcatggtaaaaacatgagataaagcacattaaatagagctcgaaattctctacaaaaaagctcttggacgatttttcgttaaaatcaacccctgacgagttacaggcccgggactgaaatgtcccggtcaggccaaaaaatttttctatttccggacaaaaatggaatttttttcaaaaatgccaccaatcgatagagctcgaaaaacggttgcttgaaagtggtctccgttttcctgggaaaaatcggcaaaaaataataaaattcaaaaacgaaaaattttcgagggggcctagctcgaaaaattttgaaaattttcaaaatctgaaaacgccatcggatgcagctttaaaaactgcacaaatgctcaagcggcgccaacccgctccgcttaacccccagcgagttattcccgaaaaacggaaaatgccgaaattgggtgccaaattttgccattttctgcagcattggcatttacagatagaacccccaaaccaacggcatgcagtgccaaacactccaacttgatttcctacctccaaacattttccgctcccgatgccctggaaaaagttgcgggccaaaaatcgcgacataaaaaaatttcacgccgtttcagcgccgccggcgctgaaccgtccaccggagcggaaaacccatatttttcccagatgcgcctcaaaaagttgtaagacccttccactactttcagggcgctcccggccttcggccgggagattttgtttttgaagacgaaaccccctttttctctatggtaatataaactagcgtgtggcgcagtagttgctcggtgtagacagttggctttgcacagtaattgcaaggtgtagacagtatacttttggtatatatgggcgggcgctgacatgagcgctttgataaaaatgctaaataaaatttatataaaagagaaaaaaattgcggattttatcaatatttttgtataccttagcacattgtttggaatgagttatgaatttttatgtgaaaaatcgaatttttcaactttttcaggaataacatttttcatattaattgtagaaaaatgcaaaaataatgataaaattctcccaatttttctgcattttttgatcatttaatcttcacatttgacccatttcaaagggagttattaatttttgaaaattcccccaaatttcccctgggcgaaaaatgaaaaattcaaacacacccaaatttggtcaaataaaaaatttaaaaaattgaaaaaaatatagaaaaattttagaaaatatttccagccccttagaacatcgttacacgtcataaaaatcatccacacgccgcggatttcgaaacccgggccccccctcccggggggcccccacacacaccactggaaccaaccggttctgcagggaaaaacttttttttgagttttcaaaattttttttatatcattccaaaagtctttgaaagttgcaacccaaaaggggcgggcggtttttcaaaggggcaaagggaaaaaaaaattatgggcaaaaaacccaaaaaaccgccgaaggggggcccggattttttttgg

SEQ ID NO: 23367 - DNA, 1841 bp, Heterodera glycines
gaaaaaaagagattgaattgggtcaaatttggaaaggttgtcagaactgagaaaagtgcgtttgcctgaaactcgtggggacacaacacaaagttaatatttttttctttataaaaataataaattaaaaaaaacttcttatttgttgctttttgaataaaatttgacaatttacaacactaaattgaaatttttggcacttttttcacatttctagcaaacctattttggggattttttagaacctaaaaatataagccctaataataacagatattttgtcaagtctcgtcatttaattttctttagcgttttaatttattcttaagcattccttcaggttaattaaggcgctgccgagtaaattttaaattaatattaatttcaaaatggaaaaagtcagctaaaattaaccaaaaaaaaagcaaacaaaataagctaagaagattttcttttcttcaggtccaccatgcaaggaaacattccgaactgtctccgcttaatcattttgaaacctgtttttattgtgtatagatggtcgatctattattgtacagttttaatgcatattttgtaaaatttgcaaaatttaaaaatgacaatttgcgtggggcctaattgaaattaagctcacctaataacgcgccaaatcgccttgcagaatggctccatgaatgtatttttcttctctaaatgtatgttatttcaatcaagacctgtacataatattaataattttgtatttatgtaaatttaaaaataaaattgaaacttaaatttaaaattttatttatgtgtcacttttttatatttgattattagggcccggatttttatgtttttacatattttttttgcggcttagttatggcgagagaagcccaaaaatagcattatctccgaacaatttttgatttagagcgacttataaaaacataaaaacacatattttggcgttttgtcacataaaatatgttagcacatattttggggtttggcacatattttgcacatattttggcatttttgagaaaaattgcaataaaaatacaagaaaattgaaaaatacaccccctaaaaatcgacttttttcctaattattaacataattttcaaattaaaaaattttttcttcgattgtagaaactaatgaaatctcgaattcattaattcgtcattggatttcgaagttctctgctggaactttcaatttatagaaatgatttatcaaaaaaagacaattttaccccaaacacttcgaaatgtatttgatttgcgttgtatgggctaaaaatgataaagaatgagatttttgggaatttttatgcaaaaacacacttattttttcaatttttaacacatattttagcacatattttggcatttttgggggtttttagcacatatttcagcattttttagcacatattttattacatatttcaggatttttagcacataaaaatccgggccctatttataaactcattaaattataaaataaaaactcgttcgaaaaaagagtgaaacaaattttggtaaaatataatgtgagttatgaattctcttttatatgcaaccacgcgaaaacgtcctggcccgcctaagaatagaccccaaaaattttcagtactgattttgattgcctctattttgtttttcaaattgtttagcattttctccgtgccactatttcttccgtcagttacgatgtttatatggtagcacagaaatgcgttttttgagctcctttcttcaaaagaattgaacaaaaaaaagttttgcctatttcactttacgaggatttttttccaaaaaataaccattttaaaaatttttat

SEQ ID NO: 23368 - DNA, 998 bp, Heterodera glycines
attttgaaggccgtccaaatgctgtgggtcaacctcatcttggacactctggcttctttggctcttgccactgaattgccaaacgaggacttactaaagcgaaagccctacgggaggacaaggttggccttttcactgtcaattattggcattttgtccgtatgccatggcattttggtgccattcactgcttccggtttcagtccgttgatttcgcgcacaatgatgaagaatatcattggccatgccgtttaccaactcaccgtgctgttcacgcttatcttcgcgggtgcctccctcttcgacattaccagcggtctttacgctccgctccatgcgccgccctcgcaacactttaccattgtgtttaacacctttgtgatgatgaccctctttaacgagatcaatgccagaaaaatccatggagagaggaacgtttttcaggtgtggcagccgatgaggaattccattgggcagccaaaggatgagtcagtcatttgagtcggggggggggggaagttatttgttgaaattaatgccaacactaaaattttttggcgcttttctctccattttttgatgttttccccagggcatgttcaataatccgatttactgcaccatttgggtgtttactctcatcctccaatatgttatcgtccaattcggcggtcgctggttcgctactgcaccgctgaagtgggagcaatggctgtggtgcttggcctttggcgtcggctctctcctctgggcacaagtgattattcccttccctccgtttggcttttcacggcttttccttctttaggtagtcatatcaatcccaaccaaaggccttccgaagagtttgaccattggcggtggggaggtggagccggagaccgccaacaaattgcgtgtgcatccgatgaaagtgacgaacggcgggaaaaaatgacagccgcatatagtcgcatttcgttaattgtaaaatgaataattgtttgaaagcatttttt

SEQ ID NO: 23369 - DNA, 1800 bp, Heterodera glycines
taatttaattgaattattacataaagtttatgtcttgttttgacagataaaatttagagaacaggatttttaaaaaaaatgaaattgtattttgttgttttttcttaataaacaactatttttccagattaatcaatgttaagaaaatttggccccgattttgagacattaaatttaattgaataaaaaacaaattatatattttttcttatattgttaattattcgccctcttcattttttcagaataatctggcccgaactgttgaaaccatcaaaatttgccttcagtccattctcgcggcccagcaattaaacagctgggacattaatcattgcaacgagggaatttacgtttatgattttttgttggtcgagcatttgtcgcaaaataactgtaataatattaataaaataaataaatatttatttttttttaaagattttgtgtcggtgcgctcggttatgccggccaacagtgcctttggattgttttactttgaaattaccgttcttcagatgaaatcgtgaattaaaaaaaaatgttttaaaataagtttgattatattaagggacgttggagttggacttgccccagcgcacatgaggatgcatgaattggtcgggcattttgagggaagcattgcgttgtggagcgacgggtctatccacagcaaattgccatgcgtgccggatgtgcttgacggattcgcacagtttggtcccggtgatgttgtcggatgcggaatggacgcaaacaaccggggcatttttttcacattgaatggccacaaaatttgtgagtaaatgaatggattcaaaagacaaaacaaattcgaattgtttcattcttaagcaagccaatttttgcaagccgaattgtttcacatgtatgcgtgctgtactctcgtggacatgaacgactccgtcaaggcaaatttcgggcccgactttctgttcaacattgtcgaaatgttgcccttctgatgggctgtttctcaatttgccagtggattatcggttgggaattgcgatgttgataataattttcaacactgttaacaaataaaccaaaataattgaattaaacccgttacacattaaataaagtaaattattttattttatgctttccattggtctcttattgcttttaaaattgatagttattacagttttcaacaaaaaaagttacctacccctttgtcccttccgatccatcctccgttcgtcaatctttgaccccaaacattttcttaaattctgtaatgcattaaatttatatgataatgatgatgattggattttatttaatttctatcgctgttggctaagtttattatgttacaatgattagcgatttttttttattgaaaaaggccaactatttttgcgtaataaaaggcagtaatgcctattgcataagtcactttatttgcacattaaaaaaaaagaatccattttagcttttgtattttattttttttttcacaacgcactcaatgtcgaatccgagggcaagttgtcagtaatgtttcctctttaaaaatatatttagaacctcactgaaattagagcaccgtttgcagttaatggacaaacaaattttgtaatcttttcgtttaagaataaatgtacatttcttacccggttttagcctgcgtggtatgatggtttgacatttccgttgccggtacaccaccaaccatacctgccttttccaccacgaccaccaccaccattgctgttaccgtcgcaagtacgacaaatgccatttcttcttaacccattcatcaatcca

SEQ ID NO: 23370 - DNA, 1127 bp, Heterodera glycines
gtgaatgtttatttttatcgaattctgaccctgtttggagtagattagactagaaaatatagaaaatttgaaaatcatgttcacactcccttctcccaggggtattattttgtaagtctttttttcaaaataacttttcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactataaaaaattgaaaattttgaaatcatgtttcccactcccttctcccaggggtattattttgtaaagtcttttttccccaataaacttgtcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgagccgttttgagtagattagactagaaaaaattgaaaattttgaaatcatgtttcccactcccttctcccaggggtattattttgtaaagtctttttttccccaataaacttttcataccccatttttcgcaccgtgaatgttatttttattgaattctgaaccggtttgagtagattagactagaaaaaattgaaaattttgaaatcatgtttcccactcccttctcccaggggtattattttgtagtctttttttccccaataaacttttcaaaccccatttttcgcaccgtgaatgttatttttatcgaattctgaaccgttttgagtagattagactaaaaaaattgaaaattttgaaatcatgtttcccactcccttctcccaggggtattattttgtaaagtcttttttcccccataaacttgtcaaaccccatttttcgcaccgcgaatggtatttt

SEQ ID NO: 23371 - DNA, 1031 bp, Heterodera glycines
ttcatttaaataatttttatccaaaaaatttttttttgtgttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgattttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagctttcctatagcctgtactttaattctgcgttggatttttgctccccataattgtttgagtaccccaaacggacacttgaaaaaatcattttttttgttttcggggcagtccccccgaaccgatgcgcccagatttatggggagaccgaatcctccggaatagcttcccctatagcctgtactttaaatcttgggttggatttttgctcccccaaattgtttgaggacccccaacggcaccttgaaaaatcgatttttttggttttc

SEQ ID NO: 23372 - DNA, 2959 bp, Heterodera glycines
  misc_feature (1940)..(1940): n is a, c, g, or t
  misc_feature (1950)..(1950): n is a, c, g, or t
cctttctctcacatcgatctgtcccggcatttggtcgtcgtcgatctctcggcattggcccaccttttcgccaaattcgacaaagtctttgcaggaaagcacgacgtaagcagctgaaagagtaaaacgtattgaagaaaccataactgaataagaacatccaaaagtacggtacgccgcgctaccgtacattgaatgtgagtgtaccgttggcacactttgcccacacatttcgtcagcacaggcgcccttacgctgttgttgaatttgccctggtagcaagtgaactttggccctgaaagaaagagaaaactcgtcaaatcaggcgaaaagcccaaatgttgtaaaaattcgacaaaaaaacgcactgtttttgccgtctcgccgagattctcgaagccaacccaacgactcgtcactgtcggccgactgtccggcgaacaaaggcaaaatgaacagaaaaacaccaacgacggaagcaaacataggcaataacggaaagagaaaaatgaaaggcctcaaaaggaaattaaaaaaaacagaaaattggtgcgaatattgaaataaaaatcgtgtacaaaacgattttaatattgaaaatgcaaaacggacaaattaaatagaattttatgcagcgcaaaagtgaaaattaattggagagatcaaataatgtcaaaaccattcgacgttcccaaaaatatacaacatttgttttcgattcacaatcaccgattgatcattcattcatttgcttatgccttctgccaattgtcgtggcccttccacaacgatcttctgcaacaatttgtccaagagcacaaatgccaattggcgattcagtgtcggcatttggaagcactgaaagaggagacggacagacgccgccctttgcccatcggaagtgccatctttggcatcgccttccttctgctgatgatcatccatcatctgattttcctccccctcctccgtttgatcggtttcgtcgttagtggcatccgtcgacggacaaaaggaaaaagcggaggaaacggcggaagcgaatcgtccaaaagcccagcggagaaacggcgaaatgagcaaagtgcgctccacccatttctccacacagtgaagcgccaactcggcacgcaatttgcgctcctgtaaaatacggggcaacagtggcgacccgggcaaaaaactcggcatttgtttttacttgctccgaaatggtgcctggcaatttttctgctgccattgcttgcgtttgctgcttccccgccaatgccatcatcgcttttcgccgccgttgctgcattttctgttcatccgccgccgatggtttgcccaacggcgccgaagccatcgaattttgggagggcgttgcgctcagcgaagagggcacattttggaacagaatgagctcatgcagagaacggactgaaaaagaaaatcggagaaagtgccgaaatcaaacggaatctaaaacactttatggcaaaaaattgtagcagacgcacccaaataaatggccatttcaacgttcagcaaattatcgtccaaaatttgtgccgttttacgtcgcaaaaaagtggagaagagaaagccgacgaaagtgcgcagagagcacagcaaagactcgacccaaaagggaaaacggacaatcagaccaaaatggagggagaggaacagaaaaaggtcgtagaagtttctgaaagccaaaaaagagtccaaaatcggcaatagaaaatgcacccggtccacggcatagaggcgccaatttcgacagagtgccgttgttgttgctgaccattgtgactgtcatctagcaattgcttttctcgtggaatgtgtgccggtgccgtgcaattctttggtttgtttgttgagcaaaccgaagaaacagcgcttcttaagggggggggggggatttgggccaaaattggaaaatttatatntaaataattntaatttttaaaaaacaaacccgtatttgttcaatggtttttgacggttttaattttaattatttttctttctccgattaaattaaattaattacctcccctcgccaccgtcgaaacttcgcgcagttgccgtctcacttttcacggacattgtgtcgacacttcggtgaatgttttgttcggacgaacgctgttttggctgcaaggggaggtggttattggtttttaaagggcatataaaagttggctggtataccatagttgtagtcgtcgtcatgttgctgcacactgtcggcggtgccaaagtgtttgccaacaaattgaggatgaaaggcttcaggttctggccccgctcttttccgcccactttgcgcatcgctctgatcgggttcaaatcgggcaacaaattggttgtgccgcttccaccgcccgaccgccagccgccgccgttgccaacactgcccgtggccaattcgaacagacgggtcgagttctcctcactggtcaggaaaatatagagtaggtcggaacgtttcatgttgggcttaatttgggtggggtgaattggtcgtcgaccattcaaacggccgacttgttggagcagttgctgcaaaaagcgttcaaagtggatacggtacgtctccagcaatgctctgttgttccgtccgttgtgcaacagttgcagcgtcgtcttccggtcgggcaaagcgttaccgttgaccaaccgcaacatgttgttattgttgccaccgctggttatggccaaggattccctgaggcggtcctccaacgcaaaaaactcttcgcagcgatggccaaccgtccaaactttgggcagctcttcctcctcctcctctttctgtacatcaaatttatttagttttctctattgccgttctcttcattttgccattttttaaattttatatacttttcattgaatttttctctttttttgggtgctaaaaaagtggcctcttccccccgctggtcagtcagtggtcgcacct

SEQ ID NO: 23373 - DNA, 1831 bp, Heterodera glycines
attcgtgattgcaggaagagaaatactgtcgagaagaaaaatccaaaggacaaataactaatagggattttgtatatcttcaaataatattggcatttcatgaaaaaaattttctagtaaaagaattattaacatataaaataataaaaagaaaaactgtaaactatttttttattgcatcttaaaaaatttagcgcaatgaacattctacgataaaaatgattaatttataatattaaattatctttaaatataaacactaaacaatttgaaaataaaaaataattccaaaattaaagttaataaaaaaaggtgtaaaaacttgtaaatattaaggtcaatgccagtgctattatctaaattgcgaaagtaggtatgcgagaatgaggaagaacggcatatcataaattttaataaataaaaaatcaaaaagaatatgttacaaacaactacaggcatatttagacctaaaaatcagtggaccattagttatgattaattatgaaattaaatgaattttatcatcttgggtatacatatgacagaagtggaataagaaaactgtattttacaataattttgaaataatttattccgataaaattaattaaataattcaaaaaatatatttactttttgaaggttttcataaatgaaaaattacacaaaaattaaaataatttattttttaaaaaattgaaaataatttgtttaattaaaatgtatcacaaagttctgaagagggttcttcgaaaatcgagagcaaataaaaaatacgtgtaataaaaaatggtgaaatttaaaaaaacacggattaattttaaaaagcaaaataactgagaatgaaaaacataatttgtgataattattttcaggacatactttacaaatgagttttgtattaggaaaagccgaaagctccaagtaaaaattaaataaaaaccattaatttaagaccttgttaatcaagaattgtaatcatttaaattaactaaaataaattgttcaaacagttatatgtacaataaaaaaataaactacacaaaacactggtcgaaatataacagtaaaagataaaactaatcacttttatgtgtttaattacccacggttgagattactcaacatgctattttaataaataacaaaatacaaataaatttataatctctgttaaatcctaaatgtttatatattacaccaacgaaacataaattaattgcaaaaattgacattggctgggcctaattttaaagttgatattaggccagatacattagttagttaaatttcttgccaaaaactacatgattttaacatataatacaacaaataaaattgtttaaaaataaaaatttaaaaaaaggtctaaaaagcataattttatcgccgaagctaaaaaaattgtttcacattacagcaacattgaacttttattggaaatttcaattaatgccaaattgaggggggcatcttaaaaatttcgtgttttatctctaaaatttcaaaattaagtttataatttttcactaaaaaatcaatctatttaagagattatgataattaaattttatcttaaaatacattgcattatgacgagtacgtgatttgtagggtttaaaaatgaaaaataataactttttaaataaataattcatatattgaaaaaataaataaaagtaaataaatattatagactcattgcataaaaaggtaacaagtatcgtttcccagcggtgcctacagtttgaatgatatcaaaaatgaaaaaataaaccataattttaaaatttcagaaaaaagttgaaaaataatagtttacgaagtagtt

SEQ ID NO: 23374 - DNA, 1096 bp, Heterodera glycines
aaaagacattaaattctcgcagaataatgccatgccattaaccgtaaataacggaacttccacccatcggccaatggatcttcttgaattggatgaactgcacggacccgatcaggttttcgataacgaacgaaggaatgggtcgccggattcgatcactgccgaaattttgcgttccaagcaattgaaatcgatgaaggtaaatgaagctgacattcttgtaaataattaattggaaatgcaaaaaacaggtaaatactggacaaaaaccaaatgcgacaccgaccaatgaccagccgaaaagtgaagcaaaaaagttggccacggtttacatgcaaatcaaacgcacttttcacccgtggattcgtggcccatttgacaaggggttgaaggtaaatcataaatattgacaaattacatggtacattcattcatctttcaatgtttaggcaatggttagggcgggtgtcagcatcgacttcaagacgaattcgaatgacattgttttgagtgggactgaccacgcgcgggtggacgaatacgcggacaaactgcgcacgttgcgcgacggaccgatcagaagtgccaaagagcggaaatgtcgcgtggcagccaaacttagcaacccaatcggcgaagtgacagacgatatattggcagaaactggtgccatcgttgcccttccgatggtaatttaattgagagaagaaccgggcagagacgggggcattgtttcaatattcctttgaatttaactgcattatctgacgcttcctttttgttaaaaatattgcctaaattctttaggattgtgcccaaggcaatgtgtcgggaatggaaatttcgctgttgggttcagcggcacaaattacgcacgcttgggactgtcttcgcgatttattcggaacgcacgacattggggaactactggcagaagcgagggggaaagactttggggacgagaaaattttgcgttgcatcgccgcacaacaaaagtcgcaaccctcgggcgctttcggtgctggtcgaaaacggaaagaatcgtcgagccgaagagagaggaaagcaaactgacaaagagacccgatcaagggtg

SEQ ID NO: 23375 - DNA, 2018 bp, Heterodera glycines
  misc_feature (144)..(144): n is a, c, g, or t
  misc_feature (279)..(279): n is a, c, g, or t
gaaagggtacagaggcatgacaacgcaaaaaagaattttcaggtcggacggctccatttctcgggacccgtcgaagctgtcgaagaattgcacaagaaaataactgctaagattagcctgttgaacaaaaacggctcaatgatngaaggacagcattagcatggagaagcaattccattgtcaagtgatcggaaagggcggcgagtttttacgaaggctgaaaaggaagcacggagtgaaggaaatcaatgtgccatcagagttttccaactcggaccnaggtgggcatggagaaggtcaagcaaagggacccctccgtttttcagattcatattgaagggccctctctcttcagtcttcgctcatgcaaagacgacctgcttaaactgttggatgattggcgcaacgattgctacgaggaggtgccggtccagcgtcgttttgtgccgatgattcggggaaaaaattcgaacaaaattgtcaatctgctggacggactgcccagggtcgaagtggacttaccgccgcacacaaacaacgacgcgacggaggacagtctgataaaaattaggggacataaatctgaggtgagtcggacaccgacagaaattatttgaaaataatgccctccaatgttttccgttaggtcactgtgtttgttgaacgtctcaaagagttcgtcgacaatttggccaagaatcatcacgaagacttcattcaattgcccatggacgaccctaatcattcttctttggagtttgccaaattcgtttgtgcaaaaaagaagcagatagagcatcggttgcccaagttgaagttggacttccaaagcgatgacgacacagcacaaaatgcgaaccgaacggttcgactgattgggccgctggatcaggtggaagccgccaaagagacagtgttggaactcatcgggagccttagggtctgcatttgattaatttattaattaaaaattggaataaaactattcccagagtatcgtcgtcgtcaaccgtgccccttccgttctgtatatcacttgtgaccctaagcatcacacagaatttctgcggaataatggccaattgctaaaggagataaaagaggaccatggacggtgcctcatcaacctgaacaaaaaaatggaacgctttgagatcagttgcgatttaaaacatagcggcaaccgatcggcggcaattgagtcgtccaaggcgcacattgagaagatcatcaatatgttggtgggttgtagaagattatgagtcaacaaatgcccattctctgtcaaggagtccaaggtggttcaccacgtgctcattccaattcgccaccatcgcaaattgggcccacacctcagctcccttcgggagcagttcaacgtccgtattcaaatgccgtccaaaagcactgacggacagccgattgtggtcactgggcctgacaaagccagcgttgaagcgacggagaaggcgctgagagcactgtgcccagtgacggaactcatcgaaatgaacgcggaacatcgctcgtcacttatgggacgtggcggagcaattttacaagaactcatcaggaagcattcggtaactcgtcggaatgccttttttctcacaatcagcagggaggttacaattagtcagattttcgcgcataaataaacaataaaaccgttttttttgtatttaaactttccaggtccaaatagtcgttccccgaggtgaagcaagttcaagctgtaatgtttcggtttccggtgcccccgaagacgtccgtgcttgtcttatggaaatccgtgaacatattttaccaattacacgcacaattttggttacacctgaaattcgaggtgaacgcatactttattgacttatattctataaataatccattaattaattaacaatttcaggctccttgatcggctctgggggtcacaaggtgaaggagctttgtgacaaatttctcgtgaaaattcatttttcgaacaaaagtgcatactgttgtgaaattacgtaacc

SEQ ID NO: 23376 - DNA, 2392 bp, Heterodera glycines
  misc_feature (2310)..(2310): n is a, c, g, or t
tcttgcccccccctgggcagagagatgcgtattcaccatacgagagagaagagaattagagaaaaagagtaattcataaatctcgaaaaaacgattaaattgtaaagagacctcggccactaaaaaacctcagcctaatggtattctcgggtacgcttagcaccactgcgcgagtgttcagccgatttttttgtgcccccccccaattaatcgatatcaacggaaattatcgatttgtgaacgcaacaatttttaaaacacagaattatgaattgaaaaaaacttaagaaaaatgatcggaataaaccccctcggttctcttttgatcttcgaaaattaattagtgcgggaaataaaggactatgaaaaaccgtgaaataatggttttaaattagtaatttttttgcaataatttttaatcacgaaatattaaaaatatttatattgggataaatgttttttaattcggtaataaatttttttcaaatcattctatatccgttttttcatgtgatgaattaacaattaaaaaggatagtttgctgggactattcctcccactaagcagtattttgtcctatggtatttttattgcggaaataaaggactatgaaaatgcacgattaaattaataaataaattcttttcaaatctatcccatattggaattcatacatctgatgaattcacaattaaaaggcttgtattttgggactccttccattaatcaataaacctcacacccaataccgaaaaattataatatgaataaatgaaaaatattttttaatgcacatgtaattaagaatcgaaaaaataaatttttttgcgggaaatgaagggcaattttattctcgtttaatttttattaataagtatttttcccgatttatatcatgaaaattataataaatattttcatttcgggaaaattgctctgttgtcaaagggttttaaaaaatatcagagaatttcgccctcatctaaagctatcagttatatctatttgttgttgttaaaaaataattaaaaccattaactaataatatatgattaaaaatagttaaaataaaaatctgatagggtatggcgggtaatacgctgcccccctcaaaatgaccccaacaaatcccgaggggtggggtacccaccaaaaaatcgttggcccacctgcttacgtgtggtcggaatggtgcaacacttttttttgaaaagcggcacgtatgtaagaagtgacccaaaggtcgatgcgcacgccaccccattcccgcccccaccaaccccctgccccatgggcacctgcccgccagcgaaacgtcgaaatgagcactcagacccccgcccccaccaaccccatgccccatgggcacctgcccgccagcgaaacgtcgaaatgagcactcagacctcatggattccacacattgtcaaaagtggagtccttctgtctttgattgatagggttgtctttgtacctgataaaaatagtcggtcataaatttgaagtccttctgcctttgattgctagggttctctttgtaccgcataaaaatagtcggtcattaatttgaagctccaaatcacccacacgctatgcaatgctcttcatccgtccacgccagtgtggcaaatgcccacaacaacagcggcgggagccaataatgccaaggtggagcaaaagccgccggaattgaatgccgtgccgaaaataatggcatcgacaatggcattgcgcaatggtggtcagctgcagatgaacaacggcgggaactcaacaaaatcgacagcaacaaacggtgccgtcgtcaaccattccaagcagtaccaggaacaactgctggagcaacaacggagagcgagggaggcgcagagcaacgacgactccaacgagtcagcagcaacaacaacgatggcatatgatgaggagctgcagcagcacaaccaccaaagtttgaagcaggacaggggagaggaggagagagaagaggacaacagcaggcgaagacaactgctcagggaacaatgcttcaaggtggggggagggtgggataagggcatggactggtcgagaatcgagactagaggaaataggtgggggggggggcgatggaagaagggcatggcataaacaggtcgagagtctcgaggccggaggaaatttaattttaatggattgagaaatgtgtgtaatctggcaggtcaatatgttaagtgtaatcacaatgacgtttatttttttaattgctgaactctcccgtaaaaatggaaaagaaatgtctttcagcacccctataaaaaaggcactgttgngacaccgacaaaattggcacttttctcccgatggttccgcaaagggtgcaccgacgacagctcggcacaaattgtgcgcatg

SEQ ID NO: 23377 - DNA, 1315 bp, Heterodera glycines
taaaaaatacattttttacataaatggaaaatataatattctataattttttcatcaaatattgctaaattttttctcatttgttgcatcaatataaaatcgaagatttttcaaatatgtcctgattaagaagccaactgagaaatattttcaattttaaaaatgaacaaaattaaaaataataattaatggatattaaataaatatcttcaaaaatatacttaaaatatataaatattttttaattaggaggaagcattgacaaataataaataaatgtattaagaaccgccgaggataaattttagtaaaaacaatctcagagcattttggactagtcagtgcaattagttttttttaaggggattgttgccaaatgcaaaaaacacaaagcaaagggaatgatgaaaggaatggatggcatttgcaactgaggcgatgggttagaaatggcacgagaagttggaaatgaaaggagcagcagggttggcttgggatcgtgaacagggtgctaataatgtcattatgtatataaaatcgtgtgtttgtaaatctcgagaaaggatttttacatttttccaatttttctagagctatgtttggtattaaaggtacaaaaattgtttatctcagctcttagaagatcaaaaaaatgtttatcatttttaggtctattattttgcgttttctctctctctctctctctcactctctctcttctctttatattctgttatactgccatacgctattaaaaatctttacgaatttattgtaaaatttgaaaactttgtcaagttccaaaaagaaattttgataattcaaaaaactccgaatcttgcacatttataaaacaaggagcatgctttgtaatcaaaagaattcattattttttaaagaaatgcctttgaaaataaatgagaggaacttaccaattattgcaaaaaatttctttacagtatatctatttataaagggtgtactgcaataaaagctctaagtgtcaatcatagtcttcgcattagttctttaataatgcatgtttacgataatttttaaaaaagttaaaaaataaataattttactaaatttcaagctaaaaatgataactttaattttttcattgcttgcattataataaaggcttaaatttttgtaaaaaaattagtgactattaaaactaacaaagaatgtgaatgtgatgtagcttattatttcgtgtttaccgtagccctttactaagtacagtatgtcctaatatctcattagcggatcatttatgccccgcccactttaagtcttttgttgccctcca

SEQ ID NO: 23378 - DNA, 2836 bp, Heterodera glycines
  misc_feature (25)..(25): n is a, c, g, or t
  misc_feature (53)..(53): n is a, c, g, or t
  misc_feature (61)..(61): n is a, c, g, or t
  misc_feature (76)..(76): n is a, c, g, or t
  misc_feature (91)..(91): n is a, c, g, or t
  misc_feature (109)..(110): n is a, c, g, or t
caaatttagagtgtttaaatttttntggctaataaaatcctcccgtgattgtnttgtattnataatggtgaggaanttgctttattaagtngtgtttttatagggttgnnattagattgatttgataagtggtagaagttttagaagattttttttcattatgagtgtgaatgttggtggttattggttttctggaattatataagttttgataatttaaaaattttatgtaatgtaagatgattgatttgttttgccgagcaattatcgcaatttgtacaaatattggcgcagcgtcaaaaggaccgattttatattttacaaggtaggtaatctatagagtgcttgctcagctttcagcacaaaaaatcaccgattcagcactgtaaacagcaccaaattttcccaaaataatgattataaaaaacctccaaaataggtgctaaaatggtaatgagatacataattttaaaaaatcaaaatcttgtcaaaaaaataaatttaaaaaaacttaggagatgaattatttttgataaaatttttcatttcttaagggtgtatttttctgaaattttttgggtcgtttctcaggggtgtattttcgtttttattgcatttttgttaataaattttttgaaaattgctgaaaatattttcgaaaattcctcaaaatgacgaaacagcacaaaaaaagcaccaaaatgccaaatcagcacaaaaaccaaaaaatcgagaaatcagcatgaaaaaagtggacatagaagcctcaaaccaagttagaaatgcgtttttcatgcttattatcacgccccaagttagcaaaaaaacaaaaaaacaacagcatatgctgcaaaatgagcactctagtaatctattttacctaattgaaaaatattcaaaaaattaaatttaatcccgattttagtacggaatatcggcaggcattccaaacggagttccaatttgttttcagaagaatttcaaatcaaaatcaagtaattccactgcagaatacgacacaattatgagaagtttttttttgcaaagaaaaaggaggaaattgaagttctctactgatatttttacaattagccaatttttaagggttcgtgataacgttcggatgtctaattgttgtctataagtaatcaactaatttaatgggtttatcgaataaaataaataaaattcaaagaaaaaatcatttttattaattaaattaaagtaaaatttgtcgataaaaacccgcgactcgagaccaagactctcaaaatattttatttgggttttggttttaatttcggtgtttggcttcgacttcataaaggctaacaataagcacgaaaaacttggattttctggacaaaatttttagaatttattatcacaagtgaccgatgtttttttcaacttttcaaaaaatgattaaagaaatttcaaaaacccaggtccaggcctgggtccaggcatcgaggagcctggatttttcctggacctggatttttttccaggtccaacatggaatgcaggtccatgattttttcaaaaaagcagatctctaaaaattttccaaaaataaaacgtaaattcttgtaatttttaaaaaccacctttaccaacatacagattttattaactaattcatttcataacatgtgccaatatttgttgggggagggctctataaatccaatcgtttttttttgaatttgatcaattccttcgaatgtttggcattctgtttattcatccttgtctttgttgtagctgcttccatccggctttaggaatggatttacacgctttgtgctggtgctgctccccttctcgtcctcactgttctgttgatcaatctcctaaaaaattatttggaatttaatttttgaatttttgcccttattgatccaacgaattttcagttaggtaattggaaaatttaatattttttttttgccaaattgtacacctaataacttttctgcaaatctgacatctcggaaattttcgaaaaaatgtattatcttaaagaattatcgaatagacttaggccttttcaaattgtcgattttttttaattggattaagcgtattttttatcaaatttttgaaaattttgtaattctcaaaaatatctctcatgctaacattaatgctaagccaaatttgattaatacccaatcttggtaaagaaatttattacgaaaagcccgttttaaaaagccgtggaaaaggcccgttcggcgctccgttggccaaaacgggctttttggcatgctgttgcctgacggctttttcctacaaactaaattttaaggccaggagcggaaaaattttgccgcattttttgagatgttttccaaaatttttctctaagaaagttcgagcaaaaagcccatctcagtaccaacgagccctattccgggctttaaaagcaattatttcaacaataattatattcattaactaattaattttattcccgtcattttttttaccgcatttttgatggaaccaattagcggtgccgtcacggaagaggacggttcattgccaaaaaatgtccaaataattttccatttcctttcgactaccgtaaactcctaatctttgaaacggacccaatctttgaatggatcaaatctttggaacgaatgtatttgctctccgatggcaattaaatgaacgttgcggtggaccaattttttttgccatgaaaaaaagcaaatttctctttggcactttcatctcctggtgatcattagcggtcatcttgctgaaggaaaatccacctgaaaaatcttggtggaaattaaaatgcccaaaaatttttaaaaaa

SEQ ID NO: 23379 - DNA, 1344 bp, Heterodera glycines
  misc_feature (1271)..(1271): n is a, c, g, or t
ataaattcttccaactaataattatacccacagtttcaaataattaaatgtttctatcaaattagacactttgttgcacttttaattggcttaatggtatagtggaaaatgtttttttcgggtgcggaactatttgttctgagctcggcttaaagatagcttaacctgatttaaatgtagcaaataatttggggttgtgtttgtataaatagataaagcttttgcttttcgtttcattcaaaattgttgaaactattatttaaattctatttttattaattgctatttctttataaatttttaatttttttgttgaaatcgaaaatttaccgactgccgataagtaataatttttagtatttaattcggcatttcatttattttttcaaaaaaataataatgtgttaagttatttagcgtatttcttctattaatagcctccctctctattagaaccccctctccgataaagctgttaaaaacgattttggagttatgccaaaaaatgttttctgttttttagtaaaaaggttaaagcgtataatcaaattacaaaaataaaaataaaataaaataaactttcttcttagaatgcgtatatggtttaatatagagtgccacgggaccgggacctggtagcggacaactgagtacaactgagtaccaaggtcccggttttgaccgggaccgggactagtcccggttttttcccggttttcccagccaaaaattcccggattttcaacccaaaaaggtcccggtcccgggtttgcccaaaattcccggtcccgtggcactctagtttaataatttatagatttttaaatttatttaccgtttataattgttttataataatataaatttaattatttgaaaattgagccccctgcggctctattagaggaaatacttacgtaaatcgatttgcaaatatttgttacctaaaaaaagatcaggaactggatcaggcactggatcaggcactggatcaagcactggatcaggcactggatcaggaactggattaggcactggatcaggcactggatcaggaactggatcaggcactggatcaggaactggatcgagtacgttatttaaattgtaaaattttagaaaaaacatccctaaatttaaaaaatttccaaaaattgattccataaaatatatttttttagattcgtctgatttaaaataaaaaaattttaattcaaatttgttaaaatgcattcaatttttagcaacacccacctcaacatgcacagatngaggcgactgtttttgcaaatgaaaacaatggggtgaaaaatatttcaaaattgttaaattgaaaattttttt

SEQ ID NO: 23380 - DNA, 898 bp, Heterodera glycines
tggcggatttacgaaatgcgctggcggttttacgaaatgcgctggcggttttacgaaatgcgctggcggttttacgaaatgcaccagcacgcttttaaagtaccttaattaaatattctatttcatttttaattgagaatttaaaagtgataaaatataagcgattggaaaaatgaggtctgacgatgaagccatctaatatagcttacttattaaaggtaatcgcttcttttctcagcaataaaattaagaaattttaacatttaaaataaatcccaattaaatttattaaatttggcttcttcctttcctcctccgcttcttttctgtgctttttgttaaccttttatttcttcctttttctccgtttctttttgtttcttttccctcaaatctttcaattttttgttaagctcgtccattaattttttgaaatttggcattttgtttgaatttttaaattttccgttaaatgccttcttccatttgttccataatttctttatttccaaccattttttgctttcgccctctttatgaagtgccaattccaacagattccattccgccatttttatatgctttaaattggcataattccaattgccgtttttttgcatttgttccaattcactgatcaattcgggcaaaatgaaaagttgtttatctttaagaaataattgaggttaaaatgaaaatcaatgctccatttttacctttatcaaggttcaaatcgagttttatcagctgggaaaagttcattatattctcatcaaagtttttgatcatttcctcctttattctaaaggacaaaattcgttggacgattaaaatatatatttttttaatttcgaggatctatcgatcaccatgaggagtgaagtgatctgatcatatt

SEQ ID NO: 23381 - DNA, 1523 bp, Heterodera glycines
aataataaaattaccgatggcttttttcacaattactttatcttccaaatacgcataataaggcaacttccaatttggaatgctgattttgacaatttcattctcaattgttattttgtaattgaaaaaatcgaatgcggaatagcttaacaaaatatccaattaattaacaattattattaacattaaactttgaagctaaaaaggttgttttttacaaaattttaaaccaaaaattgcagaagttcctttttttaaatgtgcaatttaaattactccgtttttagtgcaaatgaaagtgttgacagtgcaaattccttttgttccatttgtaagcagcacaaacgaattgccattgtaaaaagcaatttgaacaatttcaaattgactgatggccaaattgacttttgccgcttttccatcaccaattctttttcttcttccgacacaacgctttcaattgtttttataaagtctatttcttcatagattggcatatttttagccaaatttcttaaaaaataaattttattatttttttgttaatggcatcagaaataaaactaatgctaatattaagatgagtaatttctccaaaacttcattgtcatttctttcgtaaaaaaacattttaattcattgattttctatatggaaagagatattccaagtttttgaaaaagatagagaaaattaataaattttttgttttttaagaattacagcaaagtttcattttttccaccaaaatttgaatagtttaaataatttttttagaaaaattttctttctgtccccattgaaaaaactttcgattatttcgatttaatgtcaaaaatgaaattcggacctttcaacgaatgcataaagtcgctcaatgaattgttcgcacatttgcagaggaaattccattaattgatgcttttcgtcatatttcactttgttcgaatggcttttcagagtttcgtataaaatttcaccaaattttacattttccaattcccattcatttaattctatgcctattttggcagatttggaactgattatttcactgcttctgttgtactccgttttgatctgatccaatatggccaaaagggcactcaacgatttgcatttatccgcaaatgattttttcgaaaaaaccattgaaaattttttcagtttttctgtgctttctcctttatattccaagctgcttagaatagcttccaaaaatttgaattcatccaattcggtgatcttttgaattgtttcccttttcacctcgcgcgctttgagcgcagaatgaacggcgttttgaagagcatcgcaaaattgcatcacagcttaaacaacccaattagagaattgaataattaaattgaatgacctttgcattcgcttttctcaattccgattactttcgcataattccacaacggttcacggaatattttaatttctaattgctcggaacttaaggaaagtaagaatgttaaagtgcgtgctaatggggagtagtttcataacgatagcta

SEQ ID NO: 23382 - DNA, 1782 bp, Heterodera glycines
  misc_feature (1707)..(1707): n is a, c, g, or t
ttcgtccgtttcaaagtggccggaatatcaatttttctcacggtgttttggtcttcatcgttcttcaccagagggacctcaagcgcagcatttcgcagcccaactcgaacagatattcgtagcactccaacctggaaacggaatgccaaatatcaaatgccatttttgaatggcaattataatgctaattttgaacacggaatgccaaatcgctcacatcattttggtccgttgccacgtgttgctgccgaatacgaagaagccgtgcccccggacgagaacgccactcgcttcgggatatctgcacaaagtcttcatcagttgaggctgaaagtgacagtgatcagattggcaaacattcatcagcagagcttacgcaaaggacgaactcgttgatttccgtttcgatgatcggcaccaccaaagtgtcaacattttccattcggcgtttggtctgacggttttcgcaccccttaattggaacagaaatgaagcccaattttggccatcagttcgactgggctttacctggatcatctcctggcccgaaatcatgaatttgtctccttgaatcagctgagtgatcagattgccccattttgtgtgcgtgtgaaccacacaaaccaaatctgagcaattcggatcattatgaggtcgttaaaatgtgcccgactgctgctgcttcacctgggttgtcacggagcaaataatacggcgcagtcggcgttctgtccgggtccgccggacgcttcaaaattgtgccggccgatttcatcacaaaatgctcatttctgaataacaaatccaaattggacacattcattttcttttggctcactcgttgaatatctccttggccaacgagttggacgagttcagaatcagaagctcgcccgtcttcggacacttaaagcgcaccgccatgccggcgccgttgtcgcgcatccatcccaaattgtagaaatggcggattagttcggccatccgtgctttcgtgatcggcacattgtccttaatttcgtttcgttttaattcgaatttcaattcccgttcactcaccgaccatccctccgtgccgtcgtcgttgaccctttccacaaccacggacattttcttccgaatctccagcttcttctttgcctcctcctccttcttcagcgctgcgcgcagttcctccttctcctctcgatcatatgtgcttttcgtgcatggcgaaattcccctcagggctttcaatggcatttttaatatgcaaataaatttttgctaaattggaaaaatgcattttgtccaatcagttcaaagtgccctcggattgaattaaagttaatttgaagtttgtttcgttttgatttggccgcccttttccgtccgtcccttttttaaatacctttctttcattcgttggttgcccttaatgcgtctcacccatgattcaaattaatcatccattcattttaatcccccgccccctcacaatttgaggacacaaaaccgaaaaggacttttaatgcattttgaaccgtgatgaacagagaaataacaacatttgttgacgcacggactttgtaagggaaatgcaattttgacaagtcaaattcggaaatttgaaaaggcttaattaattttaatgggtcaaataaaactcgaaatgttgcgaaatgcccatttttggattaccggattaggcagccattaagggactanagccataaatcacagtttgtgaccagttgggttgaaactatgaaaatgtaaaattcacaaagaagaatctgtcgc

SEQ ID NO: 23383 - DNA, 2228 bp, Heterodera glycines
agcggaataagaaaatttttatgacaaaatataaaaatgatcgaaataaaagcatatacaaatatttatatatataagatctaatggatccattgaatcaatcttcaaatgatcatacatataaatacacaaagaatctgaatacttaatataacttaatcatacttgtccttcctaaaaattataaatcaaataagataataataaatattgaccatccacgaggcaggtcatttctgggtgtaggacaagaaattaaaaatatattccaaatgaaaaaatatataaataatggcaaaaaaaaagtaaataattgaattatttctttaataatttgttaatattcttaaatttaataaaaaacattggtgctaacgaaggcccttttgttttttaattcacaagaatgcattttgaagatccaatattaaataatacagaaaaaacaaagcaatgaaaatttaatttactaataaatatttatttcaattttttcggaaagcaattggaaatcaaaaacttttatcaaaaaagtcatttttggactaatttttgagaacatttttcaatttttattggtgagatagaaattaagaaaaataattttttttaaaagaatcaatacttaaataaaaaaattcattaaaataaaacaaataatttaaaaagcaaaaatataaacacattatttaaacttcagaagaaggaattaatatgatttctttataaaaatttatccaagaagtttttgcactgttaaggatgactatttcggtaggagagggtcgccagcgaatggggaaaagaggaaatttattcaattttgaacatttttttaacaaaattcataaaaatccaaaaaaaaatttttacccgtcggcgcctgtcggcgccgctgtgcacgcaaaaaagccttttaatgtaaaaatgatcgccaattgtctcaaaacagcaaaaattgatcattttttggtgaaaatctgttaatctcggtcacgtttttcggttcccggtaaaaatcacttctcgcacatccctaatgtacaaggagttcaaaatcaagaattgatatgtataaaatattttaaaatgacataaattaaaagcaaataaatacgtaaaaataaatcaagtaaaaattacattaataaataaatgaaaataacaaaaattaaaaattatctattaaaaatattttttattataatactaatcgcgtttttgcgttatttaatttttggattcgcatttattataagttgcttatcaaagaataaaaaccagaaattctgatcgatcgacttgaacatatggaattcaaaagaagataaaaaatataataaaaagataattaagaaaattaattcattaattaaaaattgtcacaagatggagatattcttcgtggagaagacgtgggacgtataaaggaaacgaaaaaaagtataataaatttgtgttattattgacctaaaatactcacacgttcatgatgagaaactagttaaaaattaaactagtaaaaataaaattaattattaattacatgttaaaaatttgcggccaagagtgtttggcgtccgaatcccgaaatccgaatcccgaaactcgacatttttctcgtcccgaaacccgacccgatgattttgggtcgggtttcgggataaaatatgaatttttattaaaaatttatgaaaatattgtttttatgaaaacaaaattttttcttttttttgttcattatcagggatgggatttttagttgcaaaaaatcgcgaaatatttgcctagatagttgctaaaaaactgaaaatgcccaaaatagttgctaaaaaaagctgccaaaattggaataactgcttttttggacaaaaaatctgttaccaaatttcactcaaattttcaaattttttccctgaaggcgcccgtcgccggaagactttttggcccataactttcaatcaaattaagcattcttggtgttgttcgatagctttatgcgtttataattaatttgcaaaatttcaatattttcattaagtttcaaaaaaattatggccataagaaacttaaaaacctagtttgtttaacttttttgtcctggtttttttgtgcatgaataaaaaatttttaaatttgcatgttaatagagtttttgaaatgctttcggacaataaccaagaatgtttaatatggttgggaaggaaaaaagttatggtccaaaaatt

SEQ ID NO: 23384 - DNA, 2017 bp, Heterodera glycines
attttaattagagttgagctggaccgaaaattttgggcttaaccgggaccttttcgggttgaaaaaccgggaatttttggctggaaaaccgggactagtcccggtcccggtcaaaaccgggacttcggtactcagttgtccgtgtccaggtcccggtcccgctcaactctaattttaatgcgttttattcacctttttggcaacattttcatttcttggcaaaaaatatacaaaaatgaaagcatttttcatggcaaaatttcatttactcttttttgacagaatcccaatccaccgtcctactcatttggtggaccgatggaaagcattgaggcgaaagggccgttggaattgcccaccaaaacgcggcttaaggttttttgttttttaggggaaaacaattttaaaaaaaaattaaatttacgatttataaaaattgggccttgaaaaacaaaacatttcaaaaaagagattacctatttctttaataatccgtctgactttttttagtttgtcaaattaaatgcattttttggaagaaaaaaaatttttttgagccactgaacccaattttttaaaatatttttcgaatttctcccccaccccaaaaaaaaaaataaatttggtttttcaggtgcgtatcaaacggttggacattgtcggctcgtggcgttgggtggacggcaaagaggacgcgtgcggcatttgccgtactccgttcgagacctgttgcatggactgcaaattcccgggcgacgaatgtccattggtatacatatttattgctggcggcgggtggttttggattttaccggatttcgcggattaattgaacctgtcgtactctaggcctaaactagtggcaaatcgtttccccggtgttgccccacatttgcgtctttgtccaaaatcggactcaaaattgaatttttcaagcaccatgatagcctaatccgcattagaattaagaaaacgcggtcttttggttcattaggatcaataatttgttgtttgaaaattttattattttttcaaaaattttttgaagatcaaatgatcggatacaatcacttcactttcaatcgctcatttaaagctgtttatacaatcaagaaatgcaaaaaacttaattttgaacccgattttggacaaaggcgcaaatgtcgggacacgcgataagaaactgattgtgccaagatcgtcagcaaatttttgaaaaaaaaataaaaataaatttaaacaaccaaattattgttcctattccccggtctctatgatggaacacaacctatgtcaaacaacataaggacacttctttgaaattgaggactcaaaaattcaaaaaaaaattttttgaattttttttgccaggtgttgggccagtgcaaacatccgttccacatgcattgcattgtgaagtggacgaacacgcaaagcgggcagaagcccgcctgtccgctgtgccgtcaggagtggaaatttgcgaccagctgattttttttgcggggagattattactagagatcgacctggacctggatccaggcctggatttttcctggatccaggtccaggtcatttttcggcaacctggatttttcctggacctggattttcctggatttttgtccaggaaatccaggtccaggtttttttcaaaatgtcgatctctagaaattattaaaatagtattggaaaaacattttctgctgcccaaattaaacaccaaaccagtaactcgaaatttttgctaaactaaatttggtgcattaaatcccgcagaggtcccgcatttaaaatttgcgggacccgaacaggatttcggattttttactataccgacaaatattgctatactatactaaatatcggcactggtatcgatgagacggcattacgcttctatccccggtgatgatattttctgcagatatcgcaacctgacaattggatgacagaaacagtaaactcagtgattcactgcctgctcagatggtgactgatagaactgggactg

SEQ ID NO: 23385 - DNA, 1700 bp, Heterodera glycines
gatttaattattaataaaaaaatatttggtgaagtaattggttattgttgggttattgaatatcaaaaaagaggtctcccacatttgcattttttaataactttacatccaaaagacaaatggcataatagtgaagatattgataaatttatatcagctgaaattcctgatgaaaaaatagatcccgaactttatgaaattataacaaatagtatgatgcatggaccatgttcagaaaaatcattgtgttggaacaaaacaaaaaaaaaatgtaacaaaaaatttcctaaacaatttcgagaagtgactgttataaatgaagacggttatccgctttataaaaggcctgataatggacgttatatatatagaaaagggcaaaaactgtcaaatcaatttgtggtaccatataacccatttttgagtaaaacatttagagcacacataaatgttgaaagagtaacagatatttcagttgttaaatatttatatgaatatatatataaaggatatgacgcagcaaccatagaatgcgtacaaattggagaagacggcacaaaaaaaatattaaattatgacgaagtcgctaaatatttagaggcacggtatttaagtccatgcgaagcatgctggagaatctttaaatttccgatgcaaggaaaatcccattcagttgatcaattggatgtgcacttagaaaatacccaaagagttttttatagaaaaaatgcgactgatcaagaaatcgaagaggcattgttaaaaaattcaaccttaactgcttattttaagttttgcctagaaaatcctgataaagaaattaaatacactgatatgccaaaatattgtacctgggttaaaaaagataaaaaatggaaatatccaagacaaggttaccaaaataaaattggtagaatggtaccaatacacccatctgaaacagagaaatattatttgcgttttcttttgctaaatgtttatggaaaaagttttaaagatttaaagaccgttaatggagttgaatatgattcattcggtaaggcatgtttggctagagggttggtgagagacgatgaggaatggcacaaatgtttagaagaagccacgtatttttctcgaaaacacgcgaaaggcttaagaactttatttgcaaatatattggtacattgtgcaccaaaatatcccgccagattatcgggattcattcaaagagtttatggttgatgacattaaaagaaaaaatccttccttttcaataaaacagataaataataattcgggattaaaattaattcgatcaatggcttaagaatattatcgacaaatcattgagagattttaaggatatcgccacaaattattaacaagacaaaaattattggatgaagaagagatttacgatcctgaaaatgaattagaattagcgaatagattaattatgatgatgaatgatgaacaaaaagcaataataaataaaaggcgtaatatattagaagaaaaagacggacaaaaaggcttttttatagatggaccgggcgaaaaccggggaagtcattcactttaaaaatatttatcattttgggtagatcttttaataaaatatttgtaacatggcattctcagggattgcggcacattttaaaaaaagggtcggacattgcataatcgatttaactccctttaacattaaaaaacgtcta

SEQ ID NO: 23386 - DNA, 1292 bp, Heterodera glycines
  misc_feature (1238)..(1238): n is a, c, g, or t
ttcttcctttttgctttattttttcttttattttatcctcccccgcaacactctctttttttgagttcatttcgtcgtcccctcttctttttcttcccatttttctccaaatatttcgccaaatgatttctgttgtaatttttcattagctgcttcaattggaataattagggcaatcaaaaataaaaataataaaatacagaatttcattttcaagattttattttatttttcttcaattaaatggcaattcattttttgaggcatttaaatgattttttctgattagaaaactgaataaatcattattttacttaataaaataaggaaatcctgtttaattgcaaagaaataataataataataattttatcttaatgagaaaataattgccaattggtaaattaatgattaataaaattttattactttctactggagctcattcgaaaataataaacttattttcaataaaaataaaataaattcacaatgtaaagagattttataaaaattaatgcaattttctcttcaattttattccattcttttgctgtgtattttcttcctttttgctttattttctcttttattttataatattttccaattatttcccttttttcttccaatttttcttcttctttttcttgccatttttctccaaatatttcgtcaaatgttttctgttctaatttcttattgactgttttaatttgatcaattttggtgatcaaaaataaaataatattcaaaaggaataatatgaataaattcattttgaattttaaatatatttttcaaaagtttccttaataaaaattatttattaataataaaaagtggaaaatgaaaaatgctttaatgaaaattcaatttttgtggaaattattttttaaataaattatttcgcattgattttatagttcaataaattattttaaaaaaagctcttaattggtttttagttaaaaaataataatctttttttcataaatttttttctcaaatcacgaaatgaccattttataaaaaataagtataaaatttttcttgtggaataaattaaattcgtaaaatacaaataattaatttttgtgaaattatttcgtctttaatgaatttttaggaattgtttttaaatttaataattaaaaaaattttaccaaaaatggcgtcgtggttgtggaattgaagaaacgaagaaataaatataccgtagacatttaattatattnaaaatattaatatcattgcatccatttccagctttacacacttctttacattcc

SEQ ID NO: 23387 - DNA, 536 bp, Heterodera glycines
ttcatagagcattgttgtttgatattggcagggggataaagccggctgactgagtgaaaacggggtggggtgggtaaagcgaaatgactgagtgaaaacgaagatcctgctctctcccccacctatcctccatcaccaacccgtccttctccccttcaatcgccccgctttcgctttccgatcggctttaaccagcacccaccaaacaaaagcagtgtgtgtctctctctcctccacatcccccgcttcaccccctcctccatgcttcccagtgcttcttcaaagaagactggactgactgactgactggtgtggtggtggtgtgctgctgagagtgggtggtgaaatggggctaagtaatatatgtatgtgtgtgtgtgtgtgtggatgttagcattagtctggcgatgtggtgggttcattttcgtcggatgtttgtgggaggctagcgtatttctgtttccccatttacaaaaaactaaccgagtctaactatggaatcatttatttcttcttatttttatttatcctcagaa

SEQ ID NO: 23388 - DNA, 1192 bp, Heterodera glycines
catcctcatcatcttcctatctctcttgctcaccatccctttctctctctctcttcctctctctcatcctcatcatcttcctctctctctttctcaccgtccctttgtctctttccttctctctcatcctcatcatcttcctctctctctttctcaccatccctttctctctctctcttctctctcatcctcatcatcttccttacaccctccctttcttcccctcttccttctctctctcttcttctctctcatcctcattatcttcctctctctctttctcaccatccctttctctctctttccttctctctcatcctcatcatcttccttacaccctccctttcttcccctcttccttctctctctcttcttctctctcatcctcatcatcttcctctctctctttctgaccgtccctttctctctttccttctctctcattctcatcatcttccttgctctctttctcaccatccctttctctctctttccttctctctcattctcatcatcttccttgctctctttctcaccatccctttctctctctctcttcctctctcatcctcatcatcttcctctctctctttctcaccatccctttctctctctttccttctctctcatcctcatcatcttccttacaccctccctttctcccctcttccttctctctctcttcttctctctcatcctcatcatcttcctctctctctttctcaccatccctttctctctctttccttctctctcatcctcatcatcttccttgctctctttctcaccatccctttctctctctctcttcttctctctcatcctcatcatcttcctctctctctttctcaccgtccctttctctctttccttctctctcattctcatcatcttccttgctctctttctcaccatccctttctctctctctcttcttctctcatcctcatcatcttcctttctccctttctcaccggccctttctctctttcttctctctctcatcttctctctcatcctcatcatcttcctctctctcttttaaacatccctttctctctctttccttctctataatcctcatcatcatcaatacaacctccctttcttcccctcttccttctctctcctctttggaactccaaacctcatcatcttcccctcactctttcacaccgaccctttctctctt

SEQ ID NO: 23389 - DNA, 897 bp, Heterodera glycines
aaagaattttctaatttaaaaagtttttttgggattcgattatttatttcaccatattgacggcagagtaataataaatttaaatataaataatttttaggtataaaatgattttaaatagaaagaattttttaatttaaaatgtatttttgagattcgatatttatctcacatattgacgcagattaataataaatttaaatataaataatttttaggtataaaatgattttaaatagaaagaattttttaatttaaaatgtatttttgagattcgatatttatctcacatattgacgcagattaataataaatttaaatataaataatttttaggtataaaatgattttaaatagaaagaattttttaatttaaaatgtatttttgagattcgatatttatctcacatattgacgcagattaataataaatttaaatataaataatttttaggtataaaatgattttaaatagaaagaattttttaatttaaaatgtatttttgagattcgatatttatctcacatattgacgcagattaataataaatttaaatataaataatttttaggtataaaatgattttaaatagaaagaattttttaatttaaaatgtatttttgagattcgatatttatctcacatattgacgcagattaataataaatttaaatataaataatttttaggtataaaatgattttaaatagaaagaattttttaatttaaaatgtatttttgagattcgatatttatctcacatattgacgcagattaataataaaggcatttccgcaactcgagacatatttttccgtgcttagctcatcgagacgaatcgattggtatataatttgacccattttttcacaggggcgttcactacagttcaccca

SEQ ID NO: 23390 - DNA, 1139 bp, Heterodera glycines
aaaaagagatagccatttttttgggcatagagaataaatttaaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattggctctccgcgcccctctgcccatgctgggaacatttgtatgg

SEQ ID NO: 23391 - DNA, 1722 bp, Heterodera glycines
atggtttaaaaatcagtctaattgaattttttccaaatagtgaagaaataggccaactgaggttccgaacaagcgttatttttgatagcaaaatcatttagattggctaactactgataaaaatgttttactgcataaacaatgaccatgactggtaaaatgcaggtcatctagggtgagaatttttaagcacgaaaaagtccaaaataagtgcgaaataagcatgaaaaaattccaaatttaggggtataatttttcaaattgcttttatatgaaattaatttctttttcattgattacagttgaaaataattaaatatattcgaaatttttgaatacatttttctaaaataaataaatttcaaaaaccaaaatttgatcaagaaagaaaataaattttggccaagaaaaaaaaaacaaattcagtggaaaaatttttaaaaattttataaacagtcgccaaaaaatgtgatcgcgtcaaaaaaaatattttgtttttcattgcatttttgttaaagaatttctgaattttcatgaaaaatttaaaaatcgcgaaaaataagagcgaaaataagcacgaaacgccaaaataagggcaaaaacttattttaagggcgtacatctaaaataagtatttctaagttcgaataagtgcgctaaaaagcaaaattttcgaataaaaaatgcgtttttcgtgcatttctcgtcgagttaaagccgcagaaaaaataagcaaaaacttaaaaatcctcaccctatacataagcaccctttcgtggatgcagcagtttccccggtaatcgtacgctttactggtcccacaaaaaaaggtcgaaaaaaggaattccgagctttttttgttgtgcactcagggggtttcgcaggcgctgatcacgaatatgacatccatttcgatctatttctgaatcccgaacccgaaccaaagtcggaaattaatttttatccaaaaccgattcaaatgcactaaatgaccttgaatccttattttctattatattccatgtatctgactcgattttggaccataaatatgaattttggtgaaaaattaattttcgacttttgttcgaaatctggtccggggttcggaattgatcaactgttcttaggttcgtgattagcgaccccgaaaacccatggaaaagctttattgacaattttttcaaaatttttacaaaaaaattgttcgaattcgggttcgggattgaaataggtcgaaatggatgccggattcgtgatcagcgaccctggaagcatgttcaaagaatgaccttgatttcagcaaatcgcttaattcatcctaaggcatattgtataacacaatttgtgatcaccgcaacaaaaaaaacagttttataagcgtcaaattaattatccaacaccgcaatttcaaattgattatcactctcaacagttcattcattcacttctgtaagctgatcacttgggccaggagtttcgttgagaagcctaaaaatagaaacgcaaaataaatatgaattttgaaaaagcattcgcttaccctttcccgaattcgtcctcgttataaatgtgaatgccaattttgttccattgatcataagtttgccatccaatcgcttcatcttcccattttgtccatttgctttcatctctcgcaattgcgcaacggatcagcagaaaaagatcgctattgtcagttcttttcaatgccaattgctc

SEQ ID NO: 23392 - DNA, 1541 bp, Heterodera glycines
  misc_feature (4)..(4): n is a, c, g, or t
  misc_feature (51)..(51): n is a, c, g, or t
  misc_feature (54)..(54): n is a, c, g, or t
aatnaaactataaaatttagaacaaataatttctctgaagttttttaactngcntttaccatgcttttaagccccgccgtgaggcgggacagttccaaaatttgcaccacattttactgtggaaagtccaagtaccttaattggacaactacgtgtcaatgagcacagtcgccgttggccagttgtgaaacagaaaaatgggaatatcagatggggtgcgtcccatcctaaaaattcctcttttcgtctaaccatcactccctttttgtgcactatttcgtttcaacattgtatcaattttttgttgtcttttgaaataaattgtgaaaaaatatacgaaaattattttcgcttttaattatgatgtacaatgcttttaagccccacggtgaggcggctcctttttgtgcactattttcgtttttaaaattggatccggattttttggcttttttaaataaattgtgaaaaattcaaaacaaaaaacttttattgcgctacaaatgcttttaagccccgccgtgaggcggctcctttttgtgcactattttcgtttttaaaattggatccggattttttggcttttttaaataaattgtgaaaaattcaaaacaaaaaacttttattgcgctacaaatgcttttaagccccgccgtgaggcgggacagttccaaaatttgcaccacattttactgtggaaagtccaagtaccttaattggacaactacgtgtcaatgagcacagtcgccgttggccagttgtgaaacagaaaaatgggaatatcagatggggtgcgtcccatcctaaaaattcctcttttcgtctaaccatcactccctttttgtgcactatttcgtttcaacattgtatcaattttttgttgtcttttgaaataaattgtgaaaaaatatacgaaaattattttcgcttttaattatgatgtacaatgcttttaagccccgccgtgaggcggctcctttttgtgcactattttcgtttttaaaattggatccggattttttggcttttttaaataaattgtgaaaaattcaaaacaaaaaacttttattgcgctacaaatgcttttaagccccgccgtgaggcgggacagttccaaaatttgcaccacattttactgtggaaagtccaagtaccttaattggacaactacgtgtcaatgagcacagtcgccgttggccagttgtgaaacagaaaaatgggaatatcagatggggtgcgtcccatcctaaaaattcctcttttcgtctaaccatcactccctttttgtgcactatttcgtttcaacattgtatcaattttttgttgtcttttgaaataaattgtgaaaaaatatacgaaaattattttcgcttttaattatgatgtacaatgcttttaagccccgccgtgaggcggctcctttttgtgcacatccctccctttttgtgcactatttcgttttaaaaattgggaacatttttttgtttgtttttttgaaactgaaaatgtaaaaatttaatagaattatttttgattttaaa

SEQ ID NO: 23393 - DNA, 1623 bp, Heterodera glycines
  misc_feature (63)..(63): n is a, c, g, or t
ggggggggggggagagaaatgccctcaaaaaatgccctgaatgaggaaaaatggcattttggntgagaggaaaaacaaagggagaaaagtataagatgaagttaaattgacagatggcgagaagcggagaattgtgagaaaccaaatttaatagagggaaaaaaggaaacatcggcggatgggggggggggagacaaaaaaagaaaaatgaattaaaaaacaaaaagtattataatcgctttggaaatgcaaaatgaaatgagtgattcatattgattaatgatgctcgagattctcgagtctcgactcaagtgcattgtcagatccttggcttcgggagggactgaattcaaatcccgagaaaagtctcgggttttttatatgtctcaattctcgggaaatcttcggtcttgagtatcactaatatttactgggtaaagagattgaatggcggcaatgcatggccaaagtaaaaagtgttgttcgggtggaaggcatcgatacaaatgccatggaattgggctccgcctgctggaggctttggtgtccttttccggccgaaagtgcccatgggcattgcccgagcttctcgcattttctttctttcttttccttcggagttccctctgtgtgccaataaaatggccgctgaaaattgggcaataagaaaacggaaagagcggaagaataggaaaaaaagagactacagacagaaagataagccatctgttaaggaaagacacggacagagcagagaaatgccatggaattggggggagagacggacagagcagagaaatgccatggaattggggggagagacggacagagcagagaaatgccatggaattggggggagagacggacagagcagagaaatgccatggaattggggggagagacggacagagcagagaaatgccatggaattggggggagagacggacagagcagagaaatgccatggaattggggggagagacggacagagcagagaaatgccatggaattggggggagagacggacagagcagagaaatgccatggaattggggggagagacggacagagcagagaaatgccatggaattggggggagagacggacagagcagagaaatgccatggacttgggggagagacggacagagcagagaaatgccatggaattgggggagagacggacagagcagagaaatgccatggaattggggggagagacggacagagcagagaaatgccatggaattggggggagagacggacagagcagagaaatgccatggaattggggggagagacggacagagcagagaaatgccatggaattggggggagagacggacagagcagagaaatgccatggaattggggggagagacggacagagcagagaaatgccatggaattggggggagagacggacagagcagagaaatgccatggaattggggggagagacgcacagagaagagaaatgccatggaattggggggagagacggacagagcacagaaatgccttggaattggggggagagacacacagagcacagaaatgccatggattttggggggagagacgaaccaaacaaagaaatgccatggaattggggggagagacg

SEQ ID NO: 23394 - DNA, 1216 bp, Heterodera glycines
taaaaaatgatgtccataatatcgtaaaaaggtgtgtctcgttcatttcaacaacaaactctttgccatttcgttgtccactttttgccaaaaacgtccataacgtccgccatggtaaacagtgcgtgcgctcggttccagcgtcaattccaaatgctgctcggtgttctgagcactgattggacgccaaaagtcgggtgaaacgagcgtggaattggctgaaacagaatgccatgccaataataaaacaatggtggtcgaattttgtaaaaaaaaaaattataaaaagtggaaaatttaaaaaaattataagcaaattacatgggttgaaaaattcaaattaagttgattctcttccttttaatatccctgcaaaatttgatgagctttagttcagttaaaaatgagttttaggtgatgaaatttcagtctcggctttttttttaccgaaaaaaactgtctgaaccccacttttgtacggtcggtctctaaatgctttgttcgctgtcactaccgcaatgctcattgtgccatggctgctgctgctggtggtggtgttggcattggtcattatcaccatcattttcatgcaattggtgttggccatcagcagaaggcgcagtatcattagtggtggtgaagacggtgttcatgttgattttctgtgtccagtgagtgttcgggttgctggaatagcatcattaaaaaacaatttccaaaattatataaaattttttaaatgccagccaacccattttgtttgaaaatttaagaaaattttcggtggaaaacgaaaggctcccaacccactcacccatatttggcaaaatttgtgaagaagccgccgatgatgcgcatcatttgcttgtcatcccaattcggtcgaaatttggcgtacaaacccttgcccagcaaatagcgcgcgtcatgacaatgggtggcagctgaggggggggggggggggggaaatgctaaatttaacacaaaatttttggatttttaccgaaaatcgattttaagaatttttttttatttaaaaaatgtcgagtgaatcacttgtccggtctctaatactaattcatacccgaaatatgaaaaattcataattcaaaattaaaaaaaaaatcatgacaaaattttaacaatttccaaggtttcgtatggacgtacattctttccgaaattcccccccccccaaaatgccaaagcatggact

SEQ ID NO: 23395 - DNA, 2146 bp, Heterodera glycines
aaaaaaaaaaaaaagaaaaatttttttttttttttttttaaaaaaaaaaaattaaaaaaaaaaaacttttcttttcttcttttaaaaaaaaaaaaaaaaaaaaaaaaaaaaaaaaaaaaattttttttttaaaaaaaaaaaatatttgttggtttttttttttttgaggttttttttttccaaaaaaaaaagaaaaaaaaaaaaaatgtaaatttttttttttttttttttttcggccccccccttttttttcttttttatatttttttttccgctgggcgcccggttaccctttttttttaaaaacccttgggttttttttttggggggcccaaattttgggtccgagaaaaaagggggtttttttttttttaaatttttttttttttcaaaaaaaaaaaaaaatttttttttttttgcccctttcccttttttggcctttttgccccagggggaaaaaaagggtttttttttgggggtgcccccgccgtttttccccctccccaaaaagcgaggggcccccttcggaaaaaaaagcgaaaggaaaggggcggggaaaaatttttaaaaatcaaaaacggaatgaaataatcccacaatttttaaccggaaaaatgttatataaaattttattataaaaattttagaaaaaaaacggataaaatttcatggaaaatgtgctaaccacgcattgtttcggcaaccgaaagggctcatccgtgagaacactggccactttggcaacaatcttaaagacagtaaaaatttgaattttaccgttaaattttcgaaatattttctcgacataattttttttttactaacaataatcaaaatgacgaatttttgggaatttaaaattaaaaaaaaatttagtaatggttggtttccggcggtgaaaatggccaacaccttggaaaaaatttaatggaaaattggggtgtatcgatgtgagggaggggaggggttgagtgaaaaacttcgtggagttagcgttgccccacccctctgctcacttttgtcgatgtacaaatgcgtgtgccgaccgtgtccatataggcggggaagtcgccgtcctgcgcaagtgcacgctcgcacaagtgcgggtccacgcgcagtttgcgaggacgctgaatggcatttagcaaaaagccataaaaatgattattttattagagttcgacaagcaaaatatcgaactctagggtcagaaaaatgaatcagtccattatcaatggaaacccgattttgaaggtcgcgatttgccagtttttttgcgttttataaaagagaaatcggctcacctcccgcgggcctttgccctcgcctttggaccgatccgcctttttctgactgcgctttatgttgaccaacggtgcgtcctgatactcaatttcagtctcgcggtgtccctgaaaagctgcgttcaaaaacaaacgaaacgaaattccaaaaaaaaaattgaatctcggttttcccggatcgacggaaaagattctgtctcttccaccttgctccgttcaccgcacccatcgcagtaataaaagccaccgtccaacgtgaaagtgtcggtgccgcacacctcacacaccatttcgccatggtcgcccccagacgacatttccgaaaggaacaaaattgcgaaaatatgtgttaaattagcaaatttaaaatcccataatgagtgtgttgtcaaactttctaaacagctaattgtaagtcgagaatctgatttattaaaaatttaattctgagtgagtgaaaggcatcgtctgtgttcaaaacatggacaaaagcgtgaaagagacaaatgctgggagatattggaaatgatcaaatattacaaatgaaacttgcaaaaatggaacatttgtccataaggccaaaagcaagaaatactcttttcataaatggcacagaattgctcaagcaaacacaccataacaaattgacagaaataatttctgatgtcccccacgaaaatttttccaaatgtttgaaagcttaaccattttgaaaatgatgtgcgaaaagcgggcatttctgctgaaaaagtcggacgctcttttgagtagaagagggatgaaaaatggtggaaagtggcgagagtgaaaatgatcataataaatggtatctgattttctgt

SEQ ID NO: 23396 - DNA, 982 bp, Heterodera glycines
gtcaattggagcaatgtttcgggcatgtagtgcgggaatttcagaattctcgaaaactgacatcttagtgagaactgaaaacggtacggaagaattacaaaataagtccccatttgggtttaaaaggccgacaaatgtcaattggagcaatgttttcggcatgtagtgctggaatttcagaattctcgaaaactgacatcttagtgagaactgaaaacggtacggaagaattacaaaataagtccccatttgggcttaaaaggccgacaaatgtcaattggagcaatgttttcggcatgtagtgctggaatttcagaattctcgaaaactgacatcttagtgagaactgaaaacggtacggaagaattacaaaataagtccccatttgggcttaaaaggccgacaaatgtcaattggagcaatgttttcggcatgtagtgctggaatttcagaattctcgaaaactgacatcttagtgagaactgaaaacggtacggaagaattacaaaataagtccccatttgggcttaaaaggccgacaaatgtcaattggagcaatgttttcggcatgtagtgctggaatttcagaattctcgaaaactgacatcttagtgagaactgaaaacggtacggaagaattacaaaataagtccccatttgggcttaaaaggccgacaaatgtcaattggagcaatgttttcggcatgtagtgctggaatttcagaattctcgaaaactgacatcttagtgagaactgaaaacggtacggaagaattacaaaataagtccccatttgggcttaaaatgccgacaaatgtcaattggagcaatgttttcggcatgtagtgctggaatttcagaattctcgaaaactgacatcttagtgagaactgaaaacggtacggaagaattacaaaataagtccccatttgggcttaaaaggctgacaaatgtcaattggagcaatgttttcggcatgtag

SEQ ID NO: 23397 - DNA, 1637 bp, Heterodera glycines
ttaaaattttaaaatttaggcaattcataaagaaattatttcacctaaaattttgaatgttttaaaattgaaagggaaatcaaaacattcacaggagcagcagacagatcaaaatcagaagaaaagtaattgaattaatattattatgagaaaaaggcatagtttctgatctatttagttagcgatgatataattaataataataacttaattatagtatatttattaataaatagacactaaaatatttcagaaggaattgttgaacaaaatgatattgccgaattattttatttaaaaaggaaatgttaaacaaaattatatttgacgaaactttgaatttggattaagcgccgacccctcggggaagaaattttcagggagccaaggggtcccggcgtcgtagacgcagaaatgcatgccacggaaaattttaattgaaattcttttaaatcagttatttaacacagcggcccaattttgggttctcagtgcaaataggtttattatttatttagtaatcagaacgccaaaactttgcaaaaattaaaattttttttgggattttcccttgtaaaaatggaagagccgatctcgagatagaaaagaaactttcagaaaacaaaagagaattcgatagagagggccaaaaaactagcctaggcaaaatttcaagaaaagttacccacaggaaaaaaatttttcccagggcaaacatttcaataattttaattcttttttagccaagtccacaatttaaggccaaaccaaataaaatttacaatattctccagaattttcccttcaaaatgagcataaaatggttttatttgctctactattcaccaagttataagctaaaaaaatttcataaaattgtcgatgttgtacgtaaccatcgctttttgaatatgattttttattgccacgaaaacttttattaatgaaaaaataattctgccttcttctttaaaagaagaaattgaaattaacacacaacatagggaggacttgaacctgggaccccccttttggtgactaactcacagaccactaagaccaaaaatccagcataattgtacttggagcccaaaattgggccgctgtgtaaatcaaatcaattcgtttgttacgcaaagttcgttcaaagaattttttggttatttctagggccgatttctaatggaaaaacttttttttttgctcgattgatttgaagaaaggagctcaaaaaacgcatttctgcattaaaattttttcctttggacgtcatttttcgtcactagaaatcactattttggcgtttcgtcactaaaatagttaaaaatcactattttggcgtttcgtcacttaaaatagtgaaaattcacttttttggcgttttgtcactatttttcactatttcgacattttttggaaaatttgttaacaaaagtgcaataaaatcaaaaaatacacccctaagaatcgaccaaaaattttttaaaaatacaccactaagaattggaaaattttttcaaaaattcttcccccaaattttttttcttgacaaaatttttgatttaaaaaatgtcaatatttgctaagagaattttataaaagaaatatagctcatttgcaactacaatcagtgaata

SEQ ID NO: 23398 - DNA, 957 bp, Heterodera glycines
  misc_feature (768)..(768): n is a, c, g, or t
  misc_feature (917)..(917): n is a, c, g, or t
acatttagccgcaagatttgctcaataattttgagaaacgatattctttttcctacttgatacttattgaaatattaagctaattaattaataaaaagttaaattaatacatttctatatataaatattaaaaatcaagaaaaatgccaaactcattaagcacaaaaattttttcgattttttcatggcacaccacacaacttacacaacgggtgacccattgacaattggcacgaccaccagctcgacgagcagcatgacacacagaatgctgtagccgttcatttttttttggaaaattatttttaaattaatgcaattaaccttcaataaaatttaaatatttgccattattaatttaatgtataatatttgtgtaaaaaatgttacgggcttcaccttttcggtatacaccagggataatgccgacactctcaaaaaattcggcaatcagcaaattgaattccgatcgcatttgaattttttttttgccttttgccaacccacactttctcagtttcattccatttttgagtaagtttttatcggaatttgtaaaataagatctaattgattttccgtctttcaaaatgaattattttagtttaatatattctaaaatagcatataaaaaaactcttggaaattgattaactatttaaaaaacactcttaaatccatttaattcttaaataaatttaaatttaaaatgcttaacattggctcagaaaatgaactctgttcttgggaaacgagaatttcttaaantcttcgctggtcatgtgaattgtgatggctgtgattttttcaggaccaaagttttggggccaaatgttccactttttggcagtttggccaaatccatttttatttcgggtgattatgaccggccaccaatgggatgtgtacattcatangagtagaagagcacctgatccgatattggggaaatgaata

SEQ ID NO: 23399 - DNA, 1158 bp, Heterodera glycines
acttttttgtttcctgactaaaaaagcgattcccaagggcgcccttttggcatcaaaggacgatgttgggctatttttgcccttgccaatgtctttttcatcgacaatagccattcacgagtgttcaacagatcaatcaattgatctggtggcaaatccgtatgtttcaacaaatcattcatttctttttcaattgtctttttaaattcgatgatcttcaccgtttgattaggatttttcgattttcgcaaaattttttgcatgcattcagcgaataattgacgactttttttgtattcatcaacatatttttcaattattggttcaaggaatggaattttcatcgaaggactgaaatttaaaatttgaatattcaaaaaaaaaagtttttttccagttttctgattatattcattatcctaaagttattagcatactaaataatgttttataaaaatttttaatttttttataaataattttaaaaattaataataacagataagtgctaaaaactaggccaatcataatttggtgtattgatggaaaaatatctatgaatttttaattttttttaccaataaatttttttaaatatataataaaacatacatataagaactatgataattatatatttgaattttctaataattttttaaaaataaatatttaaataaaggtcagataactaagccaaccatcataatttggtgtattgatgacaaaaatagttaataaattttaatttccaaccaaacattttttatattaaatttatttaaatgtgagtgaaaaaactaagccaatcctaattaggtttatatttaatgtttaaatcaatattaaagtttcctacattttatttaaatcaacccgtaaattgttcaaataggtttgtgccgcttcctccgccgtctccatttcactgctgcccaaattttcactttttggcacattgctttccgacgatgatgtcattgtttccgccgaatgtatgccgtgcttggtagtgccaattttgttgccagttctcggtttgtttgggccaatcaacaaccttcgattgacaattaaattgctggtggaaggtgccgaaaaattttgtgtttccttgatggtttcagcattttttccggctttttgtctgtacaaatt

SEQ ID NO: 23400 - DNA, 1281 bp, Heterodera glycines
ggggaactaaacctgtattaatatttttaacaaattgcagtccttttcgcctaccctgttaagagaaatcttaattcacataataatttcccaattttcttctataacagattaactcttctatggtgagtttttcaatttctatgtactttattaagtaaacaataataatcaaacatttttctatgattgcaaagcatttaaaaaatcataggcttgtttattttcattatgttttggaaaaggtcaattaaataaacaatttttttttgtaattttattaattgtataaatcttatgcaattttctataagcaatcgatagtgtaacaaatagagaagataagttctgatcaagcacacacctttcattatttccggttaaatatgtgttcatattttaacaaaaagcagtcttgaatgtcgtcgaaatttgtggtaattccatggctatagccccgaccaattgcgctggaattttgccatgaggcttattttttgtgctggtttcgaatttacaggcgcccatgcaattggagcgcattaaattttttgtcgatttttcttcaatacccaccttaaacgataagcatttcctcgcacaccgctctatttgctctgttttaaacaacaaaattttcccaagcattcatacctactttcttaattgcactgggatcacatctaaacgactatgctaaaacggggaactaaactgtattaatatttttaacaaattgcagcccttttcgcctaccctgttaagagaaatcttaatttcactaataatttctcaattttcttctataacagattaactcttctatggtgagtttttcaatttctatgtactttattaagtaaacaataataatcaaacatttttctatgattgcaaagcatttaaaaaatcataggcttttttattttcattatgttttggaaaaggtcaattaaataaacaatttttttttgtaattttattaattgtataaatcttatgcaattttctataagcaatcgatagtgtaacaaatagagaagataagttctgatcaaacacacacctttcattatttccggttaaatatgtgttcatattttaacaaaaagcagtcttgaatgtcgtcgaaatttgtggtaattccatggctatagccccgaccaattgcgctggaattttgccatgaggcttattttttgtgctggtttcgaatttacaggcgcccatgcaattggagcgcataaattttttgtcgatttttctttcataccactttaa

SEQ ID NO: 23401 - DNA, 1577 bp, Heterodera glycines
attatagggaaatggcacttcaaataccaatcagcagtatcattcagaaaacggtccgattcatccgtttttttacagatttcatgaatattttgctgtacgttttcctcattttgtttttcttctttcattttctggtcatttttcttccttcgtgcgacagatggccacactttgtcccctttttcttctcatagccaaaaaaatgaaaatttatttgtccacgaaaatgtcgtaaagccgaaaacagtgccaaatgggcacccttctcagctcaaccattcttaaactgaagaaggcgttcaacattggcattatgaattgctctgaggaaccctttcggtttagttatcgacgagagatgtccactcggatggaggacaattcgttgtttctggaggaattggcgcgtcagactgatgaaatccgccaaaatgggctcgacgcaatgccgaggcacggatcactgacagacaaagtctgaagcaaaaatggaaatttacctgggattaaggaggctattgttatttccccattcagattctcgaacttgaggaagaggtggaacgacttcatgcggagaatcgcgagctgaatgagcagtgcacggatttgcaagcgcagttgctgcacaattcggtggaatgtggcagaaatttgttggcggacgcgggacagccgagtttggccgccgaactgagtgggaccggtgggatggaccaccacagggtgagaaaacagttcaaacggtcaaattacccaattttgaattgagatgttggacatcataaaggagcaagacatcgacaatcaaaagcttagaaattacataaacggttggcacaatgataattgccaatttgtgatcgcatccctttcattcgctttaggaattttggtgagagtgatcgagctgcatcccgagattctcgagatcaaggacgacatgaacagttcacaatcagtggcgtccaacggctccgcccaatcatagcaattagccggcgacgctgtgcccgaacgacggcgagtaacagatgaaatggagagacgtgccgcgtcacaacccgtgtccccgtcctcctcttcacttgtaattggagcatccgattcgattttgttagtaatccgtggtgttcaatccgttcagtttgcccgtagtgcgatggagcgtctctctctccgtcagtgcacttcgtcttcatctgcttgccaccgtcaaacagcgtcgccgaccccccaaccaaatgaccaacaacaacaaaataacaccttcgtctcccgtttgtacaattccatttggagcccacaatggactctcttccgaaaagaaacaactgccaatgagaaggaatgtgatgaaattgggagggtccccgacgacccaacttcgtcaaaagtcgcggaaagtgatgtaaatagcgtcgatagtaacttggaacaaatgaaatgagcttaattttgccctgactaatgttttccatcatatccttcttctatttccctggttcgatgtttcgccttttgtcaaatgaaaaaacaaaactcaccaaggaatgttctaacctaacaattca

SEQ ID NO: 23402 - DNA, 1161 bp, Heterodera glycines
ataaggtaaaagagccctattttttttcagagaatttattaaaaaaaggcaaaattttaaattaaataaggaaagtttgaaaatgtttattaaaaaatttaaggatgaaatataattaaaataaatcaaaaagaaaaaaatcaatttatttttctaaataaataaaaaacattgtcagaggcagttcctgccgaaaaaaagacaaaaaatttttcgaaaaaaaactaaaaaaattgaaaatttaaataaatttaaaagtgaaaaaaggaaaaaagattacaacaccttcgattcccaggacgtctccgttccaagtactaagaaggcccaacgttgcttaacttgccagatcggacgggatggcgtgctttcaacgtggtatggtcgtaagcgaaaggaaagcaattaaagtaatttaaataggcatatttaaaagagcctatttttttgccttttcacaagagaatttattaaaaaaggcaaaattcgccttaaattaataaggtgaaagtttgaaaatgtttattaaaaaatttaaggatgaaatataattaaaataaatcaaaaagaaaaaaaatcaatttatttttctaaataaataaaaaacattgtcagaggcagtgcctgccgaaaaaaagacaaaaaatttttcgaaaaaaagctaaaaaaattgaaaatttaaataaatttacaagtgaaaaaaggaaaaaagcttacaacaccttcgattcccaggacgtctccgttccaagtactaagaaggcccaacgttgcttaacttgccagatcggacgggatggcgtgctttcaacgtggtatggtcgtaagcgaaaggacagcaattaaagtaatttaaatagtcatatttaaaagagcctatttttttgccttttcacaagagaatttattaaaaaaggcaaaattcgccttaaattaataaggtgaaagtttgaaaatgtttattaaaaaatttaaggatgaaatataattaaaataaatcaaaaagaaaaaaaatcaatttatttttctaaataaataaaaaacattgtcagaggcagttcctgccgaaaaaaagacaaaaaatttttcgaaaaaaagctaaaaaattgaaaatttaaataaatttacaagtgaaaaaaggaaaaaaagcttacaacacct

SEQ ID NO: 23403 - DNA, 2258 bp, Heterodera glycines
tggacaatccgtcagtgaaggacaatccttcactaatggacaatccgtcagtgaaggacaatccttcactaatggacaatccgtcattggacaattcgtcagcaaattttttttccaaaacccgaaattcgaacgcaaaaaaaaagccgctaattttcgcaatttgagttttcgacagccccagaaattttttttttacgcttatcaattcccagttccgccacactttttttatattaaaaatcgccgatccctcacaaatattaaaaaaaattccattattcattcattgaaggaattattgttatgtgcagaacacctattgggtgccatttgaagaacacattccgcatcgattggacgagcgacaaaagtgtgaattgattaattaattacttaattgattatttgggggggggggggggtgttcaaaataaatttaattaccaaattcaaggaccatttgatgattaaatttcagacgacaaattggttattatcaatgggtgtcttttgtacttgctatttctgcgctaatgttccatttgccggtgagttaaggtctcgactcgagaaaagtttatcgggttttctggtttcgggaccaagtctcgtcggtctcgagtccaccgattcgagaaaagtcgtctcggatttttttcggtctcgagcatcactctgtttagcgtgctttttgtgtgtaaatgcgaattaactacaaaacaactgcatactaaaaaacaaatactaaatttggccgcttacagtagtcctcttttctactgatactgtaggctctctgctggcgaatgctgtccaaccaatcgggcctgcaagtgtccgttgtgctgggcgtggcatgccaggaagagaatgtggacccggaggtgcgcgaccgtaccatcgacgtgatggcggtaaagcaacaagggagggacatacctaattcgagagtggggttgatcgggaatctgggccaaggatggatttttggaaattggccggtggcctgaaaaattcggtgtcaggggtaagagtcagggacggttcacacgcaaaatttatatgtgaaaaatggtattttgtgctaaaattttcatttttaatattggtaccttctccaagacctccacacccaaatttttcaaaaaaattccgtgaaatttacataaaattagcaatttttagtgaaaattcaattttcgaatactttttcctgtcctcatttcacgtaaatttaattaaaaaatttttttatagcgtcacattgatgacgcactgcgttaccaacgtgatctgattgcccgatcacggggcgtttttctgttcgcactgatcaatgttggccgaatatacggtaaacgaacaaaacagatgcaaaaattagcataatttgccatttaaggagcatacgtcacgtgagccgaatgctttgcaatttttaaattcccaatttttaataaaaacaattttttaatttcagtttgttgtacagcatgtgcaaattgcttcacttggtgaacgcgatggtccagttctatttccttaaccggtaaaacagggtcatttttgaattatgctctgaattaaattacgctttaccactccaaatcttttaccctgaaatttaaatttaaaaattgattcgattagggttaagcccctacccgattttttgtttttttttttgaaatttactccctgacgagggtgttttgctctcatcagatggatttttttaaatttttttctgttgaaccttttattttatgatgatgatgggtcatcatattccatcttaattggcaattcataaatggtggcaaattttctaaaaaatttttttcaccaaatccaatccataaatttaaatgatcatttattctttaaaaggtttcttgaaacgtccgactatccgctgttcggtggtcatgtgatctacgacttgttcagggtcggcaaaagtgtaaaataaaaaaaatggaatggcactaatatttctaattctaacattgatcaattttaattgggacaattttattttttaaactttctctaatcatttttcaattaaaggatcgagaatggcaagattcgggtcgttttcccagggtgagtttgatttggggtgaataatgattgggataaaattgggatcagaagcaatgaaacttaaaagtgccaatgataataataattaaataattttatttgaaaattaatatctaaatcataataaattaattaaaaatgataat

SEQ ID NO: 23404 - DNA, 1538 bp, Heterodera glycines
  misc_feature (1523)..(1523): n is a, c, g, or t
ttttttcaacccaccaacgtccagtcgtccctcactgctcgcgctcatcaaaggtgtcgtgccatcaattgcttgctggttgacttcagctgcccattcctcgaccagcagacggcacacctccaactcaccagattcggcagctagcattagtgggaagacgcttcctgaaacggggggaggggaaacaaacaaattaaatgatcaaaaaattcaaaattaaactcaccggtggcgtccaagtgtccaacggttgcaccgtgggcgagcaagtagcgcgcaaagtccacctgaataaatggaaaaatgttttgtttttcttcaaaaaacggcatttttttcctacccttccagaggacgcagcgaccatcaacatggtgattccttcttggccacccggcatgtcaacgctgaatccgctctcgacgtacattcttgctggaaaaaagatgttggcagagttaaacacaacaaatgccatcaaaatttggacgccatgccattacccataatctgcagaaagtcgacgagctgctcctggttgaatgactcgatcagaatggaaagctcgtgcactgcgtcctcgcttccctggccgatggacatgatgagttggcgaacatgttgctccaaatcaacgacgacatcaccaccatcagcagcaacagcaggaggaggaggaatgtcatcagcctaaattgaaatgggagaaaaatttaaaaaagtgccgaaaaaaagagagaaattgttgaaatttttaccattgccgtgaagggcaattgaaagtggcagcagttggacgacagaacggagggaaaggaaatgtgtaaatcggacgaaatggacgacgagtaatggtgaagtgtttaaaaatgtcattgttcgctccttttatatgtacattttgactcccaaaacgacccgtgtcaaaaaatttttaaattcgtgtataaaagggaaggttttgctcatgaaattgtcacatttttggcattacatttcgagtttttagtgcctattttggcattttttatagcctaaaaatccgatccctagttaatgaattaataaaatactttattaattgagtaaataacataacataattgaaaaaacataaatcaaacaaattctaaggggcattcatcgaatcttccgtaactgcgtcctgcagcacgtagcgtttgtgatccaaaacatatttaattttaagtgtgaaatttgggaattaacgcttgtagactaatttttttttaataaaaaaagattggggacgaaacgacgcagggacgaaatgacagcgcgccatttatacacccatacactccaaagtgatcgtttcgtccccaattttcttcttaaagttgtctctcagacgcagttgagttggttttctaccccttctctgatttgttatcatctctcttattctatagaagtttgaaaatttaaattcacacaaaatcaaagtctatccgacagattttatcgatgaaaagttatgccatattttattgaccganatatacacatacaaa

SEQ ID NO: 23405 - DNA, 385 bp, Heterodera glycines
attattattatttcatttctgttccttttttttggcctttaaattacaatgtgacacaaaattataggttcaccttttgtctattataacattctaaatacgcaaatcggcgttgaacgtgtaattccatgtcagagagcccgaaaatattcaccaaaccataccaattttgtggaaaaaaatgcgagtcctccgccgtggccgcaaatgaaagattggacgacgaatggtttaacattttttcatattccgtcatgacaaaacatgtcaaatttggcccacagccattgcaatattgtcgtccacccgtatcttcagttctatgcaatggtgctctacagaacaaaaaattgaactcgaatacgaaaaatattgttttaaaaaa

SEQ ID NO: 23406 - DNA, 1084 bp, Heterodera glycines
cttctagatggtttttcataccacatttagctattttcgggatttttagcttaaatttaatgaatatgaagatttgtaaaaattttgcccccaatttggaaaaatttacgtgcatatttttcactttttatgtgcatattttgccatttttggtgcatattttacgattttatgtgcatataatttgacaccctactgaagataaatggtagaaaagattactggaaacatttgtcaacaaaaccagcaataaatcgctcaattgggtcacgcacaaatgcgaccattttccaaagctgtaattcattggtcaggtcttttgtcattgaaacattgttcacaatctgaaggggaaacgacagagacagacacaacgccaaaagaacaaattcaaatcaaaatacctcttccattggcaattcagcataatacggtgactcaacatgacaaaacatcttcctaattctcggtctaaaatttaaaaaaaaaataatgccattctctctaagtcacgtttaattattaataaaatatgaacaaacaaattcaaataattgtaatcgaaatttgtgatgttaaatttattcatatttgcaaagtagcaaaacaacgactccaagaaaacatttgaattttttgcaattaaacagccggccaatttaagcgacggaataaactaaaagtgaatataaaatatatttaattaatttaatttaagttataatttaacaatgcataattattttttataacaaaaacacacaacattgcgctggaatttgccatcaaactttctcacacattgctgctggtcatcacttccacaaattctgtcccaatcttcattaaatgtaccaaagtggctttttgttggcaatggcttaattgtaaaatagtttgcaaaattgaatcaaaatgactgccaaaggaatatgaaaactcattaaactttgtttttaattgattggaactcaataaatattattatcgactaattgaatttattaaagtttctttttaattgattgaatactcattaatctttgtttttatttgattggaactcattaaacattattatcga

SEQ ID NO: 23407 - DNA, 2130 bp, Heterodera glycines
  misc_feature (1794)..(1796): n is a, c, g, or t
  misc_feature (1798)..(1801): n is a, c, g, or t
  misc_feature (1803)..(1803): n is a, c, g, or t
  misc_feature (1805)..(1813): n is a, c, g, or t
  misc_feature (1817)..(1817): n is a, c, g, or t
  misc_feature (1855)..(1873): n is a, c, g, or t
  misc_feature (1896)..(1896): n is a, c, g, or t
  misc_feature (1898)..(1900): n is a, c, g, or t
  misc_feature (1902)..(1902): n is a, c, g, or t
  misc_feature (1949)..(1949): n is a, c, g, or t
  misc_feature (2006)..(2006): n is a, c, g, or t
tatattccttgatatattgttaaacttttaaacaatgtatgtaatccattgaaaacattgtcgttaattaaatcaaagttagaaataaattagtgattgattgtatgaaataaatggtattttttaaaattaattacttataaaactgcatttaaaaacaaaaaattttattagatttttagaaacaacggttatattttttcgttattgcgttttgtataaaatttttctttgttcaactttttgtattctttattaatgttgttttttgcttaattattcatttttattaaaatttgtcaaaatgcatgtagatttttttggactaactttcctcgctttattaaaaattttgttttcatttattataattattattttttatttattatttacatgaatatttattttttcactcctagcgttaaatccattttaattggttttttgcactaaggaatatttgtagattgtttttcattaattccttttacaattttgatttatctttacggaaactatacaaaataataatttaataggataattattagtttaaaattttttttaactcaaaaaatataataaaaatattttattcatttttattttggaattctttataaaattgcataattaaaaatgtatatttttgtattcaattttgataaaccttatttataggtttttccacttttattttaaattcatttataacaaattcctattttcatgtttttagttagataatttagcttgaagtcattaatttaaaatatgtatttcgaagttattattcatattaaaaaatatatatatataataattatcaaagattttaattttatgatttttattttctctaagaattgccccatataagaaatttccaaatatcccaaagaataattaaatgtaaagataacaagcagctttaatgccatctaacggaaatatttataactttgaaaaaaattaaaggggatccgcgattcttttaaacaatcctttattcctttaatttcaatttttaaaaacattaaaattctcccaatgcgcttatttgaatccaaaaaaaatttaattttaaaaaaaaaccccttggaaagggttaaaaattctcttttggttccaaaaaaaaccccaaaaaatttaaaatttacttttaaaaattccccaaaatttttttcccccattaaaaaaatttttttttaaaaacggggggactttattttttttttttatttttttttaaaaaaaatttgtgaaaaaatttttttttaaaaaaaaaggggggcgccaaaaaaaaaaaaatttttcattttttgcccctttctctaaaaaaaaaaaaaaaaaatttcttcccccgcggggggctcctctaaaaccaaaaaattgggttttttttataaaaaaaaccccccccacaaataataaaaaaaaaaaaaaggggggtgttttttttttttccccccacaaaaacttttcctctttttttttttggaaaaaaaaaaaaaaaaaattttttttttttttttttttttttttttttttttttttttttttatttttaataaaaaaaaaaacaacttttttttttttttttttttaaaaattataacacaaaaaaaaaaaaaaagagccccccgggcggtggatattataaaaaaaagcaaagaacaaaaatatttttttttttttttttttttttttaaaaaaaaaaaaaaaaaaaaaaaaaaaaaaaaaagaaaagggggggggggggggggggggggggggggggggggggggggnnncnnnncncnnnnnnnnntttnttttttttttttttttttttttttttttttttttgttnnnnnnnnnnnnnnnnnnngggtctgcttggggcggtaaagngnnngngggggtttattttttttttttttttcctttctcctcccccccccacnacccccctccccttttttttttttttttttttttttttttcccccccgtttgtttanttttttttttaaaaaaaaaaaaaaaaaaaaaaaaaaaaaaaaaaaaaccccccccccccccccctctcttttttttttttttttttttttttttttttcccccccccccccccccacccccccc

SEQ ID NO: 23408 - DNA, 2029 bp, Heterodera glycines
aaattaagaaaatgaaaaatctaaaaaatttatatatttttcggaaattatctcaattatgcctgaaaatgaaaaagtacttaattttaaaccgagatgaacccttcgcaaaagtattccgtatttaacttcaattgctcatttccaaatgcttttccgtcgtttcgttcagtgagtttctacgacctcggcgtcgtcctgcagtccctcatgctcactgctgttgtggtcgtctccctgttcatctacacgcttcagtccaaaagagacttccacaaatattacgccactcttttctccgtctctctcctttttttggccgccactatggtccaggtacggtacaatcgacacagcacacggtgcctttttggttacggtaataccgtagtgtgttcagatgttggtgatgtcttctgcgctcaattttgtgatgagtttggctggcgctgttctcttctccgtttatttggtgttcgacatcgatgacataatggtaaatacaaaaagcgaaatttcccctttttaaatttaaaatattatttttccatccaaattcttcatgctttagtattccgattcgacatttcgtcccttaaatccttcccattttctgttcagaatcattacaatgaggaggactacatcatcgcatgtctctcaatttacttggacatcatcaacttgttcttgcgcattttgcagattctgaacgaaatcaaccgcaattgaaaaaaaaagaaattctttccacgacaggcccatattctattcggaaaatggttggggaaggctcccccggttttggtcggttttcatatattcccccggtttcgaggcctggtacacctgtaaaaaacatttatttgcaaattgcaaaacaaaaaattattgtgagattctttgggatggactcatccttctgtgtatttgtgttactgtatgtctacctattttatgtatgcacagtgattaacttatacaatcgcatcgaatggcaattgtttgtgcttttaattcggggagaaaatgttttcgtaatttgccagttcaattaaagtcgtctttcgagtgaattgactgacttatttatatatttataatttgatggattagcggcttcaatttaaatatttttaaattaaaatattgtcaatacatttaattgtttttctcgtgtaaaaatatgtaacttttatcggtctttttgatctcgtcattccttccaaatgtttacaataaatttttgtttaccctttctttcctttttactcttttgccttttttccgtcccaatttccccccccccccccccaaacgcgtttttatgttgtgaacgcaaaacaaaaaaagaagtacaaaatgttattgtattgtgaaagaacggcttttagtgccaaaattttatttcacctctgaacttttgggcacagatttaaaagaatttttaaaaatatattttagtatatgtatcaattagtaattgaataattagctgttatttagggttatttgtcgggaatttcttattctttctacaaaatatttccatttcaaatgttgccaccgaaggaaatttgggaaaacgatgcctacgatcggtggaatgattttaatgtgaattttaatctgtcgaaatgcctttgccccccccccccttgtttgtttacttcgcctcacatgtcaaattcccgtaaacattctcggccctcccaaattcattcatcccttttcttggcttttatttataccccccccccccaaaagtatcatcttccaaccaccaaagaattttaatgcttttcccttttgatttgctttatgtaaaagcattaattaattaaaatggcctattggaacttccaggggttggaggtcgaattaaaatatgtaagtgtttaataaacttaaccattgctcaggtggctctgatcattgtgatttgtgtcattggctttgcactgatcgcttgcaccacagctgccatttggtttacagtggcggtaaaagggctttttgttgcctttga

SEQ ID NO: 23409 - DNA, 1467 bp, Heterodera glycines
ccattttataaacaaaaaaagtcgttgcatggtttaaaattacaaaaactagccattttatggtgacaatctgttaacaaattgcattcaaattctcaacatctatccccgacggccacagtcggcatcttcccccccccccccccccccccccctctgtcccacaaaatttttggaaaaagcgcgccacaaaaaagcgtttttaaagcagaaaaaagtcgtcgtaaatgaagaaaatgataagtgaaaacaaaaaaatgttggaaaaaaacaattccggtgaaaaatacaagccatttgaataaatattaaccattttgcattgcatataataaaaattttaaatgtccttgaatttcatgaattttccccactatgtccttgcaaatcggcatacccgtccttggaaacggagcatggacgatggcaaccctgaccttatctaatttcatgttaaaattttagcacacattttggccaacaactgctttccgacagtgaagttcgtcaagtgttgggtttcatggtcatttccggtaaaaattactccggaaaatgcaactctaccgccaagcttatgtataaatggcatgacaaagaatacctcggggcggcgcacggcgtcagcggaatttaccaaatgatgttgaggtgggcggcgaatcgagtcggtgggattaaactgacattgctttgtcaattggatgctttagcttctggaacttgcttgatgcctctgcgaagtcggacttaacgcaaagcgtcgattggttgatgagcacacaatttccgagcggaaactttccgtcctcatcccatcgaattggtaaaacattgacaaatcatatattaaaatgagtggtgcccttcgaatgcctttgtttttttaaccccacttcctttgcattcccctcaattcatttcccgacttttgttaggtgtgaaggatgaacttgtccattggtgccacggtgctcccggcgtcttgcaaatgctaattgtcgcttatttggtccttgaaaacgacaaatatttgaaggttctccgtcagcatattcaatcaattttccatttgctccaatttcagtcggcggagaaatgtaccaaacttatctgggccagaggaattctgcacaaagggccgggcatttgtcatggagttgccggtgagttctgtgattccatttacattgttctatttcaatttgtatttttcttacaatttcatcagattacctagtttccttttgaaggccatggctatgcatttcttctgctctatcgcctcactcaaaatgaaaaatatttgtcaatggccaaagcattcgctttcattttgatggccccatcttttgaagtcagccctttaggatgtcaaagatataaataacaaattatatattaataattgagaaagattttggttagaaatctgcccgaactcctgaccactcatggagtcttttt

SEQ ID NO: 23410 - DNA, 1246 bp, Heterodera glycines
aattattaataagggtcaaaaagcaattaacaggtggtaaatcgcaattgtttctttctgcactacaaccccgaatggtccaagggcaaaaaagaggacgataatccttggcgagattcgcctctcagaatcaacgaagcttttctgttactacttgcttcgtttaattatgcaggtttcgccattaggctattcgctcgcgatacaattagccctatagaatcttggagcaaaaactagtaatattttatcctttagaaagcatgcaaaatagtttgttatagacttgtgcaacaactatgaaataattcgctgaaattagtgtcctttcgacaatatgaaattaatttcgtttattttagaaccttaggttctgatgaattaggtaaaattaagttctaatttattattaaaattatgaataagggtcaaaaagcaattaacaggtggtaaatcgcaattgtttctttctgcagtacaaccccgaatggtccaagggcaaaaaagaggacgataatccttggcgaaattcgcctctcagaatcaacgaagcttttctgttactacttgcttcgtttagttatgcaggtttcgccattaggctattcgctcgcgatacaattagccctatagaatcttggagcaaaaactagtaatattttatcctttagaaagcatgcaaaatagtttgttatagacttgtgcaacaactatgaaataattcgctgaaattagtgtcctttcgacaatatgaaattaatttcgtttattttagaaccttaggttctgatgaattaggtaaaattaagttctaatttattattaaaattatgaataagggtcaaaaagcaattaacaggtggtaaatcgcaattgtttctttctgcactacaaccccgaatggtccaagggcaaaaaagaggacgataatccttggcgaaattcgcctctcagaatcaacgaagcttttctgttactacttgcttcgtttaattatgcaggtttcgccattaggctattcgctcgcgatacaattagccctatataatcttggagcaaaaactagtaatattttatcctttagaaagcatgcaaaatagtttgttatagacttgtgcaacacactatgaaataattcgctgatattagtgtcctttcgacaatatcgaattaatttcgtttatttttagacccttaggttctgatgaattaggtagaattaagttgctatttattattaaaatat

SEQ ID NO: 23411 - DNA, 1090 bp, Heterodera glycines
tcaacactctagacaattccaaccccaattacggaatgatagcgccaaccctaaatttttccggaatttctttttgggcgagtttgattatgaaaattttggaaaaacgcctatctcttcttctggaagttgatgtacgcctatctctttttctgctcaacactctagacaattccaaccccatttacggaatgatagcgccaaccctaatttttccacggaatttctttctgggcgagtttgattgtgaaaattttggaaaaacgcctatctctttttctgctcaacactctagacaattccaaccccatttacggaatgatagcgccaaccctaatttttccggaatttctttctgggcgagtttgattgtgaaaattttggaaaaacgcctatctctttttctgctcaacactctagacaattccaaccccatttacggaataatagcgccaaccctaatttttccggaatttctttctgggcgagtttgattgtgaaaattttggaaaaacgcctatctctttttctgctcaacactctagacaattccaaccccatttacggaataatagcgccaaccctaatttttccggaatttctttctgggcgagtttgattgtgaaaattttggaaaaacgcctatctctttttctgctcaacactctagacaattccaaccccatttacggaatgatagcgccaaccctaatttttccggaatttctttctgggcgagtttgattttgaaaattttggaaaaacgcctatctttttttctgctcaacactctagacaattccaaccccatttacggaatgatagcgccaaccctaatttttccggaatttctttctgggcgagtttgattgtgaaaattttggaaaaacgcctatctctttttctgctcaacactctagacaattccaaccccatttacggaatgatagcgccaaccctaatttttccggaatttctttctgggcgagtttgattttgaaaattttggaaaaacgcctatctctttttctgctcaacactccagacaattccaaccccatttacggaataatagcgccaaccctaattt

SEQ ID NO: 23412 - DNA, 983 bp, Heterodera glycines
gggttggcgctatcattccgtaaatggggttggaattgtctagagtgtgagcagaaaaagagatagcgtttttccaaaattttcacaatcaaactcgccccagaaagaaattccggaaaaattagggttggcgctatcattccgtaaatggggttggaattgtctagagtgttgagcagaaaaagagataggcgtttttccaaaattttcacaatcaaactcgcccagaaagaaattccgttccggaaaaattagggttggcgctatcattccgtaaatggggttggaattgtctagagtgttgagcagaaaaagagataggcgtttttccaaaattttcacaatcaaactcgcccagaaagaaattccggaaaaattagggttggcgctatcattccgtaaatggggttggaattgtctagagtgttgagcagaaaaagagataggcgtttttccaaaattttcacaatcaaactcgcccagaaagaaattccggaaaaattagggttggcgctattattccgtaaatggggttggaattgtctagagtgttgagcagaaaaagagataggcgtttttccaaaattttcacaatcaaactcgcccagaaagaaattccggaaaaattagggttggcgctattattccgtaaatggggttggaattgtctagagtgttgagcagaaaaagagataggcgtttttccaaaattttcacaatcaaactcgcccagaaagaaattccggaaaaattagggttggcgctattattccgtaaatggggttggaattgtctagagtgttgagcagaaaaagagataggcgtttttccaaaattttcacaatcaaactcgcccagaaagaaattccgttccggaaaaattagggttggcgctattattccgtaaatggggttggaattgtctagagtgttgagcgaggaagagagataggcgtttttcctaaaattttcacaatcaaact

SEQ ID NO: 23413 - DNA, 1856 bp, Heterodera glycines
tttcttcttcgtctaacacttctttcgcctgcttttttcattttttgaattccttttttgtcattttttcagcctccatttattattcattgttctaatacaacaaaaaaaattctatgaatttttggttttaataattttttagaatttgaaatattttttaaattttcaaaaaagcattcattgcgtcttcttcattctttgtttgttcaaatattttactcatcgcagaatatttattgtattattgaagcgcagccaatcgagaagcaaaatctccatttcttttatcttgaaagcataactgggcatcaaatttcatggacaaataattgccgaaaatttttaaaaattatgattgcatttattcattaaaagttaaaaaaaaatcagcctcaataatgggaaagttatttttttcattatttattatttatttgtttttgttcaattaatcgccttaacctcctacacaaaagcagcaattccgtccataattcccgcctaaaaaagcgatatatttttaattttgaagaaatattaattaattaaaataaagcatattaattttttatttacaatatttgaacaaatttaaaagtgacaaaaacgttaaaattaatgttaaaattagttagattatataatttaggaaatatttttaaatttcttagcaataaaaatgttacgtttttcttatttttgggcaattattttttagaaagttaaaattgttaaaagcgtgttatgatttaattaatataaaaataaaaataaaataaaatatcatttaaaaattgaaaatatttcaaaaactataattttttttattcaatttttcaaattgattattttttatattattaaaatcttaaaataaaacgccgcgaatcgcgcgggtcgcgtcgcggtcgcgtcccaccccctgctatataggcaaaaattttcaattgttttgaaaatctattaaaaatatcgttttttacaagaaaacatttaatggttttttattaattaattttaataattaaaaatcaataaaaacattttgaaaggaattttctaaccttgagaagaaatttttattgccttttggatttgagcgattgtcatcatgtttttgtgcacatcaaaaggccatcgtcgtcgtcgccctccttttttcatttctttttggctgcgcatttcgtcgccaattatttcttacatttttattttttattttttttgattgggtccccaaaattcattcattcccatcaatttgttaattttaatgattatgttgttccatcaccaaaatttgttaatttgattatttaaattcgaaaaattgaaactttttctttttgtgatctccatttttaaatttttttttttgtttacttatttattttcacaatattttttatttgaatttaaataaatttacattcgcgaatttttaaaatttttttccagcggcttctctcggcaccgcttacaatgagtctcaaattttcaatttttttaaaattttaaccgaaattgatgccaaattgttattccgtgccaaaatctgtcacataaatcctatatattttcatttactatgatagcaaaaatttcattattcaaatatgggaatttgtttatccaattttaaacgctccaaaaaccgaaatggctgtacaggacgaaaaccacacgatatgatggtattagaaaaaataaaatattttattaaagaaaaaattactcgtttttattttaggaataaaacagtagtatcataaattgggtcacattaatttaattttgtccttatttgatcaccagaatttttaggattaaaaatccttcattttaaagattgt

SEQ ID NO: 23414 - DNA, 1282 bp, Heterodera glycines
gggtgctgaccaaaaagtgggatagcgatgaggggtgctgagcaaaaaagtgggatagcgatgatgaatgctgagcaaaaagtgggatagcgacgatgaatgttgactgttgggtagcgaagatgagtgcttgcaaaagaggggttcgaaagttcaaattttcgaatttagcttttttgtttcaaaaatgggtaagtgatctcttatttaaggattgaagttcgggtcagggaacgattttcctatagaatacttttttactacgatatttaatgccacagaactttattttaaatatttgtttcactgacgcatgcattttccgtttcatagaaaaatcataatatataaaaatgggacatgaaattgggcgagattaaattcaactttttgcctgaaagataaagtttgatgattttccaatcctgaattcttctcatcaattatgtaatattttttgccgaaaaagtaatttaacttaaatccataagtacggtggggtgtccgagcagctccccatctaccaaattagggtttatcataatgatgcaacagaaatatgattttttcggtaatgttcagcaaggaaataaataatataaaacagtgattggacacctcaggcataaaaggagtaccgcgactatccattttgcccgagcaatctctgtcctgtatgtacttttcaattgtacagcatttccaaatcatttccattccattcctagtttgttgtgagctataaaaacattttcaaagccaaaaaacccaaaaaatcataaatagaccaatcgagagctaacggacaacctaataagaaaaaaccccggagggagagaatttaattaaatccaaacctccgggggtccgtgccgggtaccgcggggtaagcagtgctggctttggcttcatcacggcacccgacctttaggccaagttaagctcagcgttgcctaacttgccagatcggacgctagcgcatgattccactgtaccaagcaccccaccggaagttagtcaaaacaaaaaatatataaacccaaaatttcgagtccgctcggaggcatgacaatttaagaagaataaaaagagacaattcatataagtttttaactacttattatgaatattttagaacaaattaaacaaatttaacctgaagaaaccatacatttttgctatcattttaaagcacttaatgaaaagaaccagcatatactaaataacagcttttacgcatttgaaaaaataatttgaattggactcaaaaaaatttgattgg

SEQ ID NO: 23415 - DNA, 1318 bp, Heterodera glycines
ttgttctgtggaagaatttcaattaataatttaacaatttttaaaatttcaaaaagttaaattaattaaatatttaatgcatttatttcaattctatattgtattagcattttttaaaatttttttgcttttctgtcattttgaatatattttaatatttttgtgattttttgaatgattttaaattttgcatttttgctaaatttttgctgttcggaatagcataaaatatgtgcaatttatatgaaatcggaatgcttcttaatgctttgcaattatttaaatttttatttaaaattaaattcaatgaatgctaaattttactttccatatattaaaatattttaatgaattttggtttatttgcattttccaaaatattcttaaatatccaatttaatccataatttagtgagtcccattgattttgcatttatttataatttttgcgcaaatttcgctaagtctttgttaatgtacataataaaaactatttatttaatggtgctttattcattcattaattatacaaatatatgtatttttattattcttattaatcctttccttaatattctctatatgatattgttattttaaaataaaataattgttaattgcctttaattttgcatttatttatgtttttgtcattttgaattattatttttttaactttttctcgtgttaattgttgaatttatttttgattttataataatttaatcagcgcatctttttattagtattattatttttttgtaaaatttgatttatatttttttccttttcttggatttatgtgggctaataaacaccaaagatgtcataaatatggaataaaaagcccgaaaatggccaaatatggaccaaaatatggagaaaaactgccaaatttaagtttttaacccacaaaaatcttaataaatggttatatatcaatatttgcttaaacaaacttaaaaaatacactaaaaactaccaaaaaatggatttaacctaaaaatgcaaaataaaatttatttcagaagcgaacaaattgcaaaaagtcgactattttaaaagtcaggaaaaagggccaattattgattataaagccaaaaatgaccaaaactaaaagcattcgtattattattttttttaaaaaccagaacgttgatccttagagcgtatatttttcgatttaaacaatatacctagctctgtgaactttatgaaacggttttaaaagcctttttctaagagtaaagtcatttcggacttttcaaagaccgaatttctttagctttttttaacttacttgaaattttaacttctc

SEQ ID NO: 23416 - DNA, 990 bp, Heterodera glycines
  misc_feature (33)..(33): n is a, c, g, or t
  misc_feature (60)..(60): n is a, c, g, or t
  misc_feature (70)..(70): n is a, c, g, or t
  misc_feature (95)..(95): n is a, c, g, or t
  misc_feature (186)..(186): n is a, c, g, or t
  misc_feature (227)..(227): n is a, c, g, or t
ttggatgaatgaaggataatgtttactcgttgnttaatttattattttttctatctttantattagtttnaaattctatataatttatttaatgnaatatcctttttgtatgttatttatgaagcatattttatggcttttcagtaattctgttaattatggaatgattttattatttctaaaatntaatttatttttatttttcaagtttagttattactgtcctntagttaatcaattctcattagccttgttaattttttgtttgagttacgcggaataggacgacgattttacttaaactgtgtgagcttaagaaacttttcgtaatttctgttgaatttatttatgtttaagataatttttatgtttattttatactaatattttggtaaatattatttgtaacattagaaaataataattgttgcacttttgacgatccttaagaaaggagagtcaataaataatcgaaatttaattgttgagttcaaaataggattctgctggagggttttccgtggcgtgttcaccaatttgaatcttttttgaataaaaaagcaaaaaaatggtcaaaattaggcaatgtttaaatgggagaagccaagttgaatttggaaaggaccaaaagagtgccaaaaaagaaggccaaaaagacggggatgggaaaatatgaataaaatagtccatagccaaaacaataaaacactttaatagcttactttaggtgaaaaagataaaaataaaaataatttgcggcaggcaaagcatttaaaccggttttgaaaaccgattgaaactcctttggtaccgaagtattcattttctccatttttattttaaaccagttcaaaaaccggtttcaacactttggcgtgagctttattggcttactgcattgtattcgaaccaaatataaaacctataaaattgattttgagttgggccattacgaagggatcaattttccatttggttcaccccaagtct

SEQ ID NO: 23417 - DNA, 2903 bp, Heterodera glycines
cgaaaaaattttaatatttttttcgcctttttaggaaaatttcctccctgacgaaggggttgctccccgctttttttttaaattttctatttatctccgacaaactttgtcgggaattttgttcccgatccccgggactattcattttcttacacagatagagcctacggtttgggcatttcaaatttgtttaccttgcgctattataccgatgaaatggagaactttggcgactcgtctttggcgttgattgtagtgaagaatttcttctatcgtaattaatttaatttttatttttattttaaattaaattaaattttatttatttcttctatcgtaacttaatattttttatttttaaaattttttattaaattttaaaattccatacttaatcgggtttgttgctgcagcaacgggccgattttgtgtgcttccagtgcttgaatttcttcttattgctccagtgagtgaccatgaattatcgttgattttttcaactcggctgcactcgaatgtgttaattactaatgaaaaaaggccgaaaattggaagaacttttagcatttttttataaatctatgataaaaatataatataaaaaagtaaatttatttaattttatttctatacaataaaatatgacttataatattaaatttagataaaatatagcccaaaaatatatttatggaaaaatatttgcccaccctcaaataatcaatttagaaaagacatatttaatcatgtgcaataaaataaaaaaagattttttagaaagtgcttataatatacgtcatgatataatgtattattttatgttttttaaaattttatacaaaaatcgttggggaaaatatgaaattgtatttgaagtattttaagatatttagttttcggcatcaaacaatggcacttcatgcgctgaacgaagcgatgataaagttcgatttgcaattgtgctggcgaaaaagataaagaatgagatttttatgaataaataaatttgatttttccaattttaagcaaatattttattagttattacatgtttcagtttagcacataaaaatcccagctgaattttgataacaaaatgcaataaaaacgaaaaatatacctctataaaattgcataaatttaatataggaaactttgatataataaaatttcttattaaaaacggtagcatcttcgcggtataccaaattttagaaataaatttaaataattaaatttttatttttattgagcaaattaggatataattttttatttgccaattgatattttcttaaatttagatattttaattatttgaaaaactttttcaatacaaaaagggttaaagtttctttaatgttataacggaaatataattttttttaattgcaattttgttagtcattcatttgttttataaaggttaaaattgcctttcataaatgaggtgtccacaaaaattcaaaaatgtcctactaatattttgatgaataagcattatgaaaatggttgctgcttaatgtgacaatctttgctcgacttattacatttgtaatttgttaaattcattcattccgtccatttgcggtgtcgttgttaattcactgtgattagacaaattgaaattgctaaaattaaattaaattatttaatttaaatacatttttaaaggatttaaaaatggattggaaatttaattttcaacttttattacgggctttgttttttctaagtttcacagtcgttttcggattagaagacactttttctgtaaaatcagacagtgcagaaggggaaaattataaaaaaaaatgcaattaattaattttaattttaattttaatttagtgccggtgttgccgttgtcgaattctcaaggtaatttaaatatttataaataataatttaaattatttgattgcaaaataataaaataattaatttgattaaatttttatttatttattctttaacagatttgaaatatataaaattctgaatttaaagggttttatgacaaaaaatacaactacaacaagacctataactacaacaaaaagccagcctacagtgtcaaaaaaccggcctacagtaacagctacaggaaactaagcaacaatgatggcaacgcaggaaaaaagcccagctatggcggcgacacggtgaagaactatgactacagtaaacaagcagcggggaatggacagtacaaaagcggtgctggccagcaacagtacggtgatcaatcagcggcggcatacggtggctacaacaatgactatgacaaagacaaatcgagacctgcatataattatggagacgcaaataaaaatggtgacattttagactgttttttatttaaacttattttaaaaaacaaggatatgatggccacaatgaaggaggatatgactacaaaaagccaatctaccattatgatgacaacaatgacaaccacaaaaatggtaaaatgagttaaatattaaatttttgttttcaaattatgaaatttaagaggataaaaacaggaatgcttataaatactgtaataagccaaaaatattgcataataaaaataattataataaatatttaaatgaatattttttatattccatagagaaggaaagttctggcagcagcagcagcagaaaaagcagcagcagcaaaagcagcagcagcaaaagcagcagcagcaaaagcagcagttcggaggagtacggtaatgaaaagcacggagaagacccttacaatccggaaggaccaatgccaccatacatttatccaccttacaaagtaaaaaaaaaaaatgcaaattcatactgtattggaatgagttggctattttaggtgccgccagaatgtccaccgtattactatccgacaccagcaccacacaa

SEQ ID NO: 23418 - DNA, 1048 bp, Heterodera glycines
catattttctggatgatttagcaaatattgccaatgtctgtgcctgtttcttataactcgaaaactaactcgaaaacattgacagagagagattcccaacatttgccaaaaacattgccaaaacaggcgcataccaaaaacaggcggaatgttttgggctaatgtttgggcatctctatcccggtttttagcgttttagccgatgttcggcaatgtttgtgtctgtttctggtagtttatttgtcaatgtttgggaatgttctgtccatgtttttgtttcatattttctggatgatttagcaaatattgccaatgtttgcgcctgtttcttataactcgaaaacattgacagagagagattcccaacatttgccaaaaacattgccaggcgcataccaaaaacaggcggaatgttttgggctaatgtttgggcatctctatcccggtttttagcgttttagccgatgttcggcaatgtttgtgtctgtttctggtagtgtatttgtcaatgtttgggaatgttctgtccatgtttttgtttcatattttctggatgatttagcaaatattgccaatgtttgcgcctgtttcttataactcgaaaacattgacagagagagattcccaacatttgccaaaaacattgccaaaacaggcgcataccaaaaacaggcggaatgttttgggctaatgtttgggcatctctatcccggtttttagcgttttagccgatgttcggcaatgtttgtgtctgtttctggtagtgtatttgtcaatgtttcggaatgttctgcccatgtttttgtttcatattttctggatgatttagcaaatattgacattgccaaaacaggcgcataccaaaaacaggcggaatgttttgggctaatgtttgggcatctctatcccggtttttagcgttttagccgatgttcggcaatgtttgtgtctgtttctggtagtgtatttgtcaatgtttgggaatgttctgtccatgtttttgtttcatattttctggatgatttagcaaatattgacattgccaaaa

SEQ ID NO: 23419 - DNA, 1262 bp, Heterodera glycines
  misc_feature (1134)..(1134): n is a, c, g, or t
tcagaattgaatcaatgtaggacaaaaatagcttgccagtctaaaccgacccccaccgaccaatttaaccttcaatgaattaattaaattatgaaaaaaatgaattcctggagtttgtcaaaaaattgttggggcccacaacaattagcattttatgcgatggaatatatatgcaaatgcagaagaaaattccgataattttttggattcaaaaaacatttacattttccccctaaattaaggcgtagtgagtgggtatttagttaaaaaatgaaaaaaaatgaaaaattggcgttaattatgcaaatgaaattaattgaaattcacaaaagaaggcaatgcactttcatactgatgacgcaaaaagaccaaataaacaaattcattaaaataatgaaaaaggggagaagaaaatttttatggattaaaaactaattgaagacaaaattttcgctaaaccataattgaattttttaattcaaagagtgatttttaattttgccggcattcgaatggcaaattgtgggctttttgtgaccacggattttcattatgttttggtttgggaattagttttttgtcatttaattttgttcataatatgatattgtagtgtgtggttagtagccaaaaaccaaatttaagtgatttaaaaaattaaaataaaggcataatttgccaaatttggtaaataaatatgcatattacaacgtataaatacttatgtaagtaaaaggtcgtctcccgccaacagaaaaaaaggaaaatgccacacgcaaaagcccaaaaaagtaggaaaatgccaaaaacaagtgcattaagcagaagagaaagatgagctgcctgctgaacacacaaaacaaaaaatgagagaggaaagggcaaaaatttaaataaaaatttaaatttgtaaaataaagcgggggagggggacgggggaagactgacatttaattaaaaattttgaaatttgaaatagcaaaaatataaaaaagagggggggggggggagagtcattcattcgttcgttcgttcattcgcttcgtacaaatattgtaaaaaaatataaaatagttgaataaataaaggcatttgcgaaatgaaagattattatcgtggtgagggatgggtggnggggggggggatgtagaatgaatgaatacattttatattatttgttcaaaatactatttttatttttatgtattaaaagtgagaaatgaaaaaagggaatgtgcccatggggagtcagggaaatgtgt

SEQ ID NO: 23420 - DNA, 915 bp, Heterodera glycines
  misc_feature (7)..(8): n is a, c, g, or t
  misc_feature (40)..(40): n is a, c, g, or t
tccgccnncctccgccacttcccttccaccacatttttcncaaaatttgtgggactaccaaacaaatttatgcacattcatacatatgttaagtgctcaaaaagcatgcccatgattcagttcgtattttattcatcatccgaagaaaacgcgcatcgcaaggattacggtaggaggtggtacggtattgattagctgtgattgagttagaaaaatttggcaaagtcggattggttggcttttgcctagtaacaattttgctgccgacagggattcgcattcttcgtcggcactgttcggaattgcctctgctaatggctttgacaacaaattgtcggggtcgagattcccgaacaaacaacacccattattccgatagctttaaggtcgattgacacggaaatttcccgatgccagtgaccaaaaagccgagaaccgagactctcgagtaagcatcatttatgtgtagtgtaatgtccgactgataccgattaaattgattatatttttagtgaataaagcagaaatattacgcgcaatttatcacaattaaataaattacgtaattaaaatgaatttcgagggacgggaaagaaaatcagcgaattgccgccaatttattattatttttgaatgtattataattatcaaaataaaattgtcattaaaaaggcgatcaaactcacatgattaaaaggaacaaatgaacatttatttgaaagaggaaaaataattccgaaagaaataaaataaaaaagaatttcgacatttaaatttcgtttagcaattcattcatttggcctcattttttgacattttctttttttatacatattaaaaatgtgaaaatttaaaagagacaattaaacggaaaaagcagcagaggagaatgacatttatgaaagaaaatcgacg

SEQ ID NO: 23421 - DNA, 2126 bp, Heterodera glycines
tttaagaatcacattccttctgccgagaatgccttaagagctacacaaaagcggcactcgacacgaaaccattcgcacgcggttggctgggactgaaatgcatggcggataaatgtgaaaatccaattccatggcgtaatataatgaattattttattattaaattcaactgaataatttaagaagaattaaaaaaagatgcatcatcggatgagcttgagacaattaaaacgctggaaaattaatgcgctgaactgagtgtgtcagcagcgggtctttgcatggaacggtcggtcatttacaagcaaacaaaatcattcaattcatgcattcattcatttaattaatcatttaataattaattaattagcaactaattaagatgccctaaatgcaattgtgctgttgagatggatggtccaattgctgccactgaaaattaccccaataatgaacaaaccgttattgagccaaatgataaattgaaatttcattgccccgagtgcaattacgaaatgtgtcgcaaatgcaatgcaaaatgggtggaagagcacaacaatttgacatgcgaacagttcgccaaacaacaaaatgagcaaattcaacgaaatctcaagtaatgtaaaaaataaataaatatagcatttttaggttccggttgtgccgataggcgccgccgggaaaatttttggtatttttaatgaattttattacaacgtatcgccctttttagacttttctcggagacctctaaattcaggacaatctgaaaattcatgacattttttgatttttcagataggtaccctcaaattcaggacaaatctgaaaaatcagtagacttgatagccctgcagaagaagcaaaaaaattcaacgactaattttaacgaaaaaaaaatcaaaatgttaccccgccaaaatttattttatttagtcccgtcatttgagtcctaatggtagaggaaatttcagtaccgtcgcgaagatagatgacttatttttcggaattttcttcactaaactcaaattttggctcaaaaaatgacgaaaaaagtcataaaaacgcaaaaaagccataaaaatgccaaaagatattttaaaaaattttaaaaaaggtcacaaaaaaatgcattttagaagcttcaaacaaagtatagaacacataagtcatttgacttaaattcccatccctaaatatgaatgtagaataaatctcaggtagtaaaaaaaataataaatttaaaaaaacattattctacaataataattttttaaaaataaaaaagggcaatctttaatttactatgtttttaaattagatggttgaacttttagacaataaaaatatatttttatgttttacaatccttaatttgatgcccaaatttctggtgcccaaacttcccccccccccgcgtccatgacatgagtccctttcgcactgagccatttcagtcccagttctgtaactgtgtacataggggaattgttgctgccaaagaatttttcggattcttactttacagatagaaaggagaagtttgtatataaaaattgttcgattttgattcaaagatttcaaattaatattttcccagttaaattttgaatttattattaaaacgaacaaattggaattattaaaactgttaattaatgtgaaaggaaaattcaacaaattaatttttgaataaatttaaaactgtgtgccataattccattggaatatttctgttgcttccatcacattctgtccttgactctgatcgtcaatgtggttgtactgtgatcacactgacctggtttgaattagtttggcaaagtaatttgttaatccatggcaaatgcttgttgaattgtgcgcgatattcagtgctattcaaaaatgtaaatttaaattgaattttcaaaaaatgttacctgattttgtaaagcaccggtgcgttgatactgtatacgatgacagtaagaaatgaaaagccaatagagtacggtgttctgacgaacacatttactaccataaacagctgaaaaaagaagttgatcagtgattttagtgccactccaatcatatttagcacgataaaaggcaataatgctttgacaagcttgcgattgttttcc

SEQ ID NO: 23422 - DNA, 1358 bp, Heterodera glycines
  misc_feature (1292)..(1292): n is a, c, g, or t
  misc_feature (1310)..(1310): n is a, c, g, or t
cgaagcggccgattatccccataaaatttaaaaacgggcgcgaagcgcccgtcctgaggccgcgaagcggctgaattagaccttagaatataaaagggcgcggagcaccctttgaggccgcgaagcggccgaattaaaccttaaatataaaaaagacgcggatatggaagccgcgcatgcactagcaacgaagtcctttgcgcgaagcgctcatgtcagcacccgcccatatataccaaaagtatactgtctacaccgagcaattactgtgcaaagcatactgtctacaccgagcaatcactgtgcaaagcatactgtctacaccgagcaatcactgcgccacaacacgctagtttagatataactaaagcaacatcgagtttcattgctaaaacaaaaatctcgggaaccgctggcgggaggggttcgagattttgaccttgggggcaacttttgacggcgcatccaggaaaactataggcattttggtccgagggccaactgagcgccagcggcgctgaaatggctttttcaaaattttttttgctgttttttggattcaaaaattttttaaaggcctaaatgaaaaatcggcctcgataggattttaagttggaatgtttgccacattttttgcttcttcaccgaacccctagggcctaccagtttttccgaaaaactgactaaaaattgcatacttttttgggccatttcagcgccggtggaataactccccggcttttgatgggaggaggtcggtgtaagcggcttttttgtagagctcgacgagctctatccaaccatgtttttatatttcagaaattttcagaaattttcgagctaggccccctcgaaaattttccgtttttgaattttattattttttacagatttttccggggaaaacggagaacactttcaagcaaccgtttttcatgctctatcgattggtgtcattttcagaaaaaatttttaaaatttttttggaaatagaaaattttggttgctaggcctcaatttcagttctggctcaataactcgtcaggagttgattttatcaaaaaatcgtctaagagcttttttgtagagaattttaagcccaatctaatgtgctttatctcatgttttaaccatgagtttaaaaaaagttatgaaattaattgtgattttgaaattaaaaaccatagaggggaccccatggttttgcattccatgaaaaatttttttgctcctaaattagccaaaatgcatttttatggcctaatttaaggtgctgaactcgaataatactntatttttggtttcagatnttttgaaagggtgttaaaattttttgaaaaatcgtcaaaatttgagcc

SEQ ID NO: 23423 - DNA, 2129 bp, Heterodera glycines
tcatattcgaccaatgccatgtgctgaactagcctattgcccaaatgctcaactcgacggtccaatacatcgaatctcttgaccatggtggagtgcaacaatttcaacgcgaccatttcctcgctctccggctaaaagagatggagcaattagagaagtgaaaataaatattacgttatgcttattattgtaatactgaatatttaatatttgttttttaaaaagaattttataaaactttacttcaagggctttctgcatagccaatgctgcgaggcttccgaccggacctcctaactgaaccagctttgaaactcgggctgaaattttcctgagctgctcgccaatggttgctgccggtgcgcttatttcggaaaaggcatcgacgtagtcttttacatcctcgaccacttgaaatttgcgttaataaatagcttagataattatttaagctttttgttattttaaagtattaggttagcacataattattgtccgtttaaaaaagagatgtctgcgttaaaataccaatgaagcagatttttctccagccaatcttataaagattctggacactaataaaaacccgacataataaatatatgccaacccaatatctaattaatcaattcgatttacctccagcttcaatccatcggccaagtgacaatgctgaagcggcaataaataatgccagacagaggcgcatcttcacttaaacaaagttaatgaaattaggttaattaaaaataaatttcaataacgaatagatttattcttaatttcttttagcattataagaatgaaactttaaatacttattttgttaatttctgcccggttggctcgatcaattgcgctgcgctgaaatataacctttattttaatggaagttgaaataaacaatgagcgatttgttattaattgaatatcgaccagagaattattgtcagtaatttttttgacaaacaaaaattctgaaatgggttgcctgtgagaatgttctgctgtccttaccattttaatatggtatggaagagaaatcgcaactgactgataacaagcactatggataatgtcaatcaaatgaatgttgtaaatacatgccaatcaaaagataatttgttgatttgaccattttataaataattacatcggaaagcagtaaattaaaaaaatatatatgaaattagtcggtagggtacgattggcgcccccacaaagtgtccaagccacgaattgtccaagccacgaattgtccaagccacgttttgtccaagccacgaattgtccaagccacgaattgtccaaaagagtaaaaacccacgaattgtccaaagtctaaaaagctcataaaaagccggaaaatgggtctattttagggttttcggggtcgctgaataccaatacgacatttatatagccccttgcctaaccttagatccacccgaataagaaaaatctccaaatttgattaaaaatatgtgcttttttgtcttcagattttgctattcattaattgaacaaatgattcgtaataaacttgaaagtctacaaaaaagtcgaaagaagctttgtttgtcagcatttcaaacccaactgaggaggccgtaaattttggagtggagattgacgaactgcatgccgtgataacttccgacaatgttgaacaacagactttgaacgaggctgcactttcaacaatgacctttgagcgcggaaaaaccaattttgggtgagattgtctatggttgaaaggtatgtttgaagcgccgcaaaaaatttatttccaaactattcaggatttagattcacacaccactcaggaaatcgctgaagatgcacaaatcgagtttttctcaattatcttggccgtcttctcctggaatgccaatgttcttcctttacttctctcgaacatatatcggcttgacacagcgccagatgttggatggtgttgacgcattttgagataatcgactcaatttttcacccatcggcaaccattgtttgtttaaatttatgcgtttagtttcaaaaaatttaaatttttagctgcactcgggacaataatttcggctatcaactcggaacaagctatgcggctacccctagagttcggcaccggc

SEQ ID NO: 23424 - DNA, 1778 bp, Heterodera glycines
ttgtattattttcacttgatataaattaaaatttgaatttttttttaaatttttaaaatttttttgaatttttaaaatttcccggttggtcccggttcccggtttttcttgcggtcccggtcccgaaaaaaaatcgaggtcccggtcccggtcccggcttatcaggtcccggcaagtcccggtcccggttttggcaaaaattcccggtcccgtggcactctagttttaagtgcttgattatattcgaactatggcataatgtcaatttctaaatataatatttatttgtttagtgccaaaggatgggtaccaaaatggaaggatgcgatagaaattggtgccgctttgataatgtgagaatgattttttatgtttcgttgatttcggagcgttagttggggtttcagccgagtttattctacaaaatggggggcgggtggaagccgtaaatccgtaaatggaaagccggagttatggggacgcatatccgaaagcggctcaataaaaaagcgacaaaaagtgccgtaataaaggggacagtgaatgcgaattgtttaaattttcaattttctaaaaaggtataaattcatatttttaaattaatttctctttctgtgccagggaggtcacctgtgttcggtttacgtttgtggacaatatggtggaaggacagaatggcatcatgattggagctacttctggcggtagtttcacattcatttatatttctcgttgagattttcttttatttttattttacccatttttgtagcttgtggccggtcctcagtgggtcgtgtcggaggatggcaataccttaggctgggagtgacaaactgcaccaatgtcatttttgcatccttttttaaaatagtatttgcagcagcaatttttggctctggccccccccccccccgaccccaattacgaacgacaaacgacaaatttggcattttgtcaccgaatttgtcattacgacaaacaaaattttgtcgtttatcgtttaaatatgccatttttccgttggtcgtatgtctttgtcgtgtgaattgtcgtccaaatgacaattgacaaaatgctaccgtaaatttgttgtttgtcgtcgtcactttgcttttgggtggtattgggtatgcgttttttgaaaagccgggatccgccgctccagaaaagccgggggattatgggatcggtgtcgttcggaaccccgaccctagtgcaactcattaattttgaataaataatttgaaactgctgaagcttaacatgtccgtcgttgctggccatgaattgatgcacgcgcttggctttagacatgagcaaagacgaagtgatgctcgaaattacctgattttacggaaaaagaacggagtaattaacacaaatatttataaatttttcattttgctcattataaagcaatcggaaattgacccaaacacccaaaactttggcttcgcttacgatttcgggtcggtgatgcattatggagctaagggcgatcataaaaagtaagaatagttggatttaatgacctaaaattgcaattaaaggggcttatacgatcggatcactttgccacgcttttaccaacaaacgattggccaacgcgaacgaatctctttcaaagacgcggccataattaaccgaatttattgcaaaggcaaatcaattaaacataattaaatagattttccatttgttcagactcatgcaaaggccatgaggacaagtgccaaaacgggggctatttgaatccgaaatgatgcacaaaatgc

SEQ ID NO: 23425 - DNA, 2137 bp, Heterodera glycines
ggcggatgatcaatcaacgatcacacagatgtgcgctgcacgttgaggcgtgcttgcaacgcacgcagtgcggattgacgacgttcagcagcgacaccgtcgccctcagctgttgcagcggggtcgtcaagctgttcaagcagttgcaggatgagcagcgatggcaagtgggaggcgtatgcgagcatcaccgactgttgccggttgcgtcgtcgcagcaactccaccgcagggtcctgcaggtggtgcgagtttgagagaaaactagcatgcatgatggcaagccagcagcgtgccatgcatgctgtcgcgtgcatttgaaagcgtgtgtagcgcgcagtattcatttgttactgcgcacgcgacttgcaacaggcatttaactcgttaaaaaaagttaaaatccgaaaaaaaatttaaaatttttgtttaacctgttcaattaaaaaataattttttttattttttattttggcgttttgttcgacatgcgcttgcgcgctgcaattagcccgcacgcacgcatatgcagttacaggacaggagatcacctgctgttcgcggcacaggccgcacgcgcctccggcacagaacgcgcaaatgcagaaggcctgccatgtttttcgaaaaaagttttcaaaaaattacaaaaaatttctcaaccacaaatgtgccaatcaacagcacaaaaagtgcgacttcagcggaagggaacaacaaaaatggaagtgtttcgggcactgaatgaccagcaatggacgaaacagaaacaacggcagaggaagaggacgaatcaccggtggcggcgagtgcggcggcggcaaagttttgggcagtcaaattgaaaagcaccggcggcattcaatcaatgggagcggagcggaggagaggagggcaaaaaagaagaaaatggcaccaacacagtgattttttattggggagaaagaaagaaaatttaaacagagcaggattattgattgattgattattgattagcctgtgattgggcggtcaggtagtattgattgggggatagtattgattggctatgaattattgattgattgattgattcaaattggctggagaggaaggcagccaaaaaatagcggcggacattgtggccaatggggcaacttgttgtacacaggcgcacaactcgttcacacaaattatttatttgtttttttattttttaaaaaataaattttaaaaaatcaaaaaaaatttttgcttaaaaataaatttaaaaaattgctttttttcgttgctaatttttcaattgttcatttttttaaaggaccaaattttctagcaaaaaatatttttttttttaataataaaaaaaataatgcacgattttgtccccattgttgaattgtgatgagaatagggctggcaaaaatatggacacttaaaattgcaaaaaataaggccataaaatgacaaaaaatggacattttttttcaaaaaggggtaaattttccaaaaatttcatcaaatttattatagggctcaaaaaagccaatttagttgatagaagatgcctttctaatagaggtttttggaaaaatgccaaaacatggagcaatgcattcattcattcatccctccacctccagggctgcacgtaactcggttttcaattacggaaacgcgtaatccggtttttttaaatgatggaaatctctaaaaaaaaagtgattggcatacattcctattctaaacccaatatcggacaactgggataggagggatactgagaggtcgggaccccgaacttaatcccgcttaatctcgcttaatcccgcgagatcccgcttcaatccatgctctaatctaaacacacttcgtgaggaattgttacaatataagtacaagttttgtcaagtatttcaagtggcatcttgctgatgtgagtgttttgtggcgctccatggcaaaatgcgtccgtcccctctttttttgtgtgtgtaaagaaaaaaaagccccgcgggggttgattacccacgaaaggatgaggaagagaggcggaggacctcattcattcattttttgccgcaagaggacgcggaacacggcacacaattcaattacaaaattggaggaaattgacttcagcagggaaaataggggg

SEQ ID NO: 23426 - DNA, 1407 bp, Heterodera glycines
gctcaatcgtctgatcctcgcacctcacattgacacgtgcgatgagatcaacgatattatgatggcgaacgtgcctggtcaagcgcgcgaatatttgtcctcggacaaaccgcttgacgagcggccactggacatcgatgaaatcgagttagaagtggcagcgttgaaccgacgcacagactctgggatgcctccccaccgtctgcgactaaaggtcggaagcgtcgttgtcctccttattaacaaaagcgataaggaaggactgatcaacggcactcgcatcgttcttgaagaacttggcgacgatcgtctggtcggtcgcgtcattaacagcaactctgttggtggccaagttaagttcttcatcgaaagaacacgcaatgtctacgaggacaaaacgcctggcggcttaaaatatgagcgtttgcagtttcccatcaaacctgccttcgccatgaccattctcaaaggtcaaggccaaacaatcagcacagtcggaattgaccttgaaagggatgtattttcccacggtcaattgtacactgccttttcaagggcaacggacgggaacaacgtccgagtgtacgctcccagaagggagaccgatgcacaagacagagtcaaagtgctgaatattgttgcaacgaaaatgctcattttgcaataaagcaaacgagttaagtccagcgcgtgcgcactttatgatgtcactccgttctcatctgcacttaaaacggacacatattcaaaaaaagtgctgccagctggactgaaggaggcaggtgggccatgacgtgcgagttagggcacttccggtttccattgcattgaaaaatgcagtgtgtcaaggtgaaaccaagtgcatgtcggctgacgcaaagaccctaacacaaggcctaggtagcgaagctcccaaagcgcgaagcgctttaagcaccaagacacatgtaagcacacacccgctagttatatactactaaagaaacaaggcaactcatttccaaaaacaaaatctccttacggggcgtcgggaggggttcgaaatttcgaccttggggacaactttttgaggcgcatctgggaaaactataggtttttcgctccgagggccaactgagcgccaacggcgctgaaacggctttttcaaaattttttttgaagttgctcggattcaaaatttttttaaaggcctaaatgaaaaatcggcctcgtaaaggagcttcgtatggatgtttggcacattttttgtttcttgaccgaacccctaggccttaccagtttttcttgaaaactgcgcaaaaatgggtcacttttttgggccatttcagcgccggccgaataactcgccagatattgatgataggaggtcggtgtaagcggcttttttgtacagcttgacgagctcta

SEQ ID NO: 23427 - DNA, 1103 bp, Heterodera glycines
  misc_feature (765)..(765): n is a, c, g, or t
  misc_feature (785)..(786): n is a, c, g, or t
ttggcagccaatttcagcaattgtccatttccgtcaaaaagttctcttttccgaatcggcgtggagagcattctaaaaattaattaaaaacgaaagaattttagtttttgaattaattaattaattaataataataccatcattatttggccaagaatggcgtactctttctcgaaaccatgaggaaaatcagtaggaatttggagcttttcagcagaaaatagcattttgttgacgctgttttggagcagaaacatacaaaatgattcggaagtctgaataaatattcaaaattaataaaattaaacattaaataaaatattaaataaaacctgcggcattttgaaagtgccgtccaattggcattggttggccaatgttttgttccgactgtgccattcctcaagcggataagtttggaaagccaacaaatgaatgacacttcccaaaaaccaagcgatgtccgattcgtcggagtcaagtctcatttgcttaaaataatttttaaaattcttttgaaaattgcgcaatttttggcaccgaaatttgctgtggactcattgtgatcaatttgctcattgtcaattcactttgactacaaatttggcactcgtcaatgaaagtgatgcgaatgtttccgcccattccgttggaatcgttcgattctttttcgacacgaaagttttccaaggttggggggtacggtagttcagtggcccgaagttttgatacaatgaaaattcatttcatttttcatccgtagcnaaaccctcgcaattgtactnncgcgaacgtggagtcgcgcagaatgataataatttgaaagttccgccaaatattggccaagcgaatttttggtgcttttcaacgggcaaagaaaattcgagaaaaagccccggcactttttcgagctcagagaaaaaaactttcgctcgtcaaaaacaattgctgcccagaaattacagaaactttccgttggcttttccgtttttgcaaatctaaaaaaaagaaaaatcggtgaaataaaaaacaaatattaatcgattttactaaattggccatttgctaataattggtgcccggctgaaatttttagctttggg

SEQ ID NO: 23428 - DNA, 1739 bp, Heterodera glycines
  misc_feature (1652)..(1652): n is a, c, g, or t
  misc_feature (1659)..(1659): n is a, c, g, or t
  misc_feature (1702)..(1702): n is a, c, g, or t
caaagggaggagagagaagagtggtccctccctcccctctccaaaatgtctggaaaattcaaatctaatcgatgtttcttcgttgcaactaagcaaagctaccaatgcttccaatcctttgaaattcagagagtctaataaattgaatttattactagagtttctatttttagacctaaaaacgctttgaatttgacattttttaaattttaaaatgagtcaaattttaggggggtatattttggaaaatttttagattctttctttggatgtgttaaggaattctgagcaaaacgtcaaaatatgacaaaattgtctttaaattatttggattttaggaaaaagaattaattaaattaaatttgaaagatgcaattcattagcaatttaaaccaaaagaccaatttagattttcagaaacaaaaagctattgagcagggctcccagatctgagaatttatcctcattttgtggttttttgataggtcaatgaggattttttttttgaaataaggaaattataaaatttttcccgggggcgcctattggcaccgccggcccccctcttccccaaaatttttgtttttttggaaaaattcctgggaccatccctgaaatggacaatcaaaaatataacatttgaacatttaatttgaaaaatggggctttttgacccaaacttatttttaggaaaaatttcgaaagtgttaccgcatcaataattaacagcaattaacaaattaagaagttaaagcgattcttcggtccaaaaaaggatatgaaagggacgaaaaaggtgaaagcccaaaaaggtgaaaatgtcggaaggtgaagggtgaaagatgcaatttttcaactattttattcaattcctatcaataataactagggctccaatttatagttttttcactatttttttcctgagcttcccatagcttggaatgcacgcacgaaaaacatgttttttcggctgttgttaagctacttttcgagttattagcaactattttctagttttttttacaaaattttaaaaaaaaataataatttcaactattttggcgttttgccaaaatttgttatgaaaaatgcaataaaaacgaaaaatacacccctaagaaggtccgatttgcagcgcatgacaccaaatgacttttaaatttataaaaatagataaaatttctctaatacacctacccatttctacgtatatgcaaccgcgcgaaaacgacccccggccgaaatctgtgtgttgttaaatatacccaattttcttaaccttttaatttttattaagattttttccgacttttggcgacatttgttgacgaaagtccccgaccacagtttatatctctgaagctgaaaaattttttaaatgttaaggatgaaattttttaaaagacgaaaaaagtgaaaatttcaaatgcatttattcttcgaaccattagctaattatatgttaatttcattcccgaatttcaaggcattgttcttttttatactttacattgaaaaacgctagggaaacaaactgggaaatacaatagaactgattgcggcaactaattacagtcggtgaatcgtcactcggtcttccgactttttccatcctattcacaaatacattctaaacggtcttttctttngcgactntttccacgccccaaaagcatcgttagaggagaaacgattagtncgtgaaatcgaagcctgactaaaaaatttgggaattt

SEQ ID NO: 23429 - DNA, 2048 bp, Heterodera glycines
  misc_feature (41)..(41): n is a, c, g, or t
  misc_feature (68)..(70): n is a, c, g, or t
  misc_feature (91)..(92): n is a, c, g, or t
  misc_feature (2029)..(2029): n is a, c, g, or t
tcatttttaatgtttcgtcaatgaaacgtctccaccacgtnccctttgtgccaaatcacgacaatctnnncgatgatgaccaatccaaatnntgggacgggagagagccacggttgttctcgcgcaatccgcccagaattccttgccagtgtcagcttccgatgatcgtccagccgcggagcgagtcgtgatgacaaggacaagctcggcttcctgactttgaatcgaaaaaggttccctggattattcccaaaaatccaagagctgtttcccgttgctcgggattgtgagaggaaaatgagatactttccatttgagtcgatgatttttgatggattaaaatgatcggacaattttcggctacaatgcgtgggcccatataatttaaaaacgatgacatttcaacatccggtcttcctggtaccaaccgatcacctgctggagagtaaactcccgcgtccaaacaccgtacaatggcactgtgcaatcggtaacactttgagagaacggtgcgatcgatgccttttgctgtttccagcacttccaaaattgactcaaacccaaacttaccacgaataactgtcatttgactcggtaagtgtacccgtaactgctgtttatctcctgtcagaagtattttctttaccgatcggaattgtgtgagaattgacaaaactgccgaaagcgtggcttgcccacactcatcaaccaacacataagttacgttgcccaaatccaatgccaactcctcagcaagagccaatgtcatgaagtacactcggtatttggtctgtttcagaagcgcggcagtggtcgttcgttcgcgtgcccgtcttggtgctgtgttaaagtcatcgacgtattgcttaaatgttttattatcactccattttttcggctcggttccttcagcggaaggaacatttccatccctttgcacagcttcaactaaaagattgtcccccaggggcctgatcctgtccatgtaacgcccttttccttgcccagagaaaagtgccaacattggcaccttttctgacaaactttccatggtgtccttcaccaactcacacactgcgacattcaaaggagaaactgccaaaattgcagcgtcacggtcctttttgagcacgcttgcgatgcaggccgctactgacacactttttcccgttcctgccggtgcctgcatgaaaattacacgggattcgtcgtccaaaaacaatccgtgagtgattcgctggtcctcgttcaacttaccgaccgcaatttcgttacttgacaacctaacggttggtcgttgttccgctccgtctttgcccattcccatcaatatttttaaaatttttgagacgggatattgcccttctgcaatgtccgacggaactgaaagttcaaatgcctgttctctgaaagggagacctccgtaattaggaattggaatcacattagattccctttcatcgagaatggattcccaatcttcccagcccctgtcgtagccctttttagccctgtaactcaaaaacattttcacgttcatcagaaagttacccggagcggtttcatttactgacagtccaattactcggccaactgaacagcattgggctcttgagtcacgcgcaacttttgcttcgaccggcgtgtcctcctcccatgcctcaaggaaatcggcaaccgccgatttgttgttgatcaaccattcgaaagagacgcgttgtgcctttttcaaattcgtttgcacttcatccggtcgcacttctggtctctgccagacgagttggacattgacagtttgcttcgccaatttctccatttcgaatgaacgttggacagcggccgcagctcccatcaagcgcactgaaaactggttaaggggaaaacagaaagagtccagactttctttggcaccaattaccaccgtttttccatgtgaacgaatttcatttcctttcagaaaaggagttaccaggggtaaaatgtaattttcacccatccaccattcttatggacttgtgattttggccanaattaaggtaaaggagttg

SEQ ID NO: 23430 - DNA, 980 bp, Heterodera glycines
ttttccaaggaggacgaggtgcagcgtgaccgtgtgtctgccaagaacgccttggagtcctactgcttcaacatcaagcagacaatggaggactcaaatgtacgttttttgtggagtcctttactttttttttattccacctcccgtcgcaaatgattaaaattttggtagcgggcgttaacaattttctgagccctttacaaaactactgtcagaatgggttgagtgagacccaggggactgcggtgttttttcctcctttctatcttttgattttaagctgaaggacaagatcagcgaggacgacaagaagaaggtgctggagaagtgcggtgaggtgctggcatggctcgacgccaaccaggcggcagagaaggaggaatttgagcaccagcagaaggaactcgaagggatctgtaatcccatcatcaccaagctctaccaagccggcggcgcaatgcccggcggtccaatgcctggcggagggatgcccggaggtggcggcgctgctggtgcgggaggagccggtggaccgaccatcgaggaagtggactaagcgagtcgatctcttcgcgatcatttttttgtttgatcgattatttaattttatttttttctcgcgtaaattgtttgacatataaattcattggttgcttacttacgaatctcaccgaacatgcccttctgctttaaaccgtatgttaaatgtaaaaagccaaagacaaattggttcgggaaatcattgataccttgtgtggttagtgatttataatcggaaattcaatattttaaaattcactttatgatcgtatctatatagaatgatattttttgatgtacaattgtttttgactatttttaggttattgcgatcaaattagaaacaaaattgggtaatggtgaagctggtgcccccccccctttttggaataaaaaattttttcttttaaaaagtcgtgaaaactcgttttacggggttt

SEQ ID NO: 23431 - DNA, 1200 bp, Heterodera glycines
gacttgtcgagactgtcgcacattttggagtgggtccgaatggattaccttttggcccggtgcaacggattcgactcggccaccaattgggattggaacgacgcactttcacccggcgaacttcaagtgttgcatgtttttcattgtctatttggctcgttttgttcagcgactttccatcggcagagtgctttaccataagccgagggtcgcttttctcgacgaagccacgagttgtcttggctttgacatggagagcagcctatacaaagtgctaagggacgaaggaattacggtcggacacttttggacgctcaaattcgactcgttcggttttacaattgtttaggttgtctccacgggacagcgttgttcgctgaagcaattccacgagttggaacttaatctgcgaggacggcattggactttggtcgagttggactcggtccggtcgatggtcactgagccgtcgttgggaggagcggcggaggagggcagcagggcatgacgagcgatggatggtcggggcatccgccgaatggcactttcgcaataatcgcgtcttcccctccctccccctcctctccttcccctctctttctgtccatattttctcatatttttgcttctcattttcgggtccctcccctcctaatcgaattggccattattaatttgttcaactaataatttgctaattttgcacctttccattgtcagtcattaccaatttttgcttcgcttttctttgtctgctgaatctcatccgttcatttataaacctctccttcctattgacaatgaccactaaaattatttcttttctctttttttaattcttttttttctaaaataattcattcgcttctaataataaaagtcaaattgacgcaataacttcgattttgcttcttatttttttgtatatggaattgatttttgtcgcagataataaattttcgttctttcattattgttttcaaattacattaaatttattaaaaagtgcattttaaatttacaaaagaattgggatgatttggagcctaagcgtggcaatttgttgtgcttttattaaatgattgtcttcgttcgctttgtccatttgtcgttggaaaatgggcgctttgggggaaggacagtccaaaacggacacacaagcggaacttctccaatccgaagcattggcgaaaacgaaac

SEQ ID NO: 23432 - DNA, 1352 bp, Heterodera glycines
tcgcccctttccaaattttaggcaattttgggggccggcaaaaatttaaccctaattctgaccccaaaatgtcgaaaatcggaatttctactccaattttttgcgggaattgaaagtcggaattctgcgataatttcgtccccaaaaatgacggaagaaatcgtaatttgttcatctgtacttcaacatacaaacaatgcttgttactactataggcccagcgaatggagcggcttttgattaaatgacaattaatttatgttccgtttccatgacgatattaatagggcttcagtttaaaataccctaaaaggcgcaaaaatgggcacaaaatggacaaataggcagcacacacaaaagtctcaattgtatgaattttatttttttttcttgccttttttttgagaaaaattattcataaccttactcaaataaaaaaagggggtaattttttaacgagatggccgcaagcgaaggtgtaccgacattggcgcctcgacaattacgcaacccgtaaaaatagacatttgcgcctccacaattgcgccacccactaaaaatagacatttgcgccgcccagtataatagacattttcgccacccagtaaaatagacatttgcgccgcccagtataatagacatttgagccgcccagtaaaaatagacatttgcgccgcccagtataatagacatttgcgccacccagtaaaatagacatttgcgcctcgacaattgcgccgcccagtaaaaatcactgatcacaaataaacgaagatttgctaattaattttaagtgatcgaatttttaatttagaaaaattaaataaaaaattattatttaaaaaatggtccaacaatacaaattgtactattttgatttgcgcggtgtggttgaacccatccgcctgttgcttcactatgttggccaaccatttgaggacatccgctttaaagactttgaagaatgggagaaaacgtacaaaccgagtgagtaattaaaacatgtggcataatgccatagaaataaatgccaaattaaaaaaaacaaaaactttttcagaatttttctacggaaaagccccagttttggaggttgacgggaagccattggcacaaagctcggcaattttgcgctaccttgccgaaaaatttggtaaattaattataataattaattttatttgtttttaattataaatttaaatttaaggcttggccggcaaagatgaatgcgaaaaggcgaaggctaacgaaatcatcgactttcaaaaggatgctaactccgaattgatgccctatttgatggtcaaaattggacgccaagaaggcgatttggtgaaaaaataatgcaa

SEQ ID NO: 23433 - DNA, 2436 bp, Heterodera glycines
  misc_feature (789)..(789): n is a, c, g, or t
  misc_feature (798)..(798): n is a, c, g, or t
ggccactctgcgataacaccaaaaatagaaaacttctttttaattcattttcttggaggaaaatgccaattgctccaacacaattaaagaaaaatgatagaaaaaataaagggaaaaagaaaattaagcacaaaaaggtaccaaaaaatggagaaggaaaacaaaaagattggaagccgttatttaacaatttacgataaagtaaaagcccgaatgtgaaaaagaggttgaactgtccctaaaaaaacagttgccttccgatcgattggcctgtgatcacattgatcagtgttctctgatcagtagtccgatcacagcagaatgacgaggccagcgatcgcaactgccaatgcgaaattggacgggcctccatctccttgtgggcctcgccagcagaagccgtggtcgtccccctttttgtatgccacgcatttgtaaccttctttacacggattgcccttagaacagccttaaaagaggttaaaggtatcattttcgttcatttcaattgtttcttatttctaccgcttaattgattttcgcggatttatatgttatcctacaaatggcaacattattcatgcgccgtgttggaaatggcactttttcgccattttttgccaatgatacttttgactttaaatttcgcgttttctaatttaacgtttctcataccggcgtcacgtttctttgatggcactccgatttcgaccggcacattgcctttgtacccttttctacgccatcctttgattgggcatttggcgtacgggttcgcgtacacttggntgcagcagntttttgaaggtgcaactgtagcattttgagcacaccgtactcgaaggagttgagcggcattatctttgcagtgtccgtcaagttggcattcgatgcccgcttcagtgaaaccctgcaaattatgtgataattgggtggtccaacgacgatataaaataaatatatgacggcatcaaattgaatttcttttcgttttatgtgagccctgattttaagcgaataagaaaatttttgaaaaaatctcggtctcgagtctcggggaattttcggtctcgaacagcactactttgttgtgcttgggagcgacctattcagtttttaaggacctcggaattgtatcaatctaatataaattcatgtgaaaagtgtttgcttttatttggaatttttattttttatttttaaaaaatataaaaattattttaaaataaatgcgttcaacaatagttttttattaccaaatataattgcaagaatattatggttgcggtaacatgtacgcagaacattgccaattgcatttcactttaaaatgatatttttaaataattttgccggaaaaaaaagaatttataatattattatgacgataattttaaataataaatatacaaattggaatttaattcttaataattagcttagaattttattttaaaaactttaatttgagtaaatgatatgcattacgattttgctgtgcgcttaaataatgccaaaaataagctaaacaaacaaaagtcatccattcattccttttcataattaaggaattgaatttctaataatagagctttttatttagggccaaaattaatttacttttttggaagtttttttaatttgctataaatcgctataatttataaaaacaaaaattggcgtttaaaatgaataactttgagcaggtgtgcaatttgaaggacaatttgtaaatgaattggattcatattatttttgttcgtttcttaatcttcattgttaagaattacggctgaatcttgtttcatattttgtggctttttaaataaaattaaagcaaaaactgcgtgccatcgcggttactctccgccaatcattcgtttaacaatgccaatttagtagggtcgtagccgggcgagggggatgaccccggttaagccgcggaacggggagagcggggatgacgaaacgggcgatcgccgaaaatggcgactcataaaccggaggacgagaatttcgtgtttcgttttcgtgaaaaataaatattttcgtttcgttttcgaaaattatttttttggttttcgcacacccctggtcctgaccccccgatttcttaacacaattgcatcaaactttataaatttttaggttgatttttacattgattaagcacaaaatcccggcggacgggatcgggatcccgctggattttctcggaatcccgcggggattaaattcgggatcccgacatcggggtccgtcccgaaccctttttaattcatcgggattgattgaaaagatccctcccgaccattttgccaatcccactgaatcccgaagtcaaagcctcgggattgatggaattggatctggatttggggttcctccgaacccctggggaggtctctaataaccaccatataaaaaaaagcattt

SEQ ID NO: 23434 - DNA, 918 bp, Heterodera glycines
agtcgacaattgggcttcgcaactgatcaaactcttgattgtcattaagaagatcaatgaccattgatcgccgcacatcccgttggttaccagcaccgatcggaatggcatttgaacagtgcttaatttaaaaattaaacataagaaattaattgataataataaaaaataccttggccaaaaagagtgaaaagacgctcaaaaagagaaaatgcattttgtttctttcgattaaatttagaatgaattaatccagtaaattttctgttatttattcattttttcatcttaaaaatgaaaattcatgaggtgatctatagagataaatttattgtcgaatttattggctttttattacctttttatgaaagttttaaaattaatggtatttaatcataaaaagaaaaaaaagaatatgcattttatttcttttggttaaatttagaatgaatttgaatttagccagtattttttgttcatttttattcatttttagagataaatttatagtcgaatttattgggtttttattaccgtttaatggcagttaaaaaatttatggcaattaaccatagaaatataatcaaaacattttatttttgcaaaagaaaaaccatcaaaatattcagtcaaaattcagtccattgaaatttctttttgatttttttattagtgcaaaaagaaaaatgaaatttttaaaagaaaataaataaagatttccaatttttataacacgaatttgcaaatttaataaacattcattgaatgtgtaaatagtcgtcccaatattcgcgcaacatgtcaccctcacacgccaatgaatcgtttttattgtgcaatttgccacagcacatacagtaatggacggacaaaaacggtgtcgttaccgtatcagtcgccgttttatttcgccaaaaa

SEQ ID NO: 23435 - DNA, 808 bp, Heterodera glycines
  misc_feature (93)..(93): n is a, c, g, or t
ttcaaaacgacggaacattaacagcacaatcactagcagaacggacgtaatgattgatacggtaatgtgtacggtgtacagtaaggagagtgnaagagaggaatggactccaaaatccatactttatgtaaaaaagaactatagtcatcgtcatactaattaatatgtttaaatcacatcactttaattgaatgtttttttaaatagttgaatcgatccgaaacaacaaaagtgtaacaataactttttttgtaaaattttaatgggatttctattggggtggaaaatcgaaaatttttgaaaacaaaatgtatggtttgaataaattttgaggaaaactcagttatcctgattagagagagaacagaattcttacccgaatttccttttgaatagagagagaaattgggttctttctgagttacataattttttaggaaaaatattttttaatgaaatttttccgactttaagcattgttttgtggtattcagcagatcaccatgaaggagtgtttgatcagttgtttatattgactatttgattaatatagactgacatttgaggcatatgcatttttttctgcgcactagtttcgatattaagcataaaaaacgcagtttccacttggtttgaggcttctaagttgacttttattatgcctttttttttgcctttttcgggattttcgtgccttaaattccttttttggcattttgccgttttggtgccttttttggtgtttttttccaaaaaattccattaactgcaaaaaaaaatcgggaaaatacacccctaagaaatgact

SEQ ID NO: 23436 - DNA, 1332 bp, Heterodera glycines
gaaaaatggatgtcaattatgaagaaaatgtactgtcccgtctcatatacaagggttgcaagtcaatcccgattctcaaatccgattctcgatttttggatctcaaaaattttttactttgagcattggaatttcgagaaattttataaattgcgcaaggactacaccgcctatcaccactgcactacaaagcccagaaatttctcaaaaaattgtcggttttttggtgtcgattccggattagtacagttttgaatcttaactctaacaaaataagcaaatcacgagcaattctatggcatgtatcaacccaggcttaccacgaaacgaaattggcgaccagcgccatcaaagcataagcgtaacattcacgggcaccaccatcggtggcaccaatgaagcacaacgcggacaccaacagtgaaatgacaaagaaaaacagcgaattcggcacaactttgccggcagcaccgacggagaacagaaacagtgccaacgcgatgagaaaattgacgaacggagagaaggtgtccatgagaaaggaggaatccgctgcggagtcattgctggcactgtcgtttccaacggcatggcttggcccttcttcagcgatggcactttcactgccatggcttggcacttgtcccgctgtggcacttccactgtcactgccatggcttggcatttctcctcccgtaattagcaacaattgatcattttgcggagcattttcagtgcctgacgatgacgaggacgccgaaggcgcgatttgttggttgtcgttttgagacgatggctcatgatgaaccaaattgatcactctctccaagaccgctccttgctgaagcagggaattgttgtgccggaacattttcagtgtgaagaacagcatcatggcgaaggacacataggcgagaacaattgggacgatgttgaaaatggtggaaattctgaaaaaattgggagggaaaatgtcggataaaatgacagaattttaaaaattggccagccaagaatttgtaaaaacttgtcaagctttgcacttttttcttgcaacttttggggaaaacaaggcctcggttagaccatacccaatgaattggacaaagcaaatgagcagcaaagtctgcagttgttggagaggaaaaacggcgtaaatgagcgtttgccattgctgttgcagctttgtgagcaaatagtcgaccagagaattcatttacacaaaacaatagggaagaaaaaatcagaaaaaagaaaaatttcgattaacacggcgagtcaattttgggctccaagcgcaaataagtttattatttatttattaatcagaac

SEQ ID NO: 23437 - DNA, 2189 bp, Heterodera glycines
aaaaatcaataaaacgcatttttgaggcgcgctttttcaaaaaaaactttttgggaagagggggcaggcgccgccgggaaaatttttgaaaatttaattaaaatttgttgacagattttcaccaaaaaatcatcaaattttgtgatttttgtatcatttttctaatgagaaataagagttttggcgcgccgctgagaacagtttttcagcaaattaccaaattttgcgattttgggccattttctaagaaaaaataggagttttgggggcgcggcggtgccgataggcgccgccggggaagaaaattggaaatttcgatcatttataaacagtttttcactgaaaattagccaatttataggtaaaattttgaaaaattttatgggaatttaatccaattcttaggggtgtaaaagtcgcttttcgcgccaaaaagcgaaatgcgaaaagcgaaatgcgaaacgccaaaaaatgcgaataatgcgaaaggcgaaatgcgaaaagcgaaacatcggcccatccctgatacatatccaggccaataaacacgaatgagcgaacggtgaaggatccaaatgattatttggagaaaatttgaaaatcgcaaaaaaaaaaaaagaatttaattaattaaaaaaataaagtgggtgggaaaagttgtacccggtttgaacatttcgatggcaattatttaatgcaaattggacgatactggcattattctaaagctcttcttgattaggagaagctttcccaaaacgaatgctaagcaatttgaagaatcagaaaaaaaagatatgaacgttcgaaattttgtttttcttaaaacttttgtattcgaccatagacaaaaatgaattcattatagaaaatgcagaatatgttaaatttgaagaaattctatttttttctctgcactctctcattattggttgatctctcattttttgggactgtgtgtccaatgctcaataaaaacaaccaatacacaaatgttctaaatttgtgtcagaagaatgaatgtaatgtttcgtgtgctcctcctcttttcctccccgttttacccatttttttcatcgctttggccccggcaaaaaagttgattcaaatcaatgcaaatgtaaacaaataatgtttttcaatcaaattattttttcctgagctctccgtggcctgaaacacgaaaaatatgttttttttggaggagggtgttaagctacttttcgagttctagaggctattttaggtttttattttttagagcttaaaaagattttaaaaattttgaaaaaacctatttcgatctattttggccattgcccaaaaatgcaacaacgaaaaatacacccctatgaatcgacccgaaagtattcaaaaatacatccctaagaaatgaaaattttctcaaaaatccatctccaaaatttatttatttattttcttgacaagaatttggattttaaaattatttatcttaatattgactttgcctaatttttataatttttgaataaattttgtcattttacactcctaaatttgaggctatggtttagaaaaaaaaacaggggcatcagtgtaattgcgagaagttttacattagctttatttgaagcttatagggattatattaataaatttaatttattaaagttttgcactaaaattaatcattttattttaattttttaaattaattttataagtttggtcttataaaattcatgaatcatttagtacatacctaatcccattcatatttacaagaaataagatagattaattcgtttaactttattttccataatttgtttgcgctctcttccctctataaaaaagttcaattttgtcttttatttcatccctatttttttaatttaaaattataatttcaacaaaataactagaaaaaaagttgtgcctttatttacactaaatttagaatattatatttttggtactaatgttgtcttacaaattagttttggtcccctttttggttggattttttggaaaagcagaaaatatctctggcatacactattttaatgttttccctttctctaaaaatgaatctttgtttttttaataattttttgtgttatcaaggcaggagaataaacaccaaaacaaccaaaaaaccaggggggggaatgctatttctgagccgctttttaatagcatatgcg

SEQ ID NO: 23438 - DNA, 790 bp, Heterodera glycines
taattcaaatatttgcttcaataaaaacgataagtcaaaacagtcatttaaattttgcattttatttcaaatccaaaaataagcatatataatgctgaaataagcacaaacttagaaataagcacacttgggagccctgattatttctagtttatttgcataaattctctgtccgcttttttagcaaaagaacttttggcaatcccatggtgtttttgttttattttgaatttttaccaatttaacctttttttatttctaaggagacatcgccaatcgttgtttgcccaaagaaaatggcatacgaaaattctatgaagaaaacccaaattggatggaacacgttgcggctaccatcaacccgatcaccaaatacaccggcggggtccgtaaagcaattgcagacccgggttgggtgctagagaatagtatagagagaattgaatttgccattttaaattgtaatttttgtaaggaagttatctttaaaatgaaaaccttttcagatttattggctcataattgagcagtccgtttcaatataattagctaaaaattttcagaaatttttggacaacatcttctccaaaaaacacctcccgaagaaaacgaagaaattacaagtgagttggttgattatatatgtagtaattcatgcagtcctgatggagaaggagagtagatgagagagagagaagaggaaagaaataaagcgatggagagaaaagagaggaagagcaaacaaagagaagagagagacagagggagacagagggaggagagagagaga

SEQ ID NO: 23439 - DNA, 2136 bp, Heterodera glycines
  misc_feature (2129)..(2129): n is a, c, g, or t
cgaatatgaattctatatgccctaattgctaaccacgaagtctaattctagcaaagagtcgaaaattcaagttctttcaatctcaagtttttgttcctccttttgtttacacatacggaaacaaactgaaagtcatcactgatactcatcagtgctacaacaaaatcgtttaaactatttttagactaaaaatcgaaaaattttaattttcggctttgttagaattcgtgattcgaaattggtcgaaatggaggcctgattcgtgctcagcgcctcaaaacacccctagaaacgtgttataagaattttcagaaaaaaatttaaagaaaacattttcgggaccaatgatcgacatgattgccgcattgaaaacgatttagggcaatagatttgcattttggtgaaaagcgaatttctgattttttgttcgagttcgggtccgggattcgaaattggtcgaaatggatgcaggattcgtgattagcgactccgaaaacctattagaaagtgagaaaaaaatagaaaaatttttatgcgccctatactgcatgagccaaaaaaaatttttgggaagaatttttgagaaaataagtggttttcgccctctgatgatttttgacagtaaacaaaacaaaaatttcacatatattttatttttatttcttgcatcaaaaaggaggataaattctccacaatatgcgagcccttgaaaaagcgtatctttttatacaataccaaaatttgcggggaaaaaacaaaacgagtgaacaaaacctaaacaacaaaaaacagagaaaaaaggggggattaaaacattttggagagatcgttgtaaacggcgaggaccaacgcggcgccaaccccacggatggcattgacgaagaagccgctgaagaaagcacgtccaccctcgtgccggtggatttcctgtaaatttgaagcaaattcttggcacataatcgaaaattttctgcaaaacacacaaaaacttgattttcaaagcatgggggccaaaaaaagcatggcgaaatactcaggtaaacaagcattttttggaaaaattagaaaaattgcacctttctgttaagggaattgtaaaatcataattttaaataaagcaacaaaaacctatgaataaaaagacccaaaaatctatgttttacaatttgacggaaagtcacctgccatttgatttaaagttttctttaaaaaaatattctttacagattctctcatttatgcgccccataaaaagtgcttggagcaaaaaaaaaaaaacaattttgtagttggaactactgtaatttttgttcccccttcgccttgtaaaaaaatatcgtgttttatttttaatctataagcctcgaaaaaaggaaattataaatccatatcggctctatttgtggtttaggcaccgtaaattttctatagagttcaaaataaaaaaaagcttgaacaaaaatgtgaaaatttgaatgaatttccgactttttgttcgagttcgtattcggggttagaattgttcgaaatgcatgtcatattcgtgattaatcaacgaccccgaaaaattaaaaaaaattatggagcctaaaccataacagagccgcaatatcccattatcccgcgccccaacctcccccctctcacccgaatgcaatgccatgcatttgcgtagtcgggcactgctttgcccgactgcatcatcagccgccgtcggacggtgtccaacggataggaaaagagggcggccaaaaaggcggaacacttaaatcaaaaaaaatattggaaatatttttgcatttcaaaaaatattcacttggccaatgcaaaaggcagcccaaaagggcacactttccctgcccgtgccattttcgttctccgtcgttgccacaaacactttgaacgagtcgaacagaccgtagtagagggaacggtagaggaaaatgtaacacagcgaagggacgaaacccctgcggggaaaaagcgacgcattggaaaattgaattttatgcgccttggagttggaaaataacaaaattctgaaccgaaaaaaaacatttcccaccccataaaaagggggaatttatcaatttggtgaataatccattgacattcttttgccgatggantattaaa

SEQ ID NO: 23440 - DNA, 1634 bp, Heterodera glycines
aacgggcgcgaagcgcccgtataagcccaacaaaatttaaaaaacgggcgcgaagcgcccgtatgagttcaacgaatttaaaaaacgggcgcgaagcgcccgactgaggccgcgaagcggcctaacaagctaaaaaacgggcgcgaagcgcccgtatgagttcaacgaatttaaaaaacgggcgcgaagcgcccgtccaaggccaacaaaaattgaaaaaccggcgcgaagcgcccgtctgaggccgcgaagcggcattattaatagctcaacaaatttagaaacgggcgcaagcgcccgtctgaggccgcgaagcggccttaatagcccaacaaatttataaacgggcgcgaagcgcccgtctgaggtctcgaagctgccttaatagcccaacaaatttagaaacgggcgcgaagcgcccgtataagcccaacaaaattaaaaaaacgggcgcgaagcgcccgttcgaggccgcgaagtggcctaaaagtcccagataattttttaaaaattcaaaatctccacaaccatagcttatctaggtagcgaagctccgaaagcgcgaagcgctttttcccagctaaatagccgacggttcacgcacccgctagttactatatacgttatattgacaaggagtttcgtttcaaaaactaatttgagcttaacggctaatgggacgggtctgaaagtggtggaagggtcttacaactttttgaggagaattcgggaaaactataggttttttgatccgagcgccaactgagtaccggggactgatttgtcacttttgtttgcatttgaaggcccctaactttttttgtaaaactcgaatcaaaaagtgcccgctgaaagggcactccgcctaagggtcctctacaaggaggtattttttaaaattttttttgagcaaacccctggcctgcaaaaaatggcaactgaagcgtgctcaaaaagtacacttcagtaccaggtgaataccgcgccagggtttgatctgagcggggggtggtcagcgaacttattgtagagctttcaaagctcgattttttgaaattttaaaatttcgaaaattttcaaaatttttcgagttaggcctaaaaaacggttttcgggtttttgaattttaggattttttaacgatttttcccagagaaacggagaccacttccaaaacatagtttttcgagctctatcgactggtatttttttcggaaaaatttcgattttttcccggaaatagaaaaaaattttggcctgagcgggacatttgagtcccgggcccataactcgtcaggcgtcggttttagacaaaaaatgccttagagcaaaattgtagagctttttaagctctatctaatggtatactatatgtagggaaattttcaaaaattttcgagctaggccccctagaaattttcaaaaattttttttgggttgaaaaagagggtgaaaaatatttttctggggtaaattagggtcctgagcacaaatatgatgtttattttaagtttcagattttttggaattttttaaaaattcgaaaatatttttaatttttttggtccttggaaatttgggttaaaatttgaaaattcataactcaatgaaggactgctcaatttaagtgaatt

SEQ ID NO: 23441 - DNA, 1838 bp, Heterodera glycines
  misc_feature (35)..(35): n is a, c, g, or t
  misc_feature (1820)..(1820): n is a, c, g, or t
tcaaaaaaaatattgtaaactaaaacaagcatttntaataattttcaaaaaattgaaaaaaacgtttttttaataggaattcaaggaaaaaattttgaaagtttttcttgcttttttaaatcttgaacagacttagtaaatttctatttgtaagtttcaaatttaaaaaaataggtgcagtgggaaatgagtgcagccagaaataaaaaacagggaaaaataaagaacaccgaaataggtaactctgtaaatcttattgttagatttttttgggaaaaccccagaaaaatattttaattcctccaaatttctttatgaacaacgagattgttttgttttcatcactctaccatatttcccgaactattttccgcttttagcatccaattctcttctaatcccgtgctgcacaaattctgtttggtcccctcgcgccatttctgcgtcggttcctacattttcgccactcggcgtgccgagcagtcgcgtgccgtcaccaacacactttgcgcattttctgtcttgctcccattacgccagtaattttgaattaaaaatgtttgggatcttaaattccctccaataaatccctttgtccctttttggtccaattggtttttgcaacgacagtccgtcttcgccgaaatgttttcggatgccatcgcgcgcttcaaagccgcttcccttgtggagagtgtggaggatttggtgtgccgatgcacgcgcgagtttatgcccgtgtttttgctgttcggtgcgctcgaacggtggccatttgtggtaatggaaaaatttaaaacaaaaagcatttgaaggctttttcaaattttattgattcggtgggtccgccaatgttgagagaatccatcggggaaaaaactcgtctgtttttctaacagattttcagccaaaaaatagttttggttcttttaagactagaaaattctgacaatggccgccgccggacattttgaaaattggcccaatcaaaaagtatcgagaaaggtccaaggaccgaaaatgttgcactatgatctcgacaattcttcttaagagaggcagtcgagactgactctcgctattgactaaattaaattgcaatccctaatcacccgccatcctaatggtatcttttgtttaagtcgagctgtgagcagacccatctgcgcattcagcacagccacctctgggcgttgaaccggacgccgcacagcgactttttggcccgttgcatcaccgcctgtctgatgtgccgtggacggtgtgccgtggtgggcggcaagccgcaggaggtggcacaactgatgcacacgctggtcgctttcatggagcccagcgatcgtttgctttgtttacgaccgtacaaaatgccgtacagcccctatctgcgcttgcaggccatcaaacgggtgggagggtattgcttaagcaatgttggaatggggttaaaaaaactaaaatcgtttgtataaatttacatgaaatttttttaatttctcagcgatttttggaaaattttttgaaaaaataagtaatcatcataattttgaaaaaatcgctaaaaaattcaaaaaataaggcagaatttgatacaagatccaggctgacaatgggtttttctagattccaaattcagtctttatttatttattctgttttcttacaatccgttgactcatgaatttttaacgcagtccaaaatcctcctataacggtgtaaaaaatccgttttaacaagcaaatccgattaattttttatagtaatttttattcttatttgttttttgccaacttttacagttgcttaaatttttccactnagattttaaatttaaaaa

SEQ ID NO: 23442 - DNA, 1574 bp, Heterodera glycines
acattgagactattttcggtcgacctagcacctttctatctcatatgaaattaattcgaatcgaatttaaacaaaaaaacataatttgcatacactttgtgattttttggcattctgtccattcattttcttcaaatacctaaccaatttagtcacattgccaattctttcttatataatacctaattaaaataatgaatgaaaattataaaagaaaaaaagtaaattagcataaaggcaaatgaatttgaagggaaagaaggaatttattataaaaatggcgactaaatgaaaatgccaaatttgtcatcatattcatcttcctgaacttctttttcatcactatttgtcgttttttcattgcttttttcaatttcttcatttctttcttggcgttttctttggcattttcatacattttttgctcaaattctcccgaattctttcaatgtccgtttgtccgttcgaaatttgttttccattttttgtaatttatgggacctatttttctcctttcaatatttaattccaatttcatttggaggattttcatgttttttccaaagaatttagaaaaatcattcagactattgaaaacatgttaaactgcgaggatattgttgtataataatattggctttacaaatggtagtaattgtttcgaactttcggatttttagcttaattagtagggcatccaaaaatatgcacataaaatcgcaaaatatgcgcataaaatatgcaccaaaaatggcaaaatatgcacataaaaagtgaaaaatatgcatataaattttccaaattaagggtgtaatgtctctaaatttcttcaaatttgttaaatattaagtaaaatcttcaaaaaatggctaaatgtggtattaaaaatcattttagaagaaaaaaacatgataaagcaaaaatttactcattttttgcgaaaaaccaacccaaaaagcgaaattttgctttttttgcttatttttgacataaattaaccattttttgagaacatttatttattcaatatttttcgtgaaaattttgctaaaaaattatttttttggaaaattttccggtttttgaggtcaaaaaggccaatttgtctgttgggggccgttctattagaggttttttggaaaaatgcccaaatatgcacataaaatatgcacgaaatgccaaaatatgcacaaatatgcaaatatgcacataaatcgcgaaatatgcacaaatatgcaaaacatgcatatggaaagtcatcctagaagcttcaaaacacgctaaaaacatgtttttcgtgcgtttcaggcctcccacagtccaggaaaaaaatatgcatgtgcatataattggactccctactcatcagtgcttcaataaaatcgtttaaaccattttagattaaaagtcaaaatcgaaaaattccaatttcgactttattcgaattcaggctggtgttataaataggttgaaatggagtgctcagtagagaccggaaatttcaaatttgcggatcccgctgcgggattggaactcaaaattctttgcgggacgggatcccgcgggattaatcc

SEQ ID NO: 23443 - DNA, 1227 bp, Heterodera glycines
  misc_feature (1149)..(1149): n is a, c, g, or t
  misc_feature (1151)..(1151): n is a, c, g, or t
aaaaagcctatttttttgccttttcacaagagaatttattaaaaaaggcaaaattcgccttaaattaatgaggtgaaagtttgaaaatgtttattaaaaaatttcaggatgaaatacaattaaaataatcaaaataaaaaaaataaatttatttttctaaataaataaaaaacattgtcagaggcagtgcctgcctaaaaaatagacaaaattttttcaaaaaagccaaaaaaaattgaaaatttaaataaatttaaaagtgaaaaaagtaaaaaagcttacaacaccttcgattcccaggacgtctccgttccaagtactaagaaggcccaacgttgcttaacttgccagatcggacgggatggcgtgctttcaacgtggtatggtcgtaagcgaaaggacagcaattaaagtcatttaaataggcatatttaaaagagcctatttttttgccttttcacaagagaatttattaaaaaaggcaaaattcgccttaaattaataaggtgaaagtttgaaaatgtttattaaaaaatttcaggatgaaatacaattaaaataatcaaaaagaaaaaagaaaaaaaaataaatttatttttctaaataaataaaaaacattgtcagaggcagtgcctgccgaaaaaatacacaaaattttttcaaaaaagccaaaaaaaattgaaaatttaaataaatttaaaagtgaaaaaaatttaagtcatttaaataggcatattttaaaaaagcctatttttttgccttttcacaagagaatttattaaaaaaggcaaaattcgccttaaattaataaggtgaaagtttgaaaatgtttattaaaaaatttcaggatgaaatacaattaaaataatcaaaataaaaaaaataaatttatttttctaaataaataaaaaacattgtaagaggcagtgcctgccgaaaaaatagacaaaattttttcaaaaaagccaaaaaaaattgaaaatttaaataaatttaaaagtgaaaaaagtaaaaaagcttacaacaccttcgattcccaggacgtctccgttccaagtactaagaaggccctacgttgcttaacttgccagatcggacgggatggcgtgctttcaacgtggtatggtcgtaagcgaaaagacagcattnanagtcatttaaataggcatatttagaagagcctatttttttgcctttttcacagagaaattattaaaaaaggcaaaa

SEQ ID NO: 23444 - DNA, 1290 bp, Heterodera glycines
ggcatttttaaaaaagcctatttttttgcctttcacagagagaatttattaaaaaaaggcaaaattcgccttaaattaatgaggggaaagtttgaaaatgtttattaaaaaatttcaggatgaaatacaattaaaataatcaaaaagaaaaaaaataaatttatttttctaaataaataaaaaacattgtcagaggcagtgcctgccgaaaaaatagacaaaattttttgaaaaaagccaaaaaattgaaaatttaaataaatttaaaagtgaaaaaaggaaaaaagcttacaacaccttcgattcccaggacgtctccgttccaagtactaagaaggcccaacgttgcttaacttgccagatcggacgggatggcgtgctttcaacgtggtatggtcgtaagcgaaaagacagcaattaaagtaatttaaataggcatattttaaaaaagcctatttttttgccttttcacaagagaatttattaaaaaaaggcaaaattcgccttaaattaataaggtgaaagtttgaaaatgtttattaaaaaatttcaggatgaaatacaattaaaataatcaaaaagaaaaaaaataaatttatttttctaaataaataaaaaacattgtcagaggcagtgcctgccgaaaaaaagacaaaaaattttttgaaaaaaagccaaaaaaaaattgaaaatttaaataaatttaaaagtgaaaaaaattaaagtcatttaaataggcatatctaaaagagcctatttttttgccttttcacaagagaatttattaaaaaaggcaaaattcgccttaaattaataaggtgaaagtttgaaaatgtttattaaaaaatttcaggatgaaatacaattaaaataatcaaaaagaaaaaaaataaatttatttttctaaataaataaaaaacattgtcagaggcagtgcctgcctaaaaaatacacaaaattttttcaaaaaagccaaaaaaaattgaaaatttaaataaatttaaaagtgaaaaaaatttaagtcatttaaataggcatattttaaaaaagcctatttttttgccttttcacaagagaatttattaaaaaaggcaaaattcgccttaaattaataaggtgaaagtttgaaaatgtttattaaaaaatttcaggatgaaatacaattaaaataatcaaaataaaaaaaataaatttatttttctaaataaataaaaaacattgtaagaggcagtgcctgccgaaaaatagacaaaattttttcaaaaaagcaaaaaaaattgaaatttaaat

SEQ ID NO: 23445 - DNA, 972 bp, Heterodera glycines
tccgtatgttttccttcgtcccttttcagttctcacacaaacattcgcccgttcgcctgtttgacttgcaatttctccttcaaaaccaagggtaacaactcattgttattttgttggatgaattgtccatttttattcgtccatttgtcctttttaggcaatctcaccaaacatttggtgtccaaagcgcaccgacgcaaagtgatggacacggacgacggaatgcgaaggtcgtcgacggacagaggcgggcggaagagaggcggcgacgcggaagacgaggaagaggagggcgaaggacgactggtggtggcggaggaggacgacgacgaggaggagaagaagcacagaagacgcatggaacggtgggaccgcgtggacgattgggacgatgacgatgacgacgacgaggaggaagcggacgacgacgaggaggacgaggacggcagccccaacggcgaagtgccgcccccgccccccggcacgctcagctaccgacgcttcgggcaggaggtggaaagggggaggagagagaattggggaccatcaccgttatgcttttcccccattcattccagaacgttttggttgagcgtgagacgcacacaccgccgactttgtggacactttgtccggaacagagagaatggggaggcaacgggtatccatctggcagtgacgcgggaaaagtgccaacggattctgacgagaaggcgcaacgggaggacgaagatggctcaactgattgggaacgcgcgggcaacaagaagcggtccggtatggccatcatgcaactcaggggatggcctgagccggacgaggcggtgcgcgagaggggctgccattccgcgccgccggccgccctttgctcgccggaccattcgcgcgcgaggcgaagacgcaaccatcaagcgaaagtgctcaagcgaatgcagcagaagcagcgggagattgatgcagaagctctaacgg

SEQ ID NO: 23446 - DNA, 1728 bp, Heterodera glycines
gttttggccacggcaatcagtcgacggaggtcgccgtcggtgtattcaccgcgcagaaatttgaggtcgccgttggcgggggccgagcacttccacaattcgttggccttggccagctcgccaagcagttcctggtcgttgttgctcagctggtccgtcgctgccgacgtcgttggcgttgtgtgcatcgccgtcgtgtccatcgcctcggggatcgtttgcgaagttccgccgaccgccgaaggcattgccgcgttgttggcagcggaaacgcacccaaaatgagccggatggaactgctgggaaaggcggggcgttgagttgttgctgctgttgtggtcgctgttcagctgtttggacgagttttccagaaggtcggccatcacctgccaatggacaattgttgcttggcaaagtttccaatctctttggccaccttgtcaacaattagcatatcccccgggtatcttccgcattggcaatggcattggcacttcgtcggcgtttggagttcgcgctgttccgcttcaatcttctgctccaccaacttcatcagcacatccttgggcactgaaaccatttcctgttgatgatgctgagctttggtttggaatgtttggggcgaattttgaatggacggggaggacgagaaggaattggaggagcttatctgagtgaccgcctaaattagcacagtcacttcccaaactaaagccagggattccgcctgttggttctgctgaatgccggcgattccgccgattggctgcgttggcattgcgttcaccgcctgctgctgcgtggtttgctgttgcggctgaagcgcggcgaccgcgtgctgctgctgctgaaggagaattgtggcagcagcggccgcttgtgccggcatgggcaaaagcgaagtcggcaaagcgccgccggcgacggaagccaacgacgccgaagtattagcagacggggacaaaacggtggtcagattctgctgatgctggtgagcaacggccgctgcggcagcaacctgagaaaaagcgatgtaaaagtggcattttggggtgccatgccaaatacactcgtcactaacaagccacccatctctaaatgtctgaaaatggcaaattttcctaaaaattacgccgtccaatacatgctgcagctgttggctaacactttccgaagacgaaggcgcagccgactgctgttgctggtgatggtgaacagccgcaacattggcaaacgctgccaattgctgaaaagaacgaagttggcaaagtctatgccaggttttggcattcgcttgcctgttgctgaatagccatttgttgcgcatgtgccacaatttgagctgccgccgtttgttgatgctgctgctgtacgacttgctgttgatggattgaatgttgctggtggtgttggctgctgatgagctgctgctgttgctgctcaacttgtacgctcaattgggcatgttgagcgaccacctgctgaagggaacaccaaatagccaatagaaaaagacaactttttgcctgagaagcaatttgttgctgaatgtcttggctcgagtacggcccctgcggcggcgggtgccattaaattggacggtgccgtaggcggtgcgaccgttggcgcgagaattgttgaggaagagtccacggcccggccgctgctgttctggtgttggtgcgcgaagtgccgcgagcgacagccgccgctggtgccgaaaatggc

SEQ ID NO: 23447 - DNA, 1040 bp, Heterodera glycines
gatagaattttcgaatcgcttttaaatcatctcttttgcgtcccttaatcttcactctgagccgagttactggcggtctaaacacgatttttggtagaattgcggccagaatttaaaaatacagtttgctatggcttcgcatcacccgcttcaacgggtggggattgttgtcagcgggccctcctcttcgggtaagacgcagttggtccttcgcctgttggggcatgcccgcgagatgtttgatcccccgccgaaagtgataggtaagtccccaatgccatgagtaatgagcagtccccttgggtttagtttgggcttacggtgagtactcctcgcagatccccgagctcgagaggcagggcgtagtcccgcacgctggtcctccctccgaagaaatgctgaaaaagttgccaaaacccttccttattgtctacgatgacctcatgggcgacattgacgcgaagaagttggctgatctgtacaccaagaagtcccaccacaacaacttttcggtgatattcctcacccaaaacctgtttgacaaggcaatgagagtgccaaggtccaatgcgcagtacatctttctgatgcgtgcgcccagcgatatgctgagcattcgtaatttggccagccaaatgtttcctcgcgagcaagggtttctgatggacgcgtacaagcaggcttgtgccgatccgtacgggtatctgttggtgacactacacgcaaacacagacaacctcttacgactgaggacaaacattttcccagacgacgaagaaaagattgtctttgtacccaaaaatggttaagaagcaaatggtcggacagcgggtgttggacaactacgagtatctgaagtcccttgggagtacgacatctcacaagaagaggcgtcatttgttgagcagtgcaggttgtgaggagctgctgactctggtggagatttgcttaacctacttaacggatccttctgtttgacgcggaaacagaaacaaaaattgttgccttttgctaacaccatttcgacggtggcacgcgtg

SEQ ID NO: 23448 - DNA, 2384 bp, Heterodera glycines
atatcgattctcgccctccacgagccgctccaccaacctttccaacttttcgagccgttcgatgattgggttcagtgtgggattccctgaaccttctaacaacttttcaagccggtcaagacgggcgagaatgtcctctccctcatttaatacttttcaaaaaattaaatttttgtaaaaataagtttcaaaaaaatttttttttactgatcaaaaggagtttgccgcaataaattcaacaatttattttaaaatttttttgaaaagaatatcgattttttcatttctttttcttaccattatattgcagaacgaacggcattcaatttatttaaggattgaatttatacaggaaccaatggcgccgccggccccatgttcccaaaaagtttttcggaaaaagcacaacgcgaaaaaaatacatttttattgattttttctcatttggaataaaaattttaaatgctgaattttttgtcggtcaaatgctgcttttgaacattttcaattggtaaccctggccttaaaatcagcttctttttctacctactttacgattttgattatttttttgctcaattgtgaattaaggcttatataaaattgggcagcaatgaacgaatttgcacgtcactgaattattgaattccaataaaatggatgccattgcgttttccattgctatttcatattacattaatgctaaaataaaacaacaatttctccattttttttaaataccaatgaaatattttgttttcggtatttttgctcggcttttttactccttttcctttccgtcaatttcaaatgcaaatgcttcttcatcaatgtcggtaagtttgctgcttctcacttcccaagttctgtagggtgccgtgtcattagttagtcaaaaaccattcccacaggggaaattggcaccaaattttggaatcataataagagttaaatatgaatcaccaataaggacagctaatgccggttaaggacaaaagcacagagtaataattaaacaaattgttaatttttattttaaatttaaattgattttataatgttcaatcggtgggcgaaagggttagttgttcatgtttagaaattactggggtttaatgtatgaagagacctggtgggactcgcggaatttccgagttttttttttggttcgaagttcctccaaaatgtaaaattcaaaaaccggaaaagcttattcggcacactaatttgtaagcaattgtttttcacaaattcgcagattgacgacaatgcttttctcgcctttctgaaggggtggaaaagctttgacaaattttacaccgaagaagtgctgcttttgggccagaaaaaagaagtgttggcccaaaagtttgaagtcctcctcgccgcgcttcattcgttgcgatgggattggaaatgccatcggattaaaaatgaaaaggaaaagtgcaaaaagtatcgcaacttcgcgcactcattgtacgactatctgttccgtgtgtatgcggtttttcccgcggtgaagccaattttcatgcttaaaaagcaaaagtttgtgaagatcggcacattggccgagttggtgaacagtttggaccgaattcggaaattttttttcgatacggaattcgccagaagcttcgagttcaaattgaagaagctgttcatggtgtatttcaagccaaagctgaaaaaagagctgttggaaaacgggaaaaactcgccaatttccccaatacccgccggtttgaaagtgccaaagttcataaattttgatcgcaaattaaaagcaatgcatattgatcagcaatttgcggcatttgttaaggaacagccgaattcggcatctaattcgggcccacttttcaccctagtggtaaatgacccatatggcttcatacagcaaaagttggcacaaaattacgaaacagcttttggagccgtgtattatttgagaatgaattggcactgtgccaaaattggcaagaaatttgacgaatttgggcagcttaagtgccaagaatatcgaaaatatttggacattttgtgtgaatatttattccgtttgttctccggtattcccgcaatgaagccgatttttaagctgaaaaagcaagaaaatgaagaaatttatgcaagtttaattgatgtcattgagaatttgggggaaattatgaaattctttttcaattcgcaatttggccgggggggaaaattcaaatttgagacatttcttgcgaagcattacgagccaattttgttgaatatggatgaagttggggattacgtttcaattggacaattgggcgacaattcacacgcaaaatttggcaaaaaattcgaatttcaaatgaaaaacattgtagaagacaaattgttactga

SEQ ID NO: 23449 - DNA, 2030 bp, Heterodera glycines
tgttggtgtcattcgatagccctatgtatcctctattagcctgcaaaatttcgaaaaatttcgttcaggttcaaaaaagttatggccagaagaattcaaaaaaccaaattttccaacttttttggctcgaactttttttgaacttgacgaaattttttggaattttgcaggctaatagagcatctaaagagctttcgaatgatacaacaatgttggatttggttggcaaagaaaaaagttatagtccaaaaacatgtgttcgtacgaaaacggcctggcgcctacaatttgtatataaaacagaataaatgttaaacgctgataaaaaagtaatagacagggcccggatttttaagttttcaccaaaaacaaaatctcaagactggatataggtatcgggctgaaattttgcatacgtatgcaacctgggacggggcatctgggaaaaataaggattttccggtccggttgctaactgagtaccaggggcttatttcacacttttgcttgcgtttcttcaaataaaataaaaaaacaaaaaaaaccaaattattttttagatttttaggttaaaattagaccaatatttttacaaaataaaagtaaaagatttttttaagttaaagtgttgactaaaatacaaaaaaaattccaggcctctacctataaaactcttctaatcactgttgtaactcttctaatctctgtaaggccaacaaaatttgaaaaacgggcgcgaagcgcccgactgaggccgcaaagcggcctaacaagctaaaaaacgggcgcgaagcgcccgttttgagcctcgatgtggactaaaaacccctaataatttttgaaaaattcaaaaaaatctctccaaccaattcgatcaatttgaatcgcttcacagcctaggtagcgaagctcaagaagcgcgaaggatataggtagcgggctgaaattttgcatacgtatgcaccctgggacggggcattcgggaaaaatacggattttccggtccggttgccaactgagtaccaggggcttatttcacacttttgcttgcgtttgaaggcccataacttttttcggattttaagttgaagtgttgactaaaatacaaaaaaaaatttcagacctctacctataataggaagggctgcagaaattggcaacttttcagtaccaactttgtccaattcagtccccgtcgaataactcattaagctttgatctgagcggggggggggggggtggccagtagacttattatagagctcaatgagctcgatttttcaaattttaaaatttcgaaaattttcaaaaattttcgagttaggcctaaaagtatgttttacagcagagatgtgcagggaagccatggcatataaaagcacaaatgaaagatgccaaaaccattcatcaccaaaatccaaattagcactaaattctattttgcgcccctatttattttaattatttacccttttttattctaaaatataatttaaaatttaattagcttctgcttctcctttgtttggactcgtgcatttctcattgtgaatgtcttcgcatcccttgggtatgtacagggttcccaactctgctgattttgtaagcattttgctcatttctagtggtcaaagctgattatttgatgaaatgctgatttttggaaaaaaatcctcaaaaatagccgtttttatataaaattgctaccaaattttcaaattaggacgatgtgttgtttttgttctgtgtgtatctttttattcctttgaaattttattgcttatattacatatttatactcacccaaaaaagtcttttaccaaaggtaaaagaaaattaatcaccgaatttctcaaataacaaagggttggatctcagccattcctatgaaatatttacggtaatgcagggcctcccattcgtccttgaatggcaatgacgtccttgaaaatgagcacttggaaaacttttaacaagattcaaagaaataagagaaatttttaatttataacatatttggtgcaaaatct

SEQ ID NO: 23450 - DNA, 1990 bp, Heterodera glycines
  misc_feature (19)..(19): n is a, c, g, or t
taaggaaatacaattatantttttgcaaatttaattccaattcctatttatttatattggatttttaatcaattcgttggtctcccgtttttcaattctccattatttttttttgcccccccccctctccttctgccctcccctcgtcgccgctcgcgcattatctccgattttgatctcgtcaaaaatttccttcaaattgcacatttattcttagccatcaaagcgttccgtggcgtagtggttatgcgctcggttcgctctctcagcgctggtgttcgagttaagccccctcgggggatggcgtgtttggggttcacgccttcgaacgtcccccatgcgcacctttgctgagagggacgagcccagctcggacatggtggtaatgcataatgaacccagttgaggatcagtccaagacaaggggtaccacccgttttttcatttttaatcattttctattttcatttgaatattttattttcttttgcgccattttcaaatagggaagtatataatgatacatttcatcaatttcagaattgttttttgttccggtaattacgactttaccggtccagaaaattaatgcagtcatgcttttaccccttttaaaatttaacccgcaaaatatttcgggttcgtaaaaggcacgacgattttttctaaattcgttcagttcaatttcatgaccgaatttaaaggtcgaaacaatattttcaacagtgtgtccggtgtaagaagcccccgggcaccccgaacccttaattatttctataaattttttaatagcattttcacagtctatcagactttttgtccccagacatatcattttcccggattcccataataatgcggtggctttgatcgggcttgtacatttgataactgcggcattgaattttctagggttatacttaaattcgcattcggtgatcatcagagagtttagtttaatcccggtaccgagattagcgagagcaattatatttacgattatcggtttttgcatttttgatacaatgtaccaatcaaatggttgcgcgaaacatgttccctatgaaaatataaataggtcaaataaataaatgttatgaaaaaatgtttcgcggtccgttcactctaattctctcgggggctaccgggagtggtaagacccgttggctattacggtttttaaaacaccataaaaatttaattgaaccaccgcctaagaaaattctttattgttacggtgagatgaatgatagtattttaggattaatcggggagggtgttgagacttttaacgggattccagacatgaataagattaaagaacaggaaaaacccctcttactgatacttgacgatttaatgcttaatatgcagaacaattttcttgatttactctttaccaggggctcccataattggaacgtaagcgtaatttttgtaacccagagtctctacggtcgggacattaaaacggcaagagcgaacgcccattatctggttttaatgcgcaacccttcaggacaattacaagtgaggacactagggtcacaacttttcccaaaaagactgaattatttcatggatgcatatcatgatgcgaccaataatcaatttagctatctcatgattaacatgcacccaaattctgatgaggaattcagattatgtagcaaaatttttccagatgagactctagaaatttatttaccaattgaatagtatataagaatatgaatttaaattaaattaaaaatgtataaatttagctccgaagtgaaggagaacacagcattcctaaagaagcttgcctccaccagatcagaacaaaagaagaacgaattaatcgaaaacgctacagctgaccaaattttagcagtcgttgaaatttgtgcaaatatattgagttttagttttaaaacgacgaccaaacaaaaaagaaggttggcacaatacgccgatttgtatagagaaattgccaaatctcgttcag

SEQ ID NO: 23451 - DNA, 2859 bp, Heterodera glycines
  misc_feature (2852)..(2852): n is a, c, g, or t
ttttaccgggattgaccgcttattttgcatcatttgcccaacagtgtaagcagcaattattaattgaatgtccagcaaagaattttcgtgcctttttttaacgttttagcctgaggattttttgaaaaattcttaataaaaaatgtaaaattttcacaaaaaaatccatttcataaaattttttttctttgtaaattttaaaaattttgccacgtactcctctgtcttgtttttattcacttttcccaatttttgttttttttgccattttcatgccttattaatcgtgccaatttttgtgcctcttttaaattggcgttttcctcagatacaatcggatcaaattgcgctcctatttggcactgatcggctccatttgcgtgctgataagctccatcattgcgctgcttttccatgtcggtgccgagtcaatggctgagctgaaaataacaggcacgattggagatttcatgaaagtgatcgatcaatggggcaagcaattgctttgacaaagattgaaattccaggggagtgtcggagacttttacacaaaattcgcactggtgacgaacactttgaccattggcatttacatagccacgggcattctgatcagaaagaaatcaggcaactgttaaaatacaaaatattttaaaatatttcttcatttttctggtttttccagtgaaaaatgtgagcaccgccgaagcgttcaatcgccgcattttccgctccctttttctgatcatttccgtcaacattggtggctatttcgtgatgttcgcttttctcgtcttcgtcgcgccgcgtctcgacccgatcacaatgttttttgttcgctctgtgctcggcatcgttttgaatgtcagcgcagcgtccaacgcaccgatcctttggctgaccaggtgatcaagcaatcactgatcataaaggaaacacaccgactttgttgccgccatcaattcttgaaaatttttaaatttaacaaaatatgtaccctaaaattggcatttatggacagaataatctgttaataaatctcatccgatttttttttaatttcccctccgcctccatcgccggattggtgtttttacttgaaaagaattaattataaaatgacaatgcgctaattagtggaacaaatcggaggggtaataaataacaaattaaataagcgtaaacgatttgaactcaaattttaaagttttcaatttcgtatttcagcaccgaatatcggaaggcgttcaatttgcactttccattcctttccaaattcattcgcggcacaaatgccaatgttgtggtgccgatgacgggttgttgggctgtcaaagtggaaaaagcaactcaaaagcaaacaacagcagcaacagcgatgcgaaaaaacaattcataaaaaggaccaattgaagcaaatggagaagattcacagaatttgaattatataatatataaaaattgccgttatttaaaatttgccattattgtttggcattcgtgcacatttttagttccgctaattaccagggattttttcacgagaaaaaattattaatatggggcgaaaccttccaaaagagtcaagggccccatgctgagtataagctaactctgtagacataagaaataagcaattaagaaatttatggaaatagcacaatttgtcataatttcgattgttccaagaaatttgaattgaaaataattccgctgaactgctcaaccatttgcgtggactttctgccttctgcggaattggtcacgcaacctcagtctgttggccacgtccataaaatcgatggcattattcagttggtcaatcacttcaaaatttgatgaataattaattgaataagtgttaattatgattttaattgccttggtcatttgggggcatttgcccaggtggcgcaactgctgccggaggcgatgccaccggcgtcgctacgtttggccgagaagtgccgcttatcggtgccacctgttatttgtggttttccaaaaatatattaatcgtcatttggtttttatttcatcatttttatttaattttgaacaaaaaacccggtccttcccttaaattgattttattcgaatgtttattgtcttaattaggcacgaactgtttgcaaatgttgtggccgtcgcatgccgccgaacggtggcgtcattggcattgtcctcgttcgtgccaacagattaagccgttcctgattccgctcgttatcagttattatcagtttttaataaatatcttttaataaatcttttttcattcacttcctctctttggtttttttacttttgtttccctttgccattttcccattgattattttacttcttggcattttcccagtggccttttttctttggcacattctctcccctttggcatgtcccattggcattttcccattggccttttttctttggcacattctctcccctttggcatgtcccattggcattttcccattggccttttttctttggcacattctctcccctttggcatgtcccattggcattttcccattgtccttttttctttggcacattctctcccctttggcatgtcccattggcattttcccattggccttttttctttggcacattctctcccctttggcatgtcccattggcattttcccattggccttttttctttggcacattctctcccctttggcatgtcccattggcattttcccattggccttttttctttggcacattctctcccctttggcatgtcccattggcattttaagcattggccttttttctttggcacattctctcccctcggggggcctcctttttttccacctcttcttccaaanatgcttt

SEQ ID NO: 23452 - DNA, 1840 bp, Heterodera glycines
  misc_feature (48)..(49): n is a, c, g, or t
tgcatagatgaaaaggaggggaccaagaacacttctcaatttcagtcnncatataaggagggaagtgaggggtgaaggtggatggaagaaaatgcaattaaatatatgtacggatggcgccgtgggggtgggaggacggcaaaagggcatccatcgccgcccatggatcgtcgagattctcgaagaaggagaatgagagagaaaagagaagagggaaaacagagagaacgagcagagacgagagattgttattttgtagaggaagatggacaagaaagtgaaagaatgagattcttaaagtattttggctcgagactctcctaccgacatgaagattattaagaaatttcggctcattgacaggaaattttttttagaattccgtttttaattattgggcctcaaaatcccgatttaaaaacgcattcgttcattgtcaatgtgaactccacggtacttttccgttatggggtcgcactttcaaattttaaaaagttaactataggagcgaatttttaggttttaacttattttctgaaattttccatttacaaatcatttggcagataatcatacgaattttaatacaaaaattggaaatgtatctcatttgttaattaacaatcaatgaataaaaagtttgcactaattttaatttattttcaaaaaaatagaaatacaatataagaaaagttacgccgttattttcgcccatatttcgcgattttttttgccccaatttaagtttttcatccttaaaaatccgctccctaattatctattgatggatgtatgaacaaatatctaaatgtaatactatggttggttggccaactattgagaaaatggcgcatcatttttattatttaaagtaaaaaaaagaaagtgtggcctcataacgaaattaaaaaaaattaaaaaaaccagatctttaaatgtgtttctcaaatacctaatgcgaattttgaaaatttctcttaccttttatacttttataaaatgcaattctgacatttttaaaatacgggtttttgtcggccatctccaacattctgtcctcccaccaacagggcaggggttcagtgttccgtataaattttttatttatgtctatgccataaagaagcagatttgttaatgaattcatcaagaatttcgaaataaatatacaaaaaaattgaaagattcctaattccagttcccgaatttttgggtcagatatttgaattccataattttttggcaccctcggtctgtgtgctcgaggacccggggagggcgggggagggaatggcatcagagttggggttaacccaccaataaaaataactttaaaatgggaaaaaatgagtggaaatgggaggcccaagcatcagtgatcgtcgggggaaggcgagaaagatggaactcataaaacttggggtttttacgaggcctagggggggggcattcgctcattagcggaggaagacgcggaatgtttaaatttaaaaattttataatttttcattttttttgccatttcctacgatgtggccgggggacgacgtcggaaattttttgtttttgcaaaaattttgggagaaaaaaaggcgttaccgcggccggcgagaaaatgatgaacaataattaattattaattaattgtgccgtcattttttttttgtagagagagagagagagcaaagcaaattggttgtaacttgaaacgtaataaaaatggactgcccgtccatcaaattttaatctcaatttttttaggtacttttgcaatttattaataccaaaaaaatgctttttttattctgaaatattcattaccaacttttttttatgaaat

SEQ ID NO: 23453 - DNA, 686 bp, Heterodera glycines
aaaactgtatagaggaaagagttatggatcccggaatttatggtggaattgcgcattccggaaatttatgttagtaaaagacggaatttccagtcattatgcagaggaaggaatctgggttccggaaatttatatgtattccggaatttaagaagctatttatgtgaaattaaatttttatgtaattaaaatatcactggttacagcgttggttttctaacaaattacagtatcactaacgcattcaaaggtcatgtattgaatttgaacaaataaattttctatgataaaagattatacagttgtcccagcataaaacataccgtaaccagttggtccgttactgatgccgccatccgtccccgcgattgggccaactttgttggcggaagacatcattgaggaaaatggatgccgaagatgatggggtggtgcgttgattggaggaaatggagaaatgattgatgatgacgacgacccgccagggacaacaatgtcggcggaggacggttttgagagattggcactttaataattaattttaattagctaaaaaattaattgtcccataattgtagttatagaaaattcaaaaatagcgaaattgacaccctaatttgtaagctaagggagggaggcggaggggggaaggggggctgtaaaagaatgaaggaaataatttaaaa

SEQ ID NO: 23454 - DNA, 2308 bp, Heterodera glycines
  misc_feature (4)..(4): n is a, c, g, or t
  misc_feature (69)..(71): n is a, c, g, or t
  misc_feature (183)..(184): n is a, c, g, or t
  misc_feature (190)..(190): n is a, c, g, or t
  misc_feature (282)..(282): n is a, c, g, or t
ttcnattccaatcaattcccttattattccccgaaaattccccgtaatgtcgaacgaagtggacacacnnnagaggaagtgagtgcccttgaggcaatgattttggagacaagcgtggacccaatggccacgctgggggccaaaatgctgaatgggaaggagcgtcattcgtgacgaatatcnntgaganaagtggtgaggaagtgaaaaagtgccgggacaaatgatctcatggagacggaagaaggagagaaaaatgagggaatgccattcgtggcaganatcctgaatgtggttaatgaaatgagtggcacggaaatgccatagaaagctcaaaaggagggttttgggtttattttagatgatgaaatgcagcaggcattggacaacatcgacgaaagcaacgacaccgccggatttgggacttctcatcttcgatgtgccattgtccaagtgcaatcatccatggctgtcgcaatgctgaagcgattcaccaagaattgcccttggtttttcggcatttctaacggaactccgacagggagtgatcgccgtctccgattgggcgacgaagtcgtcattgtcaacttcgcctggaaaagtggctacgaagtcctgtggcatctcgaccaggacggcacttctcctccatggctcaatgccggaaacatcaacatccaagcaacggcaatcaaagccaacatcgccaatccgacgaacatcgttcccaaaatcgggattgtgcttaatgtcaaacgccgtggaatgcgcaaaacgaacgtcatccaaagcctaacggttgtggcacccggcatgaaagttgcacaaagcttaccaggctgggctcttggtgagaaggattggtttagaaccgggcaagctgtgcttgtcgaaacggttgaattaatgagacctaatttgtggaaagtcaatcaaatttatgcactgccgctcaattgcccgtttggccaagtgaatgatcggaaagcctaccatccttttgtggctgttggcattgatcaatccccaattttgcacaaatttccattcagaagaggggattgggatgccaccattgcgcaaggcgaacaagcaattgccgcggcagtcacagcatgtttggacaagctggaggaggacatcctgcggtttaccatcactgccgaacctcaagtggaatatggagcggaagccgacactgccataatcaccattcgacatcgcttagacaacaagcaggaaatggtcgacatgtcaaaaatgtggactgaagaccagccaatccatgtgcgtgtggcagccaaaggggccaaaccatgtgccaccggcttcatcatgaatgttgaacgacaggaatcggaaacgggactcagcattgtcgccaaactcttcctagcgtaccaagaagccaagaactacgattgtgaggaggcatgggaccgaataatggatggggaattgaccgaaattgagcctttgcattctaggaaaatcctaatgcaaagggccgaaaaattttcagttaatttattcactgaaatggcgaaaaacacaacgacgggactcggcacaattatgtccattctaatggcacgccaaggggaacgaacgcctccacaaaattcatgggatgagctattcgtagctaaacaaccagcattaaatgatttaattggaggacagcgagagacggctaggctaatgcttgattcagtcccccgcgtcgtgttcatgcaggcaccacccggcacaggcaaaacaaaagtgtctgttgacataatcgccgcccatctgcgcaccaatccggacgcacatgtgctttttgtggccccgctgaacgttgccgttgtgaaagcagtcgaagagatggccaaaacgatggaacgaatgggatggcgagaggacatgttggccttattttcaggatccggcaaaaagaaatacatgctggagctgaacaaaattggccctcatttgttggctgcagcgttgcgcgcaccccaattgtttgaagagctgaaggatgatcagaaacgcacagtgctccgctacatcaaagcctgtgagacgtcgccaagaactgcgaacgagggaaaagctgcgcaaatccttttgagcaaggaaaagcgacggatcatcttctgcactctttcattggctgaacagattggcacaatctttgatgaaaccgacatgatcatcgtggacgagagtgggcaagcttcatacgtccaactcttatctatgctcaccaattttcccaatttgaacaaattgttggtagcaggcgaccgttgggcagctaagt

SEQ ID NO: 23455 - DNA, 1140 bp, Heterodera glycines
ggggaatgatggaatagggtgtgggcagtcattgagggttttttgaggggggaggggggggagacgaagaattgatgcattgaaaaggatgtttgtatgtcttattcggctggttgaccattaactgctgtcaccaatgttcggcactttctttttttgtagggcaaagcgaaaagcccggggggatttaaaagacgcgcgaatggacagagaaggcaaaggaagcggaaggaaaaaaagggaggggagagaagcggacaaatcgaacgaagagacagaaacagtccaagccaaaagtcaatcaacagcagcaaacagagcggcacattttgcccaccttttggctgaaccgagtcaatctctgggacgccgatctgttgcaaataggccaagctccgtttgatgctgatcagctgaaaattgcgaagtgttgatcaatttgcagagattttcttctgcttttgctttgttcattaattaactaattaattaccgggtcgtcgtccgaaaggagcgcgactaatttctctttgggcactttttggaattcaaacgctgaaaatggggggaaatgggagaagaaggagatggaacatggaacagaaggacgaccttggaattatctgatcaaaaaaaagcgatgatttgctcagttccaatccgaaagtgtattttcccattttattttttccattaaatgccccaaggcaaattttattatttatttggaggaaaaatgccatgcaaataaaaaacatttgttaatcttgcgctgactgattgagtggatgagcgcaattaacttgtgcggcatacaaagttcgcccgacaaatccgtcagtggcggcaaattggcagccaacaaaaggcgattggcccattccgtgtaaatctgcgaaaggacggcaattaagacaaatgagcgaaaggcatttgattaatttaaaaggaaaatacgctaatttatatggaattgttcaccatttgtgtgtttttttctgtttgaccattggccctgacaaatccaatggccatttgaaaaagggaagagtcgcgtgatatcgcagctcatccccgccccggggaccggtcactctcggggagacctttttgcagaggcggcatcggcactccccgccc

SEQ ID NO: 23456 - DNA, 1648 bp, Heterodera glycines
aaagccatttataatagtaaaaaaattcactcattgtcgtaatgtccattgtccaattgtccgcttctgtcaaaatgtgttccctgtccaaatgtccactgtccaaatgtcctgtcatgatgtatgggccgcaaaagtcgggacaattttcagaaaactatagaattaccgttttcatatataaaaacaattgtctgagttgtcggctcaaagtgcacgaatttgttaaagatttaaccaagattaaaaaaagaccaaaaactaactattttgccacaaaattcataataactaaaatattgaacaaaaattattattaggctaatttaaatacaattttcattaaaacataatcaattaaaaattaattttacgaatcatttaaaaaatagatggaaaatttgtaggaataaaaatcatttaattatttttttttgagtaacgcccattttgatggtttttgagtaatgacccggcaccgttttgagcccctttcttcatagcatatgcacagaaaaaatatgttaatccataccaagggcgtagccagacccttggcttcgggggggggggggctgaagtcaaaaattcgatttttaagggtgtatttttcttttttcagccgatttttaggagtgcatttttgttttttggaaatccagaattagaggggatgtattttgcaaaatttttctccgtttttcgccaatttttgcttttttggcatcaatttttcaaaaatatggtaaaatgggggtccggcggtgccgataggcgccgccgggaaaatttttaagtattacaaccctattgataatgcaattgcgaaaatagcgattacttctcatcagaatattcataattggaactaaacttgactattttttctaaattttggtttaatgagcatattataaattattttaaaaaaaaacagatttaacaaaagcttttgtcttaatcatagtataaatttttgaaataaaatgttttaaaattacgaatccatccaaatcaggacaatttcaggaaaaaaggacaaattcacaaaaggaaattaatatattttttttttaaataataattgataaaaatatttcgtaccctttcccaaataaatggaagaaaatgcggcaaaaatgagaggaagaacaattcactgacaattgcaacggatgtcagcaaattattctaaagaaattctaataatattttagtttttcaagaaatcactttattaattttagcatttttgttgtggacgccattttacgattggaccgataaaaaacgacgaaaaaaacgaaatggcactgattgtatttaaaatggcacaaaatggcgcgccatccgaggtacaattggacggaaatgccaagaatgcagccgaaaatttcacattctaataattaaaaaattaatattattagggccaagatgcaaaataaatttaaatattattaaaagatttaattttaaataatttttatactaattttgggttgtaacaattgacaaaaatgcacaaaaactaaaaaaaatcggggacttaacttatgaaagcgccctcgaaatctaacacaaaaaattcttttaaccatttttgaatagaaatttcaaattcttcagaattttttttaaatacata

SEQ ID NO: 23457 - DNA, 376 bp, Heterodera glycines
atggatttgggtacacaaagtgtaaatgacgaaacaattcaaaaaggttgttacgcatgaatatgtcaaaacaaaaaaaagaaactattcatgaatatgataggaacagaaaaagagaacgaactcatgatgaaggtttatatttaaaggcccgtgtttttgatacttcaaaaataaaagtatacaaaattggcgaattaaatgtaatttagaagaattattacaataatatcctttgaattacgcattttgtttcaaccagaacttgactatgataaccagggatcattttttatgtaaatacatgttttttcctggattctctatagcctaattagtaggaaaaacactttattttttgtgtttgcgaacaaaa

SEQ ID NO: 23458 - DNA, 783 bp, Heterodera glycines
gttaggctcttccacttcaaaatcagcgctggccgtgccaaacaacaacaaccgcagcagcaaatgcagcagcaggtggtcgtcgatgtgtggacacgacggaacagcgacaaagcacaacaacaagaacaacagcagcagatgaggagcggaagtggcacttcatcctcatcatcatcttcatcctcttccgtttcattgtccgtcggaagtaaacggtaaaaacatggttcggtgtggctcagttgataaacagttttctcggttggagttgttggtacggtactcaccgggcggttgcaaatatgacccgcagcttagttggttgagagttttgttgaagttgcaggttccgagttcctccttaaaacttttctgtctaaagaaagatggaaatatatttaatagctcagttggtaaagagccatgttttggacttttgcgggttcgagtgccaccgggcggtgcaaatgtaataaaatgggacttgagtctactaagctttagcccagttggtaaagccgctttgaagggtaactgggttcgagtcccactaggtgcaaatgagaattgagatccatagccggggtgttaagcttccgacccattgaacggggtggcactggttcgagtcccatcggaggcgtgtgctactttttgttataattttcaagctcgtccaatgtcagtcgcccgccggtgacgacagcggaagcggaggagcaacggcggcaccacgacgcgtacccggaactcagtgagccggaacggtacacggacgac

SEQ ID NO: 23459 - DNA, 910 bp, Heterodera glycines
acaaagtcggaaatgggaaaatgattgagtgataatgataaaatcactaaacatttgaatttaataaaaacgaaaaattggcaaacaaaaaaatttaaattataaaaatggtcaaaatttatttgatggattcggaggaataaaatcgattttgtaaaacaatcagaataaacaacagagaaatagccctatctaggaatgaatggcatatgccaatgattgcctcgggcactttgggatgctttctttttgcctgttgcaactcaacaatatttcccagccttatatttctttttccacaagagattctgaggaggaaatctcaaaataaaaaataggtaaataacgcagaaattttttaataattttgtgaaattttttcgggagaaagagtgagtgaaagtgagaggacacaggcgcaaaagacagacgaaatagtgaaataatacaattaattcgccgctgcattctctgattcattgggccaatcggacggcccctggcgatttgtgcgttttcaagggctgaataaatttttgctttaatccaaaattgtttgaacatgtaaagaatggattgtatctctgtgatcagtgatcatttgcctgcgggcacatcgatcactttcttcttcgctttgaaccattatttttcagcttatttttatttgtgttgctcaagcaacggtggttcagtggtagaatgctcgcctgccacgcgggcggcccgggttcgattcccggccgttgcaattcctttttgcttttattttactattttttgttggaaatgacctgctaaagctgattttattagcaaattacattaaaaatcccagatttttagttttacatgccttgattgcccatttagcaaattaacagtaaaaaagagaatgaatgattgatag

SEQ ID NO: 23460 - DNA, 784 bp, Heterodera glycines
aggaagaatgaccttccttcccagtggcaaacctctttcttgtgctcttcttattaacatattatcaacattcttatatgcatcagccaaaatctttttctgattactctttatccaattcattctatctccttcaatcttaacatattcatcaacacaatactgttgaaagagctttccaccatacaaaatcgggttaaactctctttctctaattgcgactgtgtagcacacatattgcaatctcgttactcttctgttactatttctatgcttcatttcagggtcccaaccaagcgtaccacgcggataaaacagcgggtaagtcattggagtcaccattgaatctgtactcttcaaaatcttcaattcctttccacgttctctcaccacaatcttggcattaggtacttcaccgtcagccccaggtacataaactgcagcaacttcattcgctcgaggtacattgtaccccaaacgtctgtccaattgccttccggtctcaaacaaaagcttgatctcggctggctctctgttctcagttctggctctctcaacttcttcgtcttcttcttctttcatcatcatgtatgcttcagcaaacggattcacatttctaatcacttcatacgcagttctcagcaattgaggttcaatacctacattggcatgcctcattgctctcattgcatgctcagtatctacgatgaaaatctgcccataagcaggatcatcgccttcttctggattcaaagccaaattcattctatgataaatctgaccg

SEQ ID NO: 23461 - DNA, 852 bp, Heterodera glycines
tgctgctcattttcgaccattcattcctttggcaaaccttgattcgttacggtagctcttttacagtatgcgcttagcgcttgaaaacgcggaactttgtggggtaatccgttggctttcgtcttacattagctttctctccgtctgctttcgtctgtttgtctatgccctcgaccgatgtcatcccgaagaagcgcaatttttggaatggcaatgccttcggcacttttgcatcattcgcttctcttctcccttttcgtcgtcactcgccttttaatgcatttctcagcatttgtcctataatacatttacgcacttcctgcgcataatccaacaggtgtcaaaaatggccaaaacttatgccaaatgggaggggggggggggtcagtcgcttttaaggggggagggagggaggaaagggacggcatttagctaagcaaatcccctggggcatatgtgaaacggtttttggtgccaccgcccccgagggtttgcccataaaatatcggtgacgacggagcgcaaaaacggagcggaggatttagggaagaaacagtcggcgagtggaatcactttggacgacgaacgaactttttaagacgaaagcattggccattgagaaacgaacaagtcgagaatatctctcgagtttatactgtcaaagcattactgtacttttataacaatattattgttcagaggtggggaccgaaaattctgaaaaccgagaaactcttacaaattacacccaaatgataggcaccccttaaaatacattgaaattcgtttttgacttccaatcacttttccgatcaatttctggtcaattttcagatcacttttctgatcgct

SEQ ID NO: 23462 - DNA, 1569 bp, Heterodera glycines
  misc_feature (63)..(63): n is a, c, g, or t
attggactgcaaaaaaatcaattttcctaacatggtctcccttaatccggtttcgcaaatcgntacaaatgagccggcttagaaaaacaatctttcgctttcaactgatccacaaaggtgcgctcagaaattttgggcaacacgacaaagaagaggccattttccatgttcttctttcaacttccagtaatagaaaatacaacagaaattaaaaacagaaattaaaaattctcaagaaaattaagtttttttgagtccggcggtgcttgccgtcggaaaaaaattgaaaatttctatgcaatttattaacataaattgtacaaaaattgctaattttttggaaaaaaaactcaaaaaaattccgaaaaattccgacttttcatcaaaaatttcggaagtcggaattccgaggccccaaaaattttcggaagtcggaagtcggaattccgaccccaaaaatgtcggaactcggaattccgtgccatccctgatataaatggcagagaaagcaaatggggagacaaaaatagtacataacaaagaaagaaaggaaaagagagagaaaaacaaagtgaaagaaagaaaattttcagaaatagtgtggaaaaaagagagaaaaggaaataaagtatacgctcttggctggttgagctaccctccccttcgcttacaaccataccacgttgaaagcacgccatcccgtccgatctggcaagttaagcaacgttgggcctccggtactcattgggtttgggtccgcttttttgatcaaatttttcaaaagcgtaaccagacagtcagacagtgcactatttccttctttatttttctcacttcttcccttttcccacacacaatgctgctgcacagcgagcacacggctgtttactgtctacccttccacccgccgcagccccacgtagacagacagtgcactatttcttcctttctccagtggctatgctgaagaaaagaaggaaatagtgcactgtctgactctctggctacgcttttgaaaaatttgaccaaaatatgggatacaaacccaattagtaccccaaaaattattaacaaaaatgcaatacctaaactaccaaatccttcatttttccaaggtttttttttgtgctgctgtactatttattaaacaactaataatgcatgatgagttgcatccgccgccggcccatcgccagtacatcccgggcaacggaaacggcaacaaattgaaccgtcgcctggaaatgttggagcgtctgttgcgcgcctcgggcggcgacgggctttgcgcccgcaccaactcattgcgccaggcgttgcgtcggaaccgaagcgacatggcggacgacacggccaaatcgttggacgtcttacgccaggttgttaaagggtgtaaaatttgccatgacaaattgaaaaaaatgcctatatattttcttaattaaggctttcctttttgttaaagtttaaataataataaaaaagattgcaggttttccaagctgatctgacggaagaaattaaggttttccgttttttcattttttctgtcaaattttgtttttaatt

SEQ ID NO: 23463 - DNA, 829 bp, Heterodera glycines
tcagtataattccacttattcttgcacgcgtcagaataattccgcttattctggtacatcagaataattccgcttattcaggtacatcagaataattccgcttattcttgcacgcgtcagaataattccgcttattcttgcacgcgtcagaatcattccgcttattctggtacatcagaataattccgcttattctggtacacgtcagaataattccgctcattctggtacacgtcagaataattccgcttattcttgcacgcgtcagaataattccgcttattctggtacatcagaatgattccgcttattctggtacacgtcagaataattccgcttattctggtacatcagaataattccgcttattcttgcacgcgtcagaaccgctattctggtacatcagaataattccgcttattctggtacatcagaataattccgcttattcttgcacgcgtcagaataattccgcttattctggtacacgtcagaataattccgcttattcttgcacgcgtcagaataattccgcttattctggtacacgtcagaataattccgcttattctcagtataattccacttattcttgcacgcgtcagaataattccgcttattctggtacatcagaataattccgcttattctggtacatcagaataatccgcttattctggtacatcagaataatccgcttattctggtacatcagaataatccgcttattctggtatatgtcagaataattctgatactccgatacacgtgagaataattctggtttttccggtacatatcatataaccggaattattttaatttttgt

SEQ ID NO: 23464 - DNA, 858 bp, Heterodera glycines
tttttttgggttttcggggcagtccccctgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttctggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttatttttgttttcgggcagtccccctgaaccgatgcgcccagatttatggggagaccggatccttccggaatagcttccctatagcctgtactttaattttgcgttggatttttgctccccaaatttgtttgagtaccccaaacggacactttgaaaaaatcgattttttttgtttttcgggggagcccccccgaaac

SEQ ID NO: 23465 - DNA, 115 bp, Heterodera glycines
ccaacaccaagctgttcgcccgcgaccgcaatgtctgcgcctactgcggcaagctgtacgacgccgcgcacctgacgcgcgaacacatcgtgccggtgtgccagcagggccggga

SEQ ID NO: 23466 - DNA, 860 bp, Heterodera glycines
ggaattgcgcaaatggcaggtgaaattcgaaaactcgatttgataacttaaccaaaaccctatttaataaataaagaaattttgtttggatggcaaagagcaaaaaatgattttaattagttcggcagaatatcattaaattaatgcgtacatttttagctatttcgggtgctaagctaatcagccgtgcgaattggacatgtgttcaatttgtataataagcttcgaacatttggtccatccctttttgttaatggtggcaaatatggtaatggggggatggaggggaaagagaatgttccattggcaatatttgctgtttcaagaaggtaaccaaaattggattaggcctaaaatgagcccttaaaggctattaaaaattaaataaaaggagaagaaggaagggggaaagttaacagagaggtaacagagtaaggagaacaaaaattaagtaattaaaggaacccaattaggtaatgaattaacacgcgtattattaaatattgtaataacagaaataatttgttgttgactctttacgaatgttatgcttctgttaaaagccgtttattgttatggtgttgatgaatgtgagggagtaaatgaatagaaagaaggaaaataattaaattgcctttttggggtggaagaaaatttgtagtgacagaggggggagagagagagagagagagagagagagagagagagaggaggggacggaaacggggaggggagagaggggaggagacggaaagcggggggaggggggatttatttaaaaaagtgaaaaaaattgtaaaaagggcacgaaattaattaaaactataatcaaacacgaacagagaaaagattggttgggg

SEQ ID NO: 23467 - DNA, 1015 bp, Heterodera glycines
tggctcgggcttgcgtcggacggcaaaattcacctaacttttctgaaaaacatgacccattggtcattttaagcggaaaactttggaatcctccattagatttttcaggtataaagaaaggcctgataagttttttctggaaaaaggtctaaagaagttagttttcctggataaaggcctgccccccccctctttcttccgaaacctttcaactgtgaacactctctctgcgcgttgacttggttgtccccgttgcgtacacagtggtggtcaaactgtgcccatgtcatgttcgttatctcttcagcggcgtcataggaagacgggttttggtagagaaacgaaatgaccatcagagaagcgaagaaataggcgaagagaagggcccacacttttttggagccattttggaacactgacaacaacaaaaaaaatgtgaatttttttaatagaaatatgtaattttgacatttgttggatcagagccccccgggggcttttatttttcaacccttctcccctcaaaatgagagttttattttaggggggagagggggctcaaattcagtaaatgcggtttttgttggactgcgtattacgtttgaaattgaactgtttggcgatgattgaatagcattttcggaccaggaaaggcatgacgaacacgagcacagtggcggacactttcagcgcggttatctaaatgcacatgaaatcataataagaaaaagggatttcaaaaaattctgggcctggatccggaaaagctacatggaatggatatctggatccatatccgggcacgttttccaacaagtacccgggtttgaaatccaaacgggtgcactttatttcccccgggtgcactacgtttcccccccgagaaaatttttaaaaaaaaatttctcgggggggaaacgatgcgggggggaaccgagctgggggggaactgatacggggggggggggaacggcgggggggaaacggcgggggggaaacggcggggggggggggg

SEQ ID NO: 23468 - DNA, 1234 bp, Heterodera glycines
aacagtatacagacattccaatgaatatacaaaatataaatttaatatgttttatgaattgatacatactatctaattattaacggattgactccaaaaggtcctgcctggtctagtcacagcaaatttcaagattaattattttaaaaataaataaaaaatttaaaaagtaaaaatttaccatttaatgtaaaacaatatttatatttataaaaaaatattaattagaaagaaatctacatattaaatgctacaggaagggcctggtatgaggcagcagggacgaaacatgagaaaaattgagcaattgcaacataaataatggaaagaaattaatatttttaaaataaacaaaataaaaaagtaaattttaacagcatctatatcaacctttttaaaaatcaaaaaagcaaaaaataagtttaagattcatataatggacatagaaaataaccaaattttttcggattaaatcagctttgaccccaagaaatcaacaaattgcttactaaatcaccagagttgggagccctggttttatggtaattgcataaaaattattgtttacgcaattttttctaaaattcaaaaatggacaaaaacaaaattgtgttaatgaatgaggcgaaattatgcatcttttaaaagaacaatatgagaatataaaatcaatttattattcaataaatcaaaatatcaattaaaatggttctatttacttaacttctattttttgataaaaaaccaaggcatttaaagaagaaaattaaaaataaattagatttattgtaaataaaaccctcaaaaaataatattatcatttcatttaagaaattatgtatttttattgtttttctatattttttttgttaaaaaaacttacggtaatcttttgaaaaatgatagaacaatttaaaagaatataattgcaatttgaattttaaataaaaaaatcgagtttaaatgaaaagttaaaaaaaaacttatagaaacaacatttaaattacgaaaattttttaatattagcaaaaaaacactaccatctctaatatgacactggatacggttacaattatgctcatataaaagaataaaaataaaaattgtttattaaataaaaataaatagataaaatcttatacaaataacttttaatgattaatgttcaaatataatttattaaatctttaaatcgaaataaatatttagacctttgaataaatcaagtctatat

SEQ ID NO: 23469 - DNA, 986 bp, Heterodera glycines
aaattgcactcaaattttaaaatttttccccggcggcgactatcggcaccgccagcacccatttttcaacggaaaattcaaaataaatttttagtgcttttttaaatttaaatcaagaataaaaaatccatattatgataattatggtttaattaataaataggctaaaatttgcacttttactcagcgtcgcctaagaccactaatttttattagctcaaaatgccaaatttggtaattttttggtgaaatctgttaacaaataacactcaaattttctaaattttccccggcggcgcctatcggcaccgtcggcttttgattcataatttttcagttgaataaatgcaattatttcaaacgtaatagtaatttttcataatttttaagaaataagaaaatttaaaaaaaaagtaattcccctccaagtagttgtttttcttctaatttttcaaaattattcatttttcggtgggaattcaatcataattttaacaattaaattcgtaaaatattttcattttttggactaaatcagttaacaaattgcacttaaatcttaatgaatttttgttttgtgcgtttttgaaatgataaatattgtaccaaattgaatcaaaattaaaaaaaaaaaccaaaaattagttaagaatagagtcaaaaaatgtttttaacgatttttaagcgaataggaaaattttttgaaaaaagtctcgagtctcgggttttttgggtctcggggttttcggtctcggggtcgagtctcggtctcgagtctcgagtctcgggaaatttttggtctcgaacagcactattattttccatgcaaaatttgtcaaaattggacttgcccttcaacaaatactattaatatttcattttcaggctaaaattattgttatttattttatataaagtttttaaagcattatattttgctggtccgttttttgcgaaaaaaggcaccgaacttttttaattaaaat

SEQ ID NO: 23470 - DNA, 217 bp, Heterodera glycines
  misc_feature (12)..(12): n is a, c, g, or t
tataataacgcntgcggacatctacatttttgaattgaaaaaaaaattggtaattactctttctttttctccatattgaccatcatactcatactcttgatagtttaaactgaaggcgggaaacgacaatctgatccccatcaagctagctgctgcaggtcctgctcgagcggccgcccggggatcgatccccgatctagtaacatagatgacaccg

SEQ ID NO: 23471 - DNA, 1352 bp, Heterodera glycines
  misc_feature (1338)..(1338): n is a, c, g, or t
tgtcgtacgtccccaggggctgcatgcaaattacggctttccataattgaaaaccctggtcgggagaccgatcagggttttgaatttaaaattttttggcagtgttttcaagaaatcccctgtttctgctgctctcttatgaaattaattggacgggcattttgtggccctctcgaagaagtacaaccaattgtcgagatcaaaaacctctcaaggccggtaaatgtgaacgagccgagctgtgttggattgttttggcacgttcattaaaagggttgggggtcgaaaagcgccgtcggaaaagttttcaattcaattaatttgttgcttgcggaaattgggcggctaaaaagggccaacataaacccaattaaaaatgaagcaaaaagtggtgaaaatttatttaataaataatttgttacacttttaaaatgtagaacataaaaggtatctcgcccggtgggactcgaacccacgtccctgcaatccgtgccgtgctctaaccaactgagctacgggcgctcctttaagcggttttcccaaaaattcaaaaataggatatttgatccttttggcgatcctttccaaaattttatttattttttctgctttaccacggaaacgcttgaaatgtgattagtttgcaatgttcaacttaagaaacattctattttttgagtttgataaaatattttcttaaatatttttacatttttcttaaattatttaaatattttaaaaatccgggctcaaattattagtaaaaaatccaaataaaattttcaattaaatgaaattttagaaaaatgtaaaagttataaatataaatggtaaaaaagggtttttctatgtaaaaatgcacataatctgtgaatgtgaaagtgcttattgttagaaactaatcagcggacgaagtttaaataaattaataaatataattaatatttattgctttttgctagttgatcagaagcagcaattgatcaatgaacaaaaatgtggagaattaattaattgtccatcggcggagtgtacaaataacggcgatggataaaattgtatattaattgtacgcaaatgacatgataaatgtcatttttgcattgtataattaattctctccaaattaattataggaaaaatgaaactatacaaataaatactagagaccgagatttccagatttgacgggacggaatgagaattccagaatgaatcgtaagccgaacattgcaaactaatcacatttcaagcgtttccgtggtaaagcagaaaaaataaataaaattttggaaaggatcgccaaaaggatcaaatatcctatttttgaatttttgngaaaaccgcttaaa

SEQ ID NO: 23472 - DNA, 1041 bp, Heterodera glycines
cccctcggtaacgggcctgaataaatattatttttttaattttattactatcatttccaaaaatgaaggtgtcatacgtgaaaagtttggacatttttcttggcgtctgctttttcattgtgttcgcctcgttgttggaatatgcaactgttggctttctgatgaaacgccgacggcaaaaaagttcgtccacctcctcgtcggtgatgccacgctcatccaccgtttgttttcgtgaattggaggacggcacgctgaaaatgttggcaccaatgcatcataatcaccatcaagtcaataattaattaatttcttattatttttataaattttatggattagggatggtaaattgacccattttggaattcatttgtatggcaattattaaaactatgatacttaaatgtgtcgggattattcttgggcccaaagacataatcccgaattcccatataagtaatttgagagacggccaagcactaggcctcgagtcttcatttccatgccaggccggaaacattttcaaaaattttttgaaatttacaattcgcagtttttgccaaaaaattttcaaaaacccaactaaattttttctgcggcgttttttttataaatttttttaatgcttgagttttttattaataatattttgacgataaaccaatgtttcaaatccccaaaaatgtaatccgagagacggccaaaattttggcatcgaatcttccagacctggtcaggccggaagtgtttttttgaaaattaaagtcacattttttgccaaaattatctgaaaatccaaataaatttttcctgcggcgtttttttataattttttttttacattaattattttattaatgttaatatatgaaaacttatttgcaaaattataaattttcagcaacgaatgccacccgaacgaaaacccgcattggggcgccaagcgtccacaacaccgccggcacgtaaaatgtcaaccgtactcgcatcagtaaactttcgacaaataaaaatgccaaattttcgcgaaaatgccaa

SEQ ID NO: 23473 - DNA, 1318 bp, Heterodera glycines
cggatgttggagagttttatgtacgcgcgcaaattccttcgccctggcggttagtaaattgttttcaaaataattttctcttttcaaaaatcataccttacaaatgtgcacaccattaattaggaaatcgaattgcaacaaaaaatggaatatttggcatatttaaaaaaattgcttaaaaatagctttttataggttaagataaaaaaaaccatttaaaaatagccttttctggggtaagcaccaaagtgcaaaatggaccttttccataggctcaaaaaaatttttctccactaattaaaaaaaaattaaatatttttgttgcggcgaaaatttttttagcaattttttccgaccaaaaagtacatttatatttaaagaatttaaatataacacttaaagtcgttaaagcgtcccagagatgtcggtagacggcatcggggaaaattttttttttttttatcccgctttagaaaattgcattttccagcgcctaattttcatgttttatttattttttgcattttggtccctttaaattttaaaatttttctagcgattttttggaataattctctttaaaaaataactagtaaatccagtgataaattgcttttaggtcgtatgtttccgactcgtgccgatttgcacttggcactgttcacggacgacgcgctgtacgcggagcagcagcagcgggccgccttttgggcccagcaaacgtttcacggtgttgcgcttggcgttctgcaagagccagcgctggacgaactgttccgacagccagtggtggtaagaagcagcagaacagagaccgacaaggccccccccccattattgacgacccctaaatggtcctattaatttttcggacgggcgaggccttccggtttaaaaaattaacaatcagagtcccgtactaaacacttttctaccgaacctttaatcatttaatctaccccattttgaaaaattggggggggggagagagacgatttgccgccagaattattttatgtgggaaaaaacccttcatttttattgcaaaaattgtataacaaatctcgactaataaatagtacacattatttttgtataggacgcgtggagtggtgccattttggcctcgccaagtgtcaaatggaccgtgaactttgagcgggacccggtggagcggttgcatcgcattcagataccattcacggtcagttttacaaattcgccggcgaaggggaaaagaaggaaatttctgaaaaatttggcttttttctcaacaaaatttgctagaaattttcattttttcttctggcggcgccta

SEQ ID NO: 23474 - DNA, 962 bp, Heterodera glycines
taaaaaacgtcaaatatggactaaaatgcccgaaatatggtctaaaaagctcaaaaatggccaaatatggactaaaatctgacttaaaattactccaaaattttcataaataaagaaaattaaaaaaaaaatttattgaaattcaatttaatatggggtttttaaaataattttcggtgttacctcctcaaccttccagttaatgtactgcttgttgaccccaattctgttactgatccatcaattccacccacgtcgatgctctgccgtacctaccagtcaaacccggacagacagcacaactgtccatcgccccactacaaacatgtgaaaatttaatcctttctcaaggacattttgaaaaaaattcgctaaaaatttttttcaaaatttctctttcttgaatttttctttttcgagaggtggactaggtttttcttcccccgataaattaaaaaaacttgaaatcttgtttttttttgtaggtgatcgttacgggtgcgcgcgagcaccgcttgccgtccgcctacattgaatcgctgatcaacaacgtgccgaccaacggctaccgggggccgatcacgctcaaactgcgggccatccaacacttgaacgacgacaccaccgccataaacaacaccaccaatgctgatgctgttgtcatggaaaatgatgaaaatgttcaacaacagccaccgcagaacaagaatgatgatggtgtgaatggtgatggggttgttgtgttggtggagaatgaaagcaaaacgatggatgtgaattaaaacaaaataggaattggtccccatttttatcgctcaaaaaatcggaggcgtgtctaatcagtcaatcaactaacaaaattatgaattttacggcagagattttgtcatattcgaccagggtgggctgccaactttaaagggaactgaaaattttggcttttatttttttttacgagtcaa

SEQ ID NO: 23475 - DNA, 701 bp, Heterodera glycines
cgtgataggaaattgccaaataattagctaatcattatttatcaacaatttctgcatttaattgcatttccaccaaagcattgcccgataaatgccgaaaaaagcatggtgcccaacatgggcaagcagtactttggtggaatggtgataaactgatgtgccgagcacggcaaacgattccaaataattattccctgacttctaatgcaatagatgtacggatgagtatgcaaattaattaattaatccattttattaacataaagccccaaaaggaccattcatacggtagaagctcttctctttgagcgacaaatgcaatttaattaaattgtaatttgataaaaaattgccaaataattagctgatcattattaggaaaaaacggaaaataacaataaattgtggagtgagtaattcagaaattcacaaaatgaaaaaattcaagtcacgtatccgcacccgcataataaatttgataaaaaattgccaaataattagctgatcattatttatcaacaatttctgcatttaattgcatttccaccaaagcattgcccgataaatgcccaaaatagcaactgcccttttttaaatgcaaggacattatgccaaacaatttcagaatatacaattttgtttgctttctcccatgttttcaactttttcatttttgttcctgtcgttaacctttttacttt

SEQ ID NO: 23476 - DNA, 976 bp, Heterodera glycines
  misc_feature (909)..(909): n is a, c, g, or t
  misc_feature (959)..(959): n is a, c, g, or t
accgaatgcaattctttcatcttcagaaataatgtaaaattatgtcaatgttattcgggagttattgcgaaaaattacaaaataattaattaaatagtattgacttaaaaaaggcaaaaaaatgattaaaaaataataaccaatttttattaggtttttaattgaatgaaaataactttttctgcaactaaaattaacaaaaatgcattttattcattagttttgctaattaaattcatctttttgagttcattctcattaaaagaaagcttcagagaaaacccctacctaattataataatattatttaattaattatttataattaagaaatatttgcatttgaatttaaaaaggtaatataataaatagtaccgatggatggtaccgccccccccccccgcctcatcaagttttgtggaatagctcgaattttactgaaattgaaaattttcgactttttgttcgaatccgggttggttcggaaaattgttgtttaactttaaatatacaaatatatttaaataaattattaattttacaattataatatattattttacccattctttgttttttgacactgttcccaaatcataagcaattatttctgtttacatccaaatttgtcttttaaatttgcaattagtgtccgaagaaaagggtaatatttttcattggcggctgtgacgaacacaaattttggatggccagggtatttgacatgaaatttaaaaataattaaatttcaaattttaaaaatggataccttaattttctttttaattgcgtatttgtctgaaagtttgtagtgatccaaaagccatgttaatgagcaattaaattttctgccacgaattattcgcgagtcattcattttcaaagtgtatgccatctaaaaataaattnttaatgggcctaatatagtcattgattagtagggatgctatttttaggcnaatgcccctaaattttt

SEQ ID NO: 23477 - DNA, 898 bp, Heterodera glycines
  misc_feature (7)..(7): n is a, c, g, or t
  misc_feature (872)..(872): n is a, c, g, or t
tagattntggtcaacaatgaaaaaaggtgtagtccaataattgggctggcaacgaaacggcgggcaccgaaccggcgggcaccgaaccgtcccctaccgaaatttaaatcatatcaactgatttgaaaatatttgaaacttaagcgtatgtatttgttaggggtgtatttttccaataaattacccgaagttcgaacccaaaaaacgcgaagttttcgaagctcgaagtttcgcccgtccctggtcactgcggaaatgaattattcttttctattaatttaaaaaaatgcgctgatttcgaatctgagcccggcatttgaaaacattgattttgtctatgtttttcatcgagtacttaaacttcttaaacccctagggggataacaccgcattcgcccctcaaaatgtcctccgtccgctccatcagtagcaccgctcgtgctggcaatgtgctcgtgctgctcgatttgtatgcctcggggtttgcctcttcaaacacttcgccaactattccgatgctcacttcccgaacgatgtaagtgccgacggagagaaagcagagggaaagagtgccatttctgatcagagggaaagagaggccataacaaataactccaagctgctttttcccttctgttttatttggtcttccttccttttacatttcttccctttttcacccttccctctctcttttcggcacactctctacgccatttctatgctcgtctactcactgaactcccttctcaattgggtccacatttattttgtcctctgcggttccctcagctctttccccctcaacttttggcttgctatgcttctcgtcatcgctttctatttcgggcactatgctaattatccttctngatgggtaattgcgataattgccttt

SEQ ID NO: 23478 - DNA, 917 bp, Heterodera glycines
  misc_feature (822)..(822): n is a, c, g, or t
cgcgagaagggcacgcatttggtgcagtcgccggtgtccaccgcaacgttgcgctcggacgtggaggaacgggtggacaatgtggccaaaatggtgcacgaactcgagacaaaattggccagcatcagaaaagcggcagaggtaagcacattcgagaatttcttggattaacaaatttgcaccattttcttctaagtccattaattatgcataccaatcaccctcgaaatttgcacacatttctctcattttgctgtttttgtataatttatttttcggcattttttgtccatttcattctctttcttttcctttttgaaaaggcttcttctccatgttgttgctatgattgtttcattttatactaattttgacatattttcccaattgaaaaaccaaaaccaagagttttttttgtttgatttaaattcccgagacttttttgattcaaggctcgagagttttattgggtcgatgatacacaagaaaattaaggcctctcggttttacaacaaattttatgattgacactggtcctaccaaaattttgttagaagcgcgcggcgcggcaaggtcatctctttgttggaccatcgccaattagcggcttaatccatgacaaaaataaataatctctcttctgttattcctctcgctaactattgtttgctttttgttgttgcacctcaaatctcaacagcatcatgatcatcatcagcataattgtgatcaattatagaggtatatgtacctcaatcatcatcattggatgaggtaatattaacgagcctccccccccccccccccccgcattttctgccnggcgatcggcgcgcaactgtccgtccgcgcgcgccgcaccgcgccgatggacaaacaaagcaaacacccacacattttgggtgctcatgatgctg

SEQ ID NO: 23479 - DNA, 1023 bp, Heterodera glycines
cggcacttcacaatgcgtaccaacttgcagtgatgcacctgcatgccttccagccggccaacacattttttgccgaaaattctgtggagttgcgaaggaatccaagcgatacgattgttgcagggccgagttgtgcacttgccggttttgtggcgcttatttctttggcaattggccgttcacccgaacgctttggtctgacggggtgcttcgagccaaacggaattattagccaagttggcggcatggaaaagaagctaatgaggctcgtccattctggaatcaataatgtattggttccgaatgacaattataagaagcaaatgccatccgagatgcccacgatgccggccatgacttgggtcccatccctcacattgacttttgttgtgcatatcaatgagctatggcatagtttgtttcctcttttcttggatgctcaatgaaatatcaattttaatttgttagattattttattttttttcgatacttctccacattttgtgttttgtcaaaatggtgaataaattctttatataatatggtattttaatttaatctccttctgttcaaaaccattggaatttaattttttaaaagaaacctaagttgtgggtatgactaagtccgaaaaccttggcaagaattgtatttcgctttccttctattaatgcttttttatgtcctatactctttgaataatcatcaggtcagagaatttaattgatgataaatggagttaacaatttcaaaataaacacgaaaattaagaattattcattttttaaattgttttaccctataattaaagggtttcctttttaagacacgaaaaatcgcaaaataggcacaaaaatcctcaaatcaagaatagccaaataaattttattaagccttttaggtagcaaacacataaaaacttaaataaatatttttattttttcgagtaatgagaaatttattaacccataaatttttattaaaaaaaaaatagttgaccaaagttatgtttggaaaatttt

SEQ ID NO: 23480 - DNA, 849 bp, Heterodera glycines
ttgtatgattttatgattatttaactcttaaagtaaaatttctcatttttttattttaaaattactaactaactaataatgcatttttaggagcttaggttttttgtgaaaaaatttatttgatctgtcaaatgataaatgcatcgagtgattcattcctttacaccgctttattttgtcatcgcttcactattattttcaaaaaaattatgcaataataattcactaaaaataataataatattttttaaattttacatattattaaacaaaaatataaaatcccaatgaaaatagtcaaaaaattattcgaaataaatttggaaaacgtacctttcaatgaatttaatgaattaaacctgatcatccttttaatcgcttttaattaattttttaattactttttattgtgtacgccacgcattaaattaaatttggtctttcagctataaaatttccccaatgccaagcatcatcattacggccacttttgtagcggtggtacttttcacttgcgcttttttggacctttgccatggtaaaaaaacattttcaatctcaatatatttaattgcttttttaataaagcattgacttgcaaaagccgttcgataatggagaaaaatggcaagcaatcaaaagattctgttctttgtgagaatggccaagacgtttgtcgtgcgttcttctgcgtagcgagtaattaaaaataatttttgtgccataagttttttttgaaatttgtcaaattaatgaaaccgatccatgcaatctggccgattgtaattaaattactaattataattatcacagaccattcccttttattcatcctaatgggattgtgcg

SEQ ID NO: 23481 - DNA, 1487 bp, Heterodera glycines
cccccccttgtccacctatgcggtaaagcaacattgtagcattacaagcaaaaagtctaatcggtcaaatcatcttcagataacatgttgatcgcaaaaaatggacatatcaaattggcggactttggcacgtgtgtgaagatgaacacggttggtcaaaagcagagacggaaccaaaaaccccactgacaatgaccgttttataacttaattttcaaaaaaataaataaaaacactcagattatgatacagaatggtcattttccttacaaaaagccaagctgttcctccttccaaccaattcaatgctttcccgtctctcactgacaacattctttccttcccttaggatggcctcgtccgatgttcgagtgccgttggcactcccgactacatcagtcccgaggtgctgcgttcacagggcggggagggcgtctacgggagagaggttgtctgtccggcaaatgactttgccatatgccaatatttcaggtcgattggtggtctgttggcatttttctatacgaaatgctggtcggcgagactccgttctactccgactctttggtcaacacttactcaaaaattatggaccacgaccgacaattgcaattccccgccgatgtgaggatttccgcacatgccaaagacattattcggaagtttctttctgaaccaaacgaaaggctgggcaaaagtggcattgatccgatcaaaaagcacccgttttttggcaattcgaattggactttcgacaccatccaacacggtcggtgataagaagtggaagagaagagattggcattcaaagcaattgccattgtttttttgttttaatttttattctaaattcgcagggttttctccgtttctttagcaactccgccctttgtgcccgaactcaaaagtgacgacgacacttctcactttgaggatgttgagcaggccgaggcagtcaatcccgacaactttcaaatcccgaaggcttttaccggtaaccaattgccattcatcggattcacttactccagtgaacaagggtaaattttataaaactcccttaaatgaaaataagattttcaatatttttagcccattggatgcaattcgaagacaaatctcttctccctcagatgtgccattaattaatgggacaaatcaaatcacaaattgtgccgaaattgaacaattaaaagaagagaagagacttttggaagttcgatttggcgaccttcaggaccaattggacacagtcagttcgacatcgagacaagaggtgggcaaacagagaaaatggaactgatcggacgataaatgatttgatcagattgaaacattgcaaagggacaaaaacattttggaagaaagcgcaacggaactgaaggagcaattggaacgaacgaaaaacgaagtgagacggggaaaagggaaggcaaacggagaaatggtgggacaagttcaggtggaacagctcaaaacagacaaaa

SEQ ID NO: 23482 - DNA, 1746 bp, Heterodera glycines
aattttttaaaaatttttcttgcaattttcttataaaaaactttgttttttttcaagtttataaattataactgaagaggtgatttattcacgcctaaagtgaacaaaagccgaaaattagtacacgatttttgtaaatcaattttgggttgaaatacatgtgagaattagggatgggatttttaggctctaaaaactgccaaaatttgtaggctctaggctctaaaaaaccccaaaaataggctctaaaaatggaaaataggcactaaaaactagagtgaagcgggaccgggaatttagggcaaaaccgggaccgggacttgccgagacctgagaagccgggaccgggacctcgatttttcttcgggaccgggaaccaggaccaaccgggaaatttagaaattcaaaaaaattttaaaaaatttaaaaaaatttaattttaatttatttcaattgaaaataatacaaaattaaatttttattttgtttttattaaataattaaattaatgaaaattttcaatcaaattttcttcaatcatttcaaacaataacggaaaaattgaaaaaatctgtgacccgtgatccgagatcacggcaccccaaaaaccccgtgatttccgtgatcacggccagccctgatcctgagccgcggatcgccaaaaatgatccatagatcgcggatcataattttcccttgtaatgtggatcgtgatcagaggatccgatctatgcatacgggtactggtgcatttgaatcaattatatttagacaatacatgtgaactttggtaaaaattaattctcgaattttgttagaattcgggtccaggtttgcaattgaccaaaactagggctgggcgcaattgcggattacggcaattgcgtggtttttggagttacggattgcggattttgggatttgtccgcaattttgatccgcaatttgacttttggattatttttcgagacgatttcttgcgagatttttttttattagagaccggaaaatttcggggaccggtaaattggacaccggaaaattggacaccagaaaattggacaccagaaaattggacaccaagcagaaatttggacaccgccggaattttggacactaaaggaaaattggacaccggaaaattggacaccaaatttcgcttttaaaaaataaacccaggaattaggttgaaaattaaatggtgtggataaatgattaaggcacttagagtggatcaggcattcggtaggcaattgccctcaaatattggaggggatgacgatcggcacgcgttgcaaatatttcccgaagattttcatcttgctcaatataaagctgtttgcgcttcattcctttccctcgaactccgaacgcaggatttatttcatactcagccatttgtcgttgccaatattggtcttctttccgaataacgcggaggaattcactcaaacttggcgattgtgatcgaaacaatgagttaaggttgcgatgccaagcttcgacactgttattcgtacgaaccaagtcgtcttgtaaactaattcaaatttttcatgtttgacagaaattaataccgttcacacatgttccaaatattcattgggaacaatgcccgacgattctgaaagccttcctcttgaatccaatttcggatgtgctggtcaacaaaaccataagcaccatattctgcctgttgatcaaactcatcaattggctccacctccataacagcttgacaagcaa

SEQ ID NO: 23483 - DNA, 849 bp, Heterodera glycines
  misc_feature (816)..(816): n is a, c, g, or t
ttctctttacaaaccattatttttatttttaaaatgattatgtttaggatttttagttttaattttaactaaatctagagtttttacataaacgttattaaaattaaatataaattagcctgcctgttaatcaaaatgatgaatatattaatgatacctgattttaaaggaccagaacacgtccattgtgggaaatgtggcttcgacttttatttctacaatgtcaagtggcaagactgtctggtggatgcggggatgggcccaggacagtgttggttaggagaggataatatagtaattttttatttttgatggagtggattttgattttaagaaatttgaaataatttaaaataagcataacttttcccggcaaagattgggcgcaaacgggcctaggttttcttttttccaacagtaggtagtgcttgacacttagcaatatttaggaatttagataaatatttatttcccaactcaaaataatgttttaaatgcttacagccgcccggggcgctaggcaaatacaatgaaaaattgctttccgagatggacaaagtggaaaaaatattggatgatccagaacgcctacttgaccaaatagtcggaatcgttgaagatgaagatacaattccgttaggagcagaagtaagctaaatctggatattttaattgtgtaggaccgcatttgtagtgcagaattgtaagaaaaatcttgaaaataattttttaatgttttattattaggattttttgcttatttcgatatgtggaaaattttttggaaatagtaaaactaaataaaaatgaacaaanacgtttaaggcaagcaccctcaacaaagaaaaa

SEQ ID NO: 23484 - DNA, 1051 bp, Heterodera glycines
atacaaaaaatgataaataataataataggcagcaaaattcattaattaataagaaatgaataatggatgagagaaaaagggggagagagagaatggaaagaaaatcggcgaggggagtgggggggggggagattccaatttggaagtaaaagtgattaaaccatcaaaaagccaagctataacagcacagtgatcaattcttcagaaacaagcagtgattaaaatgaagaggctgataacattgccttttcaatcaatagaaagtgatcagatagatttgtgagtgtcgactttagtgcccgatcactttcttttacgaacatgacaaggcacaaaagtgaaatgatcaacatctaatcacaatgccagtccgatcagccaaaatcatttcactgttctctgatcttttaaggatagtgaccagacatttgtacaaacaacaatgctccgttgttgatcagacatttgtgttaattttttgactcgtctccgatcattttccgtcttcagtgtgctggttgatccatccgatcagtccgtccatccccatgcattttttgttgtttttttttgatcaccaatatggcccgtcagtggtcagctgcttccatgaggcgaatgtggtggacgacaaaccgttgggcgagttccaatcgacacggtacgggtcgtcacgatcgcaaatgccggtgccggcgcagcgttcaatttgcattggcgacgaactgcgaccgtaaggcttaaaattcataattaaaatttaaaaaatatatatttttggtaattattaaaatagagaatgtggaagtgaaagaatgaaatttttagggattattaaaaaaaaggactttgcattataattatatattgccaccaccaaaattatgcaaggactttttatcaatagcaaattttcaaaattatctaatttatttatggctgtttttatgatgtcttatttaattttcgaattatcatttgtatttactaatcaattttttttttatttcgcatattaaattgaaaagaaggcccgacgaatttttaatc

SEQ ID NO: 23485 - DNA, 1500 bp, Heterodera glycines
taacaacagtagaattaaaaatcgatctcagtcttctcgtctcgcaacgcacgccgcaaacaacaccgttaccactaacgcactcctaacgaaacgagtccaaatctaggtaaatcacgatcaaattttcggtttttcacttcatcaatttttttttcaatctcatactactttttttcttcgcctccttttcaaatttccatcactcatctaataagaagctcagaaattacattaatttaatttcttcatttcttcatcatctttctttcagaattctttttcacagagaaccggtttcgggtttctcgctccaaatatagttatttctaattcaataactaaaatttttagttaatacttatcactgttgattttatttttaccatttatttttgattgaatatattatttcattttaattataattacaatatttcattgcaactcaacatgaattcgaacgaaatcgcatgtcttaagcacaatagttgtgtaaaaaatattattacataatttattttgtaataatctaattctgttgttcaatgtatgttaagtaattatgtttcttctatatataatatttatgtccatcctataaaactttaaaatttcatttacatttatttgccttatgtatgacggtcgaaatatcattttgaaaaagtttagttcattgtctaacatactaatgaatgggcgcttttatgaatttatcacgaaaactcattctgatggttatcttttaatgataggaggctttgtaataaatctaagccgatgattatttgctattactacaatacctttttgatgtgataaatatattttatttctgttagtgtttaattttacgccattaagtgttgtattttttgtattttgattatttttttaaaatttacatcaaatgtataactattattgagaaatttatcgtttaaattagataataagttaaatcctatattattaatttttgaaaacacccgattgtatgagattataattgtttaattttttggtattttaaagaatttagtggataaattaattgaaatataaatttttgaatatatttaacttgaaataaattttacaatttattatatttgataattaattcatttgtaattacaaaaccttaggaagattatttttattaggcattataattttcaatatctatatatagctcaagtaataacaaaacaataattttttgcattatttggaaaagttagtcattttatgtttttaggttgagctccggagaacttgtgatttctcaaacaaaccactcgcgatctcaaaacatgtataatattttcattttatttttataaagttttttgccttatatccacgaatatgtcattcttagaggtattttcaccacctgcccccgttggggcgaaggtcgcgggggcggtgattgcgggggtctgagttgataatgatattcatcagacataacaaaaattaatttgtttctat

SEQ ID NO: 23486 - DNA, 1557 bp, Heterodera glycines
  misc_feature (1399)..(1399): n is a, c, g, or t
gcaatcgcggacagttccatccaatgatgactgctgtttgggggcaaacccgatgagcacatggctaacaaaatttatcaaattattattgaatattttagatgtgcttacgatttcacattaacgacaaggatttcgaagtaaatgatgtcacaattcgtgttaagccatgaatgttttgtgaagatggaacgccaagctgcaagaattatttgaataattgaaagctaacggaaaattatgtcgaattttcaaacggattcacatggagcttttcaaagaaaaagtcaacaattaagaaaaattaaaataattatccttgctttctctcttcattaaaaatttaaaaaagatgcttttatatttttttattatggaagtatttgaaatttcaatttgttggtgaaaattttgaacgatggttttacggtgttttaaaaaataaatgataatttatattatgacaatctgagctataattaaaataatattgtcaccatttccatttgctttgtaattgaccgtcgataatttatcgccaatgatttcgagatcagagtgacgatcattggcatcccagcaattctttttttgttgtttagaaaggcacttaaaatggaatcatttaataaataacgcaattatttaattttatttgaaatattaattttacatttataaaaacggcgggaacattttttaaattccagttcagtttattaacagatttgtctaaaaaaaccaaattgtggtgccgatgctattcaaagtaaagcatggaaacaaatgatcagcaatggaagaaaaggaagaaatgaacaaatcggatgtatctaaaaatttaaaaataaatattatattatttcatttttatttttatattaccaataatttgtccattcttcgtgaaaataatccgtcccgaaaaaccaaaagaaaatgttagcctaaatttaaaaaaatgttttcattttattgaaattggcagtatttttaaatttagtgctaactaacattgtcttagttttgtattttaagaattggcaaaaatttatttaattcaatattatttaattatttaaaaatatgaaaaaataattaatttcatattgtaagagaaaaggaaaatatgataaaatctataattttaagataaattaattcatttctttctgtttcttagaacaaataattttgtttttaatcaaaaattattattttttattgtattataaatttccaaaattctcggtcatcgcaaaatccatgaggacgttttttcacttacagctcattgatgaaattcaaattataatttatatattcaaatcaattttatttgttatcaaataatcatcatcaaaaatttaaatcattgatataccaaactatacgtacnataaaatcaatgaaatttatgcatattttttagttggtaaaagggggttcagttcaattgaaagagatcggacctagacatgatcagaatcataatgaatcttttttatttataataatctaaggtggtgaaaaaatgaaccaactccccaatttttg

SEQ ID NO: 23487 - DNA, 941 bp, Heterodera glycines
agcagcactagcttaacttcggaacttttagtacatactctctgaatgagctgagaaataatatatattttttcaaggtcatgaaaaattcaagaatttttatatgtgcacgacagtatgatatggtactttgggtataatttcctctaagcagcactagcttaacttcggaacttttagtacatactctctgaatgagctgagaaataatatatattttttcaaggtcatgaaaatttcaagaatttttatatgggcacgacagtatgatatggtactttgggtataatttcctctaagcagcactagcttaacttcggaacttttagtacatactctctgaatgagctgagaaataatatatattttttcaaggtcatgaaaatttcaagaatttttatatgtgcacgacagtatgatatggtactttgggtataatttcctctaagcagcacaagcttaacttcggaacttttagtacatactctctgaatgagctgagaaataatatatattttttcaaggtcatgaaaatttcaagaatttttatatgggcacgagtgtatgatatggtactttgggtataatttcctctaagcagcactagcttaacttcggaacttttagtacatactctctgaatgagctgagaaataatatatattttttcaaggtcatgaaaaaattcaagaattttcatatgtgcacgacagtatgatatggtactttgggtataatttcctctaagcagcactagcttaacttcggaacttttagtacatactctctgaatgagctgagaaataatatataatttcatggtcatgaaaaatttcaagaatttttatatgtgcacgacagtatgatatggtactttgggtataatttcctcctaagcagcacaagcttaacttgggaactttttagtacatactctctga

SEQ ID NO: 23488 - DNA, 1636 bp, Heterodera glycines
tacgaagatacaatattaaaggtcaataatttgtgcaattttatttaacaattcaaatgactaatttcaaaaggacaaaaaataaaataaaaatacatccattggacaagtcagtggatcaaacctatcctatctttggatcaaagttattatgaagagggaaggctcacaaatgaagacaaatcggaaaccaattacaacaaatctacccaaaactccatggacacttgaggcctctcttttgttagaaaattaatgttggagccgaggggaatggtgagggtgggatccagggacggtcccaggatttcggcttccgcctgctcaggcggcgacttgcctttttttctcttcctctattatgttacccttttctcactcttctctttatttctctctctatcatattgttttctctgtcctccttctctttctctcttcttcctcttttatttcctttgtcttacggaccaaaatatgtctaaccaattctatttcatttttatttttctcttccctcccatgcatatttttagcattgagaaatcaataccgaaattttgaaaaaatggactgacatgaaacaaaacgaaggaataggtaatggtcatttatttttatttgtcttttttctttttcatttattcaatagtaacatttttatataatgaaaacttaaatttaaatctttttttagagtaccaaaactcaaaaatgtcaatttcgaccaattcaataaattgtggagatgattttacaccagcagaaaacaggggtaaaggaaatgggagaaaaatttaaattttgaatatgaattaaattaaattattctaaattaaagatttaatttatttaaatttcagaagtgaatggcgatgcaattagtttggaaaatgatggacaatttgatggaaacagtgaaacgatcactgatcaacaacaacagcttaaggtgggcggaagaaaagctaacagaagaaagaattggagaaaaattgaattaatgtgagacaaaagcgattttgttaatttaaattcaggaatttcatgaaaagtttgccaaattggaaacggaattgaaaatggccaaattggaaacggaattgaaaatggccaaattggaactggaaaatgtgagtttgctataaaaatttgagtaaattataagtgccaaaattttctaattatttttagaaggcactaaagttaaagcaccaggaattggtaggcgaacagaaggcattgaaggaaaaagtgatcaaaattgaacagaaaaacggtaggtaaaatgaaaataaataaagaaaaatatatttttaacaggatcattttttacgaaaagaattataaaaatgtttaaatttagattttaaaattaaaatgtcatcattcacgacttcttcatcggccgacgaattttctcctctccaacgtaaatttttttcttaaaatgcataattaaaatacaataataataaacatttttcaataattaaatttgctaaaataaatttttttttttaaattaatttttcattttcagcaatttttccaaatctgagcacatcggaggaaatgagtgttctgattgcccgaatttctgagctgaatcgagccaaaacaacggagccatcaa

SEQ ID NO: 23489 - DNA, 1495 bp, Heterodera glycines
aaatttatttgtttattttcttgatgataatttttgattttgaaaattatttatatttttaatgactttggcaaaatgtattgttttttgaagaaaattttcgattttacacccataaattcggaactttttagcaattatttacccatttttagtaaatattttggggtttttataaactaaaactaattatttggcagtttttagcaactataaattggagtcctagtaattatgtgtttttttgatttaataaataaacgtcaagagcttattttgaattgctttcttttctaattatttctgtgaatttttttatttaattcattgcaacatccgtaaaatttagtttttatttatttagaatccaattctaatgctgtctcaacccttaaatctaagattatacaaaatctaaaattttaaaaatttgttatcattatcacagaaacatttaaacttttatattagtaaataatttgatattcaactagttttattttttaatgttcatgcttattattcttattcaattatatataatatatgtttattaatttttaaattaattttttgactcgttgtaactcattttctggcatgcgatgaatttgtttttattatcgaattaacattgtaacatttactctttcatttaatataataaaatttttaataattatcattttctttttgagggttgttttgaaattttttaatgcattattttttataatcaaatttctaaagattgttttaattaataaatttcacattgattcttacaaattgctccaaattatgtttttctaatgaattattataaaaaagaaatttctcccaaatattttattgtctgtgctcttattgggtcaacgaaattttctgtgcgatttttctctttgccagaaatctcttaaagtttgtttaaaagtaatctttattttttaatttgttttaataatatattattgggttaatttatataattattcgcgctacatttttagttgtaattgctgaattaaaatttttaattcttattttttttattccatgcattctccatctgggaaatagacgttaattgcttgcggtcattattccaatgtgctcattagtttaaatctttgtcatttccgatagttaatttagattctgcttttaaatgattgttttgtaaaatttgttctaactctcacgatatttattatacaaataagcttctattggcactattaatttgtattattgattttaataatctcaactaattatttattattatcattttttatttgttattaaaaataatgaatttgctagtttgacctaaaattcaaaatttattattaaaatcaattaaatacttaattttaataacttttaataattttagattctttttgaattctggagttcttacgttttaattgaaattattatttgttttattgtgttaatcgtaaaacattaataattttccatttcagta

SEQ ID NO: 23490 - DNA, 1459 bp, Heterodera glycines
ggtccatagtcaggaggatccggccaaacaaagctagaagttccgagcgcaaatgggcatgctttgtgaaataaaatttcttatgattagggatgcaatttatagttgttaaaaactgccaaaataattaatttttagtttctaaaaaccccgaaaataggtgctaaaaatgggaaaatagttcattcaaatttaggggtgtaaaattacaaaatttattcaaaaaaattttcaaattaagccaaatcagtattgagctatatatgtaaataaataaattttggaggcgaatttttgggaaattttttttcatcttagataaatattttctgagattttgaattttcgcttttttgggcctttcgcgtttgcttttcgcctttcgctttttggctgaaaagcgaaataaaagtacacccctaaagaatgggttttaaaataaataaaattttcggagaaagtctatagaatttattatcttttaagcattttgccgaaagcgaacgtcttttttcagcggcgggattgatcataaatgtcttgagaaaacgcttgacgcccaaaaatgctgaaatgttattgtttttgctagagcccgacgggatcgggactcacgcggggtttttacggggttcccggtcccgcatttttcggttaacggggaatttttacgggagcggttatttttagacaaaacaaaatctgacaatgtattgtattcaaattttttccaggcggcgcctatcggcaccgcatgcctccctcctcctcctttgtcccaaaaaagttttttcgaaaaatacgccgcaaaatctgttaaaattaataaagggattcgaaaatactaatttaataaactttttgttcgaaataaattaaaaaaaataatttatttgaagcaatttgaaaaaattttccgattttcgaccccaaaatctaaaatttcgccttttcgctttcgccttctcacttccgctttttatttttatttttacacatccctgccgccagtcactagttgacgaaaaatattctttgacgcgaaagagcccgggtttttcgctttggtgatgaaattttaaaaggtattcggattcctccttccaaatttttttctggctacgggtctaaattagggaatagaaggtttagatgacgaaaacgaaaaatgacggaataaaaaaaaaaaccgaaaactttttataatttttattacgataaaatagaatggctgtgataattatgttacgaataatttaactacgagaaagacgatgattgatgaattggacgagaaagagcggaacggaatgcgaaaacgaagaagtgtattgtttttgtgtaccgttgcactttgatcgagataatcagaggagatgtgctgcgacggcgacgaaaagtgcgagtgttgtaagaggagtaagccgttctgttttaaacgaaaatcagcataaataaa

SEQ ID NO: 23491 - DNA, 700 bp, Heterodera glycines
  misc_feature (670)..(670): n is a, c, g, or t
cccccccccccaggaaaacactcatatataaaaaaataataaataaattactattaaatttatttcttttgttaaaaatttctaaaaatgttcttaagttttgataaaatttgatttttaaaattatttttaaaaataaaaaatttttgttttgggccaaaaggggggtaaaaaatatttttgtggggtattttgaggtgctgagcacgaatttgatgtttatttaacgcttcggaaattttagaattttttaaaaattcaaaaatatttttcaaatttttggccctcgggattttgggcggatatttgaaaattcataactcacctcagagaaggtcaattttcatgcaataaagcattaaaaatagcaaaaaataaggagaattttatgggctttatttaaaatttatatctcaaaaaagaaaaaagttattccagaatttctggaaaatttcgactttccagaaaaaaattcagaactcggttctgaaaagttattctggaaaaataaaaagctacaaaaatccgcaattttttgctctataagataaattttatttcacctttttatcacatttttaaaaaaagatataaaaataaaagtgtttttggcatttgggaccaaaggggggagcacatgctttttgagtggaaaaaatttttcacccanaaaatattaaaaacatgtccttaggggtat

SEQ ID NO: 23492 - DNA, 962 bp, Heterodera glycines
  misc_feature (16)..(16): n is a, c, g, or t
ggatccaagaggaaangggatcaatcggaagagcaaaatgatgaagaaagccggtggaaggaagatttggtgcgaattggccgaagaaatgatcacaatgaggcctggcgagagtttctgaccacaacgacttccttggacagagaaaaggaagagcgattaaaagcaatgggcaaaattggtttgggggaaaatggccgaagaatggcagagaaaagtatgagagcagcagagaaaacaatttttgaaagtccgtgcttacagccggaggggatgagaaggaatgtgattaatgaattggagagccaagaggagcgagagcgaaggaagcgtttcgccacccggactcctccgagtggccaagcatttgcaaatacggtttgggcggaaaaagattggaaaaaggatgatgagggggaaaaggatgaaaaagaagagcctgtcttcaccaaaataataaaaattcaacggaagttaaaagaagcaaatgaagaattaaaaatgctggcaaaagatgttgaaagattggtcagcgcagaaaaaagcattgccgaaaaggaaaagaaatgggacggttttccgacaaatgtcaacgaatttggggaagcagggacgtccaacagatggagataacacgatgacggaagatggcgcggaggtcgcggaaaccgcgggcgctggacgacaaatgcacgggcacgaggacgacaatggcaaacgaacgagtgggatgtgcgcggacaccagcaaacggagacagaacaaccgagaaacgaaagaggactcacaccatgggaattcacaaaaatggcgggatatggcccgggatattaaatttttttgatttattactgtgtatattgcattagtgttataacacaaaaattcaaaaatatatatattcaaaaaaaaaatgcaaaatacaaaaaatgatatgcttaatcatattgtatgttaaattg

SEQ ID NO: 23493 - DNA, 1526 bp, Heterodera glycines
  misc_feature (51)..(51): n is a, c, g, or t
ttgtgataattgctcaaatttaaaaataatcatcgaaccgtatatatatantggagaaaaaattgcacactaattgcatctttaaataatttttcattcatcataattagtgaattcattcaaggtcatattcattaaaatctttaacaaagttctcaaaattttttccgtgattccccaatttctttataaaaaattgattaaattaatgtttttggctatttctcatgcaaaaaattgaaatattttattaaaattgagtttaaaatgtaattaataaaaaaaatgtttatttttcataaatattttttaaacatacatttcactatcatttacgctttttatgtccaaattgtcttgaattttgttaataaattatgaataaaaatgaagctaacatggtcagacatattcatgtcaaaggtcaaatcttgagaaagtgcacaaatgtgattaaataaattatctttataaatagtcgttaggacaaacaaaaagccattaaatttttttttaaatacaacctaatttaattattaaaaaaccattataatttggtttgttaaaaatcgagttctaattcaatcctctaaattattttcattcttcaaaaatcgccattttctttttgctttctctgttttggccatgtttataattggcgccaaaatagatgaattaacgggagtgatgacattgttcaaccaagcgctggaggttatcaggtagaaaaattaaattaaattgaagattagatcaagcttaagcttggcaaagcatcggggcaaatgcaaagggaaaagcgccgaccaaaaaatgatttccaatgttaaaaattgttggtggcgttgaagcttgaatgtgaatatgttttaggctatttaaaacatatgaatttttccatcggttcttttcatacattcatctagagaggttaaaaaaataaattttgtcaaaatcaattaaattttacaaaatttcatctgtaatcatgtaaataaaaaaaaaacttagaaagttttttctaaaaaattttgtaaaaaattaaattatttttcttgcttttttaatttacatgattatagagccgccattcataggcttatccaaatataattaacacgaattttcatttaactactgctgttaaaatttctgaatgattttaacaggttggacgaatttatgaatggtataatagaaataaaattaaagtttgccgaataaaatataagggtaattgggatatgtactggaaaaataaatccgaatcattaaaattatatatattttttaatttgtacaaaattatcaacattttatgcacataacataaattatgagcctttaattgtgtcatcgaaaaagaagtaccaatagtagaggccaattccattgatcccaaacgacatcaaaaagaacatgtgctaaaagtgttcttttattttttggggggattttttggcatataaatcgattaaagaatttatttttttataattttttttttattaatgaaaaaaaaa

SEQ ID NO: 23494 - DNA, 1577 bp, Heterodera glycines
  misc_feature (1460)..(1460): n is a, c, g, or t
gtttgcaagtgtgctttgagatgggacgaattgctgtacgcctttctgcatatcggatgggcacatcggtggtgattcagtgtcagcgactggggcagtgtcttgcgcggcttatgccgctcattagatttattttggagggggcctctctccgtcctttttcctcagtcagtgtccatattaggatgcattcctctcgaatgatacatggaatcttatgggtattagattggaaataaaaatgcactgcttgttgttcaccggtttgtccgttgtccatggtatgatgtccagaaagatcagtttcaaaggaaaattgtgacaattctaaaagatagttggacaaaaaaccttaaacaagaattaaacaataaataaacacatgaaaatttgtttaattccatgggtaaagcaacaaaaaaaagagggagaaaaaagttgcgatatttgtttttgtgttgtccatcattatgatgacgacaacaacaacaaattgacacataaaaagttgtgagtgcagcacaaatgcccatttgttttgagaaagcccaaacaaataatttaaacaatagaaaaaagaaaataaaacaaaatggtcaataacaagaaaaaaacagtggatgatttctatggaaaacattttcttttttgttgttgatgttttgacacagataaataaagagagagagaaagcaaagaaaggaaggaaaggagaaacaccgaaatttacattttacaagaaaaaaaagagagagagaaaaagatgatacaaaaaaatacacaaaaatttgttggacaaaaaaacaattttggttgagagagagagagagaaactgatggtgcctgccggcgtatagtatgggtgtggtgtactgtagtgcatgcaccgtactgtgactgaatttgcaacaaataaataattgtccatgagccattttagcgccagaaaaaaaagagagaagacagaaaagaaagtttcggaaaacaaacaaatttaggggctaatgatggctccctccctagacatcacaatatccatcagaactgtttacagttcactctttacagcttcgtctttctccgcctcctttttgtcttgttccacctcttttttgtcctcttccgcctccttcttcacttccgctgcttcctcctttttgacctcttccgcttcctttttgtcctcttccgcctccttcttcacttccgctgcttcctcctttttgacctcttccgcttcctttttgtcctcttccgcctccttctttgcctccacttcctccttatccacctctccttcctcttccttcttttccaccgcttccgcctctgcttccttcttctccgcttcctttgcttccgcctcggccttctttgcctccgcttccgcctcctccttggcctttttggctgccgcttccgcctcctcgcgctgtttgagcgcggccgcgtaatatttnggacgtaggaaacgcacttcgcccatgatcgaatttgtctgaaaatttaaaaatttgttttttttataataaattaaaaacattttcgaaaaatggttcacccatgaaaacattttg

SEQ ID NO: 23495 - DNA, 915 bp, Heterodera glycines
agcaaatggcacttcatttcatccaatggcacttcttttcaccaaatggcacttcacttcacccaatggcacttcattttcactcaatggcacttcatttcactcaatggcactttattccacgcaatggcacttctattcactcaatggcacttcaattcagcaaatggcacttcatttcatccaatggcacttcattttcactcaatggcacttcaattcagcaaatggcacttcatttcatccaatggttcacttcacccaatggcacttcattgaaccaatggtacttctattcactcaatggcactttatttcatgcaatggcacttcatttcactcaatggcacttcatttcatgcaatggcacttctattcactcaatggcatttcattccacgcaatggcacttcatttcactcaatggcacttcattttcactcaatggcacttcaattcagcaaattgcatttcacttcatgtaatggcacttctattcacacaatggcacttcattccatccaatggcacttcatttcagtcaatggcacttcatttcactcaatggcactttattccacgcaatggcacttcatttcactcaatggcacttctattcagcaaatggcacttcatttcatccaatggcacttcattttcactcaatggcacttcaattcagcaaatggcacttcatttcatccaatggcacttcacttcacccaatggcacttcattgaacccaatggcacttcacttcacccaatggcacttcattgaacccaatggcacttctattcactcatggcacttcatttactcaatggcacttcatttcactcaatggcacttcatttcactcaatggcactttattccacgcaatggcacttcattttcactcaatggcacttca

SEQ ID NO: 23496 - DNA, 989 bp, Heterodera glycines
tttttttttttccggaaaaaaaatggaaaaattttccgaaaaaaaatacccagtggatagagcttcgaaaaaactaagttttgggaagtgccccttccgttttttctgggggaaaattcggttaaaaaattcttaaaattcaaaaacccaaaaaccggttttttaggcctagctcgaaaaaatttttgaaaattttcgaaaattttttaaatttggaaaaatcgagcttttaaaacactacaataagtctgctgggcacctttccctcagatcaaacgccgacgcggtattcgcctggtactgaagtgtactttttgagcacacttcagttgccattttctgtaggccagggggtggctctattaaaaaaataaaaaataccagcatgtagaggacactttggcggggtgccctcgcagcgggcattttttgattcgagttttagaaaaaaagttacgggccttcaaacgcaagcaaaagtgagaaattagccgccgggactcagttggccaccggagaggaaaacctatagttttcctgaatgcgcctcaaaaagttgtaagacccttccaccactttcagacccctcccgacagccgttcgactcaaattagtttttaagacgaaaccccctttttctctatatatatataaactagcgtgtggcggcgcagtagttgctcggtgtagacagtatacttttggtagatatgggcgggcgctaacatgagcgcttcgcgcaaaggacttcgttgctagtgcatgctcggcttcaaaattcaaaattttaataggcttatgtttttttcaaaattttaaaggcgacatttgcagcttcgcggcctcagacgggcgcttttgcatccgtttcttaaaattttgttgggcttgcgggcgcttcgcgcccgttttttaattttgtggggaacattcggccgcttcgcggcctcagaacggtcgcttcgcgcccgtttttagactttgtgggg

SEQ ID NO: 23497 - DNA, 879 bp, Heterodera glycines
aggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcacaattaaagtacagactatagggaagctattcccgaaggattcggtctccccataaatctgtgcgcatcggttcggggggactgccccgaaacaa

SEQ ID NO: 23498 - DNA, 1918 bp, Heterodera glycines
caattttatgggttaaaatcaaaaacttaattttcttatataggccaaaaaaatgttgccacaataaattgagaggaagcaaaaaaaaaaaaaggcatttctgcgaaaaaaccccaagggaattggcggcggcgaatgccggcgcacttttcacgcttctcttttaattatttataaattagcggaaagggacaaaaaagaaaagaaaagaaaagcagcacccaatgtctgggcaatacaaagataaataaaataaataaaagataaaatttaaattaaaaaaaaacatattcttataggggagttctatcatgaattacatcacgaaaaatgaacgggcgaagtgaaaagaaataattaaaaagaagggcgggggactttagaagcgtgtaatctttgctttcaaatatattaaaacttttttttgcagaatatttggccaaaaagggaaacagcaaattaatgttgaaagtgcgtgccaatggcactctccgtttttcagagggtttatgccttttaaaatccggcacattaatccgttgtccatcacgtgcgatgtctagaccatcttaacatttcattttctaaagcacaaagttcgattccgttactgctttttgtcagagtaaaaaaaatcagacaaattaaaaaatcaaatttaaaaaaggaataaaaattgaaagaccaaaaagttttttttaaacaataattatttttctcttggcaatattttgtgtcgttaaattggcattttttttttttgctttgccgtgggacaaaaaagacccactctttgctcttttgcgtgtcgcgtgaagcgattgtccgtgcccgcgggggccttgttgctgttccgtctgtgtcgcgtgcgtgcggcgcgttactttttcctgtctggcgatctgtctttctctctctttccctcacactctattttctctaaagtaactgcagctgtctctatttcttttacatacacaaaataaactccctcattctccctctctctccactctttctctctccgtccctttctctcccctttatctctccgttttggcaattttgtgcctctttttttccgctcggcacttaacagtgaaattaaatgggcttcgaacgtcacgcggtggaaagcgcaaaaaaaatgtacccaaaataagcatacaaatgagctgcacttgcccttggggggggggggggcgacggagcggaccaaagtgaaaatgcgcggcacggcaaaaagtcaatgaatgggaaagtgtttccgcttcaaatggcacacacttttttatgtcagggggaagaaaacggcaaaaaaaaagcagatttcacaatattatttgcttttgtgttcttaggaatcgaattattggtgttatttatgtgtttgagtttgatgagagggaatgatttttataattcaaataatttttaataaaattatttaaaaaatttaataaaaccccaatagtctggtgcacacagtcaatgctcacaatcatcggtttggtgggaaatcggagggttttttgtgtctgagaattaatggttttccctgggcattttttaatgtttccgtcagacttttttccgtgtgaaaaacattcacaaccttttaacttttgattgagaaatgtgcataaataaaaaataatgtttcttaactttacaacatggaaaacacactttaaataaacattaaaatttaaaaattgtgtaaattaatctctctctcactcccctctctctctccatttctctttctctctctttttgtctaactctctctctctctttctctctctctctcttactcctctctctctctctctttctctctctctcactctctctttctctctcctctctctctcccactcctctctctctctcactgtttttctctctctttctc

SEQ ID NO: 23499 - DNA, 1843 bp, Heterodera glycines
  misc_feature (1739)..(1739): n is a, c, g, or t
  misc_feature (1750)..(1750): n is a, c, g, or t
  misc_feature (1825)..(1825): n is a, c, g, or t
aattttggggagccgagtcttttttgtatcgcttaaaatcaaaaccttgacccttctgagtgtttatgttgttggctgctttttcgagaagattctttagtcctgccttactctcactaacgagagactctttgaggtcttttccctctagcacattggtgagtacttgatttccgctttccattccctgacgtccaattgctgagccaatttgctttccaatcggcagcaaatatctcataagacttctgaacactgcgccaactcccgctccacgctgatagggcaacccccgataaatgttgtatccaccaaattgcacatactcggacgagaatgtggaccaatctacttgtagaggatcaaaatcaacatgcattttttttaaatttgacgtttttacattatttatattctttgaaaattatgctttttacaaagttgtttacgagcttatccggttgcatctttccaaagtgcaaaaagctgacaattttttcaaaggtcattccaacacatcgacaatacaaaaagaaaatgacatgtcgaccacacgcacttgagttgacagactgaaggggaagagaattatattgaatttgtttgtagcgtgacaaatgatccacaatgtaaacactgggcggtggccagaaccccaatgagtcataatactccaaatgcaaaggagaagcgcaatatatgcccacccaatgagaaccatgtgatgtgctggggtcaagattaaccaccatacagtgaggaaatttgacaattacaccggcgggtatttgatctgctgcaaaacaaccaagatagtagtggcgagtcacgttgtttcttgtcaatgttttgttaatttccaacgtgttcatcatttaaaaataggacatttttctaaagtgtaatgttaatgtacatgttccgtattggaatggcatcaagatgccgctattggtacgtatctcaatcagaatttcagaaaactcctttaataaaagtttatgatactgtatggcaaaaaattgttcttcaactacttggtcggggtttccgcgtatggtcactatgcgcaacactggggccgtcacatctccaatcatcattggttcaataagatccggcgtgtaaacgtggaatgatgacacaccaccgctcatgtccggcatgaattttgcctcgttttcagattgaataaactccgtgttgttgaaaccgagaatgtaggcaagttgaggcgagacttgaacctttttaacgtaccgtgggtcggtgttcagaacaaaacgatttctattgacgtcatagttaaattggcaaacaagacgtatctcacggtacgcctgaatccatgcttccgtccccatttcctttgtggcttcaaggatcacacgttcctcttcggtcaaatttttgatttcggcgttcaattttgtcatgcccaattcatcaagaatgttcaaatttttgtcacttaatttcgaaaagtactcatccaatttttcttggtacgaattggtatcatcagctgacattctcaacggtacattactcgttgcagcactcttttcgcgtgccagaaggccttgggccacgttgttgaggtcaaccaatgttccagtatctgtcaacatggcctgtaggagcagctcttcgtcacggacgccccgtttttctttagtctttcgcttaatgtactcttctctggcccatcgccgagccttgtttatcaaaagcatganagaattctgtngtgatcgtaccttttttgctaacggatcacttccctcacccaggagcctgtataaatttttgctaagctcatggngggtttgtgacatttgat

SEQ ID NO: 23500 - DNA, 820 bp, Heterodera glycines
ttatgctgtatcattgtgggcaaaggtatagattattggtcccgaaaaattctttaaataaaatttgagaaaattgtttttaggggtagtcttaggcgccgagcacgaatccggccttattttggctgtttcgaaccccgaacccggatttgaactaaagttcgagaattcaattttttcagttttagttcaaagcccggctatatacgtggaatcaaataggcacattaatacctcaataaaaaaattatttaaactacttagggtggaacataatttttgatacccaaatttttttaattaaaaattttttttttaatttcaacaaaccacaatcatgattcaaaatacccgccattattatcaataatatgttgccattattctggcaagagatcaataccaatggaaaagtatttagggagttagagtaagtaagtaaaaattgtcattttataggtacgtatttttgatggctgatttaaagaaaaataaaagagatacagagccagagaaatagtgattaaatagagcaaagttaggactataagaacacaaaaatataaaattttaattacaaaaattgaattattggagagctgagactgaaagtggtctccaaaaacggcatttttcaagaccaccaagtaacataatgttttaaaagtggttttggaaattctgaatttaattaaacaaggtaaatcgggtatgttgagttcgaatatggtcttagttttggtctctgggatcgcaacaaacctgtacagctcgaacttcatgcatggagttggagcagtacaagctcaggtgaaaagat

SEQ ID NO: 23501 - DNA, 1703 bp, Heterodera glycines
  misc_feature (27)..(27): n is a, c, g, or t
actgaaaattttcaagatcagcatttntagattttggcttaaaaatcagcatttcaaaattttatcccaaatgattaaaaatccacaaaaatgtttttttgcggcgcgctttttctaaaaaaaaaaaaaaaaaattttgttgaatttggaaggtgaggtgccgatagagactatacatatatggcaatttttgaggattttcaaaaaatccagcgaatttttaaaaatttgaatcaaaaatttgatgaaaaaagaaatttcagtgactcataaaattatttgttaattaaaaaatgtgaattcgtttaaaataactgcttgattttgtgcaggtgcgcgtccgtgccggccatgcgaacacacgccagtacatcccgaagagtgcgcggtccaactcgggccagtgccgcattgttgccaccaatgagaagggcacggcggagacgcgtgggctcatatcagtggttgaccggcccgaccccccagagggcccgatcacttatccggccacaacaaagtgagaaaaattcaaaaatataaaaatattttttctttagccaattttttcatgacaaatttcagtaattttaaaaaaatatatttttttctggcgtcgttttgcctaaacgtactttcaaaaaaaaatatagttagtttattatcagtccaatcaaaaataattgagaatttatcaggattcacacatcaattcggaatttatggcagggtgcaatatgtttccatcccagaaaaaaataataatttaaatactgcaaattttcctatacgtttttctagtagaatatctaaaaaaaattcttaaacatgtttttttaagaatttttctttgaaattactgtaaaaatctttttgaaataaattcttttgagaaatgataatatttaaaaaatgaaatttcgagcaaatttataaaaatttaaaaaaaatgtgcctgatttttcttttgcaaataattatcaaaaaatgcctacctatgccccttcctctcaggcattccatcacactgtcctggcgcccgccaaaggatgatggtggcgcagaactaagcgcctaccatatcgaattcaaaggattggacgaacgcgactgggaacgtgtgccagatcacgtgacactgccgaactacaccgttcgcaacttggagaaaggcgctcagtaccaggcaaaaattaatttaaaaatttgaaaatttcgtaatttttaattattattttttaatttttctttttacagttccgcgtctttgccgagaatatggttggcatcagtgaaccgctgaatggcgaaccggtgaccgccaaagatccatttggtcggtttttgatgagaattttttgattaaaaatttatatttaaattttttaaagaattaataacacataaaattttaaataataaaaaatgttttttcatccatttcttttaaaacaaatataacaattttattttattgtgatttcaaagattttgataaaatatattttaatattttttcaaatttgaaaattttcattgaaatttaaggttgattttaaaaaaaaggatcaaaattagcaaataaaaaaattatgtctacaatttttaaatatttcgaaaatttatttttatttatttattatattaaaaaaattgcgttttctaggcccacccggtccaccttccaccccggaagtgacagcata

SEQ ID NO: 23502 - DNA, 1724 bp, Heterodera glycines
tttctaaaaaaaaaacaatattggacataaaatttaaatattctacaatttttgggtcgaggtaggcgaacacttcgacttcagctttttgccgtgcggttatttctgccactgttggaattggagaagtcgagtcaaaaagtttggattcggcagtttgcgaattttcgaaatccgcaaaaatgtcaaatacaccaacaccatcacatcgatcagtttcatggcatggtgattcctgcagttggttctgaaaaactggccatttttcatgtgaaacacaataatataacttcattcatggcaagcttttctgcctcggaaataagccaattaatatagtcgtcgtgccgcgttgtttcaaggtacggactcagtttaaaccgcgggtaaagcaaagtcgcaaggaccaggtcatgattgttaaaccacgattctcttttgacattctgtcgtgcatcttttttttcctccattctcttattcaaaccgtcaatgatcgcttttttgatagagggaaaatcatttttgtccttttcaagagcgtgtatgatcactcgaaaaagtggaataattgttgaaattgttgtacaccgcccttggattagattatttgcattgaaaattggagccaaaatctaaaaattttcaattttatgggtttcaaaagaattttaaacttcttttattgccacaatggacgaccaatcgccggctgaaaaggctggtaaatcagaatatttcatgctcatcagtttgattgttggcgcatttgtgataaatcggtcaagcatttcatacgttgagctccaacgaacctattttttatgttaaaaatttaaaaaatccctaggagacctccatttcctttattaacgtgagctggggcaattgctcaagcttttgaatttcttgaaattcttgacggaacaccgctgattttttgtactttcgaataaatttttttatcctctcaaaaatatccttcatttctgtgtccgaagttaattttcgcattccatcccaaatggcctaaatttttacttcataaaataagtaatatgcaaaaactaacaagattcaacttatgcgcgaagcagtccattgatcgcaatccaaggtcatcaaaaactttaaccatgacctccgctgcgtctctaataaaaatgaaacttttttccttgacactaaactcttcgagtgcttctcgaatcagctctttcaatgcaggagcattgtgccggcctttgatcggttttgccgcaagcaaaacagatttttgacggcttttgatgagaaaatgtgcagtcaggcacaaaagagaatgagcgccgtccgtcgatgaccaacaatccgttgtgtacgaaatatattgcgcattacgcaactcagtgcaaatacggtccctaaataattataagaaaataagaattgaacgaccaatataagttactttaaaatatgaaaaatgttcggcaacatcttttccgtaaaaaattttcgacttggaatatggtattccggctgaagctcgttgatcaatcgcttaaagccaacatcttcgacgacggaaaatggctgcaaatccacggcgataaactccataattattttatgcacactgcttgctctttccccgccccatttcccatggacttcttgtccaaattcgatcgatcttcggctgttcatcgagctttttgggcaacgaaatcgcttcgatttcc

SEQ ID NO: 23503 - DNA, 704 bp, Heterodera glycines
aaccaccgaggcggagatttccaaatttatttttctttttgactatgtaaatattattaattttgaccttccaaaaatttgctaaactttggattttgactagacacttttacctataaattttttcttgaaaattgtttttccaccaatttaattcataggagcaattttacaaacttaaatgtcagtgcgtatatctaatggagctggaaaaggatacgtcggcacaatttatttcatcttttttgaaccaatcatttccgatgtaaaagtcccaaaaagccaaacaaaaattaaattatcaaacgaaagcaacaaataaattgtaaggggcaattatcagatcagtttccgtacataatgatcggtcatttgtcaataattcattcactttttcttccgctgggcccaggattcattctcagatgactttttgcgtttttgaagaaaattcatttccgagaaaaatagaaaccaattgtgtagaattcctcttttttaattaggtgttgacttacagaagagtgcccatttttaaggaaaatgaagcatataaaaggcagaggaaattgacagttaatgtccttttttgcaatcataatttaccgggccaggacgttttcgcgtggcccgttttcgcgtggccgttttcgcgtggccgttttcgcgtgagggacgttttcgcgcggcccgttttcgcgtgg

SEQ ID NO: 23504 - DNA, 2450 bp, Heterodera glycines
  misc_feature (55)..(56): n is a, c, g, or t
  misc_feature (59)..(59): n is a, c, g, or t
  misc_feature (69)..(69): n is a, c, g, or t
  misc_feature (93)..(93): n is a, c, g, or t
  misc_feature (96)..(96): n is a, c, g, or t
  misc_feature (98)..(98): n is a, c, g, or t
  misc_feature (101)..(101): n is a, c, g, or t
  misc_feature (116)..(116): n is a, c, g, or t
  misc_feature (122)..(122): n is a, c, g, or t
  misc_feature (143)..(144): n is a, c, g, or t
  misc_feature (174)..(174): n is a, c, g, or t
  misc_feature (179)..(179): n is a, c, g, or t
  misc_feature (214)..(214): n is a, c, g, or t
  misc_feature (219)..(219): n is a, c, g, or t
  misc_feature (223)..(223): n is a, c, g, or t
  misc_feature (230)..(230): n is a, c, g, or t
caataaaattatttctaatattctcgtgtttaaaaatttctataaaagaaaaaannagnaagacaaaancaagatggcgcgcctttacagagncangnaanacccgcacgaaaaancaaggnggacaaacaaccgagggggcnnatgccaaaccacggcccaggaaaaaaacgncgacngcggcgagcaacgcagcacccacaaaccgaaaagngccgnaganatcaatnaactggggacacaaaaaaacggctgaacactcgcgcagtggcgcaaaacatacccgagaataccattagggtggggctttagagttgccgctgtccctttacaatttaatcgtttttccttcttttagaaaatactctttttctctgtttctctcctctctcctatagtgaatgcgcatctctctgcccagggggggggccaagatttctgtcccaatactactaacattttaaaatgaatatatttgttttttagttgtaataatgtaattcaattcgacctttaggttatgtatttagaatttttaataaaaaaatttacatttaggtctgctttcacattacctaatcgaattttgcaaagacaatagtaataataagttaaattaaataagattgaatataggcaaatttttaagttaattatttttattaaaattattaaattgtataaaaatcgtaaatttattaaaattaaagctctatattatttgtttatttacagatatataagtaaattatgaggaaaaattcgaatttagaaaaatgctttaatatataacttatttttattacgaatatatttgtttatattcatcttatatgttgaaacaggttcatcttggcaatggtcgcgtaaaatgaaaggcctgaaatcatattttttaaattgctctcaatttatatatttgttaattttcagaaatcatatttaggccataatttatattttgattaatttttactcgtaaatcatattcagcaatttcttgttttgaaattaatttaaaataataaaattatttaaaaaatttttttatttaaaacaattattactgaaataacctaaaattttcatgattgaaatattttttaattaatttgataatgaatatttttctaattaatttgataatgtttaactgtttttgcattttcagactattacttatgataaattcataaacctttatttttcaaaaagaattttttattattatcaatctttatttgctaaacgggcgttcaagttataaaaattagataattaattctaaaatacaatgatattaataaaattattaattatatcatagaaataaaatttctaaatgctgttgtcgcaaagatcggatttaataagttgaagttgcacatcctatttacttgcttctgcggcaacaatcaatgctgttatttgcttgtggacccattctttttatctcattttgaatttgaaaaaagtttcttaattacattattataaattaattctacaatcgcacttcttgcacgtttcttaatttgtataaaaaataaagtatatcttttgagtgctataaaattaattacagaggaattatacttaaaatgtttaaataaattttattacttcatgttaatgttaattattgccactgtaattgaatgtatatattcaacatgattattttaatgtgctcttcgtgggcagtctcactttattttcaattaatttataaaatttgaagtttgtatttctctgtggaatagaactttttgctcttacgatcattttttacaagtcggaatattttttgttgaattaatttattcgaatgtttattctatcatttggatgaaagcccttctaaatcaatagaatttttttcatatatttaggattttgacccaataccgaattaaaaacgaaaatatacaaaaacaaacgcaaacaaatgcactcttttaaattcactttatttccactaattgcgtccaagggaaaaaggcgatgaagcaaaggttaatgccagggctaggatcgggcaacctccctttccaaggaaggtataccaatttccaaggacataaggggaaagttccattaaattcaagcacatttaaaattttttatatatccagggcgcgcggaaatcaaagccttttatggccagtcggccgttgggatggaaggggtgtaataaagcgcaaaaagaggggggggggaataataataattgtaaaataaagggattttatttgtcgggggaacgaagagagaaaaagagtttttattgttaatttttaatgttattttatattttgcattacaaaaactaaatactctagttaatggagattatttcagtttagtatttttttttgcaaaaattaacgcgaataatttttttaaaatttttaattaactttctgaaaaattcagtcttttttttttcc

SEQ ID NO: 23505 - DNA, 1637 bp, Heterodera glycines
aaacaaaaacggccgtaggcccagtgggagtggtcgaacagccggtgcttggacaatctgctgatcaaaatgttgcttcaacttcggaggaaatgccatccgacacttcttcgacttcggctgtcggggtttgagggttgaccgtccccccgctcccgttgcgggggcgggaggctgtctacgccatattttttgattatttaaaaaacaaaataaaacaaactaaaaaacaaataatttgcaaaacaaaaaaaaaaactttttcacattaataactttttgggtcgaggattagtaatttttgccaatgggccaatttgttgagtaccaaataaaccactaatctgtaatcagggtctacggcccccaatccccccccccttttggtaatcccttaaagtgaattggtgaatttggggcgctgaggaatttggacgctcgcgctgatgctatcggggccaattctgtgcgatggcgtgcccttctgctgttagtctccccattggctgatcatcccctccggcactgttctcgcctaaacaatttgcccaccaaacgacgccctgccccctcgacaatccgcccaaaacgacgccctgccctcccgacgatccgcccacccaacgatgccctgccctcccgagcgagtataaaagaaatgatgagccaagactttccgttgcctttttgctttttactcttcatttccgtctcctacctatcacttttttgtgcttcgacgaccttttcctctgctttacaaaacccaaaaaccacttatttttccttgcgtttccattcgtttttcgttaataaaccccttttttttgtggtgaagtcttgcctctaggctttctcgctttcgttggctttaccatttccccctcgttcccatcgcttctcccccccgtttgctttccccatttttgcacccttttgctccattggcttacagggactcagtctcaatttgaacttggctttaccatttgttggcttgtcgggacccaaatcggaacccccgggccattttctccttttcctggttggcaaggcatttacccccttgtccagcacaccccggcttcgtgaaattctgatgacccaaagcaaaaatatttcaactccattggctgaggcaaaaaattaaagacatttttattctaaataaagctttaaggtttgtttttatccacaagtttccgaggatcaaatcgaactaatcaaagctgaactgaatccggtgattattaaaccaaatttaacaacaacaaaaaaagaaataaaacgcggattcaggttttactccgtacaatcatcaaaaagtttgtgctcgaggaaagagttttcgtcaacgaaaattggtttaaaaatattgctaattattagggcgcgtatttatacgcattttttttggtaattcgtcgcttatttagtaatttcttgcgggaatattccctacgaatcgaactgttggaaagcgagaggcgcgactccgccactcagcatttgaagggacggcgaattttgacggaattggagcggagatttgggcgacaaatggccatgacagtggcaaaacgctacaaagaagtgcgggagtaccaacagattcagcacaagttcgtatttggtgt

SEQ ID NO: 23506 - DNA, 1374 bp, Heterodera glycines
caatcatggtcaatcagcaaaaccaataataatgattaataaaaaaaattcgttttttttcagattacgccttttgactggttttttgactgggtccgcctctacagaaactccctcaacaatgacactttgtttcttttttcaaaactatttttcaacgcattggtgtcgcttggctgtctgtgcattgtcatcatggaaatgttacgctctgtggaagaatatgaagtgagtgagcgcaacgcgtggccaccacagcaaattcaacttgataaaatcgcgtccaaaaaattgcttttaaattgaaatccgttcggatttttttgatcaaattgagagattattacatagtttttttgttccttttgtcgcgttaattttcagtgttcgcacgtgttgtaacaaattgtgtcgcataatttgttttgaattttttaagtcctcgggcattttactggccttcgcttctgtcttgttttggggtcactctgttgcgttctcattcaatttgctgttcttttggtcgcacttttggacttgcttcaacttccgtgcggatcgcacaattgtgccgtttgacactttggtgagttttgtttttgtttttattggcatttaaattttcgcgcatatcccttcttttaaggtgctcagcattgtcatggtgtgtttgtacgtcttcgagcttttctacagaattcgcgatatcgccacgtatgccatcgaagaggatgatgatgatatatgagataaattggattatgcattttcttggtaaattgttgttattccattgcatttctgttgtacccgtatgcataaaaatttgatttggtgacctgctttgagtggtgttataaaaaaaaccaaaaatgtcaaaccaatttgggatgtttttgcccgtgaaatttggtccatttttgcgacaaccattcgccaacagttcatttccagagcggtatttctagagacattggccatttggacaatttcgtcgtctcatttcaccgacaaatctctccaatcattcaattgaaggctgtcgcccaattgtccctttccgcgacgtacgattgactggcgagggctgatggaaaatttcgtcaaaaaaaatacagtcaggtgtaaaactaggtaggtaggtatgtcaaaaaatctgaaatttttgtcgattcgacctcgattttggcgtttcgtcccataaaaacgaatcgagtaataaaacgatttgttcttcgtccgcctatataaaggaaacgatttgaagaaaatgctctcattttttgcgtccgtcagtattttcaccattgttttctatttgccaattgtgtcaaagcatcgttctgctcctccatctatcacagcaaacggaag

SEQ ID NO: 23507 - DNA, 768 bp, Heterodera glycines
ttcgaaaatgcgggaacgtatggcgcaattttattaatttattttaatttaaatcaatttttatgcatattaattaattaattaattattattattaaatttaattaggcaatatgttaatattttaggccgagcaccggtttattagccgatgcttttcaggatgatatttatcaatttttcatcggtggagtttacagcatttcatttggttgcatttgctgttatgtgaccatttttttgattgtcaggcttaaaaaaagcggtaaattcattggcatttgtcttaaagtgcctaatttaaatacactatacatttgttacagtaacccagcaaacaaatacccgactgttacgttctttggtcatcattttgtccataaacattggcggctatttgggcactttgatcatgagtcagcttattggaaccattggccaagtgtatttgtgagtttttttttctttttttccaaaatttaaacccccaaaggtccccaattggagtttggcaatttactttttgtgcttacattcttttaaatgttgttgccggatcaaatgctattgttctttttttaaacaggtccaaatttaatttattaaaatatttaattgctgatttaatttaatttaaaaaatttattttttttcatttaaaacttttcattaaaatattttttaagcacagaatatcgtcaattgtttaaaaaggaattgcgtgcagtgaaagatcatttctttaaaaggaatggtaaaaaatatttt

SEQ ID NO: 23508 - DNA, 1187 bp, Heterodera glycines
ttgcatttgtcaaataggtaatttaaaaaattataacacgtaatagagtatttttcaagtcaatattgaatcttaaaacaaattggatggaatgccaagagatcaaacaaaataacgcttcattcattcattcgataatctgcacttcttcttcttcgtcgcctttgtcacttttgctgcccccgtccgtttccattttggcacttcgttcctccattttgcaccgttttgtcatcaccgtcgtttcgccgttgaattggctgcttctgctgctgctttcgttggtggtggtcggcgagccgtccgccggtgggtcgtcgagactgagttcggcgatcggaatggcacgcgtcacttcgccactcgatgagagagggccaatgagagtgctgagacacggaatttggaaagagtcaaatttgctagggatgaaagagtatttccgaagagattttcaagaaaacccaaaaattagtgtaaaaaatgtcaaatgtttaacaaattaaaattcactccgcaattcgcgccgcctctctcagcccggaaaggaatgcgccgtgaacggaggaagggtactgtcggtttgtgtgctcgccggcgaaaaacacccggggcgctgtcgacgacgcgtcatcattggggtgaacgggacgggccaaagtgtcgtagtcatccgctgaaagaggcaaacaaattaaaaaaccaaaatgtcaattctattttttgagattagtttcatcgcagcaaaatatatctgctggtcataaattttgggacatagccaaaaccgttaaaaaatcttgcattcgtagctaattggaatggactattaaaacaaaagctgacgcgatgagttcactcccatgtaactgtacgagccgcgtgcaaatttgtccatgtgccaccgcgtcacaatggaactgttgggctaaagggagcgaaagcgatgcaattaaaaaagacctttgttaaatcgttaattatgttgaataatttggaatttccactaatgaacattggattggaagcgtcatggaattgcattttttgggtaattgacatgttcggagcaagtgattacttgatgtagcttctctatgtggcaccttcggtgtatctatatattccgataatgttgtacagtgctcttcctcgattttcgcgtgatgatatggtcgtcagggggg

SEQ ID NO: 23509 - DNA, 1420 bp, Heterodera glycines
aattcaataccacagggggaggacatgattcccgagtgagtaaatttttcaccacaatcttccgaaattattatcagcagttctttaagtcgctgatcagtgatcactagaatataatcagaaggatcttaagattcgttaagacctaagaattcatccgtatcagttgattctgaagggatggcgctggtcaggttcggatcctttcgatataattttttgtgcattttgggtcttgtaaactttattgtgaatttttaaccattttcgtctgcttcaaaagttgcagggccttaaaaatcagaaatttttttttggcgccgaaacgaccctggcgccgaaacggcgtcgccgaaacgaccctggcgccgaaacggcgtcgccgaaacggcggcgccgaaacgacccgttcccctatttactgttttcttctattcccggtttcgcatatactatgtagtataaaaatgtaatattatttttacttttattttacatcgcgataatcgatttaaaatacatattgattcactccccttaattagtgactgtgaaactgaaatgttttaatggctcagattgtttagtttttagtcgaattcgagaaaagcaataattttctccatttatccataagcagcatagaacgcgatgagcagcagtggtggggcattgagttggaattcgccctgctcgtcgacagtcggccaacccaagcagcagccaatttcttcgtcgtcattttctggcaaacaacgccattcgccaatctttcagcagcagcgagtgctttcccggcaccatgggatgccattccaacagctagcagacgaattgttggcattgatcacttccaattgcaaagatgcggcggcgaatggagcagcctttgagaaaattctaaccattttgaagcaattaaaacagcaattttagagggcggaagaaacccaaggcaaaaagtatgtcaaaacttcgcgtcaggatcagtcagccgaggacaactcagctttacgagaatttacaaaaggcaactcgtacaatggcttgggcctaggcttaagcttaggctttaagttttattgtacggctgatgtgagttgtcctcagctgactagtccagaagcccaaaactttaattccttaaatatcatctccatttaaggcaaaatggccttcagattttgcaaaatgcctacgaaattctgaaccatttgttttttctgaggagtggcgctgtctttggccacaattcgttggcgctgcacgtcgaccgaactttgaaagcgctcaaacagacgacgtcactttcccacgaccaatacgtcggcccggtcaaggccctggagaatcgtaaattgcaagtgatgttctgtgagttacagcaccttcccaggtttccaatttgaacccttttttt

SEQ ID NO: 23510 - DNA, 1151 bp, Heterodera glycines
catgtcaaaaaacgacgacgccctcacaaaaaagaaatgtaaataaaattgaaatttcataaaaattttttccattttttcagctttatctgcggtgattgttggcttttggtgttcgattttcttgcgccttctcagctgggccttggaattgcactgatcaatcgccgctttgaccgtatcgtcgacgaacacttcaagacacgcaaatggaaattgggcaaaatgcgaatttgccacaaaattggaaagaatggcaccaagcaaatgcaaattgtcaattccgatggaaatccattgccaattttgcaaaatccgctgccgaacaaagtcgtcggattccgaggcattacaatcgcgtaaaaatggattagattggaaatgttttatccacattttctgcttttcagttacatcgatcaaaatgtcatcgcatttctccgccattttcaccgttttttcgccgtttgttcaacggatttgtacgttatcactgaaaatgttcgcatttcggaatttattttgttcgacatttggccaacgcttcgcgatgccattcatgtgattaatgtgacttccatcgtttttcgccgtttgcgccaattggtcccgtcacttctcaacgattgtccatcccttcgcggtgtctctttctgtggcggcagtttgcccgaatttccgcccgatgacagtgccaatgcgtcggatggccaagcggtgaccaaatggctgttctcgcctcgtccggatggtctgccgaagtttctcagatactctttgaatccaccggtgattcaatggtcgtcaacgatgaaacagattagagcggtgattatgctgcatatttaaattggtttttctatggttttttgtccccttttaaggcattttccaatgcttcttctccggttacttttctcatttattttcactttcggctgttttctccgttcatggagctatttgattggatcaacgaagtgactggagagaaattgacactggaacatgttggcacagatcgttatctgctcacacgttgtccaattggatgggatgagcgaaaatgggacaatgcgattgacgaactgaaaaatcgaacgaacccaattgatatttggatcgaagatggcgcattcgacaacgggtga

SEQ ID NO: 23511 - DNA, 1602 bp, Heterodera glycines
atttcggcatgtactcttttgcgggggttgcctttctgcaccgatacgctggtggcacctgttggcaaaagtagcggtttggtgcgtgcgagtgcgcccgaattaggagtacgtaagaaaatttctggggagaaggttttgtgtatcccttcctctacatacctttacaaaacacagtaaatttgctgttttaccttcaaaaaatgattttttttttaaatttatcctaaacaatgtcaactataatttaaaatttcaaaaggattggtactatcactttatggaagcttgtgagatggattcgaaaacgcgacctcttctccgctacattgacccgaactttgagaacgatttgggtgagcaattataattcaccaatataaaaaggttgtcggctttgctggtccttacggttacttcgacatttatgtttcaatacagtaattcccgattaaattttacaaattttaaaaattttcagtttgttggcgtgcacacaaagaagtcgaagcaatacgagtgccaaattgggaacagaacgtcgcatttgtgaacccaaatgaggagccgacggagccgcgtgacccattgaaatactcggaactccggaaatttcccgggggtatgggcggtgtccctttgctcgttatttttttgttttgtttcttagatttgtacttcgagccggacccgtaccaattgcgaccctaccaaaatgagctggtagttcatgcgaataagtgagtaatgcatgagttaactgtgtaaaatggatgaaaattagagacaattttttggtggaaaaagccatgaattgccatgtttttcactttcagcggcaaaaacacgatcatttgtgcaccgacgggcagtgggaaaacaattgtggccaccgatatcatccgaacacatttgtcgcgtgccaagcaggagggatgggtggcacgggtgaggccgaattgggggaggggggtaggaggccacgtggccaaaaaacagtgactggaatgggcatttaccaatccacaacccgtctccgtatcttccgttatttcctaccgttttttcatatgtttgttgttgtacagtgcgtgatgttggtccctaccgtaccgttggtggaccaacagagctgcgagtttgtccagtacttggccggtagctactgggtggatggcttctcgggctgcgagaattgtaccggacgcgcccagcgcgtgttggcatgcggtgggaattggcatattttcttacgcgttgttaaatatttcccctcttccccctctcattgtcagatttgtgtgtgatgacgcctcaaatttttatgtaagtttatttgtttttttggggttttctgtcgaatgttcccataaaaaaggacagaaaaaaacgttgactaattattgtatttaattaattgttagagggttagggcaattttttttgttcaaatgatcagcaattgaaaatgccttttcacgtttgaatgggtcccggggcctctcaccaaattgcgtattttgcgttcaaattacaaaattggagtccacaatttcgtgcttcagcaacatgtaagctcggtgctcgagtcggaacgcctgt

SEQ ID NO: 23512 - DNA, 1710 bp, Heterodera glycines
  misc_feature (340)..(340): n is a, c, g, or t
agttttcaatgtgaaaatgcaccaatagtgattgactttgggtaaacttaaaattaatatatatttaaactatttacttatttgcgttttttcgcatgcttggtcgagtggtagttctttcggctcttttcattatgtttcctttgggtcagttcccatcaaagtagttgttgcttttcttctaatttttcaaaaatattcattttttcgacaaaaatttaataaaatttaacaattaaaatcgcaaaattttttcattttggactaaatctgttaacaatgcactaaaaatttcaaaaatttcaccggcggcgcctatcggcaccgccggagctcccanaatttcctttatttttgaaatcgactcaaaaaccgtgaatattctaagaagtataaaaatttacaaaatatattgctcaaaaagttaattatatttatttatcgaaaagggttggttggtctctagaaactagagaccggcgcgggacgggatcccgcgcgggattttgcgggatcccagtccgcaatcccgcattttttgaaaaatttccgatttcttgcaccgcaaaaaagtggttttgaaaagaaaaaaaatagtcaaatttatgaaccgttaataatttgatttccgatcaactttttaccgtcggatccaatcgaaaaatcttagtcgacccatcagccccttttaatgcatcccgccagcccctaaaaatttattttcagcattttttgatttttggaaattttttgaatttaattgaaattttttcgaattttccaaaatcccgcaatcccgcacgggatcccgcaaattttaaatgcgggattttcgtgattaattccgcgggatcccgtcccgcaaaaaattttgagttccagtcccgcagcgggatccgcaaatttgaaattttcggtctctactagaaactgcgtcaattgattaaatttgatatttaaccgaaattatgtgatgaaaaaaattttggaattaaaaaaaaaattttgaaaaaacttcggcttcggcttcgaaaacttcgggttttttgggcttcgagcttcggacttcggctttgaataaaaattgggcttcgccttcggcttcgagtgctaatttgtaagccgagcttcgcccagccctggtcccgatcaatcccgataaatttaaaaaatagcttggattgataccgaggtcgggatcccgaatttaacccgcgggatcccgaaaaaatccctcgggatcccgatcccgtccggtttctactgcgtattcaagttccccgaatcaggctgtacgcgtgccagctcggcatggcccaccccatgcctagctgcaagtgatccctggccgaaactgtttgtggaaaaattactcccttctgcagcatttttattttctaattaaaaatttttagaaaacccaaattaaaaaaaccacaggcataagatgccataagaaaacatacacttgggggtgctggtgttgcggtggctgcatttgctccactttgacagtggtttttctcctctaaatcgcatgaaaacagattttttctacaatattttgtgcaattataaattgagtcttgccgccccctccccggtccccgggggtaagcttttaattatttttggcaaatccgtatcaattccaaccaggggtgttcgaaaatcacaaaaaaaatttcgtatacgaaaacgaaacgaaaa

SEQ ID NO: 23513 - DNA, 1795 bp, Heterodera glycines
gggggggaagaagagggggcgtccgaagacagcttttgctcaagctcattcactcataatcagaagaaacatttccaccggaaagtaaccgcacacaaacaaaaaacagcaaaagagaggataagccaaccaaaaatggtaatgatgccaattccgtcactacaactgcttttgccatttttgccaattttaatgtttcctcaccaattccattgtgatgctaaaccgtcaaaaatggtaagattttcgtgtaaattaaatgactgtttatgggcgtatattttagcaaattcgtgccaagcgcgactttatgccacccgacaatccgggccagccttgcggctgcgcatccaaatacgcgcccattaattgccgctgcaccagcgcatccggcaacagcggcgaattgctgtgccgttgcgatcgggcacgaatcccgcccataaacaggtgaagcgattagcaagaaataaaaaagtggcacaaaaattgaagcatttcttaatttgaatatatagagtagtgctaatgatgttcgccaattaattaatgtaattaagcaaaacattggaatttttaagggaagacagcagtagtggcaatatcattagcaacagagtaggaggaccaccaccaatgacggcacattgtggtggcaattgtcgaatgctgacaggagagccgaatttgttccgacaaggagcgcatcagcagcagcatggctacggcacttatggttatggcggtggaggaggaacagtgccatcgatacattcggcttgccatccggtatgatcatggcataataatattttaattaagggggtcttcaagggaatatgatggatgtctattagaggaaaaatacggtatctgtccgattttgcagatctgtcataagtcatgcatacattcatgcccttcaagccgatcaccgtcaacaggatcaattgaccagcagaacaacaacaacaattttggcagcgggggtttttctccatcagaatttcatcaccaacagcacaaccaaccgatgccgtcaatggactcattaaaaggcaataataattttaattgcttcccgtccaaatgccgggcaaattgcctgggggcatgttcccgaatttttgatgctcaacaacgccaacagcagcaacaaattcgcgaaaattttggtgtgctatataattaaattattttgaaattatataaaaaaattaagtgccgagcaatggcatcgaaaatgacattgatgttgagccacattaccaagtggaaatgggtggtggtcaaactaaactgagtagcccagaccatggcaataacaacaacgaaaatataatgtccacgggcaggaatgtgtgccaatgttcgccatcagcggcaaacgtatgcgaatgccaagagtaagtgacaaatggccaataaactttgaaaacaaaatattacttagtgagatatgcatttgaaaaagatatttattgaaaaatatttcaaagaaataattaaaagaaattatgattttcttagaaaaaggcctggttggtctaaaatttcgggtttttcttatatttccttttcataaacccacatttcttgcccagaccctgctacccaatttgtgtcgacacgtgcgagtccaactgtcttcaacagcaaatgcagcaatcgcctgcaaatcagcgtgcacaatgtgcccagttttgtcacttggagtgccaacatgactgtgccatggaacaacaacaacagcaacgagtaccagcacgaaaagcggtagaaacgacgatggggg

SEQ ID NO: 23514 - DNA, 2287 bp, Heterodera glycines
ccccccccccccctcccttaacctccgcagaaagggtcaaacgtatcgttggcttatacgctttgcgcccgtctttcggctctttcactttcaaaattgtccgtcctaccgcatcttatcaggtcagaattattactgcaaaaactcacaatgttcgaacattcgcaggtacaaaacggcgaagaaagtgagccgaaaatcagtcgaaaaagtcggcggcgatggcgccgggcgctgcggagctttccgattgggaaaagacgccgaagggcggaaaaaaaagaaacgcggaaagcggacggagaagcggacgaattgcgacttttggagacggaacacagccaattcgaattggtattcgacaggggcacctgtggcagtgagcacaaatacggggcggaaccgctctttgaagagcattgcttgagtgaatttgcacgcaaaccgaattggaacgacagagagtggcgcaagaaaatgaacgtcggggggaaatgttcggccgaaattatggtaaggaaaacaagcataaagcatacggtaatgaaagggaagcatacggtaatggaagggtaagggaaagaagcatacggcattggaagggaaaacaagcataaagcatacggtaatgaaagggaagcatacggtaatggaagggtaagagaaagaagcatacggcattggaagggaaaagaagcataaagtatacggtaatggaaggaattcgaactttgaaatgttttcaaatcattcgctaattacccaacaaaaatgttacagaacaaagacaaagaccgcatttgtgtgcagagagtgggcgaagtgaattcggagaccgaatttgtagagaagtcaatgggaccaattcgggtggacaaatgcacggggcaagaagagaatgagccgacaaagggaggcaaaaagccccggagggacaaaccgaggacagaaagacagccgagacgcttttggaaatcgtagtcaaacggacggacggacggacaaagaaaaatgggacaaagtgccgacagacaaaactgagagagaaaagagagagagagagataagagataaagcggagagaatgccaaagcgatgtgagaatgatgtacaatgtacataatgaaatgatagctattcactcgttgaccattgacaaatgtgtgctaattgtagaataaagtctttttgaatgtgaaaaagttcaataaatggcacagacggcgattactgatcagaaattgagaaattcaaaatgaaaaaccttttatagtgatcactgatcagatagaaattcaactgcagacagcacttaataaattagttgcattttccgatcagagttcctttatttctttctgttcatccataaactgccctttcaccactttctgatcaaatccctgctaattacccctctaatcgatccgccgtttctttttgcctttgcttttcccgcgcgattttccttcttcccaattagtcgctttataaatttaatttttttttaattaattgaggaattatttttagaagataaactgaagattttctgctttgcttttgaaatgcctttgcaattttcgcccattttcccattttccgatggctccgaaatttctcttccccaattacggccccatcagcaattatttgcggtcttttttcttttgtcttattgcgacatttccaatttgttcagctcttttgcaattccttctgccaactcttcgccttttgcgatgcgtcgccgacgcacgagcatacggtaagagacaattacggtaagagagaattacggtaagagagataagagagacatacagggaggtatatacggtgggagacatacggtagtacagcggaatttaataacaccaattaaggctcgcccgcataaatacaataagtggcaattacggtcggatattttcagatttccttttctttcccaaaatgccattctgtgccctgtcaattaattagcacataaagtgccgtccgcagttccctctggtcaattgttatttatcagtccctctcccccccccatcatttcccctctccaaatgccgttctccattggcactttttcttcccaatttgctccccccttttcccatttagttttgtcctccctttttggcttccattcaccacttttgctccgtccttctccgttttctctccgcagctgtcccccgaactccgatgcaaaattattgagcagcgaccgattgaattgtcaaatttcgccattcgattgtttgctattttccgctatttg

SEQ ID NO: 23515 - DNA, 983 bp, Heterodera glycines
  misc_feature (121)..(121): n is a, c, g, or t
gtgccatgttcaggcaaattcctggcaaaattaaggaaatattattttaattttcaaaatgaaagctaaatgattaaaattgtagttgatcgtcaattttaataatgagcgaattctgtcncaatttgttctctccattcccattatgattcattcgaattccattttaaatggttctctcggattatcagtaaatgtgaaaagccatcgctatcccatttatgaaagccaaatcatcaaccaaacaaacagaatggaataaatttatttaataaaaaaaataattttgtacttaaagtaaattgtaaattgaaaagaacgaaatgaaataaagagaaaaaaggtaaacctatatttaacaaaattaaaaacaaataaaaaaactttttggataaaaatgcctataattttaaccaaaaaatcagaaaatgctcatattaaagaagaatttattatttttttttggtgaaaaagtcaccgaaaaaactgccaaaaattgtcaattcattttgttgtaccgaaatcgaaaaattttgaaaaacagcgtcttttgtgtaatttcgagagaatctttaagaaaatacgaaataagttgggatgacgagatcaaaaggccaaataattaatcaattatacagtatttatttatatatgtattttacggtagtgtggagatggtatgcttgtcaacaatgtttgtggttcctagactcggaccctttcatttcgttttcgttttggccttcattttcggcccatgttaatttcgttttcgtgtttcattttcgtccacgaaagttttttttgtttagttttcggttttcaaatgtttctttttctttcgtatttcgtttttgtatcgaatgccctttttggtttcttttttttttggacaatggacatctatctggacagtggacatttggacagtggacatttggaaagtgaagtcatttggacagtggacatttggacagtggaca

SEQ ID NO: 23516 - DNA, 1018 bp, Heterodera glycines
tgattcattttcaaaaaaagacaatagcaaatgggtgccgcactaaattaataattcggcatttctctgttttggggcccgaatttggaatttgaaaaaaaccaagaacaacaaagggcgcatcttgcaagaaacacacgcccaaagcacctctgttgatgttttcagaattcaattccgggccccaaaaacagaaaagtaacaaaactgaaaaaaagattgacgatttaaattgtaatggaaaaagacttatttaaaaatcgaattcccctacaagtccatttaaaaaaaagttgtcatttctccttcaaaaattttaagcctgttccccaatcaaatttgaaaaaataaaaattttaaggtatgtatttcatagatttttcatttacaattttttgcggtaaatggcgaaaaaaacaatgaaaaagcagttccatttgattgccgccgcccctcccacttttgcatttcgtatacccacctccatctcctccttgtaaatgtggtcatggtctgggtgacgacagccgaagaacaagtgcatctcgcccacctccttgccctgctgtttgtgccacaatcggtcgtggaggaagccgcggaagggggcgaagccggtgccgggcccgaccatgatcaccggctgctgcacccggtggggcaagcgcagcgtggacttgcggacgaacaccggcgcggtggacacgcccggggcacggtccgccaagaagttggtgcacacgcctgacgattaattcattaataaatgccagcaattaacagaggcctcgcttctcgggatcccaattctcagcgaattttgcatcgaacaaatgaaattgaaaatgaccggccaaaaatttctacaaaaatcccatttcaaacttttcaaaaaaagaaaaatcgggatacactacgttgcccttttttgaatttttagaaaattttcataagaaaattacaagaaaaaagttaaatttttttttggcagtttttatggaatttttttgaaaacatg

SEQ ID NO: 23517 - DNA, 1302 bp, Heterodera glycines
attctgtttataaaagccgcttttccctcttttagcctcctcggcgatggtgccaagccccgtggtggtgcccgatgttgaggcggatgcattcaggacgatgttgggcttcatttacacggacgatttgagtgggatggacggcgacaatttgttcgacgttctttacgcgggtaaaactttatttttgggttttcccgttcaatttaacccccaattttagctaaaaagtacaacattgtcggcctggtcaacgcctgcttggacttccccatcccttcgctgcccaacgttttcttcgcctttgcccaggcgcgttttctcgaagaaaaggttggcatttatttatttacaattagtcgataattaggggattggaaaataaatgacataccatttgtaaaataagcagcgatgctgaaaacatactaggattaattttcaaaaaaatggaagcctaaagcctctccccaaatcaaaaacaaaaaaattcaacgaaaaatataaaaattaaatttccttttaattttaatttgatttttcaatttattttgggattttgctcgccgttgcatggaatacattgaacaaaacatggacactttgcaccaatcggacgcctttttggaaatcggccaaagtttgctgtgcgaagttttggaccgagaaaagctggcaattgaagaagaacttacgatttggcggatggtaatgccaattcaaaccaaataattgggtcaattgttttttctcacatttaattgggcctaattatttaataaagtaatttgttaattttttggcactccattgggcggacggacagtgccgccaaaagggcctcgaatgttcggcagagaatcggcgcaaaatgctcggcccggcacttttcaaaattcgttttccacgcatttcgaagaaggacttcaccgaacacattggtaatggacagttcaaactcaaatgctttacaaattttatgccatcaaaaacattcatttcattagacaaatgcccaatttttttttgaaaaatttgtgctttctttaaaatcaaagattaaaaaaacgatatttttttaattttgggatagatccatctaacaagggaacctcgcgaactgtcagtcaaaaagtgggtacaaatttggtatcattggatagagcagagtcggtcgacttctattgtgaatttttaatattagcggtgtgtgatgaaaaataaaaaagttatgggcctcgaaaatcgaaattttggccaaagggcccatttccaacttttttgacttttctattaatttcc

SEQ ID NO: 23518 - DNA, 814 bp, Heterodera glycines
  misc_feature (15)..(15): n is a, c, g, or t
ggtaaatttggccanatttgaggggcgggagaaatattttaattcgatcggccgaatttatttttttcaaatttttgcttccggcatttataaaaagattaaatttgccagtttcagtgtccattccaacgttggcacttcgtggcgatgcgttcgactttttcggcttttccccgcaaacggtggaaagttttttgaacaatgtgcgcaacgccatacaaaacactgcagggaaagcgctgagttcaggtgaattgtacaaaaatattctcataacgaaccaaatttttaattgttttttaaaaattatttattaattatttaaatggaaaatattttatccctttgtaaatttaacacactttggcactattttttggtgccgatttttatttttatttcaataattcattttggcattgcgttgctcaaataattcgcaatgtttttcgcaggcgttagcctcgtcggattggaaacgcgtctctgcccgtacggcatcagtcagccgggcattcaactgctggacgacggattggtgttgctcaacgctgagttggacgcgtacgtgctgctgtttgacagtggtggtggcattggcacgcagcaaaaacgacggcactgttcaccaacggaattgtgaaaagcgggaggcaaaaaacaaagaaaaataaagccaaaagtcacacaaatagggaatttggagatgatcaatttcgatttcacaaatgttgtttcaatccttctctttatataaattattatgtcaaaaaaaggaagctttttgtactttattgttgaggaaaatacatga

SEQ ID NO: 23519 - DNA, 2223 bp, Heterodera glycines
  misc_feature (828)..(828): n is a, c, g, or t
  misc_feature (2157)..(2157): n is a, c, g, or t
  misc_feature (2212)..(2213): n is a, c, g, or t
  misc_feature (2215)..(2215): n is a, c, g, or t
gttggagctcattatttttttcagccatcttgaaattgtttaaatctaagccatcaaattttcaaatatttatagctattagctaaattaaaatcattttaaacttttgaataaagcatatttttatttttttcataattatgtatacaattaaggttgcttcttcatttattctcattaaaatattgttatactctcgtttctgcagcaaaatttactcacataattttattagattctggaatgtttttatcgttatagtttttctttctatgtttatatatttctttctaaataattaaaaatttaatttgaaatgacattaattaagtttaaacatggctccgtctcctaaattttttgacaggtttcacggaattggtacgcatatgatggtgtttaacgatcatctttcaatattttattcatttacagggttaaatatcttttctctttattttattttttaaataatcattttttagtttcaaaattattttaattaaccaaaatgaacagaaatttgaaagttgaaaatctactgtcatttggccataaagtgatgattcattgaaaaattaaataatttatttaatttattattttaataaaatttgtaggttatttttaaatgatcttaattaagcatatcattgtcaatgtctgaacctgttattttttatttataaacataattatttttattttttcactaattcatttaaaatatttatttttttactttcatttgtttttgtgtgtgattttaatgttctaaagaataaaatttttattctttattttctgttgtgaaaaatatactcctanattcaattatttactgttattatatgcttatttctcgttgtttgcgttaccaattattcttcttaattctttatattttatattactgattgttttttcagcatttcacgaacattaatttaccgctgaatttcgacgccttgaatcaatttttatggaaattttatttttattgcatgtaaaaggttttatgattatgttttctaaatattcgaattttttaaatttttactagaaacgctatttttaatatattgattaattgagacagtttgcttttatgtgtcatataaataattaattaaaagtaatgaattttatctgatataattattatatatttctgcttaactttttaccttaatgtcatttttaggttacaggttcttatttgcatccatattttattattattagaataaatgaaacagataaatgtgccgaggaatacatgacatatgtggatggctatacggaatccaaactgttgttataaatgttaaattgtgcaggttttggcgagatatttatttctttgtagttgaatattattattgggttttttaaatttttttatttagatttaaattaaaataaaagtttttgaaaatttgtcgtttttgatttgtttttctcgcctgaatccatttcttaaatttgatttcttacaccgaatgcttataaacaacattaaacaataataaaattgttatattcaattatgtaattgtatttgtacttttttaatttataaaattatatttctttttaaattcatgaaattcgcaaattattctttttccatatcacatttaaacgaatattgtattaaaaacataaaattcatttagaaaattattcacatttatgtagaaatttaaggttaacttgtttactttcttgttaaaatatttctatactctcgctctcggccgcaaacgccgtggcaagagatgtgataaacctacccgacatcttcgattctggatcggcttttaaagttaaattgtgtttctttctgtgtttatatattattattattattaaaatttattctctataatattttcaggaaacaaatcaaatatttggtatgtcaattatgaagaaattggcagcactttttcagattattgttttatcttggggatgataataatttcggattccgcataaatctaattaaatagagaataaatttcttcaccaaaataatattttttcatattttacctttttgtttaactggtaaatttttctttgagcattttgctttagcatatgtaaagcgatcagagcgaaaatggtaatgcgaattgtattcgacanataatttatttcattggaaaataaatgtttttattattgttttttgacctgcagnngncatgcaag

SEQ ID NO: 23520 - DNA, 929 bp, Heterodera glycines
cggcagcgccttttttggcactgccggtccccgacttattttgttatacagcagtttattgggcgacgagtaaaaaaaaatataaggaagagcatgtttggaatatgcttacctaaattgcatttattttcgggattttacaggatttgaacccttttttggcacttttattagcacatgcaccaaaaatcaccaaaagtctataaagtaaaaaagtatttttacttaccagccattgccactgaacagttcgccacataacagtagtgctcatttggcttgcaaatggctacggtatcttctgttttgcctccattgcttctctcccacaaaaagccacctttgcaccaatggtttgtcaggtcttttgaaaaattaatacatatcaattaataaacaaacagttttattactcgcattgttaatgaccgcttcttctttattgttggacatgtcgtcattttttcgcccaataaaataattacatttggaagtttttgaccaaattggattgttcataaatgattctttggttaagctgcagccccacactgtggtgaagccgatatatccatcgacggaagaagaagctataattcaccttataagaagtttctacccatgatcaaagcttaaaaactaatttaagactttctagcgagttcctacggggcgggacttctgtgcacatctcaaacatctagccctttgaaggatccctgggctgtatcggtacggctccgggaactgccctagaacgcgatcgacatgcgttccaaggcgccggttttgaccgggacagggaaattcccggcttttttcccggttttcccagccaaaaagtccccggtttttcaaccccaaaagtcccggtcccggtcttgcccaaatttcccggtcccactgcactctagttaaaagcaaaagaa

SEQ ID NO: 23521 - DNA, 1264 bp, Heterodera glycines
tgaattctgaaccgttttgagtagattagactagaaaacattgaaaattttgaaatcatgtttcccactcccttctcccaggggtattattttgtaaagtctttttttcaaaataaacttttcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactaaaaaaatatgagtgatcaaactttcactaaaaagttaagcctaaactttttcccaaagttaaaaagcaattaaaattttattcacctccattattgatagaaaaagcatcagagtgcctaaactaacatgtaaataaaatttggtgcgtttcagaaccctttctgaaaaaatatttatgaattaattttgcaaataaataaaaacgaaagactcagattttcgaaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaattttaaaatttaataattttcctgcaccgaaggtactcactcggcctcttcgcggcctcgtggtgggccttcgccccccccccctcccacgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctcccccataaatctgggcgcatcggttcgg

SEQ ID NO: 23522 - DNA, 1241 bp, Heterodera glycines
caacacccccgaaaacccaccgaatagtaattttaggaccaatatataaaagttaaattaggcaccacaattctgcaccatttgctagcaaaaatggccgcgccaaaaaagctcgcgccaaaaaaacctcgcgccaaaatacccgcgccaaagtggctgcgccaaaatggccgcgccaaagtgggcggttcccgttttttgggtcggtgtttaaataaattagccagccactcacagttaaattaataaattgtaatttcttatgtttttagttttcatttttgacatttattttaaacactaaacacaatgagtacaagcacatcgagctcatcattcgacgacagctcttcagaccaatgtaacggcaaaatggcatcgtaataaaaaaacacaaatgttggcaaagaattcttgacttggaccttgatccaggtctgggtttttcctagatccaaatccgaacgacaacctgaaaattttcatggttttttcataatttatctctgcttaaatccatttaaaggctcaactccgtgccattagttagaaagacaaaaaactgtgtcttaatattaaaaaaagtcaagtttccggacatttgtcgagaatcaggattcttcatggccctgtatttttctgctggatttttgcccagaaaatccagggcactctggaaattcttgtggttcagttcaactatggaagccaagtccagttttttcataagtcggcctatttaaacccagtcaaattgcctaactccgtgccattagttagaaagcggtctacgtcactgggccctcacgtttgggcctggccccagcacgtttttccactataacttttttccttgtcaaccaaatacaacattattggtatcattcgaaacttaatctgtttagaaactttttctaagctattgcttgtcggttagataaatgctaaaaaaagttatagcataacaattgcgaaaaagtcgaaattaaaattcttaatgacttttttatatgcgagaaaagcccaactgacgggttccgttagaaagatagcaatttatttataaaagttacaaaaaccataaaattcgacataaaaatccatctccctttttagttccccgtcttgaactggccgacgatggaaatgaattggaacggttggaagccgagcgaaaagcaattgacgcaaaaattgcagcggaattggcacgacggcaaatgataacggagggcaacgaa

SEQ ID NO: 23523 - DNA, 485 bp, Heterodera glycines
ccaaaaaataaacatccgcgtcctcacccgtgctcaacaaattcttcattcgttcaaccaacgatttggacatgataggcaaagtcgaaatcgtagataaatatcggctaaatgcctttgttctacaagataattaatcgtattccatgccaaaaacaatgaataatttaatgtcaaagcccccccccccctcatttctgtttttttttggaaaattcgaaatcacaaaatggtcaggggaagacaatggcacaaaattgatgcgcattgttttattcatttttaacaaaatgcctatggcagtaaaaattgaatttcaattttttatagaaaatatttttgaataaaataaatttattgaaaaatgacttcctaataaaagattgttcaacttaatattataattatgaaaggattaaacaatttacggcaaaacgatgacctaaaaaggcggaggagaacagaaagaaacaaatgtaatttga

SEQ ID NO: 23524 - DNA, 1471 bp, Heterodera glycines
ttataaggaactacaaactgattggtaagcattttcccttttttgtatacacagcggccattatctggccgtttataaaggggataaccatcttcagtaatttttgtattttcagtaaaaggttttggaaatttcttgttgcattttctttttttttcattccaacatggcgatttttcattacacggtccatgcatcatacaatttgttattattttataatgttcgggatcctttttttcatcaggaatttcagcagatataaaattatctatatcattaattgtatgccatttattttttgggtgtagggttattaacaaattaagtgcggtaaacctcttttttggtactctataacccaacaatctcctatcacttcaccaaaaatttgtttgttaaaaattaaatctaaaaaatgatttttctttaaatgaaatacacgtgaaactaaatcaggtctatcagatggagtttgattcggcaaaaggcattttaaaatatcgtaatcattagaattacatgtgaacgtgataaacaaatcaggtttgcctgtttcgttgactatagctaaagcatccataaaatttcatgcacactccttggccctcctgtaaaagtagacggtagaattacctttttttaatttatgcgcctgttttagaagctctattcttaagaagatcttcaacatttaaacaattactgctacacaattccatctgatgcgtccttatatattctaagcgatcccattcgattttagcagcttgatccaccaaccattgttgaaagttttttgcgtaaaaatgagggaaaaaatttacattttcccgaaaaaacaataaaatttggtatagtcacacaaagaaatttttttcccagttaaatttttgatgtttacattaaacccttcgcttcttattggatataataaaggataacacatttggtctacacatttgtctaacggataaatattttttaattgtttttcacctttcgggtaaaccactattctcgctggcggaatttcatcattggcatcacaaactacaattgctccaacctcattacaccttggaatactgtaccgccttttatcataatttttggaatttttaacccattttctttacagttattttcttcttttttataaacctctttcatcattaaaaaggactgtgcaaaagggtttatttttcttaaaaaagtttcaagaaactcaattatttcagagcggcattttttataattttcagaacgaatatctatagcttcttcagaatcaataaaatataactgtccgtttgtaggaatttcattatcttttggcatagcgttctgattaaatttatggtatatttgtccttgtattttatagcatggcgggccaggactttgaaatttaaaccgaaaacaactaattgatgcacaggcgaacatactattgtaacgacgtatattt

SEQ ID NO: 23525 - DNA, 1105 bp, Heterodera glycines
  misc_feature (1088)..(1088): n is a, c, g, or t
aaaaaataagaaaaattgtgcttttcttgaaaaattatttttacaaaaaacaatttttcaaaaaaagaattaaaaaacaaatatttaaaaaagtaaaaaacgttacttggtggcctaccaacaaaaattgaaaaattacaaatcaatagcttttgtttaaataacgaatttatataaaactcaatttttggtttttatataaaagaaataagtaatatgcctggatgcgacattaaaaaatatattacatatttcatcaactaaatattgttttgttgtttacatgtgaagagatacaagtaaataagaaagaattcaattttaaacaaaagttaattttaaaaaatcaaatatatttccggattctaagcaagtcaaaaaccttaataaaattgataattttttgtgggaattcattaattcgttaatttaaatagaaaaaaacgaaatgaaaagcataacggatttaattgataacattaaaaataacaaattataagaagaaaaaaacagaagaaatttaaacaatatataagtatgaaacagtaaatcccgttgacttttgtcatggaggatggagaaacattgtcgagaaaaaaatccaatcggcaaataaaaaaaatagaaatttcgctaattttatttttttagaggaatgaaaaatttaattttgtagtcatttaaataatagataaaattaatctattaataaaacatttatttttaaaagttaatgaactatataacataaattatttatcaaaatatattaaattacaaaaagataaataaaccaatgaagataaaccaaatttataataacaaaaaggaaatttagatctaaactaatcgcacattaaattattcattaaattattttcttcgcttatttacattaaaataattatgtctgaacaaacttttattcaccaatactgatatgctgatcagaaattggtgaaattaatttttggcctaatataggtaaattttaaaaaaatccgagtcagaattcgcaaaccccgtagttatggtagacaagcaaaacaataataagaaataattttttaatttttatttataagaanaatataattaaataaaa

SEQ ID NO: 23526 - DNA, 1314 bp, Heterodera glycines
ctttacccactcacatgtgcggcagggggtaaattttggtggaatatttggttttcttttcgatgttgcaaatgcatgccaaagtgttctcgccgcctatgttcattgcgcacgaaccgcaaattccttaattattcggtgattttattaattgtttcaatagaatggttaaatggcatttaaacaaaatattggaaattgttttttgggcaccatccaaagcaatttccgatttttttgttttctgatgacaaaaacaaatgactttcaatgaaccgaccttctcgacaagaacgacgaaaagtcaaagttggatccatctcatttttaattttgatcagtgcgtccaaaaccatcggcccgcattgattcaaatccacgtcatatttctaaaaaaacacaaaaatccaaagacataatccaatcggctaaacctggagaaagggtttttgttccggcttttcagggttgtagcggtaaatttcaaaggtttttacacttgggccacgagccggcggatttgtggaagcggcgcgcaaagcaatacaaaaaggaggtgggattttcgaaagaagcattactctcgccaacccgtttaaactaaacttaattaaagaagattttcactcaaattatggatgaaaagattttaaagttaggacaagaattgtctttgccgcccccgccaccgccaattcgttttttttcaacgatatattggcattttgttttttaatatttaaataattaattaatgccaaaacaattcaatttcttttacagtaaaagaaattaccaaattgatcagacaattcagtagggatgcgatttttaggcaaatgctaactttttgcgcacttaatacgcacagataagcacgaaaaacgcattttccgcttggtttggggtgtctaggatgacttttataatgcctaactttgcctattttggagtttttgtgcctaatgtgcctattttagggtttttgaaaaaatccttaacaaaaatgcaataaaaacgaaaaaaacacccctaagaaatgatcaaaaaaatttcagaaaatacatccccctaagaattgaaaaaaattttcaaaaaattgatcatcaaatttactattttttcacgataaaagtttttgactaaaaaattgtctatcgaaaaaacaattaaaatataagcaaaatttttttttttttgattaagtctacgtgctttgctacctaaaaaacgttaataaaaaattttatttgcctattttagtgcctattcgagggtttttgtgcctatttcgcgattttttgtgcctaaaaa

SEQ ID NO: 23527 - DNA, 521 bp, Heterodera glycines
tttttgtttgttaacccccgcccgaatcccccccccccctcattcctgaccacaattggtttctgttgcatcggctgttcaagttcagagcggtcggactgcaaaagaaaaaaaaagattatttattttaaattaaaaaaaagtattatttatttaaattataaaaatgttgtaccctaggcaagacttttgctaattgttcatcggttagctgaatttttggaggaaattttaaaatataaaggtaaaatacagatgaactcacagaaggaataaggacctcacatttgggcagttttggaagcgcaggacgagccgggcgacgacgtttggcagccactttcggtgaacgtacagttgttggctgtgaagtttttatttaatttatcaagaaaaaaaaactttaaaaaaaactcgctttttctgttagcaataagaccgcactttgaaaagcggcgcgcttatggcgcaaatgcaagttcctagcaatatcgtcaattttaggcattctaaaattgatg

SEQ ID NO: 23528 - DNA, 1868 bp, Heterodera glycines
  misc_feature (826)..(826): n is a, c, g, or t
  misc_feature (842)..(842): n is a, c, g, or t
ggtatagagtgcgtacagaactcaaaaagggatattcaaattttggtattatattatatatgaaatgtttaattattaggtgttctattatatgcatattttttcctgaactgcgggaagtctgaaacgtatgaaaaactcgatttaggcttgttttgagcatcaaggacgtatttccatgtgtatatgccgcgatttagtgcatattttgatctttcgaacgtattttatgtgcataatttggaatcctaataattatatacactgtacacaacttacatttcccggccttgttgatttccactgggtcatttgcttgaagttgtccgataattgcctcgaattgttttttgtaaatttctgatgtcgggtaatttatggcttcttgtgcctcgtcaacggcgccgtggttgttggcaacttggaaaaaagctgccatcactaaagggatttagttcgggagtgttaatttaggattcacataatcaacttactaatgaccatctgtctgcggtgaattggactcaaaaacggctcaacagttgccaacaatcgttttgcttcaccgatgtaattgtttgccttctaaagaaaaaaatgtctaatattagcactattttcggttctagtcggttttatgcgtcccatgaatgaccatccccagtttcttaggccataacttttttcttactttttcaatacccatattcttggtaccaagcgaaagataaaagcctcgagattttataaatgcaagaaaagagcaaatactctggggatggtcattcatgggacgcataatctggcatgggacgcataaaaccgnactagaacccaaagancctgtatacatattgtggattttatgatctttttaaccgtttaaatcgtagaaaatcccaaattccatcttcaaaattttaaataaaagacgtttcgccaaaaataattattaaatttttcaaatttggggcggtttcactggtgaaatttagtcccgtttttccgacccaaatgaccggggccgggacttggaaaatggacccgggcggggccccgggaccgggactcccggtcccggtggtttgtccaaaaaaaccggggcctgggtcccggcaaaatcccggcggggcccgtgtttaatactccaaacaagaaattcacaattattcgccagacaaatttttagtgtgactttatattaaaaaataacttttttacggtactagtaaggtttgggtccacatttttggacaaaattttttcaaattttttttttcttttttattgtagcaattgctttaaataagaaagaaaaggagatttatgtgtttatttcgactaggcaaaagttctaacttgaacttacagtaagatgtggcaatcacggatcactttttttcccatacgtttctgattttttgtggtgtaagaaatttggatgaccgtgatattaatacataatccgcgcctacccctggctgatggggattcacttgatatttatagcgcacgtgaactcccgtgtgctcaataaccaatttgctcagaatatcgtcatcctccttctgttggacattcccattctcatactgtacatatttgtttacggtagcggtgtcgacgacggcccaagtgccacccaacaattcgttgacgtggacaatgacgtcacggtgggagaccagcacaatatgttcgggtgaacgaaagcaaagtgcaaaagaagtatagttaaacgattgtcctaattgctgattaattggcttattacccaaatagttccatagaagacaattaaatgggccatattgcccaaatggggggccccgtttaagccatgtttgttaatccctgctgagtactgt

SEQ ID NO: 23529 - DNA, 1339 bp, Heterodera glycines
ctccaatataatttatcattttccttctgattttgtccatcttttttcagtttccgattcttcaaagtcagtctcggcgtttctctcactccccgagaatcatcggtcaaattgggggaactttgaatgagcggatgttggctttactactacaactattgtgaaactcggtgtttttgggcactttttggttgcataaaatcggcggaaaataaaaatgggaaagcccttcccccggctaagtgtcatttcataaattgtttcaatttaacttatgcaaccaaatccgtcgcccaataattaaagcattccccggaatctcaaattgtgttgtgcttttcacacgccattcccataatattaaacaatgtctggcattcgcttcttctccattcagtcgtattttttgtttctttttctcttcgccgctcatttcgctttttctccgctgtcttttcgttgtgccatccctttccttttccctaaaacaacacaaccaacaggggaatttttataatatttttgttgtttttgtattatgagtgaattaaaccttacaataaactctccactctcgggttggttgtgttttgtgaagcccatgcaaaataaaattcgaatacgactaaataacaaaaaaataccaaaaccgatggttcgacataatttttcatttttgaatttgtttgaaacattctgtacaatggacgaataaaggaaagaaaagcatttctgacgtatacaaacataaaacaaaacatcaattggtcaatttttcattcattcatttttctttgacccgcgctacccgacagagacgacgttttggtgggcaaaaatggggggggggaggggagagatgggatcggaaagaaaggagaatgaatgaataaatggataaaaatggacgaatgaaatgagtatggacagcgtaatgaaaaaataagtaaaaatgatgagaaaatgtaaaaaaaaaacaaaaaaaagaaagaatgtgtgggaagggaggcgatgacttagcaaatacagcagcagaagcacgtgcgacttttgctctttttcaaattttctgaaaaattaaaaaaatgccaggaatttatttatgttaagaaacaaaaagggagaagtggcaaaaaaggcactgaccgcttgagtttggttctggcagtgtttccctcgtgacaagatgcatcacctgaggcggggggggggggaggattattactacagaaatgagtacggtacgcgaagctgaactctacccaacaaacatcaaaaaacagattcaaagcgcccatcctgacactgcctagcaacctaatgaacactcaaaattata

SEQ ID NO: 23530 - DNA, 1353 bp, Heterodera glycines
  misc_feature (1273)..(1273): n is a, c, g, or t
  misc_feature (1297)..(1298): n is a, c, g, or t
  misc_feature (1309)..(1309): n is a, c, g, or t
  misc_feature (1334)..(1334): n is a, c, g, or t
taaaatgattcccttaatgaaaaaattaaaacttaaattaaataacagttcttttattttttgtaaaataaaataatataaataaaattattttattatataaatattaatcatttttgaattgaatgaacttgcaatgacttcatattttacagccgcatttctgctttttcacaaaagttcaaaaaataccctctaagacggaaaaaaatttatggaaaatagaaaatgtgaaaaatattttcatgagaaaattatcgtaaaatgaatttattaaaaaaattatttggtaatagttaaaatatgaatatttttataaagagaaaacaagctattatattattattttgcaaatatttcattcatttgcaatacaattttgattttcattattatttttttctttttgctttttccttcaataaatcaaatttcaattgtgatatttatatgatttattatcctttcactttcttgcattttcatcgaaatacattactttaatttaattataaatttagtttttatattatgaaaacaaaaaattaaactattgtattagcaatgcacaaacgtactcaactaatgaagttcaaataaattgttttttattttaaaaaatattaaaaattgaatttttataatatatttatttactttagcctcctaaattcttgtatgttttccttcctattaatacatttctattttcatatcaattggttttatttttattttaaaaattaatagaaagaatttaatacttttatttgcatgagattaaatttaaaatgagtgtagtaattttttatttaagctttatcaaattgtttgataaaaaaatgtttgaatattttaatttaataatttctcttattttttagattaaataatattttttgggtacttgtttggtatttgttaagacttacacgcaaataagccaatgttgtcccaagtcaatgttgtcccaacttcttcccagttattctttttagagtttttatgtccgatgaatttgcattaagtatttttgattatgctatttttttaaatttctttcacttgtcattgcaacttaaaacatttttaagagattctttgcttttttttttgctttgtaattaattgctaatttttttatcacaaaatattttttttcttttttattctatattattctttaattaaagaatgttgttaataaatttaataattatatagttatttttttaacctttgagacataattttttaacattttgtttcccanaatattatcaatgaaaattcattnntcatttacgtnaatattattgtataatttttataanataagactctgatattctc

SEQ ID NO: 23531 - DNA, 897 bp, Heterodera glycines
tttcggatttgccgacaacacaaacctttgctgtcccttttgaaccgttctggcacttacgcatacgcaagcaccggcaactttttgatcaacggctactgggagaaaggcacttgcaaatttgctcgtggggacgtggtcggatgtggcgttaatttggccagtcggcggatcattttcacaaataaaggacaacgtttgggttggtatttcggaaaataccacaaagccttattaatgaccccgggacttggggttggataattaaattcttgggttggcattttccgaagagaaattgacgaggaaaattgagaacaaattttgaatagactgagcacagcgaagtgaacaacacacaaattaatgagatcaaaatcagaagacaacaaaacgccacaataatttaaaattaaaacgaacccatcaaattaaatatccaaaattgcccccggcggggggggggtcttctccggtgtgcttttttatctaatttttaaatttagatttttttaaacttttttatttaattgcgttcggttccccccggctcgggaaacttcttttttgtttttttggggttttgtctcattttcgaggtcattccagacattcagtaaaaacggcatttcttcgtatttattcattttcttttttctttacagacactgacttttcactcgcccattcttcggctgaccaattgttcccgtgcgtttcgttgtgcgactcgggcgaccaaattgaggcaaactttgggccgaacttcgaattcgatttgaccactcttcgaaacttacattgacgcttctcacaataaataaaattaaatgaaatttaaaaattggtaacgagaattgactcttaaaaggtggtagtaatgttcccttttctttg

SEQ ID NO: 23532 - DNA, 1651 bp, Heterodera glycines
aaatcttgtcggtggtgccgttaagcaagcagcaaatcgctgcacaaatccatcaagcaccagtccaattttgtcacccctcccccctcccattctcgtccccctttggcgctgatcggatcggtcagcagcatcagacccatcaggacgaacggcgaaagaggggaccattccctttacggcacagcgagcggagtgagcagaggaaaaagggacgagagcggtgaagaggagcgggaaccaatcccgcctcagctgggccaagccacacacttggcccgcccgagtaaaagattggcgacaaactggtgccgttagcaggggcatctgcaacgacaaatcgatcggtcaggcaaagaccagagacttcaaattcgagaagctaacggcaaactggtgccgctaacaggggcaactgcagccaccaacaatcggtctacgagcgaccaacgatcacgaattcgagaagctaacggcaaactggtgccgttagcagggggctccagcgaaacatctcggtcgacgaacggaacaggcggaaacgaaaaatgcaacgactcgaattcgaggacgggagcgaaagcaacatggacccagcgaatgagggccatcgcaacggcgcacagcacgacgaaaatgtgcaggacggggatggtcccgtcgcttcaacgaacgaagagcaacaaaaattgccagagtaaacgaagcaacgagaggaagcaacatggcgacaggcgtggcgacaaatcagcaagggatgctacccttcccatcacgcaatttgcggagtgtatccatcccggtacggacagcgcgggacagaatcgagagagcatccgggactctcgccgctcgaattgcggaggctcgagaagtgatcgaccaagaccttaccgaaggggaggcaggctaccaagcagcgcgacttttggccatggagagaggactcaaggaggcaactcaaatcttccaaggacatttcgagattggaatggcagcagcgggagcagaacccgcaggtcaccaggacttcttctacgacatactgacgacgccactgccggcagcaacgaaacaattgcagttgcgaacccatccaacaccagctgaactgcttcaaatcgcggatgagcacatcggagacttaacgggcactcgaggatgaagaagaagcaatcgcgcggtcacgattgagcgggtcactcgggaccaacaacagccatccggtgggggacgacccacctccgctggaaaatcggaacatggaagaatgggagagatccttccaagtggcggccaaacgatggcaaaacgacggacaagttgtacagcaacacaaccgaagaccaatggaacgagtcgcgacacccgtcatgccgaatttggatgggattttccaacggcgtgccaaagtgccgtccgtcgccagcatgagagtggcgaacacagcgcgagaatggatcaatcgaaatcgagacgagatgggggcgtttcccccagcaacagcccatcggcggcactgatgcaaccaaaaatcgaaaagcagcaggctcacgtgaacgacgactatcgggagcgtcagacatacccgattcgacggcatgctcgagacgagggagaacatgattcggaagcacgggaagggacgaaa

SEQ ID NO: 23533 - DNA, 467 bp, Heterodera glycines
acatttgcgcctccacatttgcgccccccctccagtatttacactttttcgcccattttttggaaaaaaaatttatcaaaaacctttaaagacattccctactaacgcttaacaagaattattctccaaactgcctccgaataaaaaataagttcaagttcgacccctccaggtggcggttgattacttagaacccaatttattagttcgccaggcaatatatgttgtcgaaaaacactcggagacacaataattgacaaggggagaagtaagataaaatccttacaatataagtaaattatattcagatatttggaaaaaaaagtgtcattttcgtcattactattatagataaattttcaaatttaaaactttaacgtaaaatttaaatttcttgtaataaaaattggctttgctggtgcaaaaaaaaattgcgaaaaattaaagtgtaaatgctgggggcgcaa

SEQ ID NO: 23534 - DNA, 1884 bp, Heterodera glycines
tcgaccgaaatgccatcgattttctccaccgttttcgtcaacttttcgccgcctgtccaattaatttgatttttcacacgactcctgaccaaattttggtgttcattctgcgcaacatttggccaatgatcgcgaaaaacatttgtgccatgctttttttcgcgaaaattttccaatcttggcgaaaattcgccacatcaattctcaatgattgtccatcgcttcgctttcttttttgatgaatgcctcaccgaattccctgccgatgacagtgccgcggcatcggatggacaagcggtggccaaatggtttttcacgccacttcaaaacgatgcgccaaaggtgttcgaatgctggatatcgaggaactccaatactttcgaccgtgactgtacttctaaaaataaataaaaaaaacaaatatgtgtttattcatctcactaccagcagaacacttgatgagccgcacagcgcagaatttcccttccccctttatcaccaaaattactaaattttcacattttggctcttttacaatttacgtatcctaatgttagcacaaaatttcgagtcgatacatttttcaaaacttacaaaatccaatacgcaattagtgtgtgaataaataatttaaacacgtaaagtaaattggaggcgtaatgtaatagagccaaattttctgaaaatacagagcaattaatggccgaagaaaacccaaaatggagagaggctaaagaacgagaggaagctgcagaaactatgcggcggatttacgcttctcaacagcgggaccattcgccctatatcacagacagggccaaattcgaaattttcgacaaattggaatttcgtgggccatggagtgccgatgtaaattttttttttcaaaaaaaatttacatttgctgctatttaaagattctacgcaaattgcataaattggcgtataaaggaagcgagtttgagaatgatggatgggttggaaagtttcgaggtgaatacggcgcccttgagccggaggggatgaattttagtggagtgaagagagagaaagtgaaggacggagttgaagaattggtcaaatggatgaacctttgtgatgccactaacatgccaacccaaggatttgctgcgcaagcatttctctcctttgttagttaaaatggggagtagggggtgagagaatttcaagtaactaattgatttttaccaatagattcgccttcaaccttatggggacggaaatgggcgcaccgggcaattattaattaatttgattcttcgccgcagttcacaccccacattcattatcaaagaggattgtcgcaaaaaaattaataccttattaaaagaaaaagatgaacagagctgcattaattttcttgaggtattaattgtacctgagtgtacctctcttccctcaaattagctgcttttttaaaaaatccaaaaagtggggacttgtaataccaaacgtttttacggatacgctcactacgttccgcgccccgaaattaaaaaaaacaacacttattatttcctattaaaaaaatttcaaaaattcattaataattaaaaagtatcaccgaaatcaaatcatatctttttgcaggttggtgaagcaattgcgtgagaatgtgctcaaatccatcgactttgaggagatggccggcgatgtgaacaaacggcgactcatccaaaagtcggtgttcatcgaatagaatttgattccgctttccctataggatgaagcaaatgcagggcgcctcgggcttcgatggcagtgccagcggaaggcataagtgaatatgagaaggagggagatacaaatgatgatgaacacagaaagcgttcaaattgatgagaccaacgacagatacggacg

SEQ ID NO: 23535 - DNA, 2287 bp, Heterodera glycines
  misc_feature (2209)..(2209): n is a, c, g, or t
  misc_feature (2234)..(2234): n is a, c, g, or t
atagtgactgactgagcaatgtaaggggaagtactcttttatgctagtgggaggggtgaggtcaaagagcatatagagtaggcataacatacacaacagcatagaataaagaggaaaataatgaaacgtaatcgattttttgacttacattcctttattcaaattaatacctcttcctatttttcgataattaaatttaattagaaagaaacagaaaaaatttttttagcttttttaaataaaagcgtttactattaaattagaatgaaagtgaaaaagaaaaaaattgttagccaatgaaaaaaaggaaagatgagaaaaattggcagataaacttttctggtttcataaagaaaataatgcaaaatggtcataataatttctctattttgaattaattaaaaaataaaaattaatcttaaaaataaaaataacactcacaaaaataaattaaataatgcatgaaaacatcaggaatcggtgggacccgaaccatcgagccacaaaagcacaggcagacgcactaaccacttgaccaccgaatcgcttgcctccttcccatttaattcccttttccttttccttcttttttggaagaaatcccgaccaaaagtgcttgaaatccctttttagagcatttctcggacccggacccaaacaatactggtatcattcgaaagccaagagtttgtatatcatgcgaaattgtttcgatttttgatttgaccctttttaaggtatgcaaaaagcgttcaaaaatgggacacccaaaaaaagtgcaaattttgactcgtttttcgaacacagttcgaacaattcttaaccgattgggatgccgatagtttttccttatagccagtccaaaaccctatcgaatgataccactagcgccccgtaaaactcactagaaagtcttaaattagtttttaagcttggatcatgggtagaaacttcttatatagggaattacaaataaaatgatcactttaatttggcaaaatattgtcaattattgaattggcaattgagtgatcactctgatttggcataattatagtgaattattgattggcaatttaattcaatgcaaaaatatgaatttgcttaaattggattgatcaataaaagtaataaatagagaatagtaataatattaaaatatttgtaaatatgtatacagctttggcacaatgtttcgttaagattacccggcgcgggattttgcggaatcccagtcaccatctcgcataagcaaaaaacagaaaagaagggacaaaatgcaataaacccattaaaaagagctttttcaaatgcattttgtggttcaagtcatcaaactattgtgacgaagaaagggatgaaccgatttcatcaaaatcacctattttaattgggctaaatttttttaataaaattgaaaattattttttaaaaaattaaaattttaaaaattgcggattacggattgcggggtttttggacccccgtaattgcggattgcggatttccgtaactgaaaaaatctccgcaattgcggatttccgtaactgaaaaaatctccgcaattgcggatttccgtaattgaaaatccagttgcgcccaggcctgtttcagtgtcgctgaacataattctgaaatccaatttgtataatttttaatttttcaacgttatattacattacatttttgttaaggattttttcgaaaatcgtaaaataggcactttaggccacaaaaaaaaacccgaaataggcagacataatacgttaaagggggtgggccgaaaaaattttttgcgaatgcgggtcgggatttgcggaagtaatcccgcgggatcccgtcccgatgagttccaatcccgcagcgcgatccataaatttggtagcctagtggttaaccctccagtctttgttcttattttgcttgggttcgatcccccatcagaataaaaattctttcatatttttttataattcttttcactcaaatttaattaaaaaatttttcctattttaaaaattttccattgttttttagaacatcctataaagccagaaaataatcaaagatttgatcatttttggataaaatctgttaacaaatctttttcctggcggcgcctatcgccaccgtcggactcgccctcttttgcccaaagtttccgaaaaagcacgcaggaaaaaagtggggtgaaaagcaaaataaaatnttattttcattaattggaacataanaaaattgtccaatttttcagcattcatttggattttaaaataatagataattt

SEQ ID NO: 23536 - DNA, 1708 bp, Heterodera glycines
gttttccgctaatggcaacggtccagccgctaattaacttttgaacaattgaaattttggcataattgatgtacaaatttggcacaaatgagaatttcggtgccataaaaatttaggaatttgagaattaaaaaaaaatttttttttttctaaattcggaatttgcgcttatgtttagacttttgcccaagtattcctgctctccatgatgaacacaatcaccagctcaatttatgtgtacatgcaattcaacgaaacgcaccaatggatgatcactctggcccaatttacatggtaaatataatttaaaatgattttgtatactttataattatcccgccggacctcccccctcccgcccaaaaaaggtatatttttggtgccggaatttccgataaatgccttccttttttcgaaattatgaaaaaaaaatttttgggggcggggagcggagtgggcagcataaccaaaaaaaaatatcaaaataatataaaatatccaacttctttttcctatcttccaggatacatgtccatggtaagtgcggtaacaagggtgttctacaattatataccgtatattttaatttatgtaatgttattcccttgtctcactcatcaaaggctttccggcggtcatttatttggcactgaacaaaaccatacgctcggattgccgtatgctgtacatgaaagtgttccaccgtaaccggatcagctacgtcagtggcattaccatgctccgcccaattgggacagttgtcagcggagcaccaccaccagcaacagcagcatcgggagggagtggcaacagagtttcaccctctgttttctgatgactatggttataaatagggctccaatttttaggcactaaccgccaaaataggtaggctttaggccagggctgccatccgtccttgaatggcaaggacgtccttgaaattgggccctctttcttgaaaataaaaaatgtccttgtatgcaaggacgtccttgaaaacgagcatttggaaaagtttaaaaaaaatcaaagaaatttgagaaatctttgtaattttcaacaatattttgattaaattatggcattatgtcatttaaaaatgtaatttttgagaatttttgaaattttatggcattaagtcactagtcactatttttcttaaaaaattagccaaaaatcgcaaattttggtcatttttggacaaaaatctgtaaacaactcgcattaaaaattacaaatttttccggacccccctatcctcaaaaaaatttttaaaaagcgcgccgtaaaaaaaacccattttataaacaaaaaaagtcgtcgcatggcttaaaatcgcaaaaattaggcagtttttggtgaaaatctgttaacaaattgcattcaaattttcaaaatttttccccggcggcgcctgtcggcaccgccggaccccccccccccctctgtcccacaaaatttttggaaaaagcgcgccacaaaaaaagcgtttttaaagcagaaaaaagtcgtcgtaaatgaggaaaatgatcagcggaaataaaaaaatattggaaaaaatccattccggtgaaaaatacaagccatttgaataaatattaaccatttttcattgcatataataaaaattttaaatgtccttggatttcatgaattttccccactatgtccttgaaaatcggcatacccgtccttggaaacggag

SEQ ID NO: 23537 - DNA, 1096 bp, Heterodera glycines
tattttctatgaaaattcattgtaaagagtaatttctgggccctttaaaaatgagatttttgcatttttttagaataaaacatttattcatgcaattaaatagaaatttttttgtgcaattaaatagatttttttctttttagtgttttagcaaaattttattgctgaaatttattaagtttcaagatgtttttttcatcatactttatttttagattaattttttgggatttatttttttagaaatttgttcacaatgagaatagtagcactgaatatacgaataattagaattcaattctgttttccatatcaaacattttacaaattttagcaaaattaacatttataatgttgtaaaattaatttaaaaaattaaactgatttcaaattgattttgtaatttgtagaggcgaaaatgtaaaagtaagacgtgaggatccatgccagagtgggatgggaggagacggattgtcccaggactgaaaggtcttaatcttaggaatcgggcccaatccccaagaagtccaaagggtccaatcgttcgtgtggctctttattatgtcggattaaatgcgcgaaatgtgtgaataaataaatgattaataaataattaatttgtctttgatcgctccgacgtccaactctcatctcctccgactcgactgactgattggtgggggaaacaaatgaacggaaagggggcggggatttgtgagagttagagtaaagagaaatagtgaatgaaatggtgaacgggggaatcggaaaagatgaataacatcgattggccaaaaagggaaatgtgtgaaggattcgtcttcgctcatgggtgataattagaatatgttacaataataagccaattgccaattaggacaatcgcttaattatccgttttttgtcgactttgcttttgttcagccgagcacattgtgctggtctctcaccgtgacgtcatggacatgtaaaccaattgttgggcggcaattgggccgtcgtcgacgtcgctaccataaacaaatatgtacagtatgcgaatgggaaggacgaacagaaggaggacgatattctgagcaaatttgttattgagcac

SEQ ID NO: 23538 - DNA, 2351 bp, Heterodera glycines
ttgttttaatattttaaatccctttgcttcgattgtccgtctttcttcttctgttccctctctccgtccaatggacaattaatcgcattattttagtggacaaaaataaattgtgaatgaatgaattgttggcaatttcatttcaaaatgggattcggatgaagccaaaaagcggaaaattttaatattttattttctgcgcttagggaatgtcaacaaaaatatggggaaaaagaaaaggaaaggggaggaagcaaggcataaaggggaaaggagaatggcacaatgggaaggggaggaagaatggcatattgggaaataggggaatgaggaatggcacatttgggaagggggaggaagaatggcataatggggaacaggggaatgaggaatggcacatttgggaagggggaggaagaatggcataatggggaacaggggaatgaggaatggcacatttgggaagggggaggaagaatggcataatggggaacaggggaatgaggaatggcacatttgggaagggggaggaagaatggcataatggggaacaggggaatgaggaatggcacatttgggaagggggaggaagaatggcatattgggaaataggggaggagtcgcacactggtgaagcgacacattgcgatgacgaacggaccgaattttcacggggggagcgtgagaatgggctgaataatatgaaaaacaaacaaattttggaggtgataaatattataaaaaacggaaaaagatgagaaaatgggggaagcaaaagtaatcgccaaaatccatcacttctaaattatcgaatcgaaagataatttattaccaaaggcaaatttaaaatcgaaattcttttcgggcagagaattagcaaaaacaaagctttggccaaattgtgctatgaatgtgccgcgctgatgtcggaatgagcattcattgtgccaatgccacccaaaggcaattgcaatgaaagcgaagaattccgtcggttgccacgcaaccgacggaaaggtgcccttccggtgccaattcacttggcactgtttctgagggagtaacggcaaattacaaaagcaaatgggcggtaattaagcaatcaaaggaaagaacaaataattaaacggaaaagagcagcgcaccgaagcattgcttttagacgcaagaaaaatagagctgtgatcgcattggacgctgaagacattcattctattggcctttccccgatttgggggtgccgcttttgctcaaaaagcctttccctttccctctttcgctgcgggaaattttgtcaggaatttaattggttgagttggtctcggaaaaattgacattgggacgataatttacgttcttttataagagaaagcgaaggtaaagagacacagaatgccattcgttcgttgggacgacgaatgaagcttcctagtgaaattttaattaacaatagaaatttgacttcggtttttggcattgaaaatacttcttgctcatttcaaatgtagctaaagttttttaaatccttttttattttattttaaaaatgtttattttttggaccgttaaattccggagaaaagatggcttaatttgttaatctcagtgggctttttttgttgaataaatgaaaagggttgtactgctgaagcaatataaaattacaacgaatcgaccaattattttgccaaaggaaaggcaacggcgcattgcctcgccgtctcgggtaaaatttgcccttattaatggaggttttggcactgtgccgacaatggattcggttgccaaggaaatttggtggaaaattcattcaatgggcacaatcaaaaagaaaactcaaagaataaaagctcaaaatggaaaaattttaagaatttttgtacatattttagtcacaattaaacgcaaaatttgatcatttgcaaattgccctaaaatgtctttcattcattcgtcgccaaataatgctgacaaatgagggtaactcatactaattatattggaaatatttcaggcgtattcccaagcaaatgtttcagactttgctttcgactttagacccccccccccctcatttgtcaggtcgtcgctttaatcccctgggggtgttttgggcccacaaaacagctgatgaccaatgaaaaacacttttatcgatgtataaaactgacaatcgaatttataaacccaatcatccatttgacgaaataattaatcaaagaaaaaaggctcagacaaaaataaaatgttaaattcgatcaaaaaaatggtggcgcataaaatgttcataaaatgccatgggacgcgtaaaacaggacagaaccataactttttaccgtaataaaaagtag

SEQ ID NO: 23539 - DNA, 201 bp, Heterodera glycines
cgctcctgctcttgatcttttcgggagtatcaccggccgactgagttccgcttcttcgcaccagcgctcggactccacacgacgtctgcgagttcatttgcgttaccgcgcaaaacagctcttgcgaaccgtcatttccctagcctggcgtgggaatgttaacccacttccctttcggcaaccggatggaccaactgcgca

SEQ ID NO: 23540 - DNA, 1476 bp, Heterodera glycines
ggaacgcggcgggggggggggggggggggcggggaggggatggggtgtcaatcgcagcactcaattaaatattcaaattttggtaatcttaggacgccatttatctggttttaaaattaaaattgtcctataaattttaaatattttcacttttacctttctattgtttttttattccatttttagcaaaaactgtgaaggctaagtcaatcgtaaataagtgttttatgaggggggggggtgaaggtgaaaagcgaatgaatgggcaaacgaacaaagaaaagagaacgaatgatttgtgcgcgacttttattccttttcattggaaaagaatctgatgcttttggatttaattagtttttatttctttttaggccgatgatttgataaaggcggaaatgtacgcacttatggaatgggacacggaaaagaaagagccgacgcatttgtacaccttcgaagagagggaaaaggcacgcaaaatgatagaggaagaggcgaccaaaatggcacaagaggagggcatcgagcccaacttggacgcacacatgtggcaagtggtggccaattgttcttctgaattggtgcgccaccaaagccgcttcaacagactgcaaaatctgcacaaaaaggaacagatcgaagtgttgtcggaacgcttcaaggcgagtgggctgttgtttttggccaaattggtgcattttgggcctcttttaatttgttagcctttgctttaattgaccgctaatccgctaattccctcccccattaacctaaccatccgagcaatttatgcaccaaagcatccttttggcaaaattccttattgatgcacagtcccgagttccctctgctctgttttggcaatttgtttggatgcttccaattattaattgagtttgtttgttcaaagcggggactttgcctttccccaaagattattcccccgggcaaaaggcatttgatctctttgcctttgcggtataatgtggcagccgtgtcaaattacgcaaaacttattcggaagatggggaaggagcggcaaataatgaatattaatggactttatggtgaaagaattttgagaaattagacgacgagaaaatccctggagaaattggggacaaagcaattaaaaatgtccaattggtccccaaaatatgcaaattcagaaaaataaatataaatttttatcggttaagcttttattcaattggatgtcacagcaggcgcaacgcgtgcaaaaagtggagaagaaagtgaaagtgaagctgggcggatacattgtcagtgaaagggcaattggggggggggggacaatcagtcgggaatttattaattgtcgggaactaacggcttttcgaaattgcagaacattcattcgaatctgcacgcaaagttggacgaattgcacagggagaaggagaaacttttgttggagctgaagacatttcgccgttggaggagaagaacaaa

SEQ ID NO: 23541 - DNA, 1889 bp, Heterodera glycines
  misc_feature (9)..(9): n is a, c, g, or t
cagcgaatntaaaagcgatgttgtgaatgcgttggttctttctgaaacatttttgaccgacgaagtaattataaaaatataaataatttttattcatttaaaataaacaattttaatacattttttatttatttaaattattatttttattgtttaggtggtccgcgctgggctcacacttttaccatttttgctcatcggcttctcaattatggttgtgttttcgtcctgcacgatgagcatgtaaagattatttatattcatcaatttaaattattaaaggcccacaattagcatccaaaaaactgactataaaattcattttatctgtaaaaaaatattttattaaataaattttttaataatttttaaattaataaaataaaacaattttattcgttaagaattttatttacttaaattaatattcattatattttaccttttttattaattatttttgttgtttgaaattagttttaataaatagcaatatttagtttaaaaaaaaataaattatttcaataattaaaataatttacaaatttttaaaattaacataaattatttttaaatttgtacagctccgctttttatgtgcgtcagatgggcgcacagaaaatactgctcgcggtcgtcgcttgctcatgcccgttcatggcatgtggttggtttgaaaatggggtaaaaactccaaggacagtttattttaaaggacaccagtgaaattaatgaaatccaaggcctccgttctaaattattttgcccaagaatttttctagaggactactgcatttcatctaataaagcatgtttgtaccatgtaaatgaagttttttgggaatcaaaaacgggattctagttcctccaacaaatttcaaaacttaaatccgtgtccctaaaaagtgataggaagccgaggagtactaccatgtaagcctcaaaattttggaatcggaaattccaaggtctacaaaaaaatcgggaaattgcaaggtttttttttcaaacaggcacagcccttggcggaatgttttggctcggctttcgtttcggtaattttaattttgtcgttttttttaaaattttcccaattaaaagggtcactgctttgtgttacgccctttttggtgcttgcgctcggtgtcgatgatgcttatttgatgctgaacgcgtggcagaggcttagaattaggcgagcactagcatttttggcgcaatttactcaaatattggtgcaccataatttcttaatgaaattccagcccagaatttttaaatttaacccagcttccggctgtttttctgccgaccatttaatggaccccaattattataagtttgagcgctgaaatggctataaaatttttacaaatggtcgagccaattcagtactgtataactgagcgcaataatatattggtgctgaatcagcgggcgcagaaataataacctcctaagccatgcaaaatttcagtttggaaaaaaagcttgaacatgagggcaagccagtgtcggtggaacaaattgtgcaacggttaatggcccaagtgatggtggacacgggtacgaattttgtgatttttccacaaaattttttaccaatttcttcaaggggcctccatcacgattacggtatggtctggaacaaaatacatggaaaatactggcgctcatcttttaaatgataaaaatttttgagtggaaaaaaataaaaattttatcagagctgtgaatttctccaggatatttttccttaattgaagataggctgtctggaaattgaaaatttctcgattcatcatatacgaatttttgcaatacgttcctttattggcattttttcaaaaaattttcggaattttgccagcagtacatatccggcacta

SEQ ID NO: 23542 - DNA, 1506 bp, Heterodera glycines
ttgctgttgttgaagttgctcatttggattattttatttaaaattatgtagcgaaaaaaacgaagcgaacggatgaaaatggtgcaagaatggcagaatgagatcatttggtccaaactccggcaccgccctttcactcagtgagggatgtcacaaagaacatttgttgccatagggcgcggttgtgggggacatacaatgcgacgatcaaaacgaatgtgtcaatcaatcatcagattaggggcacaggaccacaaagactaagggctttgtccatagttaggcccgagaatacacatacgcggtaattagtcaaaggattaaactttaaataaaaaaatttaatattttaaatatcaattcatgtcgtccatgtcaattctttccaagcactttcgttttccttgcatgtagttgtttcttggaccacctctacagtatgtaggaccgtaattatcgtaccaaaagttattttgactgtcattttcgtcattatcgttgtttttattgtttctgtttttattgcggttgttggtgttgttgtagttgttattacgtggatgatatgccataaattgcacagaattcatatcgctgagtcgcatgttgagcattgtacaatgtttgcacaggtgaaagttcaagtccacacctccatcgttacactctgttatgtcgtccttacggttgtatagctcttgtgcacacattttacatagtttaaatgtcaacatgtatttttgtcttttcaatttccataactggtttgtggggcgcgcgtagcagtgatcatgttcgatcacatcagtttgatgttgttgatcttgttgttgttgttgttggtgttgttttggcattttgtcctcatgctgaaactgattattcatacaaactccttcactttttttaatgaaattgtccatttttcaaaaaattagttttaatgaatgattaaagtgtatacttaagcatacaatctgcacttaaataggctgctatgtacgattttttgaagcgaattttttaacgcaaaatttgaatacaaattttgaggatgtgtagtgagtgattcgaccattcattctttcaaaaagcacgcattcacttttcgtgtaactaactcctgctcagatgagtttgctcgatcaattcacgaatttgtttaactgttctgcttatgacgttagtaacagactgcttagtgatgctgagcgaacaaaggctttagtgttgtgtaatcacaaacttctcactaccatgtacaaggaccgtaatggactgaatcacacgttcacgtgtactggtctgtccgcagagggagcagaatcccttctcgcttatggaaaactgagagaaccgttcaatatttctgtcgctgcccattattacgcacgtcatcgtataatgctgagtcaccccaaagcaccatgtgctattgagcgacaactttgtctcatcgtggcggacagcgaaccaccgtattaaagttctatcccttggaactcg

SEQ ID NO: 23543 - DNA, 1569 bp, Heterodera glycines
  misc_feature (80)..(80): n is a, c, g, or t
  misc_feature (91)..(91): n is a, c, g, or t
  misc_feature (154)..(154): n is a, c, g, or t
ttttgatttgtattatttcttgatttaattttatttgtttgttttcttttgggcgccatgtaagagcactaatgttcctntggttgctcgnataaattaaatcaaattaaaaatttttaaatagaaattaatgtgtttacatattattttcttntaaaataataaaatattttttatatggttttattaaaattctagggcttcaataaatgtaaatttactctctcatcaatttcataattagtattcactcagtgagctagtgattattaaaatattttaatttattcaaataaatcaatataaaaggaatcttgcgtaaaaaaaggagtataaataatattgtttctaatcaacttttaaatatgaaaaaaatgttatcttatataagataaacaatttaatgaagaaaactaaaaataccacctgaaacaaaaaattgcattaaaaataataattgttggataaatttctccattaaaatttattatttgatgactattagtaggcttataagttgtatgcactaaaaagtgccaaatatgcgcataaaatatgactaaaattcccacaaatatgccctaaaaacccgaaaaaacataaatatgcactaaaatatgcattaataaaactgcaaaaaattggctttgaaccttcaaaaatgcaaaaaattgtgtaaaaattcagaaatgactttaaactccaaactatggctaagtgttttttagacaattacaaaaagttttaattttcaaactttatatatgcaatttcgaatttttattttatgctaaaatcaaaattgcttttttatatttacaaatttttttcaaaaattctcagaaaaaaaaatttaaaatctttagttttaggggagcaaaaaagtcaattcttaggggtgtgttttacgaaaggacaacggtggaaaacatattataattttagtcattgagcaaaatgcatataaagattatcataacaagtgtttaagagaattattactaaattctaagaaataaaaaaaaactattaatttacttattgttaaaacaatatattgatttttaaatttctttataaattcattacatattctgttaattcactgaattaaatcaacttaaatattatattgctagagataaattagtatcaaaaattatggctattaacaatgcattcagatggccgctcacgagaaattaagttaaatgcaaaaccttaaaaaataaaaacaaacctattcatatatttaattaagtaaatttaaattttaaaatttttaattttcattactatcaaatttaagaattctttatgaataaaaaataagacaatttgttgaatctttgttcagattttggaaatataataaaagaaattatttttggatgtatcttagattaatcattatttaaattatttaacaaaaaaaaaattttttcgtaatttactttaagacagaataaataaaaatatataacataagaaaaagatcaaacagattaatggaattcaaacaatattttaaaaatgagtcaaacaatttataagataatctttcggtat

SEQ ID NO: 23544 - DNA, 1603 bp, Heterodera glycines
attggttactcaacactaaaatttgcttttgttattcgtgtaattccaatttcaattttgtctcccgatttgcatggtcccacgcccgcaggtgtccctgtcaaaatcacatctccgggcattacgctcacgcgcgaagtgacatattcgagcaaagtcgggacatcaaacatcatcgcattagtcttctccttctgtctgatttgccgattgactaaaaacaaagaatcgtaattaaaaaattatagggttcattatacccaaacagtaaatttcaatgtcatgggggttttgaataacacttttgttgatgaattcgccaattgggcacgacgtgtcgaaggatttcgccaaaaaccacggatgccccgcctttttaagcctgtcttgcattcctcgatcagtcatatccaatgcaatgcaataaccgccaatgtaatcaaaggccgattccttttttatccgactgcccggggagccaattaccacaccaagttccaccttaaacttattttataaaaggaaatgcgtctttaggttagatggcgctcctatatctaacatttaatttagcaccgagcaaaaagtcgaattaaaattttaaaaaaattctataaaattcaagctctcaatacaaacaagaatgtaggcagaaactgtgaatgggcattgattggattgcgttaactgtagtagagaactgaacccacctcataatgcagctccgaacatccactcggcattttaatttctccaccagaaagtaataaagcatttgaagttttagcaaaaatcagcggttcttttggcaccgggttggacctgtaaaaaataaaataaataaataaataaaaattaattgtatacaattccaatgcatgatccctgtaatttcgaccgatgcaaatgattttctgcgtaaattcgtggaattttttcagctttatcattgcagacatagtgaaaggaaattatattacctacctaacatataagtgtgggtctaggcgtttggagcaaaaaattgaaaaaaaataaaactttttaaataagatttttttaataaagtttggcattatatatttttttaaaggaaaaagaaatggattgtttggtgtttgagcttgaggctataggcaaataaatagacaaataatggtgtagcgtaccaagtgcttatcttcttatacttaatttctacatagtcggcaaatgtgggactgagacaacgcgacagtgccacaacgcagtcgcgtcccaccctgataggcgtagtatatacaggctttcttcattaattagttatgccttcgcattttagtgctcgtaatgacgtaattactattttttagcattaaacaacgagagtgatgtttagattccgcgagtttaaatagagacaggcaaaacgaaaatatagatatagagtttcaaaataatgatgtcttataattagtgcaaaagaaacatcatgtgtaaacattagtgatcggaatttgaaatgaatggaccgatcctgcaaaatcccggcatgactccggtccctccgaattctaatcatttatacccacaatacatttgctataatataatgaccttttgg

SEQ ID NO: 23545 - DNA, 987 bp, Heterodera glycines
attgctgcttcagcctcagaccgcagctgaacatcagaaggacatcaacgaatcgtcgtcgtcctcctcagattcctcctcttcgtcctcgtcttctgacagtgaaagcgacggcgacgagtcggacgcgggcgaaagaggcggtgccacagccgaagagcgccgacgcacgtcgcactcacacggaagcatgcagtcgttgaacttcacctccgtaaaacactccatttgcttacatatggtttatcttcggttatttttcagatctttaaaagtaagcgcaagcgccgtcgtccttcccactcgcgttcttccaccacggccaaagaggacattgagatgggcaaacagaggaaccgaggttggtggttgcctcgagtggtccaatccccgttcgaccacccacaacttctgcttagattgccaatgccttttagtgacaagtcgcagtacaccgataaaggagggcccaacgttgaaggccgttgatgaagacggtgctggtgctaaacaaaggaaaagcaaaggcagggagggccgtggcgtccgtgcacttgtcgcccattcgacgattggagcggcagcggtgccatcggcgaccaacagtgattgaggagcaattcgtttttactaatggaaaatctttaggtaccggtggaagtccgctgttgtcccatgctccgcttccactgaataacgcaattaaccacgcctggccaactccaaaaacttacggcgcaataaaccccgacggaaaatcgccacattttctcgtgggaagtgacgaaaacattggcgactcgtcaaacgaagctgcttattaccacccaacaacaacttttccgacgaggcacagacgaaaaaagacagtgctcagcgaaaatggtcctttttaggcacatattttcgatgctccactcttttttagcaattttgttttaaagccattgaaatataattctgggaatatttgaaattagtcataaa

SEQ ID NO: 23546 - DNA, 664 bp, Heterodera glycines
cattccatcactgggactcaaatctccggcattacaaacactgggactcaacccaccaactttcaatgacattccaatcgctgggactcaacccaccagcatttcaatctctgggactcaattctcctgcatttcaatcactgggactcaacccaccaactttcaatgacattccaatcgctgggactcaatccaccagcatttcaatctctgggactcaattctcctgcatttcaatcactgggactcaaccgcagcaaatttctttagcatttttaactttttgtgtgccttgggatgttgaacagttggggagggctcggccgcttcgcggcctcgtacgggggccttcgcccccccccacaattttttgcgccaaaggtaccatcatttaatcactgggacttaacgcaccaacattccaatcactgggactcaactctccagcattcaatcactgggactcaacccaccaacattccaatcactgggactcaactctccagcattcaatcactgggacttaacccaccaaacattccaatcagtgggattcaatccaccagcatttcaatcagtgggactcaacccacccaacattccaatcaaagggactcaatccaccagcatttcaatcagtgggactcaacccaccagcatttca

SEQ ID NO: 23547 - DNA, 1192 bp, Heterodera glycines
  misc_feature (95)..(95): n is a, c, g, or t
  misc_feature (616)..(618): n is a, c, g, or t
  misc_feature (689)..(689): n is a, c, g, or t
  misc_feature (729)..(729): n is a, c, g, or t
  misc_feature (731)..(731): n is a, c, g, or t
  misc_feature (733)..(741): n is a, c, g, or t
  misc_feature (817)..(827): n is a, c, g, or t
  misc_feature (837)..(840): n is a, c, g, or t
  misc_feature (853)..(853): n is a, c, g, or t
  misc_feature (857)..(864): n is a, c, g, or t
  misc_feature (868)..(868): n is a, c, g, or t
  misc_feature (880)..(886): n is a, c, g, or t
  misc_feature (894)..(896): n is a, c, g, or t
  misc_feature (898)..(899): n is a, c, g, or t
  misc_feature (901)..(902): n is a, c, g, or t
  misc_feature (912)..(919): n is a, c, g, or t
  misc_feature (951)..(956): n is a, c, g, or t
  misc_feature (961)..(961): n is a, c, g, or t
  misc_feature (1051)..(1051): n is a, c, g, or t
  misc_feature (1070)..(1070): n is a, c, g, or t
  misc_feature (1091)..(1091): n is a, c, g, or t
gtgtggggggggggggggggggggggggggaaaaaaaaaaaaaataaaaaaaaaaaaaaaaaaaaaaatattttttttttttttttttttttttntttttttttttgcggcggggggggcgcgtctgcgccccccccccctcacaaaaccaacaaccacccacccccccccaccaccccacgctcgtcgtatcgtgtggggggggggcgggggggggggggggggggtgttggttgtgtttttctctcccccctcccccccccccccccccccccccgggggggggggggggggggggggggggggggggtcgcaccaacaaaaaaaaaaaaaaaaaaaaaaaaaaaaaagaagggggggggggggggggggggggggtgttttttttttttttttttttttttttttttttttcccccccccccacaaaaaaaaaaaaaaaaaacaaaccaccccccccccctttggttaaaaaaaaaaaaaaaaccccccccccccccctctttttttttttttctcccccaacaaaaaaaaaaaaaaaaaaaaaacactgttctttttttttttttttaaaaaaaaaaaaaaaaaaaaaacccccccccattttttttttccnnnaaaaaaaaaaaaaaaaaaaaaaaaaaaccccccccaaaaaaagaaaaaaaaaccccccccccccccccccnccgagatgaggaaaaaaaaaaaagaaagaagaaaaaaatntncnnnnnnnnnaaaaaaattttaaaatttttttccctcccacaaaaaaaaaaaaaaaaaattttttgtggaaaaaaaaaaattggtnnnnnnnnnnncaattttttnnnnggagtattctaangggnnnnnnnncaanggccctttgggnnnnnnncctttggnnnannannccctgaggannnnnnnncaaagactacagggagagggtaaaagcttttnnnnnnggggnttagtatttttgtatctgcatattaaacaaattttttcacgatctttgcgggcaaatatgggacggagccccgaattaaattataaaatnttttccgggaagaccctcnaactttgggtaattaaacaanaatatttgaaatggtgaaaaatatcttcgtcctgtgcgtttggtgacgcacaatcaattgcaaacgaaaacctgtcaaaccattcggaaattctgctcttt

SEQ ID NO: 23548 - DNA, 1589 bp, Heterodera glycines
  misc_feature (93)..(93): n is a, c, g, or t
  misc_feature (140)..(140): n is a, c, g, or t
ataaattttcattttttcccattttttcattcttcgttattcgtttactgctaatgccaaattgtttcttccattttggattgtttcacggtntacgccaattttcttgccaatttcttcataattttgttgccattctnttcttgaatattttctattttgcttatattcatttgacatttcaataaatttttgaacaatttcaagtttttgttcatcacttttggatttgtgacatttatttctttgaagaccaaattctttaatccattttttaatataattatcatttgtccccaaactcttcgctattttcgtgtttattttatcccattctttttttgaatattttattcctttttcctttattttctcttttattttataatattttgaaatgatttctcttttattctcttcatttcgttgtttttcttctttttcttcccatttttctccaaatatttcatcaaatgatttttgcggtagttttttattttccgttttaatttgatgaattttgatgatcaaaaatataattggaatgaataatatgcgtattttcatcttcttaacaaatttttttaaataaatttaataaaaaaattttttcttgtataaatgtaatttttgattattattttgcatttttattgatgtaaaaatatcgcctttctactgatttcctgtaaaataaaaaaaagtcatcctaattgaaaataaataattattttaatgattaatattttattctactgatcattgaataataaaattgtgaatatatgtattattgaaattttatatatttttaaaagtcaaaaagaggctttcttttttaaaaagagagattctgtcggagataaagaagcaaaacggcaagtgaaagtgacaacaaataaaattgcttaaaatccatttaaattaaagcatgagtaattatggcaaaaattattctgactcattacaaaaattgaccatcacaattttttttgaattcttgaacaaattcagaatccgacaaaagtatccacaaaaaaaaatttttagctcatttatcatccaaaaattccgatctatatggacaagtggactgtgtttttgaagatattactttcaattttgctaaatttgaatcaattaccggctggtaccggtaatggtacggctctactttaatttaaataaattataaatttagtttttcaactttctgattcttggcgaatttttttagagtcgggatggccgattctgaaatccatttcgtccaattccaaaccccggacccgattctaaccaaatgtcgaaaattcatttaaaaccaaattcacttttttgcaaaaaaattcctaaaaaacaatgtgacggagatgtctttgaagaattgatgcgagactgggcgtgaagtattagcctctcgagtgcttcatttcagggatggcattccgaggcccaaaaattttagaaaatcggaatttcggggtcaaaaaattttcggaaatcggaattccgagggccaaaaaattttcggaaatcggaattccgagggccaaaaaattttcggaaatcggaattccgagggccaa

SEQ ID NO: 23549 - DNA, 1288 bp, Heterodera glycines
agaatttcgacaaaaagagagcaaaaaaaaaaagtgttgcgatatttgaggaattttaaaataaaaataaatggatcctcggctacctacgcttcgcccactcgctacgcttcagatgagaggtataagaagttaatctcaacaaaaaatattttatgattattctcaaaaaaaaaacattcaaaattttgatactaaaagagattttacttctaatattattcgaaataggttttatcaaaaaatttcattccttgaacaaagtctcaacatccattcttcaattgttcgagcagttcaaaaaatcggggccaggatcagagcttccatgagcatcatcaggaatgctaaagaaaattatcaacaaaaattaacgaatatatttgatacaagatggtgatggaaaaccactttcggagttgttggttcgtcgttcctaaaattaaaataataaattgcgcaattaaactacatcctctttttttttgcaagttttcttgctcaattccattattcttccaaaaaaccgaaaattttacaagctatagctattcttttttcaatagtacaatagttaaacccaattttgtccaagatcaaggctcttctgcagtttagccctcaatttttttttacttttgaaaacaaaaaccctcataataatgctaatttgtaggttttcggattcgctaatcacaatctggcatccatttcgatccatttccaatccatgacagccaaaattaattattcactataattcagagttattgcccaaaatcgattcaaaattcggatccaaaatttagaaatgggtcgaaagattcgtgatcagcaacttcaaaatctaattattatggatttttgttttgtggagagtaaactgctaaaagcccaagaccaatttaaaaaatgtggggttttcaataaatctttttgtaaattttttgctagaataaatggagcaaaaatggtggggtaaacaaatgtagaccgggcccttcataattatggcagtttaataatttctggattcaaacatgctggtcatccatcgcagtcgcaaccttaaaaaaagcattcattttaattttcatttgttgctatttttgttcaattccaaaaatattttgaacaaaaagaaagttgtattctctgtcgttaaaaattatgaaacagcaatttttcatgaaaaaaaaaatctgaaaattaaaattttttcttcgaagattcttataaaaaacgttgtaaattttttttgtttgaaaatttaaaaacaaatttcggc

SEQ ID NO: 23550 - DNA, 1083 bp, Heterodera glycines
cgtgcatgctctaatttataatgaaaaatttcaaaatattattataatatagactcaagatattgacgaaatatgaacaaaaaatattgaaagatgaataaaattgacaaaattggggaagaaatttctcaaaaactgaattcaattcgaaaaattttaaactgattatatttttgagacaaatagcgaaaaattaatttaaattcacaaaaacaaaaaatattaagattcaacagtttttttttcttaaaattagtgacaaaatcggtgtaaaaaaatttttcttttaaagcgatcaaatacattccaatgttgtagcttataagtagagaccaaaattttgaggcatatgcccttttttttgcgcactagtttcgatatattatgcataaaattccacttggtttgaggattctacgttgacttttattatacttttttaccttttcgggattttcgtgccttaaatgccttttttggcattttatctttttggtgcctattttggccttttttcgaataaatgtaataaaatttcaaacaaaattttcccggtggcgcctatcggcaccgccgagtcccaatttagccttattatttaaaaaaaaaattttgcctttaaaacgtcttgaaaaatgtgtttaaaattttaaatgccttttttatgtctttttcgcgatttttggtgcctttttttgcggtctctacttataagactgtcagtcaaaaaatgggtataaattagagttacgacccgagcagatcccatacccggatacccgggttttgcaagagccggacccgaaaaaaattaaatggccttatttatccggcctgtggccctgtggtcattcattccattggattctattctttccttactcaggttcaattcgttcgcacgcacggtgtggtccagggatgtgcctaggtttcgcatttcgcctttcgcattattcgcattttttggcgtttcgcatttcgcatttcgctttttggcgcgaaacgcgacttttacacccctaagaattggattaaattcccataaaatttttcaaaattttacctataaattggctaatt

SEQ ID NO: 23551 - DNA, 1679 bp, Heterodera glycines
  misc_feature (1621)..(1621): n is a, c, g, or t
atccggaaccccatcagtttcggcctgaacgttttttgcattaatgggacagctgaagaaaagtgacgaattaattgccttcggaattggaaaacggtgaataattttatggctttaaattaattaaatttcaatttaattaaaatgcaattatattattcattttttctttgaatacagacaatgtgccggagaaccattggccagaatgaccttatttttgtttgccgccaacttctttctcgcatataaagtgccaaaaaaaaaatatataatataaataaaaatgattttttaataaaattacacttaaaattaattgaataattttaggtgcttccgtctgatcccgaaaatccaccaagttctgataaaattcctggcttatcagttggtgcacacgaattcacgtgccatgtgatcccttattttgatattcagtgatttacgatttgttatttgaaatttatgatggatgaatatatatatatattttttattatttcatttgaaatttttcagcaaaattaaaaatttttacagaatttgacatatttttccattgctaggcaaaatgccaaatttaaatataactttaaaatcaagtacatttgaaaaaatcaagtgcgtacattgaaataaattacaaatctgagcaggaccctgtagtgtatagtagagcccggagcaggaccggatcctgcgcaggattttgcaggatcccagtccgcaatcctgcattttttggaaaatgcaggattgcaggatttgcaggattaatccggccggatccggtcctgcaaaaatttttgaattccaatcctgcaacaggatccgcaaatttgaaatttccgggctctagtgtatagtatgtaaagagttgtggaaaattaacaaatgtttaaactaaaactaaactgcgctttcattaaaaaccgtcaaaatgggcgttactcaaaaaatccatcaaatggaaaattttttgacgaaaaattatttataacttggtcgcgagtaaagaattgaaaattcttgatatcatttgatacatagctctaaatttgctctattagttttcaaaatttcaaaaatttgtcgactttcaaaaagttatggtcagatattttaagttctttataaaattttttttgaaaatttgtaagctaaaaaacatttcgggctgagctatcgcatgatataaaaagtagcaaaattaagcaaattttttcaaattattttttggtggtttttgagtgacgtcataaaaaccggtgaactttccaaaaaagccatgtgtcaagtagggttataagttgtatgcactaaaaaatgccaaatatgcacataaaatatgcactaaaaaccccccaaatatgccctaaaaacccgaaaaatgcccaaatattcactaaaatatgccttaaaaaactgtctaaaatggcttttaacactcaaaaaatgccaaaattgtgtataaattaagaattgacttttaaacaccaaaacaagggctaaggagcattttttagacaattgcaaaaatattgaatttccaaatttataattttttattatatgctaaaacaaaattacatttttatataaataaattttgttccanaaagttcttacaaaaatttaaaaattttttgatttgaagggtgtatttaaaaaaaaat

SEQ ID NO: 23552 - DNA, 1643 bp, Heterodera glycines
cgccgacctctcaccaatcactcggaccgttcgaaaatactttttgacccaccatccctttttcgaatatgtcaccagctcccaaaaatttctttttcaaaatttattatatttagttttttaactattctttttatttgtgggatctcgcttattgaaatgcggaagttgcgggattaatcccgcgggatccgcaaatttgaaattttttgtttctaacatcgaatcattaattttttgcgttattccaaaatctgccaaaaattgtattgtaaacgataaacttcacttgaagttgacacagtaaagcaatattgctgggtgaaaggttcgaagaaatttcaaatttttacaaaacataaatatgaacatttatctaggttctttctgagaaaattggataaacaataatttttgtttataatcgcattttatttgaaattttaattattttctttctttttcttcgcctttctctttgggcattcattaatttgctccaagtgaaaaagtaataattctataagaataaaaattctatcctttacctattcttttgctcttcttccatttttgggtcatcgttttgccgtgattaatttttgctttgcccccataaatgggcgaacaaagtccgtaggagataaattcaaacatacataattatttaggaaatctccaaaacttttttacttttcaaaccctaagcactctgggtcatacaataatttccaattgaataaatttaattaaagagtaatcaaataaaattgttgttgacttcaaccaattcgatggacagcagcgatttgaaaccagcagaaaaaagtggtgaaataaacggttaacagataaaaccatttaatttataaataaattaataaaaaaatgaaattatgatcattagggcggggaatatatggaaatccatctttttttcctggactgtcggggttcatatttgtccatattttggcatttttccaaaaaacctctattagaaaggccccatcaggtaaattggcctttttgactcctaaagaccgaaaatttccgaaaaagatatttttagcaaaattttggcgaaaatattgattaaatttaattttattaaaaattggttaatttatgtcaaaaataagcaaaaaagcttaaatttcgcttttcaggttgatttttcgctataatgagtaaacttaagctgtatcgtgttttttcttctaaaatgatttttaataccatattttgccatttttaaaagggttattttgcgtttagcgaatttgaagaaatttgagaaattataccctcaaattggaaaaatttatgttcaatttttgccattttatgtccatatttcgctatttttggtccatataagtcaccgccctaatgatcacctccttttaccgtttttcggtccacggaaaaggaatcaatgtgaccaatcctaattcccaacttggtgaattttcatacaatccagaaatggattcaacatttcaaaattggctcgaccgttatgggcctttcatccaagttgacgggaaggacctccccgatcagatgcaagttcggctcctgctcggcaagctcggatcggaggagtacaaccgctatgcccaaaagggtgcttccaagca

SEQ ID NO: 23553 - DNA, 112 bp, Heterodera glycines
caaagcccaaatcagacgcctctcatccccatcagcagagggcatctcatcctccccgtggccaccctctgtgtcctggagccacgccctccggctctgattctgtgcagct

SEQ ID NO: 23554 - DNA, 1939 bp, Heterodera glycines
agagtcaatttctcattttcctatttttttgctgacattgtatttttctgtcatttttttgtagatacagaaacaggtagaccttatgcttttcctttactgttttggaattttgtatctgaaatgatcaattttatttcattgatcaaaactgggttattcgattgtaaaaatataattattaatatttgttttaattttctattaatcacaatgagtctctgtatatgcagaacaacagcatgggtttaataataaattataacattttgatttaaggaaaaggcttaaacatcgctcagacaattttcttggcagcattttattcaaacgtggaattgatcaattttcatcatctccgcttagcgataaaagtgatcgtttttcatacagtagtccatccaatttgtctgatcaccgttcggaagaagcgaaaagcaatgcatctgaaaatgactcgtccatccttagtgaacaaacagagaatgaaatcactccagcagctgactttgattatggacaaccgagcaattcttcagaacatttttcgtacagtgatgaagaaatgtcctacggtagagcgactactggagcccatgacaaaagaacacaaccaaatacagttgaactgagcagaacaccctccgataaagtggttagaaaatttggaaaagtgtccaaactgtcaaatcttggcgaaaagttgcatctatggcatttggaaaaaacattggatatgcgtctttggaagttaaaaatgaaggatgccagtatcgtaagacatttttccggtaaaaagcatgatcaggcttttccatccgattcttcgactggatcaagcatcagcgaccaaaaataaggctttgttgaccacaatgaatgatcaattagccaattactgtatcattaatttgcaaaattaggagaatagatttatttgcttattttcttgtaaaactatttctatgactggtttaaattcgtaaaaataaatacttagataaaaatctgtgtattaaatcgttgagagttcgaagaaaatgatccaatttttattttgagaaagaaaatttgtttaaatttgttttgtcaaaaaatctttttttatttttcctaaaattcaaaaatatagcaaattacattatacatttttcatattttcccggcggtgctgactggcactgctggatccaaaatgcccataaattttaaagtttacccagctacgtatttcccgtacctcttcccatcccaaaaagtaaaaaaatgcatcgcaacgatgggcagtaattttttatatataaaaatatttgaaaaaactttttattctaatgagaaaaaaaattttagcagaaaaacctttgcgttttttaccgaaacttcaaaatgttaacaaaatgtccgcgccctgagtggactcggtcaaaaccggacacaattgcgaattacctaactcccgtaattacggattacgggttttttgaatttttcataattctattctaagctttgtcgaaactaccttgaaagattattggcaaaaaaccttccagaattttggaaatagtccttttatatggtaaattctgcaaaatttttgaaaatttcctaataaaggaggcgtctattcggttatcatttttcattttccattctaatgtatagaaaaattttaaaagcatgttgttatttaataatgatcatttggatgcgatttttaggcaaatgtctacagaatcacaaaggaaaattagggtttttgaaaaaaccttaacaaaaatgcaataaaacgaaaaatacacccctaagaaatggtccgaaaaaattttcagaaaatacactcttaagaattgaaaatttttcccaaaaattgatcctcaaaatttaatattttttcataaaaatttttggttttcaaatttgttcttttctgaaaaaa

SEQ ID NO: 23555 - DNA, 744 bp, Heterodera glycines
ttgataaattacaaacgtggaaatgattacttcgaaacagaatttggtggccgaatgtttcgtcaatgaatctgatttgttggtcaatttacggatgaaaaagaagaaaaaagcagaaaaagaccgttggcgtaaaaaacgaaatgccaaagcattcaaaaataaaacaaagcgttttcaaggttagagatgtaaaaaaatagtacgacaaaatgagaggaaaaaaaatacttttttgtgtttattttataacttttgaattaggtacagtataaataatgcattgacataagccgccagggaaattgttgaaattaaaattttttttaggaaattgggtaatttttcaaaaaaaaatttccggaccgggccaaagggagcgggggcagcggcactgatgaggtggatgtaagagcaaatgggtgggtgaggcagttcagcagcagcagatgaggttcccacgaagccttgtgccctgtggggcgggcgggagagtcacaaatgtattaattactcttatccccccccccctccccatctgaaatgaaattgtttgccatttttaaaatattctatgttaagaattttgttaattaattttattattgagtaccttttttatttgtaattagccttgttatttaactagcggggtcagcgccttcggcgcatcccccgctaggtagtacgattgtattataggtttatgaatgataaaatcgactggctcggccgcttcgcggc

SEQ ID NO: 23556 - DNA, 1423 bp, Heterodera glycines
agatgtaacttttaggtagaaaaaatgcataattaacgatttgaaaataaagttttgaaaaaattaaggattagaagatacaagtttttaagccaaaacataattaagcgttgggagtatttgtttttaggcgaaaaaatgcatagttaagaaaaggaagatataattaacaaaaaatatgaattttgtggtaaatttgggtgtagtgctgtgtgtatgtgttcaccagtacgtgtgtgctgatgatgatgatggttggctgcactcaccacgcccagtgttggtaatttcgtcaatgctttcataccatttgcagcctttaccgttaaattgtaaataggaagagttggaagaatgtgaagcttcacttttggtgtcctcctcctcctgctcctcaatttcagtgaacaatcgaccaaataatcgccctccctttttgtcgtcgacaatttcaagcagttccatcggataataacggtcctcaccacgcgtaaagccttcaatgatgcatggcacataggggtagtgcaatttgacacggtgacgagcataaaaatgcgctgccacgttaatgttgaacggcttacgcagacgtccatatgcgggttcaaatgccgcgcctcgttcagtcattccaccaacgaggaaagatttgcgcattccattccgatccttgtatgttgtctggacctttttcccaatcaattgctgcaaaactcggactcggtcctctgggtggttcagtcgatcgcgaagtgactttgtcgggcaggagagaaattgggcacaaaattcgctgacgagaaccatttcagatttttttatgtctgaatgaagaaattcgagcggcttttataccggtgttccaactcaaatggataagctccgcccctttttattttattgcatgcataattaatgaatgtgaaataaattacgaaaataattaagcgttggaaaatgtaacttttaggtagaataatgcataattagtaggtggaagacacaattttgaaaaaattaagaaattgaaaatataatttaactgttcaacattttatttaacattattaatgaatacatgtcagggtttgaacaagttttgagaatatgtataaatttatcgaatgattttccgtgggacatgtggtaaacaaacacaatacaatggggggcacatgttgatgtcaatggggactggtaggcttcaatgtttttgtgtaaacctttgggaaatttatttaaaaaggatgatgaaatacttggtggtatgggaagtgcaaggctatcaaagtaaatcactggcgcgtccaagtccctggcgtaaatggcacaccaatgggagccgcctttgtgatgggggtcacggttcacaatgagcgccgcaggatactgtagggtggccggcgaaggcaattggtca

SEQ ID NO: 23557 - DNA, 824 bp, Heterodera glycines
  misc_feature (63)..(63): n is a, c, g, or t
  misc_feature (90)..(90): n is a, c, g, or t
  misc_feature (96)..(96): n is a, c, g, or t
  misc_feature (102)..(102): n is a, c, g, or t
  misc_feature (104)..(104): n is a, c, g, or t
  misc_feature (108)..(108): n is a, c, g, or t
  misc_feature (110)..(110): n is a, c, g, or t
  misc_feature (117)..(118): n is a, c, g, or t
  misc_feature (127)..(131): n is a, c, g, or t
  misc_feature (134)..(137): n is a, c, g, or t
  misc_feature (140)..(140): n is a, c, g, or t
  misc_feature (145)..(147): n is a, c, g, or t
  misc_feature (163)..(163): n is a, c, g, or t
  misc_feature (169)..(169): n is a, c, g, or t
  misc_feature (175)..(175): n is a, c, g, or t
  misc_feature (189)..(189): n is a, c, g, or t
attaaatcactatgaaatacaaaatttgctatagtcattaaaaggtgctttaagtaaaaatanaaaatatggaaaacctttaaaaaaaanggaganatgatnangagnanagagaanngaggggagnnnnnaannnnggnagagnnnttttccgatgatgggntttttntttgtngtttttggtatttngtatatgaaattgattggcagagaaactgctcggttaattgtcgtttttttctcaaaattctcatttttcgatttgttttttcggaattttaacggaatttgtaggtccaacttccgtaggtcttccagaattttttcttgctgcttacgtcgttccaattgtttcctcgacggactaatcaatttctgttgtgcatttgtctgatcacttttttctgccattgatttgaaaatgaattccttcgattgactttcggctttatattctcttttttcatgaataatttcatcattttctggcgaactgatgcaattcggtcgtaaaaatacggtcaaaatggcttccagaaagcgattacgataaacggacggatgtttgaccgagtttggcttctaaacatcatttaagttaaaaagaatttcaaaaataaattatttatttattaataaaaagatacttaatttttaatattaaaaatatagctatattttttaaaaattacaataaaaattttttttgttctttaattaagctaatttaagtaaatctaaattaatattcttataataaataatttttacatatttttgccgtgtttctggaggaaaaagaagccatctttctaaattcaaaa

SEQ ID NO: 23558 - DNA, 839 bp, Heterodera glycines
  misc_feature (811)..(811): n is a, c, g, or t
ataaaagataaattttcgccccttaaaaaaaaattaattttacttatttgaaactctactttttgtaaaatttgaacgaattacaataattaattttagatattacaaaaaagctggtggcgtcgattgcgacgcatgagaatttttttgtaaaatttaaatcaaaaatctattcaaatggatttagcctaaaaattcactttcataaacaaaaagatggaattttttttaattttaaaactttttctttgctggcttcccctgctgctttcatgccgatcgacatgtcgcataaatttttaattttcaaaaaacgaatttcaggcactgcaccaaggcttattgaccggttgaaattatgtgatgctttatgttgttcataggtgtaagctgaaaattatttatttattcaaaggaaattagtaaaggttcaagttaatgaatatttaatatggtgattcttttgttaataaatttcaaatttctaaaaaattggtaacaaaccataaaattcggggtgttcgcaactgtttattaaccggtattctcccgggtttcggttctgtcaattttttggatcccctggttttcggttatttcggttaatcaaaaattttcagatgacataaaaaaaatcattttaatatctttaaattgagtgcaatgttatataaattttgtccaaaaagtctaaatttgaaaagaaattctgcaattatctttaattattcaattactttcgtcctcctccaattcgccaaatggtaaatttgttgctgacggaggtaaaaggttaatttactgttccgantgattgtgattgtttttgctgctccttt

SEQ ID NO: 23559 - DNA, 1116 bp, Heterodera glycines
cgtccctttttcctcctcaccggcgcttgttctccgcttttccgttcattattttgctgctgctgccgctgctgttgttcactgttttgtgctgccaattcaatggacgatgaactcggcacattaaacagtgaggcgagagtcgccggtgcgtcggcgagtgccgaggcgaccatcgaattcaacgaactcttccgtttaggttgctgctgctgctgggtttgttcctctgctgcaactgtttctggtacagcttgattttgtgggtctgtcgctgctgtcggcgtttgggcgccggacgaaggcggcgtttcgcaggaggaaacaatggccgagtgcttggtcattttctgaaatgaagaaaacaatttaaaatttataatcaaaaataattaaaattttatccagtctaagtattttgtgattgtgcggatggaatggccaaatacaaaaaataatacgtacacaattcttaagccaaccgtttgacttaattctcagagaaaccatagaaaagatggcttatgaaaaggtatttatccatcgcccataaaagagtgaattaattgggcggtgccgcctctttcgcttgtccaccaaaagatttaattaattaagaatttgactcggaattgcgttttccttggttttcttgagaaattgaataaaaatatgaaaaatttgaggatttaaaagccatcggccggttgtatgcccgtaccagaaaaaattcgagggacgggcactcgaagggcattttgtaattttcctaaatttttggtccgtgggaaaaacgagaaatttttagccattttcaccaaattttgttggtaaaaatataagataattgggatccgggggtgccgtgccgttaggcaccgctggggaaactttagagacattagggtctaatttgttaagaaaattaggttaatttaaaaattacccatttttcatttccggcgggggcgggcaactgtccccctagttactggccggacataaattttaaataagcgcaccccccccccccccttaaagctgtaaatctaaactaaacgcacaatattcttccgttgctttgttgtcgtcttctgttgttgttgttgcgcctgt

SEQ ID NO: 23560 - DNA, 821 bp, Heterodera glycines
  misc_feature (742)..(742): n is a, c, g, or t
ttgttacctatgggtgataacggaagcgatgttttatttaaaaaccggaaccgttgttacatgggtgataaaggaaccgatgtcttatataaaaaccggaaccgttgttacctctgtgtgataaaggaaccgatgttttatttaaaaaccggaaccgttgttacctctgtgtgataaaggaaccgatgtttttttaaaaaccggaaccgttgttacaggggtgataacggaagcgatgtcttatataaaaaccggaaccgttgttacctatgggtgataacggaagcgatgttttatttaaaaactggaaccgttgttacctatggttgataacggaagcgatgttttatttaaaaaccagaaccgttgttacatgggtgataacggaagcgatgttttatttaaaaaccggaactgttgttacctatgggtgataacggaaccgatgttttatttaaaaaccggaaccgttgttacctctgtgtgataaaggaaccgatgttttatttaaaaaccggaaccgttgttacatgggtgataaaggaaccgatgtcttatataaaaaccggaaccgttgttacctctgtgtgataaaggaaccgatgttttatttaaaaactggaaccgttgttacatgggtgataacggaagcgatgttttatttaaaaaccggaaccgttgttacatgggtgataacggaagcgatgttttatttaaaaaccggaactgttgttacctatgngtgataacggaaccgatgttttatttaaaaactggaaacgttgttacctatggttgataacggaaccgatgtcttattt

SEQ ID NO: 23561 - DNA, 1353 bp, Heterodera glycines
ttagcattgccaaatagcagaataaaacacacattttcactaactgccgcagcaacttggaggatgaaacggtcaagccaagttatcgagcgaggcctcagagaattgccctcgagaaagcccaaatgtccgccatgtttaagcaaaacaaaagcatggagagggtgcgtttcgcacaactgccgaactggttcccaaagagcttcgggcacgagggggtcgtccaaagtgttgatgaaaatctgaaaacaattttatttattttaataaaaaaatttagtgaccaaccataggaatctttatgtctttaatgcgtggaaggcagcttatatgggaatagtaatccgaaactgaagcaaagttgtgcacccgacgactgtaaaattcgtcaagccaaagaagcgaagtcgacgaccagattttctgaaaagataactaactgtagctgttttttaaacaaaaaattggtaaaagacaattcgttaaagccactcatataaccttaaaatgtattttaagttttaaacttacaaatggagataaaaccaatgttttttatactaattttaaataatttaattacagacccaaaagacctcgaaaccccataaaaagtagttttacacgaatttttgaaaatttttattcttttgaagaatggggtgaataaaccaaactattaccaaattttctaattttttttctttctacgtttgaaaatattttttaaaataaaaatttttagttttcaggacaacaaaatccatctcaacccacccgagtgattgcttactcgttcatccaccaatcccgacttcacatggggcagaacaaccattgcgtaattccgtcgaagtaatcgtttaacactttcagtgattatgtaattgtacaaacgtcgcccgccttgccaatcgaataaaagggaagaagcactaaaagggaaaattaaaggtgaaaaaaacgactcaaagcactccgaagcgcaatagccttggcaaacggaaatgccgagaagaatgcgcgaagaaatagaaggatcgagtccagaagccaaacagttagtcagcacattggcacccatactgaagccaatgccaatgaaataagttcgcgggtacaacttggcaagaactcggaacatcgcttccatttcaccatttccacctgaaatttgaagcgtataaaggaggaaattaagggacgaggcgagggaagcgggaggataaaaataggtcatttaaaatgtttaaaaataattaaatgttctaaattcgaataaatcaattcatgttttgacttatcctttgtattatgtaatcagatacaaaactgacttttaatataattctt

SEQ ID NO: 23562 - DNA, 1434 bp, Heterodera glycines
tttttagcatctaaaaaacaaaaaaaatttaaaaacttattttcagctattttggcgttttgcccaaaatttgttaacaaaaatgcaataaaatagaaaaatacatccctaagaatcgacccgaaaattttcaaaaatacacccctaagaaatgaaaaatttctcaaaaatttctctccaaaatttatttatttatttcttgacaagaatttgtgatttaaaaatttttttagctcaatactgatttggcctaatttttttacttttttgaataaattttgtttttttacaccccctaaattcggaactttatgccacctatttttcatttttagcacctattttggggcttttttagaacctaaaacctacctattttggcagtttttagcacctataaatatcagccctaattaagacataccaagtgagaatgcaaaaggttgaagagaaaaaatgatttattcttttcaacaaaagtttgttttcaaaaatatgtaaatttgtaacaaagcagaaccgatacaaagcttaaataaattcagggctcccaaatgaaattttttagaccagcctttaggaaggatcaaatttttaaaaaatttacatatattgcaaaaaagcgcgagcaaaaatgatcaaatttgccactttaaagcagcaatattctgataaaaatacacatggcagccctgagtaaatgacataaaaatagccatgctagtatttatacgaatgatataaaacatttaattattttaatcaatttccaaaaaatgacaacgcggcattttcttggttagcttggcacccagaactgcaaatcccaacaacagtttgcgcatttgtggctcctttggtcccatttcagcgcacggtggatacctacataaaatgtcgggattcgagattcggaggcactgatatgcattattacggctcgttctgcctagattgtcaggctttgtgcgacaaattttattcgatgttgttgaatgagacgtgaattttttcagtcaatttttttatcactaatcgggtaattaagagaagaaaagcaaaagcataaaataagttctgaaaagtatttggacagttgctccaaaagattattatatcaacgaataaaaattttaaaagcacaaaaatttaaatgaatgggattttatgtttttgttgtgtctttgtaaaaactttattttcacacacaacaaataataaatgaaaagggaataagaagtgatgagagaagtcggaagaggaatgagtttgaataatgaatgggagaagagacgagggagagaagaagtgacgggtatttatgcacttggtctgtgggagggcattattgattgggtacagagtacaatgtttggaagaggaaaaggaatgcataaagaaataaataataggtccatgattacccacacaaca

SEQ ID NO: 23563 - DNA, 409 bp, Heterodera glycines
aaatgtctgtgtttatttgctgagttgcggacgaatttggcggtggagggaaagtgaattggcgagcatcggcataaattgggatgagaccgagtcggtggcaaagcacttcgtcctgtgaattcagccaaactaagaaaaacggaacaatttaatgacttgaatgcaagaagtgttctggtagaggaacaccttctcgatggccatgctcggcacctgaaaatcgaatccccggtcaatgccccaaattcgtctcgccaacctccgatattaaaacgcgtctcaaagcattggcaatgggcgcttccacgttgaccaggtcgaactccaagtcgagtgcgtcttcactttggctgaccattcgcagtgaaatgtcatcacaatatttgctcacgtcccatgccccgtc

SEQ ID NO: 23564 - DNA, 1632 bp, Heterodera glycines
  misc_feature (988)..(988): n is a, c, g, or t
ttattttttgcaaaccaaaggggtacaccacttttgtttttcccttgctctgtttttttcgactccaaccctatataagtgccaaaaaataattgtatttttcaaaaactgccaaattaactgttgaaaagtttcaacaattgttgtgaaacaatcaaaaataataaatgtattaacaaattttaaaatccattaaatccttttccattcctttcactcggccattttcctcgctaccaaaatgtacattccgtccaattcataaaacaattcgttgtccaattggtctctgttttgttccggggttttcccctttcatttcgaattgtgccgacctttctaaaatcagtccggcaccccgcaaacattccatcatcagttttcgactgacgaaaaggcatttgaactgtcggccaccaaaagcacaccaactgaaaaagcattggaaaagttcaaatatttaatcggagaaggccaaaaactcgaaaagaaagcaaaaataaattgtaaaaccaattaaaattattgctccgatcacaatcaatgtttgatcagttagttaaccttttgccatttgacttttggacttccaccgaattgtcaaatggcttttgcccgccccgcccccctttttttacgtttcctccaacactccgcccattattagcactccgtcgggcgcaaatgggcactcaaatgattaattgccatgcgtattcgtagctgctcaagcagcagtacttcaaggtgaagaatgttgtgatggcctgtgggagaattgaatgaaataaaaaatattagatttcttactgtccatcggtgggaaattccgaaaaagttttgtcgcgtcggattttgtcgggggatttgcacggagggaaaggaatggcagtcgcagaagagaacggcacgaatctgaaggaaaggggagaggggaagggggggcatattcaagggagggcggggggattaacgggggggccacctnccaacgcaaaattagtgcccaacccaaaaccttggggaggcaaaagggaggatggacaaaagaacaaattagggcaattaatcgacaccctttggacggtcttttgcaaaatgacttctcgcgcaccttttccctcgctttctgctccatttgccttatttcgctcaatgggaccgcctcacgagcagcgattatctgaaaatgtccgcggttggactgccgccccccccccccctttgatgcttttaccctcattacggtgctccaatcgaatttgctttgtccgctcagccattggcacaattcgtcacggttttggggcagataatccgccagataaatctgtcggtcgttgtactgcttcattccccgtttcaaagcattgcttttccctcgcccattttcacctcttcggccgtgtggcgaaagcacaccgccacgtgaatggtggggcccgagccgaagtcgagcagcgaagggagggagccgaggcgggcgacgatgttgggcagatggaacagaaccatttgcatggccgcgtcgtccacacgcgcgtaaaagtcctaattgacggggcgataaaagtgaccaaggaaggcatttgccactttcagataggcatcggtgtcgaaatgctcgtggaa

SEQ ID NO: 23565 - DNA, 946 bp, Heterodera glycines
tttatgaagatattccggacaaaatttttgaaggagaggcacattccgattatgccagagggagggtatgagagagctgaaaatcagagtaaaatagcggtgaaatattttgagtggcttgcccaaagaaaaggagtaaaagtgcggcatgcgtgtaacggaggggaagtagaatttggtgggctgaaagtggactgtgcgattggggcagagaaaaaaataattgagtttcaggtaaaagtaaaaatattttctttttaaacaatacttaaggggtgtgcatttcacgggtgtccgagatgttttttaccttggactatagcgccaaacggacggacaatagaagagaatcaaagtagaaccgaaattcgcatggaaattttgagggaaaagtgcaaaaatttttcaatcggagaagtttgggtagaataaaacatttagaaatatttattaattgttagttttaggagtgtgacgtgaaagaggaattgaagaaaaataaggagatgaaaaaattctttgaaagtgtgccggacaagggaccgatcaatccgagggatgcttatgccgggggaagaacgatgccattttgtttgtacgcaaaggctaccgaagaaatggagatctcaatgtttgacatcattagtttgtacccctttgttaattatggtaaaaatctgcataatttttgttaaagtttcctttcgcttaagacaccccataccccgtcggggtcccgaaaattatagtgagcaggaatttcaatgtgaattggacagtgctcgatgacgtgccctatgatggacttttgaaagtaaaagcgatcccaccgaaaaatcttttgtaccccctcctccccatgcacatcaataagataaggtcccaggggccggggtccagacccctgaacctgattaaaaaaacatacatatttgcttttcatgat

SEQ ID NO: 23566 - DNA, 1975 bp, Heterodera glycines
atttgcgcgtccatgtgggcaacaaaaatgcaacagacaacagcaacaacagctcggccaagtcagtccggccagccaatccgacaaatttgcagggccgaaatcccgtgccgaaaccgacaaaaaaatttgcaggccgaaatcccgtgccgaaaccgacaaaatttcctgggctcaaacaatacataccaggatataagaatggggatttccgacattttttgggctcggaattccgattgccaaaaaatttttcagcatctctatgctttggcattagcacaatacttcgatttaagcttatattttgtttcgacatgctgctataatcatttttcttcggtatttatggagctggaataaaaaccctatatttttccataaattccctcaattttaaaggacaacaacgggataacggagacactttatcgtcacaagaacacactggaaactctgttccgatttatggacaaagacaattcaggcaaggacaaaaaattggcatttttcaaaaattttcaaaattttgttaggcctcgtttcaatgaaagaatttatggaggcgtgccaagtgttgggacaatatgccaacattgacctgaacgaaagaagcattcaaaacattgcggaaagcatcgatttcaacaaggacggattcattgacctgaacgaattgctggaggcatttcgactcgtcgacatcggaaaattgtgaaaatttggggaaaaatttccggatttttgtttcactgaaccttatcaaacctgatttgctcattttataaccatgatattcaacgattcacaaaatgcattcatatgtattattttaaaccgatgtaaatatttatattaaaaatattaatttttaatattttgtaattttcgggaaaggtggcaggtttttgccattttcgcgggaattaagttgactaccttattcaaacagctagttttttgatttggcattgattcgaaaacggcatttaatcgggataaaagccaattgttaattttaatcagataccccaatttgtgagtcatacggtacatcctaaggatgaaaatacttaaccattttagaaaataggagacatctctgatcactggtcagatcattttgaaaatctttacagcccgcttccatcagccttcatttccttcttccatccttatcttctcgtaagctttttcgtctctcatgagcccctgaaaattgggcagtgattttttacttttcggaacaacacaaatttgcccgaactttagaaggagtaaatgtaccacccaccacccgagactttactttcgagcagataatactacaaaatccagaataattttgagactggctctttaagactccagatcagatcctcggattacgacccaaaaggaaaaattgattcaggaatcggaccaatgagtcattaccgaatatctggtcttgatctttatgcgtgtgagtacttgtggccggctctttgtgaatgttgcaaataattgaagtacccaactggccctgaggcttagatagactgctcgggacccgagactcccgagcgcatactgattgcgagaaccaaacaattgatcctgagatccaggacagggatcccccaaatctcatatagcactccctcgcgagcttctatttcacttccaccccatgcttatataacgagcttacactccctcacgagggcttatataagggcttacacccgctcacgcctagtgccatttgtcattacacgatcttccgggattatgttgtccgtcacccgctccgcttcatcccaacgcttcaactcctcatacgattccttcatttgttgcttcattttgttcatttcttcgcccgttgtttgttgtgccatttggtcgcgctctgtgctgctaaaagaatgactcatcagcagattaacaactctgaagaatttttattaaattttaagcaattttttttaat

SEQ ID NO: 23567 - DNA, 1547 bp, Heterodera glycines
caccagcattccaatcacatggcactcaattctcctgcctcctttatcactggtactcaaattcgcctgcatttcaatcactgacgactcaacccaccaacatttcaatcactggagactcaacccaacagcattccaatcactggcactcaacccaccagcatttcaatcactgggactcaacccaacagcattccaatcactgggactcaattctcctgcatttcaatcactggcactcaacccaccagcatttcaatcactgggactcaacccaccaacatttcaatcactggcactcaattctcctgcatttcaatcactggcactcaattctcctgcatttcaatcactggcactcaattctcctgcatttcaatcactggcactcaacccaccagcattccaatcactggcactcaattctcctgcattccaatcactgggactcaacccaccagcatttcaatcactggcactcaattctcctgcatttcaatcactgggactcaacccaccagcattccaatcactggcactcaattctcctgcatttcaatcactggcactcaacccaccagcattaaaaccgacagcggctcgaccgcttagcggcctcgcactcttcttttggcattttcttatggcataacagttcttccttgtttcttgactttttcttacgcacaacatttttcttctatacaaatttttcaaacaaattctcattcattcatttaaaatttcattaccatttacataagcaaaacaatatctttcatatcaaaaccaaatcaatttataacacaaacaacaaagaaagaaaaagaaacatttttaagactgttttttacataaaatgacaaaagaaaaaaatgtaaaacaaaaacatttcatttttcaaagcatttatacaacacaacacaatgttaatattataggattttcttagtgaacaaactaaggggtgtcctctttcttttgttaaatattttatacaataataaatgggttataaataaggaagggatgcgagagtaatttcccattatctctccctttcctttcttttactctcttttcttttccattgcaatttactctctttttttcccactccctccttctcccacacacacgcacgcgtccaacagactgctgctgcacaacagcacgcgtctgttcactgtatgcccctcccatctgccgctgcccgcatagacagacagtcatacagtgcactatttcccaccatccctccctctaacctctacatcctaggaggagaaatcttttaccttctttttctgtgctatttcttttgccttcttcttcatcttaactatttattttcgtctcttttctttatattctcttctttttcaaaacaatttcttttcatctcttttcaaattcatttttaacgcaaaactcaaacaaaacgccacacaaattcaaacacggacacatacatacatacatacatacaaacactcaactttattatataggattatatatatcgtccgatcgtttttaatatttgg

SEQ ID NO: 23568 - DNA, 1724 bp, Heterodera glycines
ccctgtcattgcgctttccaattaaatcttcagtgccgcgcatttgcgaaacaattcgaaatgttgacgaataaaagcaactccgatttacatcttaattccaaataaatcttatagagttcgtcctatttgtgcgtaggatcccgcggagtctacaattttgaaaattcaaggacctaatgccagatattttttcttctaaaaatttctttatttttcaaaaaaaaaaggtcggcactagtcccctctttctgttgcacaaattctgacaatttcttaatttccatcacgagtgtccctctgttgcccatgggaatgttccaatcggaaatccgcgcgtggcttggaaatttcagtggataaagccctggcacaccgctgagactcggatgggaatggaattgataaacgccaacgaattcttccactgacagaacgccggagggaactgtgaaaaacaaaaataaataatgtgatttataaataatataattccaatatgcttttgctcgaacattattgggaaaatattgatcatatggcccagagccgaaatggccaaaatatatgtcaattgatagcttcactgtctgtaatagaagaaaccgaaagaatttttttgcggtaagcaaatttaattgaatttaaatttaaaataagaaaatattttataaaataaggtaaatgaaaaaaactgccttctaagtaataatatttatgttgggaccggtactctattgtccgcccatattattttcattcctttatttctctccccttattctctcctctatctctcttcccttctgtcccccataaatactctgcgtcctctgacctccccgtcattcatttgtcacccatttattttgcttatattgttcaatcaatattcgccctttgtcctccgtccctcttctcttcattatttatttgtgtcttcccaacttgaataaatcctttatttattcactccgccggtttggaatttgacggcacaacagatatttacaattttctattaaaaacaaaaaaatttcggaatttcaatttggttttgttagaaataggtctacaacgagtcaattaataacagttgtggaagattggtacgaggcaataataaatggaaaaaatgttgattgtatttatattgattttcaaaaagcatttgactcagtgccccatgaattacttttatacaaattggaaaaaataggtataaggggcaaacttttgatgtggataaaggactttttgagtaataggacttttcgtgttaaaattggggatgatttatcctccagtaaaaaagttacctctggagtcccccagggatctgtcctgggccctttattatttttgatttatattaacgatcttcctgatgctttgccatcaggagtaagaattaaattatatgctgatgatgttaaattgtatatttgttataaagcgagagttgacacagaaattatgcataaagcgttgcataatttatcagaatgggcaaataaatggcaaatcagaatctcaattaaaaaaacttttgtactttacttggggaataaaaaccccaaagaaatatataaaattgatggaaatataataaatgttgtggatacaattagggatttaggcataaatattgataataaattgcaattttccaatcatgtcgcactaaataagaaagaatgcatatttacgtatgcgttctttat

SEQ ID NO: 23569 - DNA, 852 bp, Heterodera glycines
aaaccaagccctcgggttccaactgttcacgggtgcacgcatgcccattccaactgctcacgggtgccacgcatgcccattcgccaagcctcgggttccaactgttcacgggtgccacgcatgcccataaaccaagccctcgggttccaactgctcacgggtgccacgcatgcccattccaactgctcacgggtgccacgcatgcccattcgccaagccctcgggttccaactgagcacgggtgccacgcatgcccattccaactgagcacgggtgccacgcatgcccattcgccaagccctcgctttccgactgctcacgggtgccacgcatacccattccaactgttcacgggtgccacgcatgcccattcgccaagcctcgggttccaactgttcacgggtgcacgcatgcccattccaactgctcacgggtgccacgcatgcccattcgccaagcctcgggttccaactgttcacgggtgccacgcatgcccattcgccaagccctcgggttccaactgttcacgggtgcacgcatgcccattccaactgagcacgggtgccacgcatgcccattccaactgctcacgggtgccacgcatgcccataagccaagccctcgggttccaactgctcacgggtgccacgcatgcccattccaactgctcacgggtgccacgcatgcccattcgccaagccctcgggttccaactgctcacgggcgccacgcatgcccattccccaagccctcgggttccaactgagcacgggtgccacgaatgcccattccaactgagcacgggtgccacgcatgcccattccaactgctcacgggtgccacgcatgccca

SEQ ID NO: 23570 - DNA, 1273 bp, Heterodera glycines
aaaaccctcagaatttctcaaaaagccacaaaaatcctcattttccaaaaaattcctcattgacctatcaaaaagccacaaaatgaggataaatcctcagatctgggagccctggtcataacaccaaattgctaaatacatgtgatctgatctgaccataatttcggcacaattcacgcagcacggcaccactcggtttggcaccatttgactgtgcagaagactgaattcgtcaagctcttcaacttctgattcagaataatggtattcaacccatgattcatcttccaaattctcagtaggagaggccatcattcatttttggtggtatgtatataaaattcttttctaaatattatgattggaattttaacaattagggagtgcgtattttagtacagtcaggtgcaaaagtaatgcatcaaaccattttttttttttgaaaaaaccagtttctcaaaaatgaatgatgcgaaaatggttttattacgccaaaagatacattaattagtgcgctaataaatacccaaaaactgcccgataactcccattgtcgcgagaaaatttccgggcaaatgagtaggaaaaaagaacttaagcaagcctcttctgttgtcaatatttgcctactttctattcgctgattgtttacattacaaacatatttcgaagaatggggtaaagccggttgtataaattcaagagccgaaatctccaaatgatgaaatcctcacattgcttaatttgaaaaacaaacagaaaaaattatggtctgagtgagcctaattttcagagaaaaataaaatttattttatttttcattttatacttaaattgtcaacaacagcttttttggataaactgtagtgaacgccccgttaaaaaaagggtcaaatggtataccaatcgattcgtctcggggagctaagcatggaaaaatatgtctcgagttgcagaaatgcaaaaaaccggtttttgaaccagttcaaaactcgaaaattgagagatttcgcactctaactttttttaaacgatcgaatccccacaaatttggtaccatttaaaagcttttgacgagctaagtctaaaaatcattgtatgaagtctaacggcgccatcttaaaaccgacaagtataaactgggttttgaaccgattcaatcttatagtgccaattcagtaccaaaagtaatttataattattttaattggcggcgcagggaaactggtgaaaataggtcattttggttattgcgctaaaaaaccgccgcaca

SEQ ID NO: 23571 - DNA, 1167 bp, Heterodera glycines
  misc_feature (78)..(78): n is a, c, g, or t
cagacgcgaccaaaatatcatcaagataaacgaagacaaaaatcattgatcagatcttcaaaaagacgagacatgatncgctggtaagttgctacagcattacaaagtccaaacggaagcaccgtgaattcatgcagtccaaattctgtgacgaacgctgttttttcaatggacttctcgtccattttaatttgccaatatcccgaaaggaagtcgagggttgagaagtatttttttcctcccaatgcgagaagaatgtaatcaatgttcggcaacgggtatgcgtctttcactgtgaccgaattaattcctcggtaatcaacgcaaaatcttaagcttccatcacgtttcgggacaaggacaatggggcttgcccatggcgattttgacggccgaatcaatcctctgctcaaataatcttgaagcatcattgaaactttttcacgatgtgcaaatggcagtggacgcatccggcctcgaattggtgaggcatcgccggtgttaatgaaatgctgagttatttcagtttgtgtcagttcgctgtcatcgagtgcaaaaatttgttcgaaaccaattattaaacgttccaatttgtccgcttcgtgttgctgagacatgccaatacgagttcgtaagatttctttgatttgttcagtgcgtatgttttcattttcatgtgtgacgctgctgacgaagaacggagggaaaaacgaatgttccaattcgtgccattcatcgacatgctcgaccaatgcgacactttcattcgcttccagtgtaattggaattgacgaaaagtttgtgatcggcacagcgatttgtccgtttttgctagatgttaaagtaggctcaattcttagttgctcatccaaatcatttcttcctattacagtgacttctttgtcttcttgtccattggtcattgacaattcgacaagtgtggatgattgaggcagaagtgtgactcgatagattatatgtgccgaatttgcatgtgtttccatcggggagaattcaacaacattcatgttgactttgtcgatcaagttaaatcccaattgattcaaagaatgggttccgaagaagaaggtcgaaaccaaatgaggattgcgcaacaaacatgcgaactcgggccgtttgtgttcctctcgggattgggagaaaaac

SEQ ID NO: 23572 - DNA, 1222 bp, Heterodera glycines
aaatatttttcgtgctctgaagggcctaaaggaagaacggaggccgaaggccccccacgaggccgcgaagcggccgagtgagtaccttgggcgcagaaaaattattaaggaggagggttcattatttatttatttttttacaaaattaattcataagtatttttacagaaactgctctgaaacgcaccaaaatttatttacaagttgaataaggcactctgactcttatattatcaaaaagggagatgaataaatatttaaaaaaatttttaattcctttttaaacatgccaaaaagtttaggcttaactttttttatataaactgatcagaagcgcaccagattttgcaagggcatcaaaaagacaaggaaaagcaccgctatgatgctaacgccagtaactctttatttaaaaatttttattaatttttaaaacttcactattttatttttttaatagatttttaaatgtttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttgcattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttggattttttttggcttaccaaaacttcatcgaacctggctctttctattctctttcaaatcgccccaaattttttttacagcttaacaaggccctattaagcttatttccagaaaatctcgcatgaattctcatttttaaattttttatagatttttaaatgtttggattttttttggcttaccaaaacttcatcgaacctggttctttctattctctttcaaatcgccccaaatttttttttacagcttaactaggccctattaagcttatttccagaaaatctcgcatgaattctcatttttaaattttttatagatttttaaatgtttggattttttttggcttaccaaaacttcatcgaacatggttctttctattctctttcaaatcgcccccaaatttttttgactctagag

SEQ ID NO: 23573 - DNA, 902 bp, Heterodera glycines
caagtttttggctatgactttttttcttagacaagcaagtccaacggttcttgttgtcattcaatagtcccaagaggtctgttatcatatgcataattttgaaaatttcattaggtcataaaaagctatgctcagaaaatttcgataagactgggattgtaaacattactgagccctagtcagaattttccgaaagttggcaaatctatagaggactcttagaaatgacgaatgaattcatgtttgttggagttggttgctaaagataactattataacaaaaaattgagctcgtatgaacctgcttggtccgctagcaagcgcgtaccactgcaggcaaatattttacatatgatccgtaaaatccagagtcgatatgcaattccattacatacgttctgtgcgccatcgatcgactggtcgttcgacatttccttatggaaaaagacggtgtctcatgtagccgcaagctatgcgcccacgagaggtcgtctaataatcttccgaaaatgattacttagcaaagtatctcttaaaggaaaggtttgtgcgtcatctactactcttcaatgattgttaggagcggtaaatcgataacacatatcaaaaaaaaaacaaaaatttcagtcaaggacatactactataccacccaccccccgttgaagcaacaaactaaaaaaatgctgaagaatgtacgctgaggcaaaattggcttgggaaaatatgatggggtgtaaattgaggtagagaagtcagagaaaagtgtgatatttcttctttacttggcgacccaccgtggggtgggccggagctagttcctcctataggcgacccacccccaaaagggagaatcccaccccgtggggcgtttggcgacccaccccgaaaaagggagaatccc

SEQ ID NO: 23574 - DNA, 1861 bp, Heterodera glycines
attaattgaattggtgccaccccttaagcaataacctatgatcaaaaatttacctggtccctcgccacgcccttactttaacactgttcagcgcatctcggatttgtcccaacttttcgaagctctcttcctcaaaattatcgaacttttgttgttttccggtgccttcgcaacatttatccgccacattttggccacctaacaaaaaacttttgtggccaagcgttgaaaccaattggccataactttgtcgaacatccatccgaaaaaattgaataataaaaaagaagtggaaaagaaataattttaaataattcaattggttttatatttaacccttgattttacgcttttaagtcggaacaaataaaatgcttttttcatccaattgttcacaaaaaggtgaatacgaacggaataagaataatgtaaggtcaacaaaacaacaatattcaatttgataggcatgcaatgaatgaattctggggtcaaattgacaatattttcaaacaaatttcacattaacaattttttcggttcaatttgctttggcgatcactttttcgcgcaatacctcatagttggcctcggcttctttgtcatggaacggaaactgaacaggggacacaattgcatttttttaaattcaaatcattgaaaaatgaaatttatcaaacaattccatggcgagagagcatttttatgatacctccgccggctgtgggtagtgcgccacgcaaacgctctccgcacgttcggacggccgggcgggcaaccgctgccaaagctcttccgcaatgaacggcataatgggggccaacagacggagggcactgtccaccgccaaatggagcacatgccgagcagtcgtaacagcctttgggggggggggataagccaaatccataaacaaatttaaacacaggaataagtcacccaaggaaaactttcgatgtgaatgaaaatgaaaatataagccaaactcctttttaataaaaaaaattttcaacaaaaaagcttaaaattttataagaaaaattacaagaaaattgcatattttttagattttttattcaaaatttcatgacgtttgtttttcaaaaaaattttccaaaaagtcgccgaaaatttaaatttttttcttttaatatctttaaaaaattcttagactttactgaaagtttttttaaattttagaggtgggatgacctgctcttggaaatgtagtgtaccatagataataatctaatgaattgtttgtgtaattaccttttgcgttgtcacttcatcggtgccgttttggcttcgctcttccgcaattgcgtccgccccctttttgttggcattgttgacgacaaaaatactcttcaccgactccaaataaatgtcgcagaattcgtggatccaaaagtggtgaatggcggaggtcagctgccggaagttgtaagtgcggaagccgacatcgcattcagaaacacaatgggacagtcgggagagaagccaccggtcggccaaattaagtgccaaagtggaaggcttaaaacaaacaaaaacattttgcaataaaataaataatcaacgagtggatgccctaatcggcttttttgtcttttattccatttagacatgttttattgccaaaaaataacacaaaaatcagttatcttacaattagaccaacttctttggtgaacccagaaattggacttattttaagaattggcattaattagaatattgggaaaagttggcatttgtttttccaacactttgtccgtttttacctcaaacgtatcgctgggaataaagtcgggcccaagccgactgagaacgaagcgcgtgccctgccaaagtttttgca

SEQ ID NO: 23575 - DNA, 1527 bp, Heterodera glycines
  misc_feature (84)..(84): n is a, c, g, or t
gagctgccgctgcactacaaagtgagaaaatggtgcggcactcctcgacaattgcttcgaatttgatcgccacgttctttgtcngactcttctccaacaatttaaggtatcgctcacgtaaatctcgatcacctgaatttaaaccgcttacaaaaattagcgccttgatctcctcttttgaaagttccatttgcgccttttcgcagcagccgttgacctattcggcaaagtccattacgctttgtgatggtgcctctgaagttgaaaactttcaaaccttttcacaaaaattgactttgtctggcataacaagcttttcagcttatttaccgttgcctgataaccaaggtcagttgacttttgtggcaaaatactctcagaatacctcgcgtaatcctgtgaactcattttacccaaaagtaaccgcgttttcatgtcgtctggcatttgctgtccgtccttctcgatgaaagcgccaaaccgatcatgtcaaatgtcaaatgtagaatccgtttctggattatacacaaactcagacaattgtaaattaattgtagtgaataggtcggaattttgtctattcgggtttgtgtttgtttgggttgcaatgttttggagggcatccgttaattgccgaaataaatttgccatttccgcttgacttgccatggtgataatgtgaattgacagagatttcaaagagaaaaagatagaactttgtgtgaaataaatgaatgtgtgcaagtgagcggtgggcctttttggatgtttatttattgattgcacagtccgaggtcaatgatgatgaatgaatggagcgaatggatgaaaatgaatgagaaaaatggcctaggactggcaaaatttagagcaaaaatttaattgccttcgctgactgcgccaaaatgttgtgtccaaagggcacagtgaacaaaaagtttattgacaaattaaataataaaagtctgaggagagagagagtgaatgaagagaagagaaggaaaattgcgaatgaatggggagagaacgaaatatgtaaggaacagtcactatttatgcacttcgacgggcagagagaaaggaaaagacattgagggaaaatagcgaagggaaaagatagagaaaataaattaatgcatgcctattttgtcttatcccaacatctccgtttttaaatattttgcccgtgattgacaagatcgtattttgttttcgtcgtgtccatgtcaaatatttgtgtttgttttctttgacgtgttgaccgtcttggctcaatgatttggacatgttcaagcaacaccttttccgggaacaattcttcctgacaaccacatttttgagccgttcctgtagttggcaaattgcactggattgtcggtgcaaaacgtgcgttgtttcgtcccataatggcggttgaattgttgtgccattttgtgccggtgcttatcggttgtgtccgaatgctttttcttttcgtctggcctaactaatgacagaattgtgcggactagaaggcctagaaacaat

SEQ ID NO: 23576 - DNA, 1383 bp, Heterodera glycines
cgtcatttttcataaaattttaatcgaaaaatttccgtatgaatcccgccgtgtgcaggcatttgcgccccgacatttttttttgtgattgggacccctcccgcgccgctctttaattagcgtttaaatgccaaattttcaaattataaattcctaattgaaatgtaaattttgcatttttttttgttggcatttggcaaagctgtgccaacaaatccaacattttttttgttgacttaagctgttgtggtggcattgatttctcttttttcccattgtttccttccctttgctcattttttttcatttttctcatttttattccctttttatgccctttctggctttcctccttctcctctcatttgaatgttttctgttggccattggcgactttcatcattttccatttggccaaattgccgccggcgttccgccgcccattcggcccaaacgacagtccttttcgcgatacatttgcggcattccgcccttcattttccattctgacattcgtaagttgaaaaaaatgagaaaattaagaatgcgaatgttaggcagggattggatcgaaaatttttcaaaatcagaatatcgggcgggcccaaaaaataagattttagggtcaaaaattgcttcaaaacccccgagactcacgaccaaaaaaaatccaagccttttctcgagactctcgaacaggcaccacctttcatttcccaagctcttgcttgaccaacagttgtttttcagcttgttcctattgggccatttgtgtgaaccacggttttgccaccaatttgccgtgtgccgacacgcaagactgtttagagcacaatcccaacactgaatgtgtgcaaggaacgtaagatcatttgggcttccgattacggtatttcccataaaatagagcctctgtggacctttttcaacccaattaaaaggttttgtttggggggggggtggctctaatttagagatgatacggcataagcacatgcatttttaacaacttttttcacagttgctgcactttgcccaccgtccaaatgccgtcgaccgtttccacggcttcgcaatttttgccgcattcgtcgtctgccgcttcttctttttcatcagcattgaatccatctccacttgtccaatttgtccttcccgtgcttatattatttatttttcgcctgatgttttgaattttccaatttgtttttgcattttcacttttgttcattttttacaatttattttaattaaattcaaaaacaaatgaaaaagagagattaattttgatctgagcccggaaatttcaaagttgcggatcccgctgcgggattggagctcaaaatttttgggggacgggattccgcaggtataaatcccgca

SEQ ID NO: 23577 - DNA, 1906 bp, Heterodera glycines
  misc_feature (65)..(65): n is a, c, g, or t
atacaaatggttgccaaaacacaaaaagaagtaattcctttgtctccggaccaggacatttttantggggagccaaaataattctttaaatgtaaattcaatttttttttaaataaaaataaaatttatatctatctgtggtggatattggacaaaattatgtacatacaaaggctgctaggaaattcctcagaagatatgtccgccttgagatgggtttcgcatttaatttgatattccaatttgcaaaaaaaaacaaaaatatttttttcgtatgtatgcaacttcatccctaattataattagcaattcatgtaaatgataattgcctaattgattattgccacttcgtttccattttggactgtctcttccgccggttgtgcgtttatttcgccctccgttcgctcagtttttgtctgttccgctccttcggccatttctattcgcgctctgttcagtaatttgactgacagaagagcagcaaattccaattaattatgtttaaaaattgacaaattttgtcatgagagcgcgcatttttttattttctcgttgaaatggcagcaaaactgcgcctgctcactttattgggtgtgtgcctgctgtggggagcaccgatcgcaaaaaaaaaaaagtcacgagaatcgagagcgaagatttcgagagacaaacggaggaggaggaggaggagggggtggagggaacggaagggggaaaaggtggggtttaaaaccgtccgaaagtcgctccaaaaatgaaacgtccgttcggcgcctccaccgaatttgataaatgagcagcattttttgtgacatcatcacatgaaattgagcaaaattttagtataaaagtggggagggacagcacaatcggagacatcattttgtaaatgtaaagtcatttcagtttcacttttgttcaaaaaatagaactcatttggaaacgataaaaatattttcccattatttcggaagacggtcaatcatttaaaaatatttcaagtttttactttcttaaattttcgtcaattttaagaagtttaaaaatgcaagagacgcaaataattgtcggagtggcctctctgtgctccattttggccatcctcgccaccgttgttgtggtgccatcgctgtactcggagatcaatgagatcgccaccaaagtgcacgacggtgttcaggtgggaacaaaatgctaacaaacaggtgctaattttgaatttgctccaggctttccgcgtggacactgactcggcctggaccgacctgatggacttacaaatcacagtcacgccgccgtccaagccgcgtcagaacccgttcagctccatcttccgccagaagcgtcagttgcccggccactgccaatgcgcgggtgtgcaacagccgaactgcccgcccggcccaccgggaccggccgggtcgccgggacagcctggccagcctggacagcccggaggacctggacagcccggagtaccaggacaacaaggcgagcaatattagatttaaaaaaataaataaattacaaatgttttttaggtccgccttgccctgtctatacgcccccgtgccaacactgtcccgcgggaccccccggacagcccggaagccaaggaccgcaaggccgccccggagcacctggtcagcctggacaacctggacgcaacagcggacaaggcccgcctggacctcccggaccccagggaggagctggccaacctggtcgccctggaggacctggccaacccggacagcccggagcaccaggagttatcacgtaagaatgatcactgagctaaccaacttaaataaattatattttaagcacctccgtgcccggaccgaagggacccccgggcgcacccggccaacctggacaccccggagcgcctggacagccc

SEQ ID NO: 23578 - DNA, 1634 bp, Heterodera glycines
  misc_feature (59)..(59): n is a, c, g, or t
  misc_feature (62)..(62): n is a, c, g, or t
gacgcaagggcgtcgccagacattctatgccttgcttcgacggattgtcctgacccatntanaatttcataaaatactaaaacacccctttgaaaggggctctgattgagtgcactattgtcgaatttacaaaaaacccgttatcttacagtggatcaaaaagcaaagatttccattccaatgacgtcgagaaagcgagagcatgcagaaggggaacaagagatagaggaaggaaagagtgtgttgagtggagagagtgttagtgatggagaggagggcagaaacggagaagagacgaatgaaaaagaggcggatgaaagagaaagagagcgggacagaaaggaaaagaggccgagaaaggaatgggtggtggccggtgttcccaaaaattgttcggatttgtacgtggtggggattccatacgatttggaggatgaggcgctcaaggagtactttgagcagtttggaagcgttgaattgtcagaggtcagtgagtggatgagcaagggaagagaaggggcgagaaaagaaattcacgggagggaacctccgggggaaaagcggaaagggaaagacgggagaaagtccgtggtgataagacaagtgtgcagtgtatggaaagtgcgacggtcagtcagagattagaaaacgaaaaccacagtcaatcgcttaacaccgaaccattggggcggcctttttttacaatttctcttccgcaaatttcacatttcccataactttcaacaaaaaaaaaaacttttgcagataaagcgggacaaaagcggactgtcgcgtggcttcgctttcgttcggatggcccagtacgatgaccaagtgaaagttctgtccaagcctgtccatgtcatcgggggacgcgaatgtcacacgcgcatttcttccacagacaaagtgattggacttacaatatttcttttgttttcttcggtatttttgtgattaaccaactaactaacatagtttcttggtctatttggtaccatgaaatattcagaaatggggagagattggatttagtcggttggactcaaaaaatatgggcaaattaatatttgttttaacatttttcaagttcaggctgtcgacccctacgtgaatcgctctctgtcggtaaaaacgtttcattttattgttttgttagaaaaattgagtcaaagaaaagtttccaaatttgaaattgtcgctgattgtgtcatttcttaaggccaaccctcgcgttttcgttggaaatttggaaagtgacatcggcaaagaccgtcttcgcgagttctttttggagcacattcgtcgtttggacaaaacagcggacatcgtcgacctttactacccgaaaccattccgaaactttgcctttctcacgctcacttcgtcatttgctgcgaaagaattggtcaggtcggtcgtaaacagcctcagaactgtcgcaaaaccttcaccaatttctcctttttctacagacagcgcgactttatcatcgatgggtccgcctgcgaagttaccgtcgctgccccccgaaaaagggacaacgaagcgcaattcggtggccctgggcaattgccattcggccccgggacggggttcatcgcacccggcgatccccgctggaacatcgccgt

SEQ ID NO: 23579 - DNA, 1214 bp, Heterodera glycines
  misc_feature (125)..(125): n is a, c, g, or t
  misc_feature (1135)..(1135): n is a, c, g, or t
  misc_feature (1141)..(1141): n is a, c, g, or t
  misc_feature (1175)..(1175): n is a, c, g, or t
  misc_feature (1203)..(1203): n is a, c, g, or t
gtcaaaggccaagggcgctggggccatcatgaagtcaaagccaagggcggtggggcccatcatgaagtcaatgccaagggcgctggggcccatcatgaagtcaaaggccaagggcgctgggggcncatcatgaagtcaaaggccaagggcgctgggcccatcatgaagtcaaaaggccaagggcgctggggcccatcatgaagtcaaaggccaaggggcgctggggcccatcatgaagtcaaaggccaagggcgctggggcccatcatgaagtcaaaggccaagggcgctggggcccatcatgaagtcaatggccaagggcgctggggcccatcatgaagtcaaaggccaagggcgctggggcccatcatgaagtcaaaggccaagggcgctggggcccatcatgaagtcaaaggccaagggcgctggggcccatcatgaagtcaatggccaagggcgctggggcccatcatgaagtcaaaggccaagggcgctggggcccatcatgaagtcaaaggccaagggcgctggggcccatcatgaagtcaaaggccaagggcgctggggcccatcatgaagtcaaaggccaagggcgctggggcccatcatgaagtcaatggccaagggcgctggggcccatcgtgaagtcaatggccaagggcgctggggcccatcatgaagtcaaaggccaagggcgctggggcccatcatgaagtcaatggccatgggcgctgggcccatcatgaagtcaatggccaagggcgctggggcccatcatgaagtcaaaggccaagggcgctggggcccatcatgaagtcaaaggccaagggcgctggggcccatcatgaagtcaaaggccaagggcgctggggcccatcatgaagtcaaaggccaagggcgctggggcccatcatgaagtcaaaggccaagggcgctggggcccatcatgaagtcaatggccaagggcgctggggcccatcatgaagtcaaaggccaagggcgctggggcccatcatgaagtcaaaggccaagggcgctggggcccatcatgaagtcaaaggccaagggcgctggggcccatcatgaaatccaaggccaagggcgctggggcccatcatgaagtcaaaggccaaggncgctgnggcccatcatgaagtcaagggccaaggccgctgnggcccatcatggagtcaaaggccaaggncgctggggccc

SEQ ID NO: 23580 - DNA, 1001 bp, Heterodera glycines
cccccccccccccctcggcttcgttcgttcgttctgtcgccctttgctcatccgccaatgctttcgtactgttcgcggctttcttcgaaaagtgtctccattctctccatcaaattccttcgctgactgtcactttgggcctgggggaacaaagttgggaagcaaaggaacacgaaggtcagttcgaaatggcgcttaaaatgggacaaatcaatgggtgcgtgcgatcgattgttttttgtgaatgatcgattggatgaattctgccgattaatggccaaaactgatcaatgccaatcggtggcccctctttctgtcatcctatccctcacctgttcttcaaaaaggtcattcctcaattgcttcggaaattccaccggtggcacaatgttcagtgcttggctttccctctccgccgtgtcgaaatacaaattcttccggggaaagtttttggggcgatgcctttgccttttttaccagccaatcgttcatccgttcccttctcaacggcgcattgacactgctgaagataatccgaatcacgtcgttcagtccggtgccttttgattgagcgcaattcattcaagaaaaaagagaataataattccaaattgaaagcctggggggccaatggcaaagtatttaccaaagccactcactcgcatggcacgtttgccagtcgatgatcgaactcagctgatcacccggctcgccattgtccaaccgattgaaaaacaaattgttgctccaaaggtcgccgtgacaaagcacaggacgaatgcctttggtaaagaaaaattaacccactttttgtgccgacaattggggggggggggggggggaaatgggggtgaatggccaaggaaacgcaaatcccttctcaccatatctttcgtgtacgtccgtcttcaatttgttgtgtttcgaaatgaatgcccgcagcgttttgtggtgccttttgaagaagggcgagtccaaactgagcactctctgtgccaatt

SEQ ID NO: 23581 - DNA, 1040 bp, Heterodera glycines
tttaattgccttttagtaaatttaattttacgctcttttttatgcatttatatgaattgaaccaagtgaattattggcacatatattcagagaagttcgatgccgtgccgtgccgaacaaaaaaaaagtgataataatttatttttctcatctcttagccctcccaccaacatcgttttaattgtttttataacggaaataaacaaatttttggattaaaaattaaggaaaaaataatagttttgttttttcactttgccctttttatttggttcaaggaatgaatttttaaaataaaaaaccaaaaataaaagggtgcaaatgccgggcacaaaaaccgtggcactctgaagatcggactttcaaactgctctttgtcatccttcacagttgtgattccgtgccccccccctctccctaatatttttatcattggtttccctttatccctttctctttctgccatttctcctgcttctcctccatgtcattgtattgcttctccttttcaggcttttgcccccttccaaaatttgctaatttccaaatgccaaaagcaccgtccgccgctccgccgagtttggctccacaacgaatgccaaactccgagtcggccttcgccatttcttccgctttttcttcgcttaccaacgacaaaagtgggcatctgttgagaagactgaccaaaagcaacagttgcagtgagagggtataagaaccaatcaaaacaacaaatgataagctgaaaaagtgccattggccaatgcaacggaaaattccaatttttggccaatccctccgaaactttcattaatcaatcaatctttttcataagacaaaacggtcgtcctggcaactcattcaatggaacggacgaacgaacgaataaatgaatgcattttcaatggagggaccgttgaaatgaatcccctcaaacgactcattgagtgacattattcttgaggaattgttgctggtgatgagggcgaatgaattaagcgagtgggggaaaattggggggggagaagggggggaggaca

SEQ ID NO: 23582 - DNA, 2221 bp, Heterodera glycines
  misc_feature (214)..(214): n is a, c, g, or t
  misc_feature (277)..(277): n is a, c, g, or t
aacgaaaaatctctaaaaatagagactgcggaacaatgatattaaaacagtaataagcgaaaaacatctaaatcaattatttataattatataataaatgatttaaatgaattaagcaaatttatgtttattaattaaaattattatatattttatgaaatataaaaaaagttaaacgaaacattaatttatttgtgaaacaaaaaaaatatgnaaagacaattattagttaacaaattgcctttttattaatgaaaaaacaaataatctaataatnaataataataataatttatttaaacaaattaaacatatttaattgctattgactcccaactataaaaatattttataaaaagctatattttttatttacaaagaacaaaggaaactatctttagaaaaaacaacacactaaatttgcatcaatagaatcttaaaataaattattgcatagtttaacaatattatcttttcttttataaaggagcaacgaataatgcactgcaagaacatatggacctgaacaagtttttaaaatctaaatatattacaaccaaaagtaactattaatatacaaatataagaaaagctaaaaattattacaaaaaaatacaaataaaagcaaacccaaatggaaaagaatgaatttttttttaccatttcattaaagcttcaaacaaaatttatacaaatctatttatgaaacaaaaatttttaatggaaagaaaaattctaaaaggttataaaattttaattatattatttatttatgtttttatttgagattagtaataattcgtcgcaaagaagatttgaattgtttaaaataaaaaaaagatatattataactttttacattttttacgaaaaataaaaaaaaattagggaatggagtgtattgatggcaaatataaaaaattgaagtattaaataagaaaaaacttttaaactattttccatttattttataaattttatataaaaatttttgattttgaaaaaacaaataaatttataaaatgaaaataaaatataaagtaaaaaaaatttcactaattatttaatgtaaatatttatttcctttcaaattatgatcaatgttaaattaagctgagttcaagaattaaaaaaaaattaaaataattgaaaaagagtaaaaaaaaagttaaatcatttaataattctatcgacatttcgaaagtaaattaaaaactaaatattctagagcaaatttattaaaaacacctcgttactaaaataaaatcatttaattctgtgactaacaaaatggctctctgacagttttctgggctaaatattcattttttaaatatttaattaagaaatattttaaaaatttaattacaaatgtcatagcggaaagttagtgcatcgaaataatcaaaacctttaagaaaagacaaaaaacaaaatcaattatattaaatttaaactgattacaataataaggcataaattataacgaaaatagtaataatgaagaaaaataatttaattggtattttataataatttattacaaaaaaaaatatatataaatattaaaggaacatcactagtgcgtaacttaaattgctacgacacgagacatgatataaaatagttaaaaccaaaatcataaaaattaatcaaaaaataacatttaatataaaattttttactaataaataaattaagacatgaaaacaaatagcaaagacgaaaaaaaaatgttatttaaattctatacaattaaattacatattatttaattttacaaaagttcagcaaacaaatacccacttacaaaaataaataaataaaaaatgggaattatatattgcacaacgagcgaagatatcatataaactaatagataggcttatttttttgactcttcggtaacaataatttatttaaataatttgtaataaatttttaaatttaaaaaaaaatcatcaagaaaatcaatcatacaaatgaattcaacgcaatacaaaaattaaatttatgggtttaaaaaagtaatcggaaaattaaaaataaattaatgcttttgaaaaagaaattcaataagcatttacagaaaaccaaattggattcacaaaaaatttaccaaagcaattatgagtagtatatagtaccaaaaggttgcgggttggttgcgggtgtttcccgcacgagcccgtgtctatgggagggcgcagccctttgaagt

SEQ ID NO: 23583 - DNA, 145 bp, Heterodera glycines
cagctactcaggaggctgagacatgagaatcgcttgaacctgggaggtggaggttgcagtgagccaagatggcgccactgcactacagcctgggcaacagagcaagactctgtctcaaaaaaaaaaaaaaaaatcctaaaagact

SEQ ID NO: 23584 - DNA, 1304 bp, Heterodera glycines
atcagggcttctttttttatgtacctgttttgttcctgcattctccatagcctaattagtaggaccccactttctttttcgtgtttgcgaacaaaaatcgggacttttatttacatattccgagctttttatacatatttacacatatttcgggtttttgtacatatttggtacatattttggactttttagcattttttactaatgaaaaattaaaaattttttttgaaaatgtacccctaaaaaatcgttttttttaaagatattaaaaatcaatttttaaaatactaaaaatgtgaacgaattgttgcattaaaatgagaatttcccgactaaaaatgtgttttttgtgcacttctcagtgaaacgaagcaacagaaaaaaaaaatgaaaaactaaaaatcccatccctgcagatgaacactgcgatctcaaaattatttgaattgaggcctgacccatacgataattcgcaaagaaaatacttgcgtctttgtttggtaagtccatcggttttatttaccaattaggtatcatccttctacaatacattcagtttttgaacgtggaaaatgcatcagacttagcggatcttgtaaaagttatggatattgcattgattcgcgcagaactcgtaattcatcatactttcaaattggactgttaatttatattatttacaggtacttgagccttttatactccttgtagcagcgaatcgtgcactttttcaagccgctcacaatcaactttcaactcgtacgtgaattcgtccaaaattgctataaaaaatgtctcgagggtaatagtttagatggtgccacaccttttttaaataaatttttatagtttataaaagtcgtaaaaacacatttctagggtgttttcggggatgccgatcccgaaaatgacaccttcgagtgattttttttcattttttaggttcactgtctgctgaactgatttactgtctttcgcccaatcgtaatattcgcgagtcgttggccacttttggcattgctggcacaacccgtgctctgttggttgcaatatttgatgatgccaaagggaagaaaatgcgtgaagccgccaaacatatcaaaggcacaccggtgacattagaaaaattgagggaaaacgctgacgaggcactaatcagacaggtaattaatcaaactgtggcgtattatttcggtgaactgccgatgctaatttatcactggatgggaaatggttggggtaatgctctgacgcattgcgaatttctgaatagttggtttagcagacctttaactcgcaaaaaa

SEQ ID NO: 23585 - DNA, 1166 bp, Heterodera glycines
aaaagtaaaattttttgatcaatttttcacaaatttaggagagagatttcgtggttcagcgcgccggtgatttttgaaaatcttagcgcaaatttttacaacggctgccacattttatgatcttttatttcttcatagcggaaaatttaaacaaaataagctgaggagttttgacgaaaaaaagaaaagatagaaaaatctttgtgaaaaaatgtaatgaaaaagctgaaattatttttttcacaacttcaattaataaattttataagcaaaacaaaattaaaaaaaataataataaaataaaaattataaataaaaatacaacaaacaatgcaattaaggtgagaaaaaaatggaaaaaagaattccagctggacggatttgaaccatcgacctaaggatgtcttcaaccactacagtcctccgctctaccaactgagctacagctggcacacttacccacttattattattctttttattccattaattctgtccccacaagtcaaaaataataccagaaggaagtaaactagagaaattttgattctaaaaagaacaaatttaaataaatgccaaatattgaaaactatagtaattaagaaaccaaaaatttattagatacttaattattaagaaaacatttaaaaaaaactaaaattttttcggtttacgatggacaaaaaatgcaatacaccgacatttgctgcgcggacatttgtgccaatgccgaaaattggtctcaaattttaggtattttaatcccagctagggcagttattaagaggccacttaggctccactctccgtatcttcccccctacgaagattctcaaacagaatttttcaaaaaaaaatcgtagaaaaagaaaaatttattttgaaaaatcttagtaatgcatcataaaatttagggaaacgacaggcagaaaacgagtgctgctcgccatttatgaatgttgattgaaaaattggattttaaaagccctaaatttaattttttgaatttttattttttaaaatgccaaaaaataacgctgataataatggtgggtggtaatgacaacctctccttgcacttggacctccatctgctgcatcatgcgatgctggccgtccacaaatgcggcggtggacgacgaaccaccaaaatagccaccacttct

SEQ ID NO: 23586 - DNA, 1201 bp, Heterodera glycines
  misc_feature (350)..(350): n is a, c, g, or t
cccgtcgtaaaatgggggcgcccccccgtgccaaaggtgcgacaaccgaatcaattaagccgacggtttctgttccttctgcaaatttcgaagtccgcaaatgccattttgggccattggccgtctctcgaaggcattttccaattcattagccttaaaaccactcaatcgacctcctttcagctgttcagtctcggttccccgggtgttgtgaaagtctacgctctttcgattgcggggacggcgtttgtttgtccatgtcacattttcacgatggaattgctgattgtgcggacggaagtgacgagtgtcagttggaagaacttctgctgaaatttcccccccccccnccattttcccaaaattcttttttcagattgttttcccgaacaaatttcttgtggcactttctgtgccgatttcgtccatcttggcgaatgtctccaaaatccgaattgtacccaaagagtgggccctccgtcgcccatttgtcctctgctcagtgagtcgtccacttttatccccctttctccatttacgtctaaactttttgtcgactgtatattttttggcattgtgataatttgtcaaattgttcaaaggcatatatagttctggcttaactaaaacggccgagtgaaactggaggatatataaataaagtgactaaattgttggttaaaattcacagaacgtcgtctttgcggttttgccaacactgtgtcatgccgtggctacggcgaatgcattttcgagaaatggctaaaggacggaaaaagagactgcatggatgggtcggacgaagacgagaattacgcggttggtggtcaaatctggcactatggggtacgagtctcgaatttctctgattcagagcctattcaacattgcttctgtcccgttggatcaacgacggactgttcaccccccttttgctgctccaccttctcctcctcctgctcttcctcctcctcctgctctacctcctccacctccttctcttcctcctcctcctcctcctcctcctcctcctcctcctcctcctcctcctcctcctcctcctcctcctcctcctcctcctcctcctcctcctcctcctcctacccccttttcccctcctcttcggacattgtccgcttccttcttttacaactcatttttttaaacttaccttcttccacataaagaatttcattcacat

SEQ ID NO: 23587 - DNA, 1177 bp, Heterodera glycines
tgtagaatgcgcaaacagattaagggaggacaaataggttgcagagactttggataaaaattcccaaaaggatttgaaaatttcaattcacggcatactgaatgatattccgtccctacgtactgtgtttaataactataaaatcaatgggccacgatacggtaactatactaattagagtaggacattttgaaaaaagcctttcaccagtattaggaaaattagaacaaatcgagatcagttatggcaatttccaactgtttaggtgtaaacaaaaggtgaaaagacggtggtaacgaataccgtaacatctacaacatgctatttcatactgtataaattatatgccattttccctccatttggtggacccacttgtgttaacggatggtggcggcacggcaggtggttgctgtgcagcagcagcaccagcagaagatgcaccgttcgcgggtgccagccggtcaattacagtaggacagccgaccgtagtcgcggtagcagcagtcccaccgcaaccgccccgggttcgcttgcagtcaacagcggactgtgcaccgctggatgacgagtttgacgtggtgtaatgggaggtgtcggcggcactcgactcgcccccaatgggacagatggcagcagtagcagcagcggcggctggtagctgtgccgatgccggtggtgccaatgccatcaattgattgtggtgatgctggtggtggtatgtggcactggctttcctcgacggactgaacaagcggcgcggaagcggctgcggtccgcaaccattccgtaaattgggcgctcccatcgcagttggcatcataccgccggcaccggtgccatcgatgccaaaacgggcaactgccgtggtccattcaggttcattcatcatctgtcaaaattaagggaattttattaactgttgctgggaaggacatggtaaaattgagattgtacagtaaaaagacacaataattgggaaaattctgtgacagggtaccatttttggctgcaaagggtactgtagaaatggaattatacagacggaatagaaaaaatggaaaaaacagagaaatacaatttagtgatagaaaagaagcagggggtttttttttttgggtttaccaagaatcttgtatacggtataacgatgtattgggcatgcacagtaagaaca

SEQ ID NO: 23588 - DNA, 941 bp, Heterodera glycines
aaaatgtcattgcggttttccctcaggcaatttaaattcacagaagggcaaacataattaaattttgttaatctgtacacgatttgccctggggcataaagaaactttggcagattaaattgaccatgccaaattaatccgctgggggggggggggagcaaacacggacaagcaattgaacaaacattttttaaattcattttgaaaatttaaaaatttatttaattttcagggctttttcaaacgaactgtgcaaaacaaaaagcactactcatgcaattccaaccaaagctgtgaggtggagaagcaaagtcggaagcgttgtccgcactgtcgcttccaaaaatgtttggagaagggcatgaaagccgaaggtgggccgacagagtttttgaggcttttaaattttaattccaacttatgccaaatatggcaaagtgtgcctttgcttttcgttgtccctccaattatcgtaccattgccccccattcaaccttttctttccatttttgagcttacccggcccttcccccttctcttccgattgctatctcttctgtccgtcttctccctcaaatggcatttgatttttcaaaattccatcaaactttgccccttttaaattgcccaataaaagtgagtgaatgagtgagaagagaagagaaggtggttgtggcgatgcagcaatagcataagagggggggggggggggttaagttgagcaatttggtggcgaaaagggaatttatgagggaattttgggggagaggggagggaattggcatttgctaacataagccatcaaatggcgaaagtgccaccgaaggtgcagtttttatatggcaacagcaccctttagcattgattgcattatcactcattttctcctcgccccattttaaaggtctgcacaaaaatcccatcaaaaagagaaaaagagg

SEQ ID NO: 23589 - DNA, 1214 bp, Heterodera glycines
ctcttccactcccccctcttttttgtccctcttccatcgtcttcttcctccgtttccgcttctccttccttttcttcatctgctgctgttcatccttcgcaaatccccaaatcccttcttcccctctttctgtgtttgccaatgacggaaatgaaagcccaaaatccccacttttgcccgttttgattgattgttcgccgccctttcctttcgttttcttcccttttctcgctcatccaatcgtccggccgtcggaagattagcgcatcttcaaaatagggaaaatgttggtcagatagactcaccaatcggccaaacaaacggagaaagggcaaatgaaatgggagaatgcgcggaatggaaggaaaagggggcaatggacgattagagggggggggggggggtacggttagaattgggaggaatggaacggagagaaatgcttgttaatttggtttattcatccccaccccataaaaagaatatgtcaagcgtatctcgttcattttcaagccaattcattgttttttttgtttgtccattcactctttaccacaaacataaaaaccgacaaaagcacataaaaacggagggggggggttgaaggaatggaacggattgggacgtataatgaccactttcgcggcggttgaatattattagcctttgattaagactggacaaaaagggcgcgagtgactcattaaacattttcatgccctttttggcattctctgtttctttattatttcattctctttgattggctcattccctgttttctgctcaaattgaattttgtttaaaccattaaacaaacagtgccctcccccgttccttcgtttcctctccaactgcacgtccctaggggacgctccctccctcccttctcctttctctcttctcccctccctcccttctcctttctctcttctcccctccctcccttctcctttctctcttctcccctccctcccttctcctttctctcttctcccctccctcccttctcctttctctcttctcccctccctcccttctcctttctctcttctcccctccctcccttctcctttctctcttctcccctccctcccttctcctttctctcttctcccctccctcccttctcctttctctcttctcccctccctcccttctcctttctctcttctcccctccctcccttctcctttttctcttttcccctccct

SEQ ID NO: 23590 - DNA, 784 bp, Heterodera glycines
  misc_feature (775)..(775): n is a, c, g, or t
tcatcactttttgattaatcatttttatttttttaataccaaattcttaaatgcatttttgaatattgttcgatttgtccataattttttttgctatttttaaatttatttttccccattctttcgatgaatattttaacaattttaaattttctaaataataaaaatctaaatcctactgttttcttacaaataagaaaatctacttaattgaaaaaaaaaattattattttattaaattttattctattgaacaaattattggcaagaatgagtaaaataatgattaattttttaaatatttttccattaattcacattttttagagtggtcaccggaaatgattaaaattaaatttaaatttctaactcctagttaatgcaaaaaagaaaaatatatatatatatttaaaaaggcggcgataaaggaaaaaatatgcaaaattttaaaacaactcttaaaaatttagtttttattactggtaaaaaacgaaaattaataataaaaataaggaggactgaaaaattgaacttatttaaaatacaagcatttgaaataactgaacaattcgaagaattaataaagagtgacgaaaattcattaggcaaaaacacttttggcaccttcgcgtttcgcgtttcgcattttggcgcgaaactcgacttttacacccctaagattagattgaattccgctaaagtttcgcatttatttttctttcgcattttttactttcgcaaatttcgcgtttcgcattttattttccaatttggnccatccctg

SEQ ID NO: 23591 - DNA, 2026 bp, Heterodera glycines
  misc_feature (48)..(48): n is a, c, g, or t
gccaattttggcagtacgacatttgtcaccatactgttgcattgtgtncattacagtatctctccattgtgctctgtgcagttggcactgtatgtaatgtatgcaacattgtcgtgttgacaaggtcagtggaaaaatttgattttttaaattagtgccgaattttggcactcattgtgccaacacgtttttggcaattatttgtattatttcaactttttaaaggaaaaaaatgcgcagcccggtcaatttgatactctgcgcgatggcctgctgcgatacggtggtaaggaaaatgccaattgggttctcgaaaacctcgagctcggcactcaattctttcaagatttttttttttagaatttgacttttttgatagatagaatttttttttacagagaacaagttttttaaataataatagcattaaaacacaaaaattcaaattatttaaatgaaaattaaaatatgggggaggagggcaccaccggggaatatttatttaaaaacttcaaaattttagtattaatttagacaaatctgaaaaattcttggcattgaaaaattttcgcatttaccgaaaattcaataaaacatgaaaaaccaaaacatttgggagccctgtttttataaaaaagcaacaaatgttaggttttgtcctccaacatggtctacacaactcattacacatttgttgccttcaacaactgtgtgccaaagtgagtgaaatgccggaaaaggttttgtccggtttagtgtttcaatttatcccgaatcccaaaaaattttgttcatgaggtcgtaatttcaatcaacaattgatcaacccatcctctacaggattttacaggatcctgccctggatattgtatctggaaaatttttgtgtccgggattcaaaattctcgggcgcttgtttcgacggcacttttctttccccgccgattggcacttctatttactcccaactcacccagaaattggtcctatggttggtgcgtatttctgatctctcatgcccatctgtccctggttggccactcatcctccatttggctgtccgtcatgttggcactgatccgctacattacgcttcgtcgccggggcaaagctggcggtgtacaggtgcgtgccgtctttggttgtgactgatatttttgcatatttgacattctgatcaatagtagattgatcatccgtttgcctccctctctctaaatctatttctctgcctcttctctctccgtctctgtgtctgtctccctctctcattttatttctctgactcttttctctacatctcttttctttgtctctgtctctctctcgctctctcttctgtttctctctctctcactctctctcttttctctctccctctctctcatcggttctcacttactcagaccactgatgaatgcggcaatcaccattcagatcggtgttcaacactcgtacattgcgatcgcttcagtcgtcattttcgtctcgctgatgaatgggcccaactttttgacctataaaatttcggaacaaacgctggacatgacctgtggcgatttggtggttgatcagtacaggtttgccaaatgatcacccaaaaaatgacccaaaagatcatatacattaaggaatcacacggcctatgtgcccggcgtggccgatgttgcacttgaggtgggcgaggaattggatgggaaaatatggttaatcagagcagttgacactgatcagatcgacaggaacagaaatgttaagatgcttcgaaaaagcactagatcccgaatgattgggagggatcaaaagatatactaattgaacagtttaccggaaaaattctgaacagcatcagctataaaccaagctgatgggagcggaatgaattagactgatttgaatatgattagacgaagggagattggaagaggctggggataaataaaatccaacagcatggccaaaaaaagtcccactttttgcaactgagccgccgagcggactttttgtttcattgagaattttttga

SEQ ID NO: 23592 - DNA, 1801 bp, Heterodera glycines
tccaggtcccggcaaaccccgaaaaacctggattttcctggacaaaattttaggatttatttttcaagtgcccgatgtttttccaagttttaaaaccagattaaataatttaaaaacacattatatttataattagatattttagaggttataagcaattgatttttcacccttttttgattttaaaatgagttcaaaaaatccaggtccaggcctggatccaggtccaacatggaaatccaggtccaggcttttttcaaaatgtcgatctctaggcatttggtttcccatttatgaaatcaaaaaaatcgccaatcggactaaaaatatttgggaatggttattcatttaaggtcattcatcgctgatccctttcatatgcagttctgcacatttcgccatttaagaccgtctcacaaattggccacagcacacagcgttcctcgtcactgtagcaaattgcgaaaacagtcaaagcgaataggaggagacaaatatagcagggccttaacaataaaaaaaaatcgtttcagcagcttcaaatgtggaaacttatgttaaaattggaacctctgattttaacaacacctaataagactttccaaaatgggtgaaattccagcggaaatttttatgaattaaaattgaaaatgaacctccgctcaagtacgaatccgataatgtagaaccagaggaacatagcctggtcaaaaagaaaagtgggatgaacaatctgctttggtatcagaagaacaggcatcagccattgtaagcaatacattttgtgaatgtacctatctaaaatataaataaaaactaatttgctacttataacttgctcaataatagacaaaataaaaccattttagctgaaaaatcgtagaaatttattaaaattttgaaagtttcgagcaaaaaaaatttaaaattttcgactttttgtccgagttcgggtccgggatacaatcttttctcgaaaaaaatttcatttttcgaaaaaaaggaggggggtacaatcggcattgaccccttctatcgattctgatttgtaagtttattttatgaaacaagtttttaactaactttaaatcggctcttgcatttttactagagtccggtaaaaaaaaatttcagggagcgggagcgggagttcaaaattttccgggacgggagtcccgaacgggattcccgtaaaaatcccgctcccgttaaaaatcccgttcaccgaaaaaagcgggagtcgggagcgggactcccgtaaaatcccgcggaagtcccgatcccgccggactctaatttttacaaaggaaatcccatttttttaatttgaaagttttgcgtactgtttataaataaaaaacttactcgacatacctaactggtgaattgatgttgtaaaatattatgcattcttgaaaacgcaaaagagccgaatttttctctatatatttaacttttattgagatacagattttgttttttcaataaaatgagttttattgttaagaaaattggaggggaaaagaatggcggggagcgtaaagtgcaaaaggttaataatatattctaataaacacggcgaaatatgtattttagaagcagcagaagcaagtacagaagaacaggtcgaagaaagtcccgttgcgcaaatcgattacgcccggaaccgttctgatcattttggctgggcggcaccgtgggaagcgtgttatctttctgaagcaattgtcaaaatccggtcttcttcttgtcacaggttcgggcaaaataaataagtttctgggccaacagacccacaaaa

SEQ ID NO: 23593 - DNA, 1485 bp, Heterodera glycines
ttttaatagttaaccaatttgatgtacattctgatttggacatttttcagaaatggctaacccaattgcaaccaaaaaacaaaaagtaaaattgtcttacgaaggccacctttacaccttcgctaaaatgagttctgatgggatgacaaaattttggagatgcaagtttaaaaagttgtttttactgtgatttttcatttttctgtacttggggcccaaacgaccctggggcccaaaaacgggggcccaaacgcccccgactcgaattattcacgtaattgctcttacccaagcaaaattgtttcccatttctacgtaacagaaaaactacgcattgttcgacaaattttcggttcttcttctcccctccaacccaacaaattcaccttttaattccctcttctgtggaaatgattttggccaatattaacgcgaatttgttttttgtccctcgaaaaaaataaattgcctttttttgtcaaagctttgctaattttaaaattgccctttcaaaaaagggttttgtttttgtattgttggccattcgctttcattttcctttttattcggcagatgaccgcacagtttttgttattgtcgctgcttctgttccattttttaaattctcacaaatcaccgccacaacaacaacaataaattcatcacattgtgattgttctacaaaagcccatcctttcatttgccatccaaaacccattgatttgaaatggcaattttcggcctcttcaagcagttactgctcggccaacatccgaccagcagcaacggcggctcactgtcctccgcgtcccatcggcgccgccgcttgccctcgacggtggcccaaaacggcgcgagtccaattggggagggcggcgaatggcgcacattgggcgaaattggggagggcgcgttcggcaaaattgagaaagtgtgcagcgttgagagaccgcaattgatcgccgcttgcaaggttcaacacgagaaagcgcaaaatgggaaataaaaaacgatggaaatggaggggaaaagtgggacatggcaaaaatcaatggcacgttcaaattttgtctgaattttgaatataggaaattttttttcccggcatcaaaaagacagatttaatgttacaaatgcaattttcaaaattttgtctcataaatacaccaacctttgtagcaaaaatggcgctttttgcctcaattgctaaacaaaccatgagaaatttagaaacagaaattggaatgcttaaaagtatattatatttccatgtttttttgcaactcaaacattccatttttatgataattccatatttattcatttgttcgtttaccctccaattttcaagagcatttctctgcaagagggcgaagaaatcgacgactttcttgtcgaaattgaaattctcgctctatgcaaaggtcagccgaacatcgtggaactgatcgcctgctattttcacgagcagaaacttttcgtaag

SEQ ID NO: 23594 - DNA, 1356 bp, Heterodera glycines
ggggggggatataatcgaagaatacggtaaccgaaaactcagattttataagaaaaacaaaaagaaaaatttgacacaatctataaataaaataataattgaaaagattttcaaaagaatttcattttaaattaatttgttaaataaattccataattaaaaatactaaccaaataatttttagcattttgagtttttccattttttagggtccacatatttatgttatatttaatattttatcaatacaaattgcataatttggtaattagttaacttccaaaaaaagatttattaaataattaaaaattttgtgattccatttaaattcccttaattcggcattcttccccttttcgtctttactatatcggataaaaattgcttcattttaattaattgccacaattaataaattaacttttaaatcattgccccaaatggccacttcgttgtttgtcaagcgaatgatggctaactcgtgctgttttggccttttgctgctctacgtgatgttcggtgggcttctgctgctgcgttttgagcgtggccaatcggagcgggcgaaagacgaattaatacggcgcaaaacggaatgcattcggcactttttgcgctaccaaaggcacttttttaataaaattaaattagcatttgcaatttttattgcaataaatattgtcttaaagtcaaagaagctgctgggcagtttcttaaattagccacgggatataaaaaatagaaaaagaaataattaaattggcttaaatttcagcgatggcattttcaatggccaagacagaagtaacgaatcagcagcaaatgcgccgactctcatctcagcagcggaacgtatcactgagcattgtctgttcggaatcgtcgacccggcggagggccggcggcgccaaacatggaacttccgaaatgccatcctctacggctttggcattctgacaacactcggtgagtgcgaaactggcgaatctgcggttaacacggcgaattgttcgtaattaaatttaaaaaaaaaaacaaaaattaaattgaatttgatttttaaaatatccttcagtggataaatgtagaatatgagaatgccaaaacttatcggtcatcaagtaaattagataaaaatggccttattaagagagaatttgtgccaaaggagggaggcacaatttgagataaaattaattcaaatattaattattctccttaaaaatattggccatttatttgctcgacagacaaaaaataaacaataaaacattttatgctcctctaatcacaacacgtaagtaattttcaacacggtaggacaaaaaaggaataattaaaataaaaataaagcat

SEQ ID NO: 23595 - DNA, 1515 bp, Heterodera glycines
  misc_feature (1378)..(1378): n is a, c, g, or t
  misc_feature (1388)..(1388): n is a, c, g, or t
  misc_feature (1449)..(1450): n is a, c, g, or t
  misc_feature (1470)..(1470): n is a, c, g, or t
ttaaggatttggggagcaccgttttttctgctttttaccacagggaaaattcttttcgggccacattaaaacccttcatttttagatgaagcggcagaaaatgggttggtaccccaacatggcctggcggctttggctccgttcgtggcgcaaaattgggacgccatgccaccacaaccgcaacaacaaatggcaatggcgagcgtttgcgcagccgttcctgccgccgatgggaatgccgccgccgatgggatttcccccgccggttccgttcgtccccctgttcgccaatccgccgctaccaatgccgtacccaccaccaccgattctgcaggtacttaagtcattcgcaaaatgctaaaatttcagaattacagaaaaaaaggaatttttctgggggggggggggggaatatgcatttcttgtaaataaaaaacttaaattttttcagcaatttagagacaaatggggttctttttgggcaaataatacttttttcaaatatttttaagccgattccaattcctccggctcgtccgctgtatggggctttcaacgcaccacaaatgagaccgccaccgttgatcaacatgccgtttgctccggtgagtttatatttttacgaacctaaattttgatataaaacattattactgtgtttattgtgaacaatcatttcgtgaaaaaataaaacattccgttacctgcaaatacaaaggaaaaacatatttgcggtaaaaaataaataaagaaatttactaatttaggttcgaaattttgtaatatatgtaaaacaaaacattcaaaatcagagggttgttatattaagaagattatcattccgaaaaatctgccacgttatcgtatcataagctacgacacagagtgttcagtatgtaaaataataaacaaaaaattatcttaacaaatttagacggataatttaatagaaaatgggaaaaatgaggggatttttgaacataaagtcgtttttttatcggctcgtattacatgttcggattgcgatggggaaaacaaggactgtgatatttgcgggccaaagggaattagacaccacacatggtgtacggttgacaactgtgaacccgtcttcgagtttttaaaatgggtgctatcgtttaaacattttgaaaccatttgttatgctcatttcgccggtaaaatcaaaaaattaaaaatttttataataaaattttagggcgttacgatgcgcactttattttgcacgcattaaccgaaatgggatatatacctgaaataattatttcagatctaaaaatttatcaaataaagttgggaaatttgttttttagatatttttggctgatgtcacagaataaattatccgatttgccanaaacatttgngttggactgcactcccaaagtatatttcccacacaaatataactcagaaaaaaattatggnntaaaaataattattaattanttttttatggtttaaaggtaaaataaatccaacactaccccccat

SEQ ID NO: 23596 - DNA, 1830 bp, Heterodera glycines
agtcaaattaatgaaacttgatattaagcggtatctctaaatatccccctctatcttatgtaattttaaaaaatctagcaaaagtttacaagttgtaaccaaaaaattttgaaaattttcgactcaatattaatgaattaccgtatatgctctaattatagcccggtctctattaatcccgcagtctccaattatcccccagtctacgaggtgttttgaaagataatccctctatcataatcccccagtctctaattatccccccttttctgaggaggttgaaaataatcccccatgggctataattagagcatatacggtaaatgggccatatttttatcataaaaaatgtaaggttatttaaatgcatgaaacttttaaaaagtttcttttgggaaccctgctattcagggcaaagcacaatatgcttaatattcattcattttctcaatttttgcctttctcttctattgattttcttcgcattatttttaaaggagacatttgaaaatcgattaaataatttattttaataaggcaaaagcaaaacgtaaatattttatttatataaatttgtattttatttagaatttatttattaaatatttttacatatttcgatgaatttacaaaaatattttcttgttattttgtttggtttattttctgtaaatgtgacatcgagaaaaaagtttgtgaaaaatcatcaaaaaatgaaaataattaaattaaacattttaattaattataaattttaccatataatattttaagtttcattaaaaaaaatattcagagatttgaaaccatacaaaaaaggaccagctaaactcataggaaaagaaattaaaatttatagaaggtaaaataaattttattaacaaagcaaagttactgagaagaaataaattaataataaataaaaaaattttatggaatttaaattcgattattttatatttttattttatgtatttattttgtttttttcaaaaagaaaaaaagctgaagggactcaattagaagatgccaaaaatgttaattttgctggtgaagactataaaatgatgatgaaaagggaaaaagtgaagcttaataaaagttatgtattttgtaaaataaatttattaatttttaaaaatattttaaacttccaaaaccaacttcgataccaaaacacccaaagcgcacaaaatttcacgacacggatgacgaagaagcattgggggtggacccaagaaaaggatcatatttatatggtaaaaattcaattaatatttaaatatttaagaaattggtttagaccaatgtttagacaattgaaaattgggttgtaaaaatttaaatttaaaatatttttaagctaaccgtggcaaattacgaaaacgcaaacgcccattagaaggagaagcattcacagagagagaacagagaaagtgggaccaattccatgagagattgtcattggacaggaaaatagcacgggaagagagaaaaagacggcgaaatgaacggcgacaggggggaataaaagaaatgagcgaaggtgaaatagaatggggcagagaagacatagactgggaagggatggatagagagagcataaacatggaaatggcaaaagatgaaaacagacggagaaatagcgagaaggagcgaaactatcacaatggcagagaaaaagagaggtggaatgagaaaaggaaaagccacagccgagaaaagcagagcaatgatgagaagaaaagacgaagaggcagaaaaagacattgaaaatagaatgggaagtagagaagcaagagaaaacgaaatttaaaatgaatgtgaaaa

SEQ ID NO: 23597 - DNA, 1237 bp, Heterodera glycines
attctgtgctattttgtgaattatgttttattttttttaaattatttttttggttaatttattaattgatattttattctttttactgatttattctcatggttcgttgagatcgttagtttgaacagtgctgcattcattaaatcattaggtaatttatttttttattatttcttatattctgagagcacatattttatatttaaaatagtttttttaaggaatttttaattagtattttttcttaagtttaaatttctttgtagatttaatttaaattgatatacattatgttgaaatttaaatttttaccaacttggaagctagattataatattttggattttaattaaatattcttattcactattcataatctaaacgataaattatattatttttttattaccctaatgccaatttgataatctatttgttccttaaaaaaattattatgaaaaattcaattaaaaggttggtattttaattttagggttttaataaataaaatttctctggaacatatgcaataaagtaaaaatcactaatatatttaagcatttttttatttatttaatatttacaaagattaattcgtttattttagttttaatctagatttagattttctttgctgatttctagcttaaccacaatagaaaaaaaaaatttttttattgtgtctacgaattgtaattttcgagccaggaattaaacaattggataaactttacgtaaattttctataatttctaaaaaaattcagcggaattcgtaatattattattaaaaaatttttataagcaagcaaacaccatttccttaactattaaatattaaaagaaaagaactagttagaaaacctatttaaaataaaattatattactatatctaaactagagattttgttttttattttataaaatcaaaaagttaaagctaaattaaaataatgaaaattttcaaatcaaattttctttaattatttcaaaaattaatcattttggactaaatttttttgtgttcgttatacttttgccgttagaatttgtttttaatttattttgttaatattttttaattgagatttaaatttttgcattgatttattctcatggtaattatgcgcaaaatgtataagtaaagttgggttgaataacgtttaaacaattttttttatcacttgcatatataatataagtttggtattttcaatgattattatgttcataattt

SEQ ID NO: 23598 - DNA, 2251 bp, Heterodera glycines
  misc_feature (2187)..(2187): n is a, c, g, or t
  misc_feature (2191)..(2191): n is a, c, g, or t
atttggcaaacgacgaagtctccgcgtggccaagaaaaagaataagcgaagtttgaggaaaatgtgagccgcattttccaattctatggcaaatgataagagctttttgcatttcagttggatttgcaacgatctttggatggacattttccctcattttgaccgtcctcaactcggcctcaaaatggcatttctttcgccacgtttcaacgcgttggtcgacaaacatttcgatggccaaagtgatttgacaatttggaatgaaatagcaattaaaaagatcggaacacaagcaaaattgtctgtagaggagagcaatgccgaatttccactgcccgaccatccgatgcacaacaaaattcgctttgctaaactttggattgagtacctaattcaaaatcaaacattatttgacaataaaagcattcaattttcagttacattgaccattccgtcgtcacatttcttcgttccaaccaacaaatttttgacaaaggcaccaacttggatttggatttggatgttgaggccaaagatgtccaaccaatttgggatgttttttctcgtgaaatttggcccatttttgcgacaaacatccgccatatgtcattttccgatactgatcatctggacaattttcgtcgccgcacttcgccaacaattcttaccgaactcaaccaattgatttcaatctattccgatgctttgttgcccgatgcaattgctgatgatggaccaaatgcaactgctggccaagcgctgtccaaatggttgcacactccgacaaaagatggacagccaaagcaattgatttgctgtgataatttagaaccgccaaatatcaaatggattaccaatttcaaagatgtattgtggcaattttccaataaaattattgcaattaattgccattgtcctttcatttcccattttataggcatttctccgtgccaaaacttcttctgccagctacatcattcggtttgaggattttgaaccaacagaaaatgggtcatttgaattggtgaatgaacggaccaacgaaatgctgactttggagaaagaaaaaaacgatgatgaaaacatggagaaagacgacgaagatgaagaatatgctactgaggattggctgttgaagcgatgccaaattgggaagacaattcaatgggaggacgaaaattttgaaaatttgaacagtgtcagctttacgctttgtggaacttcctgcgttgggtgagtggcaacagcttttgtttttcttgatgccgtcacatttaaattgcccttaatttaggccattgtctgcaccaaaagcgagccaaatggacgcaaaaagtcagctgaaaatgaatcccgggcccagtggacagcggaagaaaaagtgagagaattatttggaaatgacaatgattgatcattaggaatggaaattctcggataattgcccattatatttgttgatttcttcgtttgtatacatttaatttgtttgattttttgattcactaaattagggttcgaaccccgtgggcggggatgggttttcgcgggggtttgctttgaattagcagcaaaaaatctcacaaaaaattaatttttatgaatgatgtgtttggctccaccttcctttagtcgatgtatcgcctcaattcaattcattttggcataaaaaatgaccaaatttagttgttttaactaatttctaaagaaaaaatagggttttttgggggccggcggtgccgataggcgccgacggtggaaaattttaagaatatattaattttgctaaaaattagccaaattttcagaaatttccctattttagatgaaaataaagcactaccccaaataagaacatttcttagaaattagaaggtatagaaaccctgtattaatcagaaaaaaataaattcaaaagaaaacgtcaacaggtgtcgaactcataacaaataattattttagtgttgaagtactaaccactaaaccacaaatatattggaaattgacagcaaaatttactttatttcataaaaatctgtcaaagatggttaaaaaattcaaaattgtataaattttttgccttttatccatgaatatgtcattcatagggctgtatttttcacccccgcgcccccgcgggagtgaaggtcgcgggggcggggattgggggggtcagagtcacggggncggngacggggggtgagcccaaaaaacctgtcccgtcccccgggatcggggcagggctcgaacc

SEQ ID NO: 23599 - DNA, 1190 bp, Heterodera glycines
  misc_feature (70)..(70): n is a, c, g, or t
catctttgagtcaaaaaatattaaaaaacttttaatcaaacaaaatcgtaaattataaataagggcaatntcagaataaatgtaaaaaaattgctacaaatttctggaaaaaaaatttttctcattcagtacaaaagtctatgattcttaagttatagctaataaaaacatataattatttgttaacataaacaaatagcgatttcaaaaaattaataattattctgttctgagatttatttgtttgtttttcatgaaaaattttcaaatttatgtaaagcaacaaatttatttcgatatggcgccaaaaacgaataaaacgataatttaaaattgtataagtttaaaagcaaattattttaccgatgaatttaatttattcgcatttaatcaaaaaataaaattttaatattcccataaacataaaacagaacaaaaattcataccaaaagcatatgtactgctaacaaaaaaccagctcggcaccccttttaaggccatagccatcgcaaaagtgttttcttctggccaatgccttcccccgccgaatttatcgtttccatcgcttccgctgccttttccctcatcatttcgtcaaatttcttttgaatttccttttgtttgaccttttccgcctttttttgtccaattgtttttccattttttaatttgtcccatttcttcggcttctttgatttgttggacaattcgtccaatttgttttggtctttttccacgacgttcgttttgccaaaacataatgttccaatgtcacacagattgtccaatacttcgattagagttgtgccattttgcgtgccgagttgaaatttcggcatttccgcgggccttttttgggtcactgttgggtcaacagctgtaaaaggaattttgggtttatctttttaaaattaaaatagctttctgaccttcgacataaatcctaaacaaaaactcataaaaaatcggcacattttttctgaatgtttcgcattcgttcttccgttggctctgcccattttgatgacttttcccttttctccctttttctttcatcaaatacacaatgccaagataggctgaatattgttggctcaaatatttaaccgtttcctcaaaatcgtaaatgccctttccctttcgttttgccaataatccgaccttatttaacaaatctttggcttcccaat

SEQ ID NO: 23600 - DNA, 1831 bp, Heterodera glycines
agtgaaataatgaatgaatgggattggagtgtagaaaaattgaatggaatgaatcacatttttgttcctcatctgccggtgactgacatttgtacacatgcatacgcgaaattcaatagatttgctcgatttaaagcgatcaaaagatcgaaaaatatccaaatctttttagaattttcattttttcatacaattttctctaagtctaatcctattcaattgagtgagcttaatactacttttttataagttttttctcacttttttagtttttttctttcgtaaatccgttaatcataaaattaattatcatttgactttttcatactcctttttgtcatattcttgaaccgcatgtcactcactataaacaaaaaagtcattaaatttgtttcgtaattgcctttttgccaattaggcaaacagttttctcttcatttgtacgcacgcaattctctccctctctttcctaatccaaatgagtgagcatgaaattttgtcaaaatgggatttccaagtcccaaattgggcacagagtaaaggttagtcaacacgaaaactcttcatccattaaagaattttatttttcattctctcatctttaaacggactcattaattggatttattttaatttatttccatcaatgacttttcatatttttgcctttctccttaatttccatttttttaacttatttattttcaccgtcgcccatgctttttacaatatataattgtcatgtatttgcgctaattgcttcaaattgtcctccacgttacagcgtaaaagtgtctataccacaccctaattgccttaatgtctataccacaccctaattgccttaatcaccactaaccttttgtatacatatcatattaactaacacacaccgatcgtcacacgcattacctaccgtacatcgccgcctctacagtttgacacacacattcattgttttgcatcatattattgtgtactgtagtcgccgctcacacgctttgcgcgaaatgtgctgtggtgtgccgttgtgatgtatcgaaaccctttacaaaacagcagcagctccagcggtggcaacaacagaaaacagaacagcagcagcactgagcacggcgattggtccaggaatttgtatgtgttcgtgtccaatcattgcccaatcatcgacccctaattaatgttcactcatgccgtgggaaaatgaatttattattttttctattagcatttttgctttttgccgtatttgtccataccacgagacaaacagtgagactttttttgtcgttttgttttttgccatttgccatattcgtctgtgccatggggcgcaatcaatgggactatttggcattttgtttttgttttttttgccatatattttgccctcccctccctctgacattaaattttgttttcttctgagttgttatggggcttataatcgctgcgtaacttttcattagttcttttaaattaaacaaaaatatttttacacaaaagcaaatgccattaaaaaataaatttaaaattactataatgtccataatatgttttttttctcttattcaggaacaagatgatcaatgttcaccacttgccgttcttcggccaaaaccaggccttcatgggtgggtttaaaactatatttattttaattaattttattatttaaatgactgacttttttttaacggaaaattgacttttttgtgcaatgatcggtggtgccaataaaatcattttgccatttgattcctctcccatcaaaaattggacattataaaaaggaaaaagagtaaagtgataaactgcaaagctcttattt

SEQ ID NO: 23601 - DNA, 1564 bp, Heterodera glycines
acataaagcattattaaattcaaaaagttcggtataatttcacctcaataaaaatttagacaagaaataaaatcatttaatttacctaaaaaatatttattaattagaccattttcacgctcattttttgctctgtttaaattatacgcaaattcaaaaatttaatataatagtgcagatgggattccgaatcctggactcgaatttgaggattaatttatttctgcttggcgacttcgaatacacataaaaacacttttttagaaaaaagtgtgataccaccatcattaacaaaaacagtttccataatcacaataaacttgcctgtatctgcctgaatatccgggaatatgattggagtactgttttttgttcagaataatgcctcggtttgtcctccactgcacatggaacttaaaattttcgccgtggtgggcaattgagcagcgcagtaacagatcagagcctgggacaaatgggcatgaaaaatataagattttgtccataaaaatggagttaatgggattcctaatatatagttaaataaaaaacgtaccaataatgacggattggttcgtcgggtgctccttgaaaggcaaattttcgacaacgacggcacttgtccaaaatgataagaggagaaaaaacagagaaaaatggagaaaaaaaccaacatgcctggtaaaattttgtgaaaatggcttcaaacgaattgccatttgaccttaaagaaagtgatgaggaagtgtgccacaaattaatgtgaattgcccgatcaccctgagagtgatctgatcaagtcggtgtaaaagaattttttgataaacattaaaagttagataagcatgaattaatcagatttccgttgttttggtatcctatccaggcctgattcctaacctaactttttcaacaatccggtctctattacatcactaaaaagagaagaatcctgtgcagcacaagaatccttcgtagcatttgtgtgcctggattacaccagtcagaattttgccatcaattagttaagctacctaactacaaatgtcagaaaatttgtgaattcaaatgacatttcaaaaaattttaaacaaatgcaaaaaatattatttaaaaatgtcctgtgaatcaaacatttttcggacctcttttcacattaattaatttttctagtggaaaatatttaaatgagtggaattatttacacaaaaatgtaccaatttaagacattttaggggctaatttttcaaaagttttttaaaaaaaactggattcggtaatccgctagtgcctacatattgggattgatgatgttttatttagaaattcaaaattaaaacactaaaaatttggcgaaatgctttctgccaaaaatcttagaatgccaaaattcattttttgatttacgagatgaggtcagcccagcacggcagatttggaaaatccgatctctaagaaaaactccaaaaatatgcaaacatataagtgccaacttttgttggcaatcacaaaaaaatttcctcaaattttttgagatatttatttgaattaaaattttactatt

SEQ ID NO: 23602 - DNA, 236 bp, Heterodera glycines
tgcggacatctacatttttgaattgaaaaaaaattggtaattactctttctttttctccatattgaccatcatactcatactccccccaccctttccccccccccattccctcctccctctcctgctacaaccctctgatcgctctaaagaaaaatcagattgacagcgagatacgatcagcagatcccgatcgagcgagcgcccgcagatccagccccaatgtacgaccgagaag

SEQ ID NO: 23603 - DNA, 239 bp, Heterodera glycines
aaaacattggcaatttctaattgaaaataaacatgtaattcatcattctcattctccatacgcccatcatcctccattcactcttcttccttttctttttccgcccctctcctccctctcttgatagtttaaactgaaggcgggaaacgacaatctgatccccatcaagctagcttctgcaggtcctgctcgagcggccgcccggggatcgatccccgatctagtaacatagatgacac

SEQ ID NO: 23604 - DNA, 1788 bp, Heterodera glycines
cggaaattttttttgaatttttttgcatttgttgccaaaatttatgaatgattcttattggttttaaggaagtcttcatagtccgaaatgccaaaatcaacaaagcaaaccatataagaaaattcaattttaaacttcggttcaccacgtatatgattaataaaaatatatttcaattatgtagcgaaatttaaaattgttaaaataaaaaattattaattaatccatcacttattcaatttccaattgtctatttttctgttcgtcgtcccttcagaaattaaatattaaatcaaaacttccgtgcttctctcgtaaaatgttaacctcaaaaatgtaaaaatatgtatataaattcatttaacaactcgtaaattatttttcgatttttcttatttatttatttttaaataaaaatgatcttttctcaaatggttaataatacataaatggcattttacatgtgttcatcattcattctttcattcaagacattccaagcccgtgattccctccaaccattccttgtcaattgggacgtaaaaatttattaagcctgtgaaaagcaaagaacaattaattttagcagctttcattatttaaataggtaaatattttaaaaatgaaatgtttttattttgaatttttgccaagttttacttttgttctttttatcgcataagccgaccgaaaggatgccaacttggacaaagtgagtgccattgttggccaaaagtgcgccgccgctgtccccctcaaacagaaaagtgacaagagaaaaatgttgggatgggcaaacatttttaattaaaatgtaaatattaatttgatttctgtttaaaaagatttttttttaatttaaaattcattttcattttttaaatatttaagggtttttcattaattccccaatatttcggattatccccccaattgcctgcatgacagagttcgactcaacacaaatgttccctttgcggccgcgaaatgatctgcagccaaccattttcactgggcgaccatttaacattttggcaggcctcgttaagcccacacaatcatctaaactcattgacacaataaactttaattacagcagacgaaaattatccatatatttttaatttgattcaatccaaaaattgggccatattttggattaaatctgataataataaaatttttagaattttgcgccaggaccaatttttcgtgtacgaaggcgcccaattttctccgacgacgatctttttttgcggtgccttttttcaaaaaactttttgggaaaggggtggggcggtccggcggtgtcgataggcgccgccgggctaaggaaattgttcaaattttgaaattttccccattcgttacgaccccctcctttacagccgccccttacgacgaacgagggggggggggggggtgcgccggcgcaccccttgttcacctgtgcacgctttgacgccgcctgagtttcgcataccggcaattttttttggcttactcgtgcacaccttctccgaaccccaacctttttccatcccccaattttaaatattaatgaaaaaagcttcgcttgtctcctgcccccagcccatgacataagcagtgccattgcgaaacctatcaactttggcacagtgaatacaaattggctgaacccgcgccattgggcgagaaagctgaacttgattcaaataaaaaatatttgttgacaattttaaaattgtccgccaacactttgccttaataagtgccatgtcgtggaactgtgattccgattggtcc

SEQ ID NO: 23605 - DNA, 1971 bp, Heterodera glycines
aaaacatagttttcgagctctatcgactggtattttttcggaaaaatttcgattttttccggaaaatagaaaaaatttttggcctgagcgggacatttgagtcccgggcccataactcgtcaggggttggttttatcaaaaaaacgccttagggcaaaattgtagagctttttaagctctatcgaatggtgtgccatatggccggaaattttcaaaatttttcgagctaggccccctagaaattttcggaaattttttttcggacgaaaatgggggtgaaaaatatttttctggggtaaaataaggtgctgagtacgaatatgatgtctattttaagtttcataatttttggaattttttaaaaattctttattttttggcaattttttggccctcgggattttggcctaatatttgaaaattcataacaaatcgaagggtggatcaattttcgtgcaattatattataaaaatagagaaaaatcaggagaattttatgggatttatttgggatttctatcttaaaaagaaaacaagttattccagaatttctgaaaattttcgatttttcagaaaaaaattcataacccccttctgaaaagaaatttttgaaaattaaaatactacaaaaatccgcaatttttttctttataatataaattttattttacatttttatcactttcttacgaattgttacaaaaataaaaccgattttgggattatggaccaaaggggtgagcataggatttttgagttgaaaaattttttcaccaaaaatcttcaaaaaatatgtctttaggggttatttcggccgctgatcatgaatacgtaatcagtttttacttttgacatcgttaagacctaagaatccctgtatcattttgaggggaggggggccaagttcgaatccggacggtgtaacattatttttctatttatttttgagttatttttcaatgcttttaattaatttgaagattggttgtaaattttaaattttttttaataaataatttcattattattttttatctgtaaaaaataatatcatttcaaatttcttaaatattcaatgcattcgatttttattctttaataaaaaacttttccttatttatataattttaaaccatgttgaacctcttcttatctctgttgtacctcttctaatcactgttgtacctcttctaatcactgttacacctcttctaatcacagttgtagctcttctaatcaatcacagttgtacctcttctaatcactttttcacctgttctaatcacttttgtacctcttctaatcaccattgtacctctcctaatcacagtttgtacctcttctaatctctgttgtacctcttctaatctctgttgtacctcttctaatcactgttgcacctcttctaatcacttttgcacctgttctaatcacttttgtacctcttctaatcaccattgtacctctcctaatcacagtttgtacctcttttatcacttttgcacctcttctaatcacagttgtagctcttctatcactgttgtacctcttctaatcacagttgtacctcttctaatctctgtaaggccaacaaaatttgaaaaacgggcgcgaagcgcccgtcttgtgcctcgatgtggactaaaaacccataataattttttaaaaattcaaaaaaatctctccaaccaattcgatcaatttgaatcgctttacagcctaggtagcgaagctcaagaagcgcgaagcgctttatcccaagcccagatccgacggttcacgcacccgctagttatatatatgttatataggttttgagtttcgtttcaaaaactaatttgagcttaacggctaatgggacgggtctgaaagtagtggaagggtcttacaactttttgaggagaattcggaaaaactataggtttttttctccgagggccaactgagtcccggcggctatttctcactttt

SEQ ID NO: 23606 - DNA, 1563 bp, Heterodera glycines
  misc_feature (45)..(45): n is a, c, g, or t
cggttgagtttcgagcacgtgctgaaacaccattggatcatcgcncattgcaataagaacaacgacggccgactcgtccaccgcgtccagcgaatgttggtgattggagaagcgaacaaatgggggacagcactcactgcctttgattttatttccttatttctatccgatctcttttgtgaataaatggctgtaagcacatccaattcaatgctttgttttgcttcggttgcaatggcttttccgtccttttcttcgttcgtttttttactgattgaatttcgtttccttttgaatattccaatgaccaaaactctgtccgtcctcccctttctctccccaatcgttcgcccgttcagcgcaaaagcaggtggtccccacattatgaagcgagccaagggtttggacataatcccggacgactttgtgaacattgatgggctgcccgtggacatgcgctacgtgcacccgcccggacgccctcacggtgctcagatgcgcatttggagtccgcatcaatcgccaggtaaatcgagggactattcgaaaaaaagaatttgtttagtgtacgatggggtggcgcgtaagctcggctacaaaacgaggaagggctttcagcacccatagacaattggtcagtttgccacccgcacagaaatgcatagattgattaatgttcactggattgttctatttaattcctgtttggatattcgagtgattccatctccttcgaatgcaaattaaatttctctgtgttacaatgtgtataaatagcattctgatgagattcaatagattaggaatacattaaaaactgaaaaagcaaggactggccaagtgaaaatgacaaaaatacaaaggaattgtgctgaatgctttaaagctccgtgtgttctcttcaaaaacagtattaattgaaaaaatacaaacgaagatagacagggttatcccaatttacaaacatagtggtaagttttagtctttccatatggcagtttctgtttaaggcaaggtgccgtcccctgtaagttgactcgggcagagtttggttgacgaatgaggtttattacacaaatcgcagtggcatttattctgtttctattgttacatggccgtgcgtgggcttttcgagtgcaattggggaagaagacggttgaagcgatttttggggaagcaagtgaccaacaaccttaacagggagagcggaaggggacgagttatgaacagcagagagtgtgaccaattcaatgccccccggcctaatcaatgggcataccgtatatgctctaattatagcccagtctctatttatctcccacggggtaaatagaatttttaaatttttcgaggaaaaatttataaaacaaaatagcggatttttctactattttaatttgtgtaaaatctctttcagaactgatttctcatttttttcacaaaatcgaaaattccagttttaaaatttttaaaaatgccaaatgtatgaaagaaaaataaggttcaaattcggaactcgtcagttgggccctcgcgtatggccccagcatgtttttgcctata

SEQ ID NO: 23607 - DNA, 1422 bp, Heterodera glycines
ctgttcctcttcactttctcttcactttctgctcctcttccactttctgtttctcttccactttctcttccgctttctgttcctcttccactttctgctcctcttccactttctgttcctcttccactttctcttccacgttctgtttctcttccactttctgttcctcttccacttcctctttctgttcctcttcctgttcccctttctgttcctcttccactttctgttcctcttccactttctcatccactttatgttcgtcttcctcttccactttctgttcctctttcatattttttagttttaaatttttttgttttatttaatttttatcgatttttaattttccgtaagccatgaatcaaaatttattctgttaaattggatcagaaacattttttttgtcaatttttatactgttaattcttggtcatccaaatccaacaatgttacattgttggtattagttgaaatcttaacatgtttaaaagctttgtctaagctatagctttatgattagacaattgctaaagaagttatacatgaaaattgcgaattttaaattaattttcaatttgttacaagttttgtccaaaaaaggatcaaatttttacttttgagttcattcggtatgcataaaaaacatagtatttcactctttatgtaaattttttatttttatttcctaaacgtaattatcaaaaaaaaaataattaaaaagtttgataatcagaattaatgggaatcgaaccctatacactacaccaacaaagaaaggcatactaaccacttgttcaccggattgcttgtcttgtacttgtaaatacttatttatcttaaatattatttagatttatttattatattatttttttattattatttacctattttatttgattttaaattcagttttaaatttgtttttaagtttcttttttttttgcgtttcgggcccaataattttttgttcagtgatatttttctaaatttttggcgtcgtgggaaaacgggaaagtcgttaagtataaattaaaaaaaatacccttttttctgcaaaaaaaaaataataataatttttcatttcacgaggcaattgccccccatggcctgcgcccctggttacggccttgggtgggatataatggaagtaaaatccttaatgtgggaaataaatgccgcattagggaggaattagtaaattttaaaattgctaaattaaatttcttgcaatcaaatgacaaaatgtcaataaataatagaaaattcaaaacaatatggtgaaaaaatttaaagttttttttttctgacgaaaaaaattaataaaaataaagataattcctaatattacatgtaaaccgtgaaaacctgttattaaaaaaaataatctgccaaaaaccctgtcacttatagcaaaga

SEQ ID NO: 23608 - DNA, 1687 bp, Heterodera glycines
aaaattttgaatcttaatcacggttagggggactgaactcggtgcggatttcaaggatttattatcgctgtaatggttattaatttgagtacagcatcaaacacggatttcacctcccactattttttactgtatttataaattttaaattttggagaatattctgaaatttggcccatcacctaaaaatattactgtaatacaagccttgcaaaattcacgctttccgcaccattctctctcccctgtcggcattcgcagctcacctccctttaatttcttttttccgttttgtgtcctaaattgtctccaattttgtacttccaatttcttctctttgggcatcgcgtcttggagaaatgaatgcgcttatttccaaggtgtacttgggaaacggcgttttatccatgaatataaaagaatgttactatttattccctatataagaataatataccccagtttcaagcttaaaaactaatttaagactttctaccgaatgttacgggtcgggagtggtatcattcgatagggttttggactggctataaggaaaaactatcggcatcccaatcggttaagaattgttcgaactgcgttcggaaaacgagtcaaaatttgcaatttttttgggtgtcccatttttgaacgctttttgcataccttaaaaagggtcaaatcaaaactttaatatgtttgtgcacatctacaaactcttggctttcgaatgataccagggttgttttagtccgtgtccgggaagtgctctaaaaagggaggacaagcacttttggtcgggctttcttccaaaaaagaaggaaaaagaaaagggaattaaacgtggaagaggcaagcgactcggtggtcaagtggttagtgtgcctgcctttggtcatgggttgttgtgggttcgagtcccattaatttattggattttcccgtcaaatattatatttaaattatttgtttttaaatttgtttttaatatttttcctataaaaaattttatgggtttaaaaagagaaagacataataacaaaaatttggagcaaagtacttttggataaaaattgattactttcctttctttcctttttttatatgtaatgcacactcacaagtggtctttgacctcgccttttcaataagcaaaaaatgtctcctccttttctttccccagttcattatcaattgtttccatttacatcatcagttttctactgctcctacttttattcaataaatatttccaactaaattattgctgttttaatagcataaatttttagtttttgcctttggtggtggtgggcgacggctcgggtcccacctattctgggtgttttcatccattattttattacattttttgaatgattttatttttttaaaattaattaagtttattaaaataatttattttaaatattaaaaataataattctttcttcctaatttagcccaaaaatctattgtttgaccttttttgtgcaaaatcatttaaaaaatggagacaaattaataagttacctaaacataaaattataaatattttatgccaaaaaagaaggaaagtgaaaaggaaattaaaaggaggcaagcgatccggtggtcaagtagttagtgtgccttactttggtgctggcttcgccatgggttagagtcccatttcttctgattatttaaa

SEQ ID NO: 23609 - DNA, 875 bp, Heterodera glycines
ttttgttcgaattcgagtcaggagttcgaaattggcccaaatgaatgccatattcgtgatcagcgaccccgaaaactcttagatagactttttttcaaagcttcttaaaataaaaaactctgcaaaagaagtcaaaaatttttcaaaatggtacactttgcaggatccattgagtttcgggtttttccgctaaaacaatcttggtagcattcgaaagcttatcatgtttagaagctttttctaagctattgcttcgcgattagacagttagcaaaaaatttataaatgaaattgcgaaaaagtcgaaattttaagttttttcttaataaaattttttccagacttgaaaatctttttgctttttgaaggctaatagagcatattaagtgctttagaatgataccaagattgttggatttgggtgccaatgaaaaaagctatagtggaaaaacatgctgacgccgaaacacgagtgccgaaacgcgtgggtccccactttgcaagtagtgccaaaagcaatcagacgtttaatgaaaatgtgctcacgccaccttcttgaaattgttgacccatccagtatttgctggatacaaccaatcacagaaaaacaatcgcttcggttgtccatctttgctcggcgtgtgcaaccaattggacaacacttggccagcagttgcatttggcccatcatcagcaatttcatcggggatcagaacattggaatcgattgaattcaattggttgaggattgtcggcgaaatgtgacgccgcaatttgtccaaatgatcaccatctcgaaagatcaagcggcgaatgtttgtcgcaaaaattggccaaatttcacgagcaacaacatcccaaatcggctggacatt

SEQ ID NO: 23610 - DNA, 1924 bp, Heterodera glycines
  misc_feature (1913)..(1913): n is a, c, g, or t
gacgagcgtcggctgcattcggaagacgtccgtggcccgctttgcagagctggcggatttcatcgtcactgatctgtttgggaaaaaggggggaaaattatttttgaaaaactcaaaaatttttctacctcatccgtgaagcgatgaggaggcgagcggttgaccttcgtgatgatcgcgtccaggaagccgcttgacaggccgtctccttgcacaaggtccgatgccgctcccgattgacgccgagactgctccgccgctgctgctgccgttgcgtcgaaacagtaatcctccattgaagttgttgcgccggccacgtccgcttcgtgtgtgatgaagtgttgtagacgatggacgataataataataatataatacaatatgagggcgatgaagtgaattatgtgaggaaaagtgaggaaatgtcgcccttttatacaactttttttccgttaatttcgaaatttttttgcttgtctatataaagggagggattgcaaaatttgctctcattcattgcgcccgtcaaattttaattcttctattatgcggaagatcgtctacttcaaactgttgcaaattgtgctcagtttggccttcgtgtggcaacttctttcccttcaccaattctgcggcacttttgtctctccaaaggtgttgcttttgctgttgacaatttatttgaatttaatttattgttccatgcttttcaggccttcctccatgacatctcaggtggccattgcaaacgcttcacgttcatcggaaaggactcaaagacgggcgaattcggcgcagtgttcgacgagcgcaagtggcacaaccaactgttcatgagcagcaccaatggccaaccaatcgaggaacagcaactgaaattcatggacgaattggccgagaaattgccccccgctggacgccactgtattccgataaccgtaagcaaaagctaatcacaacaaatacatgcaaaaataatcccattttgttctttcagctctcgccttttttctggactgagaaagacagaaatgtgctcgactacgttatggaccttttttccggccaactgctcatcgcaatgtgctcgcttctcacccttggcgtcggcttgttcagaatggcacgctctgcggcagaatatgaagtgagttcgacggatgggtggacacagcacatcagcccgacaaaaacgcgaccaaattgcttttcagttgaaatccgagcgattttttggtcaaattgtgatcatttttgcttttgcgcgatcaaattgcttttcagttgaaatttgtgatcagtttagcttttgcgcgaccaaattgcttttcagttgtaattcgatggattttttgatcaaattgtgatcatttttgttttgcgcgatcaaattgcttttcagttgaaatttgtgatcagttttgcttttgcgcgaccaaattacttttcagttgtaattcgatggattttttggtcaaattgtgatcatttttgcttttgcgcgatcaaattgcttttcagttgaaatttgtgatcagtttagcttttgcgcgaccaaattacttttcagttgtaattcgatggattttttgatcaaattgtgatcatttttgttttgcgcgatcaaattgcttttcagttgaaatttgtgatcagttttgcttttgcgcgaccaaattacttttcagttgtaattcgatggattttttgatcaaattgtgatcatttttgttttgcgcgatcaaattgcttttcagttgaaatttgtgatcagtttagcttttgcgcgaccaaattacttttcagttgtaattcgatggattttttgatcaaattgtgatcatttttgttttgcgcgatcaaattgcttttcagttgaaatttgtgatcagttttgcttttgcgcgaccaanattacttttca

SEQ ID NO: 23611 - DNA, 1648 bp, Heterodera glycines
aaaaaaagtttttgtcataaaattacagtatgatctctttcatattttttgttttaaacttagcttaattaacataattaaatttaaagtcaacaaatttcctacccttttttcgacaaatcgactctctctaattagggaaatttttaatataaaaaaatttctacattttaaaattaaggtcagaaaacaaaacagatgtggaatggtaattttttattttatgattttgaaccttttaaaaatttttcaataaatagcagatatgaaagcgaagaagttgggcaatgattcaaaaaacagaaaattaaaaatttattattataaacagaactgcaagttttttgttttgtaaattttcatcattaaggagaagaaaagtttggctaagaaaaattgttaatttaaacataacaacacgccaaaatagggaaaacggtttttctagtaccggccagatatggcattccgaggcccaaaaaactttcgaaaatcggaattccgaggcccaaaaattaatcgcaattcgactcccaaaacgccagaagtcggaaaattttaaaaaatataaaattaataaaaaaaaagttaagtattttaataggctaaaaaaatattttactattaagtgaaataaagcgtcatgaaaaataattgataaaagaagaaaattaattttaatataattatttcatacaatcttataatattgtttcctagtacaggggatgctttccgaaataaaacttgtttgtaagtcaagaagatttaaaagaaaattaatttcttatatttattaagtctaattaaaaataattgaattaataaattaataaaacaaaaatatcaattctataaatagtcaaaactaatttaagcacattggaaaaagtaaaaaatttgtgcaaattatttttagttgcatgattgacaattactaaataaatacaattaggcttatatacacatattattaaacaataattgaaataaggcatagaattaaatattgaccatacattgtgaacatacataaataactataataaaaataattttaaattaaattagtgaagaaagaaaaacttttttttcgattagagttgtatcttgaaacaaaaaagagaaaaataaatatgtgcacctaaattctaaaattaattctcagaattcgacttagaaaattatttggtaagagaaaaaattataagcataattagacaattaaaatatatgattacatcattcttaaagaattactattaaacaaaacaaatttagcagttattgttagtcaaactattaataacaaccatttgaatacacgagattttatatttataatattcaatttatattgattattcagttattttttaaattatataaggattgaaatatactaattaaaatcaaaaatttataaatttaaggcttaaattacatatataaaaattgtataataatgcaagtcttgaagatatcactctaaaatccattaatgttaaaagttgcctaattgcaagaagaaaagtagaaaaattttgtgtcaagaaaaaaaattaaaaattatttttgtcttcataaaataataaatgttatagtaaaataattcagcaagattgagaaattggcagtaaaaattggt

SEQ ID NO: 23612 - DNA, 1049 bp, Heterodera glycines
tatgaggacggatgtcatccccactagacactcttatgaggatgggtaccatcaccatagacactcttatggggacggatcccatccctatagacactcttatggggatggctaccatccccatagacactcttatgggacggatgccatccacctagacacccttattggaacaccatcaccctaaacaattcaaatttaaacccttagaactacaagaatcagtgtcgacaacgtttgaataaggaacgccgacagcaaaaaaatgtgcggcaacaaaatcgtggaaaaagactgcagcaagaatctcatgagagccagattttgactcgaggacgtcagtggcagcgcggtggaagactgcagcctctgggtggtattgatggaaatcagaattcttcgtgctcagccaaatacgtttttaatttgaatttgtcttgatttgaagattttcttttaaaaatgaatttgaatatgattttgctgcatctgtttaaatttccgttgattttttgtctgatttgaattattattatttcgtataaaaaaacaatcaccttacataattattatacatattgatttcaagtttcttattactgtatagttattttaagcaaaacatggaaaacttatccgatgagcaaatcgttcgtgccacattgagcagaactgttgcaatggtcgtgttgaaggaaaggaatgagactgcagccgggttaaaaaaggtatactgtttgactgatggaatgcatcaaaataacactgtttaagtggatggtaccataataatgcagtttaggcggtatccatacacataatactgttaatatggatggtatccatccacataataatatttaggtggatgaaaacaatccacataatactgtttaggtggatggtacccataaccaatcccatccccatagacactcttatggggatggctaccacccccatagacactcttatggggacggatcccatccccatagacactcttatggggacggatcccatccccatagacactcttatggggacgg

SEQ ID NO: 23613 - DNA, 917 bp, Heterodera glycines
catttggacaatttgcgtcgtcgcacttcgccgacaattctctccgatctcaacattagctccgtggattcgggtcgactatttcccgccgccgatattgatgagaatcggccgaatacaactgcaactgttgctggccaagcattggccaaatggttgcacactccgacaaccgatggccaaccaaagcaagtttaggcatttcgcaatgccaccacttccgtccgctacataattcatttaattgtttatagtggctcaatttcaatggtgccatttgatttggtgaatgaacggaccaacgaaatgctgacattcgactactataaagggcagtccgaaagctttctaataaagcggtgccaaattggggagacggttcagtgggaggagcaaaatatggcggacaatttgaacaatgtcaacttccttttatggtgacaaaaaatgcattgggtgagcaataaaaggaaaaatattttttaaataataataataaattttgtaagtttttcataaaactatcgatggtcggtttaatttttgaaaaaaaaaattaaatacaaattttcaagataaagtacattttggcacattcagggttggacaaaaattgggggacattcatttcgaccattcggaaaaacggattattctttcaaactcgggctctgtattcggacaaaaatttcgatgtctttcatttgtttttcgattttgttccaaattttagcattttagggttagacaatctttcgaaaaactaatattttcattttggcaaatttaaactataacccgaatctgaaaaaaacttggtttttttgtccaaaatggtgacctccattcattgaattcaaattgcacttaatttaggccgttgtcaccaccagcggcgggtcaaagcggcggaaaag

SEQ ID NO: 23614 - DNA, 1497 bp, Heterodera glycines
aacttaagcaattgtacgagttgtctgacaccttagaatcgcttaattcccaccttccgctgctgctgctgcttcttctgttggcgttccgtcaccccgttcagtttgagtacgctcaattccaccggcggaagtgccgtcgtcgtcgtcgtctttccgccggtgccgttctgtaccggcgccattgtcatcatcaccggcgaaccgagtgccgacgcggacggaggcggcgacggcaccgctttgtcctggcgcctaatgcaacaccaacagagcaacgggtttctgtcgccgttcgagaggcgcgcgggcgaaacggcggccgcctcactttggcagccgctgcttcggcttttgcttctgaagctgacagacgagtggcgggaggggacaatgcgcaactgtttggtgccaggagtagtggtattatgctgatgatcagcgacgacggaatggcaatgattttgagggacaatcggcggcattttgacaaaatgctaaagtgggaaaatgccaccaaaaagcaaagttaaatggatggcgaatttggtatgaaaattgagaaaaagcgcggtgaaaacttgatcggcatctctggcaatcgagtcacccagtggtgaccagaccggatcgggatcccgcgagatttttcgggatcctaacatgggatccgtcccggtcgcttttccaaatcttcgggattgagggatcgggattcggtctggatcccgactcgggatccctccgacccaagttgtccggtctctagagtcacaacagaatcattgtggcggtggtcgattctcacgagagggacaagtcattcccgaaagatcgaagggactttcgagattgttagccctttgaccaaaactttgcaattgctaatagcagcagtaaaatgcgaataaaatccccttttttcgttttccgtccaaaagccccgcggggggcgaaataaaaaagaggggggggggaggcgacagatgcatttttaaacggtcagagaaaatatgttttgtcgcttcgacaacattcccatttgtacagtccacaaaaagggaggggtgagtcacccactgatgagaaaggggcaattgaaaggaattcgaattggcttacatttggcgaaatgtctgcgagggcaaaaagagagagagaaagagaggggggggggagagagtgtcctaattctttacaaaatgttaaatggaatatttttgattataaatttccgattaatggacaaaaatatatcaatttgattggaatgatcaaataaatcaaccatgtacatattttgtcgaatgatttaaaaattaattaaaaaaacgtcacattttttgtaaaaaaaagaatggtctccgttttgttccaacgcattccgtcacattttgcatttgctgcggttattggggcggggggggggaggggcgggggttgtccaatgaagcccaatgatgcggaaaaagcgaaaagttatggagagagggggag

SEQ ID NO: 23615 - DNA, 1913 bp, Heterodera glycines
  misc_feature (1852)..(1852): n is a, c, g, or t
gtccgtgggatttccaaatgaaacttggttggatggatagagcacatatgggttcttaagaaaaatggttttattttctgccaaatgagcacgagtgccgagttatgacgtgccaaagtttttagttttttaattaaagaaaataattaattatttacatatcgtcaatgtgttgtttggtgtagaggtaatgtgttagtcaaaatttttattggttacaagttcgaatcccctttctgtaaatccattttttaatttttatttttcctttttatgagcacttcaattagcaaattttatttctttatcaaaatctttattttaattttattccattaaaaattgcattaaacataaagatgtaataaaaaacctgtcgaattaaaaaatatatttttgtctaatatttttattgagtattttatgcactaaataatttcaaaaaaattaaaaataaagtttttttaataaaaaatattttgataatttatttggcataatagacaaaaattaaaaaaattaatttacatgtaggggatccgaaaccgctacaccactggacactgtgccgagacacaaataagtatttcttttatttcatcattaaaaagtttggcattttttatctcggcacaggggtccatttggcagaaattgaaagcatttttcttaagaacccaggggtgctctatctacccaaaaaatctcattccgagatcccacggacacttggccacctccctttgtgagtacaactgagtaccaaagtcccggttttgaccagttttgaccgggaccgggaaattcccggggttttcccggccaaaaagtcccggttccggttttgcccaaaattcccggtcccgacctaccctagtatttaagcattaatttattaaattttaacattttataatttaaaaattgataaaaaatcataggaaatttttttaagaattgaccaaccacggtttaagcatttacacttatttcattaaattccttctcagtttttattcatggaaagtccaactgcaaagcccaaaaagaggaggacggaggacgaagaaaatttggtaaaaaaattaaaaatttgtttttttcaataagggtgaggcttctaaaaaattcataacaatatttgaaaattgcaaaaaggtaaatatgaaacacaaaattcttaatagacataaaaaaggcatttaaacaattttccctttgctggaggtcgacttttccgcttctttaaattaaatttcaactcatatcacaactgcccattgacctcattttttcatcaccaatgttaattcttctatcactactacccatttgacctgtcgtatttccacctcaagtgtaagcggcagcaatgcccttcttttggttatttttatttttgaataaataaatttaaaaaatttgatttacttattttattcgtttattcataaaaaataaaaaagaaataaataataaataaattgaggtcaaagtcaaatgaggtcgaaataccaaatcacttagaaatttgttacattctagctttcccggtcttacatattaccctagtgaactttaagttttattttaaattgatttaaagaatttgtttttattagttctttatctagttgattccacaattttgttaccctcccagcaaagggaatgaattttttgcccagtttgtattttgtgttaaatctataaaaggggatgttaaagcgtgctgatggattaaaaatagaaaatagtttcagatctgttcggccataaacaattttatgcgccatgaacagatcaaacagctttcgccttttctcaagtgaaggcagttgcaggtattctnatcgattttggtatggcattaaggaaggctacatttaaaaaatactcttttggtgaaatat

SEQ ID NO: 23616 - DNA, 1473 bp, Heterodera glycines
attaatgtttatgcaaattccgctgctgctgcacggcgttttatcagcagaaccaatctctgtgctgcacaatttcacgtcttgagcacaaattgcttttatcccatccaaatccccaaatccaaatctccaaaatccaatcagccatttgagaaattttcacaaccataaataaattaatgaatggaatatgccctgaaggggcggcgggaggaggcattaattagtgaatgaattaattaatttaatgaatgaatggacgcggcggcgggcgcccggacactgatcggacccggtgatcattacaaatttatctgatcatacgtcgaagcattccggatcattttgggaaattattcatttctcttcccctcaccaattcacatattaataatctctctttgtgttgctcggctctgatctgatcaaacgggaatgcatttaattccggaaattctgtcagtgatcagcgttattgcctgaacccattttcggtagcgcaataaatcgcgcacagatctgttgatcagatatctgtgtgtatatcttgttcccggatttgtacagtcagcttgatctgctgctcagccaagcattacgatcagtgtatgattggattcatttaatttttgaggaccgatcaaatgatttagcctggacaaatattattccagagttgcgatcagttcatgattcaattttcgaggactgattatactgatcatttgatcaaatttaaacaaatatttttccgcatttttaaccagtcagcgacctgattcgctgatcagcagttattacttaacccattataggcaaattttggataattcttaattgcattacatgtaatatagcataaaatttgtcttcgtgaatgaatgaatgaacccacaaggactgatcggaaagcctgatcaatcgctaatccgaaaagaattctagctttttggtcaatatcagttcttaatgcaatcattttaaacttgcgttatggataatttagaatctcatttattacgtataataaatgaaatttaaataataaaattaacattgttttcaattcttttctaaacattttaattacaaaataaaataagttttcttaaaaatttagagcggaaaaggccagaaacagttccacatttttaaaataaatcttctaaatgcaaaaataatttttcatttaaatgctttttccattaattgttaatttaactaattattgttaattgtcttttctccaattaaaggttaacaaaattaagatacccaaacaaaatgttcaacggcaataataacccgataaaaatgagctcggctcaaaaaatgccttctgcctcagcagcaccacgccgacagcacccgcatttctgcctgtttggcactgtgcatttggcggtaaattcaaattttgaatttttgcaattattcggactcgctcagttgggccctgacacgtttgggccc

SEQ ID NO: 23617 - DNA, 1304 bp, Heterodera glycines
  misc_feature (1224)..(1224): n is a, c, g, or t
ttagtgctttaattatctttattttgaaccatttgacgtggcacagataggcaaaatcgccacccgaccgacgaatgcttgtgcccaattcgatgtaacaaaaggcacccaaaatggcaattgcggcagaaagagcccaaactatgagcgaaaggccaacctacaaatttgaaacgaaaattatggcacagtgacataatgccaatcgactgattgtgtgtggttgagaatggaagtgggcgtaatgaaaaggccggagccgacgatgttgctaataatgtacgaagtggcaccccaacggcccattttgtttttgttaacggacgaacacatcgccaacaatcgaacggagcgatttttgaacttttttttttattaatttagacgaaaaaaaattagcaaaataataataataaaagaagcattgagtgattttgataagaacaaataaaagaaattattctttggagtggtgaaagaataaatcgatggaaatttaaagacaacgccaaaagaagcggagaaaaagcaaaaagacagtaccctccacagtacgactacagtatgccagctaaatggcatttgcactttcaaaatgccatcttcggccccatcaaattttattttttttttgttatttttaattgccattttcaatgtgtggaaaattcgacaggagcagattattgttcatttcttttttggcattggcaccattttgcgggggaaggccctaaaaattaaaattagtcagaaggacggaatttctgcggcatttccaatgccttaaacacctctttttgtttgcctgaagccgagtttggcgttctgtccaacacttttacgtacacaggtctgtacagcaccacgtcgtcaacaaagtctttctctccttctgttcgtccgtcccaaacttgaccaagccgaaactctggcgaaatgtatttgcccgtttccacgtgatcaacgcaaaaatcttgaaaaattgaattttagccgtgttttttgttgtttttctaccgtatcccacgctgtacagttgcgaatgccctggacgaaagggtacagtagcgattgtaagcggaaagtccatttcgagggcggcactgccggcgtcggccagcgaagcggcgggagacggcggcgcttttggcacggacatttttcgactggcatcctcgacgtgaagtcgcagaacataatacaactgaaggagacgacaanagccaacctaagcgaaaagagaaagggtggacaatttggcaatgggagggacaaaaaacagaaaagacaaaaaaagggac

SEQ ID NO: 23618 - DNA, 128 bp, Heterodera glycines
ctattggaactgaaaattgagcacatttcaagcatttacgtgctaaagctcatacgattttcgacatgaatatttctataattcgtttgttcagtgcccacagatcaccagaaggagagtgatctgaa

SEQ ID NO: 23619 - DNA, 990 bp, Heterodera glycines
  misc_feature (938)..(938): n is a, c, g, or t
agccaccttgagaaaaatttgtaatttattagattttggccaaaaagacaaattttaattagttttgctaaaatccataaaaaatctgaagaatttcacaaatacatttctttgtacattaaatattcttaaaaaatcattctcatttgccatttttatccaaaaacacaaaaatccacaacatttctcaaaaaatcaggaaatcggcagattgtgaatatcgccataacaatggcatctcatcagcacatttttgaaagtatgtatttcaattatatcttaatatttttttaaataatttttcacattttttggtaaatattattaaaattaaaaataggaaatttgaaaagttcgacaatatttttttgttgcaattcaattaggctaccattatagtttaaaaaataaattcaaatatgaattagctttttgaattatttacataatttaatattttgtcgagtcatgaatttctttatcattttactacacatcatacaaatataagaatggatacaatttgctgttatatgtatgtgagtatatgttattaataattagtgatgggatctttatgtaagaaaatttgaaaaatatttatgtaaaaaaaaccaaaatatgtgtgaaatatatacaaaaaaaaaaaaccacgaaattatatatgaaatgtaaataaatttttttattattaaattttggacaaaaaattcatagactagtgtgaaatgggtacaaaatgtcataaaaacaatcttagtgataaggttttctaggcaatacaaatctgcaatttattggcaatttaacctccagcagatgccgatattttcgatgatgccatgctgcgcccggccgaagtgacccttacggattttgcctgaaaattcttataaattaaaacgcattcctttcaagggcgtaggcaggggtcgggngctgagggggctaaagcccccccccccccccaaaaaccacaaatataaaaat

SEQ ID NO: 23620 - DNA, 1200 bp, Heterodera glycines
aatacttattttaggagttttgcatataaatcagggtccgttatgtcctctagggtttgttagaaatgtatctgattttgggatagtgacacaattttgtctgacttcttaagattgacaataaattaaatgaacctctcgaaaaatttttagaaaatttaactcaaaatttttcattttttgaacactgaaaaccctagaaatccttaattttctttaaaaaaatgccacaatttttgtgtaccttttggtcgcatattttggggttaagatttcttttgcgcttaatttaattttatctaaattttaagctactcaatccgggccctaaaataatttataatacctttttcgcattttttgatttcttttttatatttatttcacatttttcatacttttttgaggcttttttaattacaatttttttgttttccccttccctccctcttgaaaaatttttctattggcattttaggcgctgaacggcgagtatatgaatcattctttcccacgctcacacaccgaattaaataatattgtaataaccgaattcagtaatatgtattcattgtcctacattaattacagtggaaaaaatcaacaaacgcggtcacagattatgcgccgccattccatttttaaattgttaagctttgattgattgatgattgaccattctgtaatccttaattaatcaaatgtcagtttattccgatttttaattgacttttcattatttcctaatttacggatgcattaactcacattaaacgcatgatagtaactaacaaataaacctcagattcgtgctcaatctcagcgtcaaaattagcctagaaaaaactagtaaaaaaaaatattcaggggcgggagtggaaaacccggaagtacgggaaccgcccagttcggcgcggccggttcggcgcgggtttttcggcgcggttttcggcgcggccagttcggcgccctatataaaatggctttttcggcgccagtgtttaaaaatcccaaaaaaatttcaaaaaagttttgatttgcctttcattgtgcatataacttatgccattttctttcaaagtaacgtgctaatgcaattttgagcaatggtgcataattgtggttccaaattaacttttatatttcggttcaaaatcacaaatcggtgggtgttcgagggtactgatcacaatctgacca

SEQ ID NO: 23621 - DNA, 1555 bp, Heterodera glycines
  misc_feature (382)..(382): n is a, c, g, or t
ggcccgcatggggcaggctcccgtgtcggtccagttttgccggatcgaaaatgggcgcccgacaaaggcacaccacgcgccccctccgtcggtttacctgttgtcaaaagagctcacgtctgaaacggggatggcctgcacccgccaagtgttgttagaattgtcggcgaacaccaccaagcaaatgctgacattctccaggcccaattcattttgcaattggaaaaaatgttcattccatggcggagtcacatcgcttttggggaacaaaattatccttgcatttggatggatctaattaaatttttttatcagtttgttccaaacctttaggttccttatttcgtcttgtgataaattctatgacttttacagtagcgcncgctttttcttttttttgaaaaggacgaactttcaattcgttttcttttgagcccaaaattgaatcgctttgttcaaagagtttatctttcgtgaggtatgcatgtagttatttaacattattataaagtttggattttaagattttccttattttcatgagcttcacatggcgtgaaatggtacgaaaataaagtatttttggtcctatttctcttttttcctttctttttttagtagactccaaattgtactattttagacagcttaggtcctcaaaattcccagtcctttttacctacaatatgcggggaaataatgcaaattgcacttcttatatacctacgcattaaaagaaattttttccatttttccggtgtttttggttcaaaaatgagtatataagccgacttttttgctccctctcagcataatttccgtgtccaaataatgcctttcttctccccctcctccgccgtctttttgctgccctttcaatttcttttggttgtcctcggcgctgttttcgtcgtcctcagccaatgctgtggttgttcgaagaaggaaaaggccagttttcaacctccttccccacaacgagtaaaaggacgaaattctattcatttttagccaacttaattttatcacaattcggaaaatctgacttacattttcgcgttttcaattcaaaaaaaacaatcgtgataacaaaaaacaaattagccatatcaatgcaattaatcactttcaaaaaagatcacttttccagaacactggagcgccgccgccacaaccaccaacatttctttcaccagctccacaaattactgctgctggacctgggactgggcctcaattcgttccaagtgagtagtgtttgattaacagacaagtaataatgtgttccctttctcattttcagtgaatgaccctaaatatgagacgcttaactccttggatccgaacatttttttgaagagtgcgtcagcaaaaccgccacaaaaaccgccgcaggcaacgaatggaccgaaacccgtgccagtgccaggtaaaaaataattgtgaattcctttgacttagctaattgttttaccacctattcagcaaatgatcctaaatatgagacgctcaacgctttggatccgaacatttttgtgaagaaatagtgccgtca

SEQ ID NO: 23622 - DNA, 2153 bp, Heterodera glycines
gggcagttgaaaggtatggattaattgttgactttatgatgaaaattccgttaagatttattaatcgataattttatttgacccccccccccaaaaaaaaggcaaaacctattgtaaggactgtacacaaataatcaataaacccaagcctattgcatatatcatatccgaagctttaagtaaattagcaaaaaactccaattcattaaattgtaaaaaaatgacgtcatcatgcaaagtaaaaagactccgccccttttcttgttggtcacgcccattggtttttgttttgctttgctaagaatacgactccgccttttttgcttttagtttcttttgtccagccccattttttttgctatttaatcacagtttttctacataaaaaaatcattcgtccatttaaaaaaattccatccacattcgttttttctgttcttcctgcaatgaattctcttaaacgctttcaactcccggagcaagggacacgacagcaagaggagttggattcagttgaaccgaaacacatcagcgatgtggtcaacttcaattcggccggcgttttttatgttttgggaaaagtgacaaatatgcagtaccgtgtttacaaagtccaaattaaattaattaattaaattattaatttttctgtttttaggcatgcccattccgttccaaggggctcatttgtcgccgaaaattgtccgatgataacatgtgtgaggcttgcggccaaaaagcgattgctcccatccacacggtgtttgttcgtcttctgctgcaggatgttgaacaagcagacattgctcaacgtgtcaccatgttttcgagtgttgctgaagagtttttgggaatgaaagctgctgaattgctcgccaaggagaaggagccggaaagccttgcgaaacacttggacgatttgattgctgtgaagataattgcgaaagtcaacattaaggttgttttttttttttttgcaatttattacatatttgacaaaccacaacataggcgaacagtcagacttacactggatttgattggattgtcaatttgttcaagaagtgccctggaaaaaatgacagtgatgtgccaaaagaaaaagatgatgatgatgacgttgatgagattgctaccaaaaaaacaaagaaaaattgagagatagatagatagatagataacggattcattttgttgtgagcttcaaaaaaaaaaggatttaatgtgtcctttacttttttaaaaatccattaaaaatgcattttattgttgaagatgatgagacacaaactccaaaatggtcttgatgtgattgcaattttgttttttcttcgtgaattcaccatgagacaggattgcacgttgacaatttttcgtaatgagcacagagagatttgcgagttggctctatccgagtggtggatcgtcaactctcctcataacaatccaattaacgttgttggaaaagcttggcccatatgcgtttgtcacgtaaccctaatttttcaaaagaaggaaaagcactcctaaatttagttttgatcttcatcaaggctgaaaggggatcatgtgaaaaaaattgaatatttgtgcgttactcatttcattattgatattagtggggacatactcgagaatttctgcctaattgtaatttcgcagcgatttaacatgctaaatgtcgtcgcgcagaggaatataacctcttctcttatgccaatttatcacagattcaaagtgaattaggcgaacgtgtataataattggatcgtggacaagcaatacagcgggggagagaaggggcgtatgaacgatctggtggtcaaaaaatagttcgggcccaatgagaccagctgctcgtcatgttattatataagaaaaaatataaatacgtgcgggttgttgaacaaatctacgaaagggaagctggtaacatgaacagttctgattctagataccatctacataaatagatttgaatatttttatcgaaaaaagtgtctgtcacagcttgaaaacgaaaaaaacgaaagtaaaataaatggcaaatttaaaattgcttaagtttttgcatgcaattagcatttttataataaatttttattaatttgaaaatcctggtccagaatgcggtcaagacttgacaggcactg

SEQ ID NO: 23623 - DNA, 1453 bp, Heterodera glycines
tttttggttctggtcgggttcatgcgtcccatgaatgatcatcctcagtttcttaggccataactttttgcttacttggccaatacatatattctttgtatcaaatgaaagcttaaggtctacagaagcttttgtataactttattttttcgctaaaagcaatagacaacaaattatactcggaaaagttgaaatttcgtgtttttatcattgtaattttttttcaatgccagtatttgctcttttcttgcatttatgaaatccagagacttttatctttcgtttgataccaaaaatacaggtattattgaccaagtaagaaaaaaatgatgacctaagaaactgagtatggtctcattcatgggagggcataaaaccgaccagaacctcattttgatcaaaatgatggcctaatttccaccgttttctccatcacaggaattgtgcagttatcgtgttcaagtgaaaagtgagctgatgcatttctgccaagaacttttggtgggttttcgtttccaaattaatgtctgtctccgcaattgtgaagaattatgtttttttttgttgttgttgaacttttggctcgaaatcagtttcgaatgtgctgatcactaatctgaaaactcggatttgcccaatcccgaacaccggatccgaattcgaaccaaacattgatatatttttttcctccagttatgcgttaaaatcggtcaaattttggcgcaaattgcgcacttcaatttttatccaattaagcattgtcttgcatcaaaataaattgttgatgaatgaattaaaaactttttaaccccagcagaacaatgcatattttgggggggggggggggggaattaagttttttgttcgagttcagatctgctgagatttggagttgggaaaatccgagattcgggtaatactgccgatggtcgccctctttttggaaaaaatttctttttgttctaaaaagtcgtcaaaacatcaaaaacggtcattctatacagattcgaacataaaagtgaattttgaaaattttgaattttcgactttttgttcgagtccgggtccgggattcgaaatttaaattggaccacatttctttaccaccgcgcccagtctccaatttcccattccttcttccccaacagacgttcatcaacgatttactgcttccaaaagcgaccgatgcggaggcgaaggttttctacctgaagatgaaagcggactatcatcgtcacatggccgaactcgtgacggacgacgaccgaacgggtaggacaattgtcgttgtgtgtgccctctgtattaagaatttgtccgatctggttttttcatgtgatgccaaatcccggacgcgaatttgaacaagaagtcgaattaaaatttttcgaatttttggtataaaaccggccctaacacacttcaacaaaagaatggcttcatgatgattgat

SEQ ID NO: 23624 - DNA, 2168 bp, Heterodera glycines
  misc_feature (2069)..(2069): n is a, c, g, or t
atgggaaaggggaggtagacccggcgttcttcgtctacaagaatgattttgggtgagttttttcaaaaaaatttgactcactaataaaccaatatttaggccaacgagggattcgaaagtggtgacgagggagaagcacaaaatttacaggccggtctgccagaaggggataatcgatgaagaacttaatgtgatgccatttggattttgttaatttttgtattttattgttgttttttttttgttgaataaagttgaataaataattaaagtgatattatgactagcgggggtggaacggtctaaagtgaaggcccactcctgttagccgttatattttttataaaaaatctaaaagttccagaggaaaatagcacctatgaccgttattctggtacatagttatacacgggagttgagggaattgtagctttacccggtgtctcgagtagagatgctgctcgacagtaaccccgaggaaacctcggtaggcaaaaagtctattagaaccgttaaatgcgatgtcatccggtgagataaactgattgtgcctaaggtgtctcgttattagggcgtgtcttctcaaaaatttcaaattctctttcttccgcagtcgtagaatttcagataattcgtgaggttcgcaatcgttaaaatcgcacagaatttcaacgagagaattcattttttgagcacgagtaggcattttcatattcgttgcaaatccttatataccgttacctcaccactgtaggatgagtttttgccttttctctttaatttcaaaattctgagaactgaaatacaaatgatgaccactatcaaatctaaaattgacaaaaaatacacccaaatatttgaacttgaaactctaattttctcaaactctttgaacatgacaaagttaaagaattcactatttgcatctgacacatatttgggaagtatctcgtttgagtcaaatcgatctttgtatattttcttctccttaattagataaatttgcccctcaattattaggaaatcggtaaatgaagacggcatcgatccgatcggtttactaataatttcggtgccattatgatgtgtccataaattctctattgtactaatgtcaaactcggctatttgatcgtctctgattacgaaaagtcgaccatcaatatgatcaaatctaaggtccccaccggaaaaattcctgacaaccatttcttgactccctcttgttatcgaagtttcatttgtcttttcattttggaaaattaaataactatgatcgttgtaataaaaacacgctcggggttttaattgtcgaaaatctcggtaaagcttgatattagtgggtccgctcttttcaattgaattaatttcttgtattgataggctccaccctgaaatcggattcctatttatcatgcacaatctcgagcgatcgaacccgaacagtctttcattaaccgaactctttgtcatagtaagatacttgtcgtcaaaaagtcgtgtatcagaaagaatctgaaccctttcggcagtgagatggccgactatcgttaggagaacaattaaattaaacattactgacaaattgcttaactaataaatcggccctcgggcgaaccttatatagaccgtcaatgacctcacaataaggcattccggagcatcgttgtgtcaagaaataaatgcaaaattgaccacatgcatctgagaattggtgttggacaatacgatcgttaaagagaattcgttcgaataggttaagatatgaacttaaatcttcgttgggataaacgcccaatgaatcaaaatattctatttctgtcggcgaatttacaaaacaggcgacccagtgttcacctatcgtgcccgcccggtcggtatttgctacaaaacagtaggtaaaatacttatccttcaattttggcaccctgtctgaagcaaaaaccccgataaaatattttcgggttgtcggatgtttggatagaaatatttcaatctcgttagaattcatcatatgcttccgtcgctactgagcacccgattagcattaatagacaaaatcgaatcanattcccccagaacgatcatctcatacccgccgtcctttataggcgcattaaactgcaccttgatgctggtcgttccgtttcgaatcaattcaaaaccag

SEQ ID NO: 23625 - DNA, 2178 bp, Heterodera glycines
tcaatttgtccaattgggtggaaatggtcgacttggacaacgtcacattcaccaaggcatgtttttttggcaccagccgaaagcaatccatgggtgctgaaaaatattttaaattaaaaaccattttttttaaatccccattttttggtaacattgattgcccaaatttttgagctaatttaaatgcatggcgagcgggcaaaggactctcggttctcgggtttttagtttcgagtttgaggagcttgttccaatcacgagttgtctctttctattttggcatcaccagttttcagagtgttcgctttgctgacaacggcacattgctggaagacatccatttgttggacaagctgtacacggtggaaaccgcgcaacggcacaacaaaaagcgggcgcggaaggaggaaaagccgccatcggcgaagaagcaaaagaataaagtggtgggccaggcccaccagcgattggaggcacgcattctgatggttgctgatcactcgcttcatgaaacgttcatgaagttgtatggcgaggacgaatacgcgggtgagcagccaatgccaatagtttaaattatgcactcattgagactatcgactctaggactttcggaaaattgttagacagtctcgactattaaactcttcgagagtcttggtttcgactcaaagcttgtcaaaactgttcgaaattatcgacttggtttctgttaacttatttgttactgatcattagggaccggatttaatggattaaaaaaatccaaaatatggattatataaaatggaccaaaacgctgaaacatggacaaaaaatacgaaaatatggacaagaaatttctgaaaatcggttttaatttttgaataaaatttcgtaaacccctatttttttttgtcaggaaggaaaaaatattttcataattgagaccttctatttattatttacgaaaactattgaaattagggaaaaaattagtaaatttttgcaaaaaattcatttttaaggaaaaaaattagtaaatttttggaaaaaattcatttttacacgaattttgcgcatgaaattttttttttgcacaatttttggttttttctccaaaattaaattttcctgctcattcaattcccattttgatttgcgctttcacctcaactgttcagcgtacaccgcattgagccgctatatggtaagctttttgttcccaatcaattctggcattttggtagtttaattctcggccaatctcgtttttcctggtattaataaagagagatttgcttggcatttttttgattatttttttatattagaaatattttaaaattttatttctaattttaaatttttcgtaaaatatccgttttgccacacccagtgatatcccgtaccagacttgccgcttatccgggtttggctcaaatttccgggccaattctgacctaaattctcgaagcatttcccgtactttaatataattacatacattttgttgtaccccttttcagctgggcgtgttcactcaggtgtggtgccattttcgttcgtatatgccattgttttcaatgatttccccccccctctcccgacagttggacaccattttcgcacgtttgccgtttttcaccggcacaaactcgtcatcaaccgcttctcctcctgctgctcgtcgaattttcttaaaacttgccgccccaccaatggtcaaatttttaatttatttatttactcatatttctcaaaaatctctccatctcttcccattgttcaggttattgtacggcccgaagactgtcctctgcggggtcccatgctaattgctctacatcaaagcaccgccgccgctaatgcaacattaggcgatgaagtgtcattttcagcggataataattcttcgaccataatcaatcagaatggaacattagacacaaatggtgaaagcgaattggacaaagcagtggccatcggcattgaggggtcattaattaattaatgggttatttattgagttattggaaattggactaattaatgggaaatcactgagttaaatccatataaattaaattgtaaaattttgttcaccctttttaattatcaaccacaaaaattgaatcaatagaaaaatcccacaaaaaaaactgttaattgtttgaaattttgttttgaatatttaaa

SEQ ID NO: 23626 - DNA, 1016 bp, Heterodera glycines
taacggaaaaggagggaacaatgatcagaatagagaggtgaagaaaatgatggaaactctgatcaacagcgaaagaatgaagagcaaccggaagatgatcagcagggaaatacggaggaaggaggaggagaaaacggtagatcagcagacggaagaacaaatggagcacaaacggaggaacaaagacaaccagagaatcagggagagcacgaaaatggtaagcggaaatttaaaattaaattttaaaaatttaaattttaaagaaatttatccggaaaatccattttcaataaatgaaaatgatgacaaagaaaataatgatgaacaaagaagtaaagaaaaaggaatagaagaagcattaagagaggagaaaagggaaaaacaaaacaatggaatggagttttacccggaagaagttgtgataggcgagcagaataaggaacaaaatgctaatgagagtgataatgataatgataatgataatgatgcttcacaaaaagagtcagttgaaagagacaatggggacccgagagatcaggcagacacatggggagatgaaggagaacaagttggaaaagaagcagaaacagtaaaagataatgggaaaggagaggaggaaaagaaacgggaaaagagagaaacaaatagtatgttagaaagggagaaagaaaggagtgagagagaaaagaaaagagcagaggaagaaaaagagaaaacagagaaagaaaacataattgagggaaagaaagcggaagatgagaaaaaaagtgcagcaggaaatgaaggcctgttcagaatgtttcctgaacagcagatagtgagaaaaaagaggaattcacctgatcagaataaaccgcaagaggatgaagaaggagaagagcctgatcagaataattcgggagatcatgaagcagatgaaaagcctgatcaaaataattcggaagaagatcaaacgaaaactgatgaaaaccctgatcagaataaatcaggcgaagatgaagcagaggaaaagcctg

SEQ ID NO: 23627 - DNA, 1688 bp, Heterodera glycines
  misc_feature (1661)..(1661): n is a, c, g, or t
ggataaatctttgcacaatttttaaaatataatacaattttttatttgtccatcaatttcaaattgggcacaacacttcaattttatgcccaaattttgaattttttttaaaaatcaaaatgaggcaaatatgcaaaaaatgcgcacccaaaacatttatgaggcctaatgccagcacaaaatttgtcgatgagaaaaatttggccacaaaattgaaaagcaccaaaaaatttatgtgggcaccattttcttggcaatataaacattaaaattttatttttatttttaaattttacaattattttattgtttttcaaacaaaaattgttcataaaatgcttttaatcctgcaattttttcccattttctgctgctgatgttgcacaatgaataatgaatggcttcttctttttcttcttgcgctctccgctcgcttctcctccaattccctgcgcaaattgtcttcggatttgttgtccaccgtctccaaaaaaattatttatttaagttacgcattttgcatttcgcgcacaaatcgatcagcacagaacagaaccacccaacaaatttccatgtaaacccatgaatttgggctccaaattgttgggttgaggacgatgtttctcgttttcctaagagtttatgttttggttgcttgagatgcgattttctttagctctctctcgagaatggtttcaaatcccgaaaaatcccaaattctctcatctcgggacattgatcattgagatggaaaggggggggggggtcaattcatattttcaagtggaccaggggggagtcaatttcgtttttttcattgggctccgaggctatctaaccgtcttaattagttgtgaaatttcttatttttgaacgaattatcattttttttttgttgtttatcccaaataattttttggttcttaacaatttaaattatttcaatttcacgctttttacaccataatttatacaattagtgtaagaaatgtcgaccattggtcattttttaaccgaccgagagcctctgacaccacatttgcgtttttcgtcactgatcaatctgccagccgttttttctcgcacttttgctgatcccctccccaggcattttttatgttttttttttatacttttaccaaaaccatctggcacaaattctttcttcggttggcttgcaaaaaagcgcacctaataacggtatattgctccataatcacagatggtcatttcattgtgcataaattctattttttttcaatttttacgaaaatgctcttcaattcatgtgccccactttgtaaaattgaaaattttattgatattttactaaatcttaaaatatttttggttgctcattgaattaatctaaaatataaattaaatatttagtgaaatatttcattatttttttgaaaaaaatgagtaatttgttagggtctgattgaagacgatttccggacccggactcggtttaaaaacttggaccccggactcggcttttctggacccggcaatacccggatcgggcccttgaaaccctacttcattgttgtgttttggattatggttttggccacataacaattaatttccctgcccattcatttgcttggtcggccacatattataataccctttggtcataaaatttgtaacanaaaatcatttttgcaataatcattttt

SEQ ID NO: 23628 - DNA, 1098 bp, Heterodera glycines
aatttaattttaattttaaatttactttattttttagttttgaaattgctgacaatcaaagttctatcgccgtaaaatatttctattggatttcattccgcgataatgttaaagtacgccacgcctgtaatggtggggaggtagtatttggtggactaaaggttgactgtatcataggggcacaaaaaaaaattatcgaattccacggctgtgcatttcacggacatccaaaatgttataggcctcagacggtcggaccaaacggtaagaccatggaagaaaattatcgaaatacattaaataggatagaaaaactgcgcagaatttgtaaaaaattttgtatcttggaagtttgggtatgttattcatggtctgaaaattcgtatagcattttttaggagtgcgaagttcgagaacaattgaaaaaaaataaagaaatgaaaaatttttttgaaaatattccggatcgggggtatgttacaaatgaatcggtgaataatatttaatttttagacctattaatccgagagatgcgtatgtagggggtaggacgatgccttttgcactttacgccgaagcgacagaaaaacaagtcatttcaatgtttgacatagtgagcttgtatccttatgtgaattttgtgacaccgtatccggtagggatacccaaagtcattaaaaagttaaatccaaatgttatttggaaggatccgggtgatataccttatgatggacttttgaaagttaaagtcataccgccgaaaaagttgcggtaccctttattgccttttcatgccgtaggttatttatttttatgcaaaattgatttaatgtttaggatggttttttactttttccgacttgtggagagtgtgcacgtaagtctaaacaggattttgttagggtagaatgtttcaagaagtacagacactcagcagaaggacgggaattagttggggttttcacttctattgtactccgaaaagcgttagaactcggctacaaaataacgaaattttatcgagcataccattatgagaattttgacacaaatcttttcaaaaattatgtaagaatgttttgaaaattaaaatcgaat

SEQ ID NO: 23629 - DNA, 899 bp, Heterodera glycines
  misc_feature (853)..(853): n is a, c, g, or t
cacgcgggtcccgctgtctgccataacccctccaacagcaaccattaccccccccccctaaatacaatgaacttctgatcgtcaaatttacattattattttcaatgacgacaagtcaccacttgtcgtccccccccccaccgatcgatcaatcaatcacccccccccaattaatcactcgtgacagctcgatcaccccataccctttgatcactcccgacacctcctcccgatcacacacctgtcaatcactttgattgacaggtgcggcaaagatcaaagaaaaaaacacccccaacaccctgtcgctagtgcgcgaaaacttcgcgcactgacgacaagtcggtatgtgtaactactatgggtattttccgcctacgattatattcagttttatcttttttcgtttttgttttttttaaataaagtttctgaaaaaataacattttttaaattattaattaaaataaaataattatttaatttaaattaaattctaaaatttgaatattattaaaataaagaataaatcaaaactgaatatataacaaaataaatgataatatttaatatataataaaattaaaaaaaaaaacaaagtaaatcgaaataatatatagaatttattaaattatattttaaataaaaagttatataacaaaaaggtgcgacatttggttcattttttcgcacaaaagtgttatgaaacggacaaattcctgcggcgcctttcggaaccgcaagatccccatataatgaatattaaacattaacaagacaattatggcgaataaaaaatatattcacgcatttttatctcaaaaaaattttgtaaaacaataaaaatgaattncagcatcaagaaaagaatggagtcaaaaattatgacgaaatttgta

SEQ ID NO: 23630 - DNA, 1564 bp, Heterodera glycines
  misc_feature (130)..(130): n is a, c, g, or t
ctggcggtttttgaggatttttgccctcagatacacccaaaaacaatttagcaatgtgattattaactgctgaattgatcgatttctattatatatatgttatattgggtaaatattttctttaatattntaattttccattgctttaatgattcatcgctaaaatgtgatgttcttgcaaatgtccatttgataataaaatgttcgaatgcattcccagtaatttattcaatgttttttgaacgctaatgtttatattaatatttattcatttttcgatgttatttatttatatttttcatttcataatttttaacaaattgaataattaaaatgctttttgtccttctccgttttctgctgctctgttcactgtctatgccaattttggccatccgtaatttcactttttcaaaagtgaatgaccgcagccaattgccccaccgaatgcgccgaatggtccgcgtggaatgggacgggagcacgtgagtgttttgaaccgtactcaatgcgcaatagcacgatggattgacacccgaacattcagcactgtccaatacggtcgcacatcgcctcagtcgctgaacctttactttgcgctgcccgcggcgccgcgaccccccggcgccgtcccgtcgcccgtcactttcactgtgaccattgacagtttggacgcgtgcacttgcgtaacgcaaagtgtctacgacaacatgtccatactttctgttcaattccggaagttggcttttgaattttcagtttggccttcgcttggaatcggcgatttgccgatagaattttgcccgaggaagtcgtttatttgacgtggaacctttggcaaagcggcaacagctcagcggacaatgacggccgttccgtttatttttcggccacggattttaacggattcggaaatggttgattgattttgtttgtcatttcaataaacagttcgcactcattgcagctgatggtccctcctcctggaccattctctccggcgggcagcgtcgcgctcgcgtcactttgcccgttgggaacggttctctgatgctggagtacggtagccgtttggcactactgtacaccgttccgcacggaaaagttagacgacatcttagcttccggctaatatcgcagcgtgaactgctccagctgcacccctggctgggctctcagttgtccgccgggcgaaccccgcgctgtgactgggcactgaattttgtgagccaaaacgggaaaacaatcgcctaattattcgcttttgtcgagacttacaaacggattttctgaccattaaactttttccccggcagtcctccaaatatcgcatgttattccccacaaatggcactttggaagccgaccgacgccggcggcgaaatgagcgaatcgatgacggacaacggagaaatgaagcagataaaaacggcattgagcactgttcacggaagtgaagataacggagagggcacgggataaatgttggcataatgaaaatgaaaaggcaaaagtaaaagtgctctaaaaatgtacaaaagtatataaccaacgacaattaaaa

SEQ ID NO: 23631 - DNA, 1056 bp, Heterodera glycines
  misc_feature (1027)..(1027): n is a, c, g, or t
ttcttgtaaagaataattttaaaaattaattttcttagccggtgtattttcgcttttattgcgtttttgtttatatttttggaaaaaacgccaaaataatttttaaaaatttttttcaaattttcgtttgattttttcggttttgttcttaaaaacaaaaacctagaaaaatagttcgtaataactcgagaaccagtttaacaacaaccgaaaaaaaacatgtttttcagtgaacaggacaaaatcacgccgccaaaatccgccgggaaaaaatcccacccccaaaatcgcgccgggacaaaatcacgccgccaaaagccacggggagctcaggaaaatattgaaaaaaactaaaaatcgtagcctcatatatcatcattttgacaaaaattgcctaaggacaaaacgccaaaaaaccccactaatttaaaaattttgccgagattttcccttgattcatccgttttacgacggcaatggaaggacctcacgcctgctgatgaacctcatcatgctgcgccgtggataccacccggtcatcctgcccgagaaaaaacgtgatgaatattacacgtggctggaggaagcttcagacaacaacaacattgagccattcataaagttcatcagcttccaccagcaatgtgctcaagacctggagcccgcgtcctccctcccctcatcctaattttcaatcactaacccatattatattgtacttatatgtgtatatattaggtatatttgagaaatgatcttcaatctcaccaattggaatttgatttgatgctctcattttctctcagactcactttttgttgaataattcattcgttcgaatatacaaataaatattcattgaattctatttttaaaaatttctatgaaatttttaattatgcttatattttaaaaagatttagcgaactcactaactctcatatttaaacgcttatttacctattttgaaaatttttaaaattctgagtttttctagtggttatacatatatatatgattttagttnttgaaaaaatttcaaactatttttcgcat

SEQ ID NO: 23632 - DNA, 889 bp, Heterodera glycines
aaaagaatttcggagaaaaattgtagaccatcaaatcagtttccaatggtgagagcgtcgattatttctcaaatatgattttcattgcttaatccaattcttcttctaccactgctggcggcgacaatggcctaaaattattttcatttttcgacaattgaaaattgcttttgttggctcacccaatccaatgatttccacccaaatcaaatcggacaatgttcaaattggcacacgcattattgccataccgcggatcaaatctgatatagttcaaattagcacccgaattttcacgttttttccacttaactggcgccgtcgccgtctccccaattgggtaccgttgcaacagccaattaaccaaattgtattctttgctctgtttcaatgtcagcttttcatttgtcactttgttttccaattcaaatggttcaattggcattggttccacccaaaaaaaaagttgaatattgtaactgacagaagtggtggcacggcgaaatgtctaaacaaaattggtaaaacaaaaacaatttaacgaaaatatggcgtgccacctctttgaagttgttgacccattccagatttggtggaaccaaaaaattattgcgacgaaatcgcttcagttggccatcttttgtcggagtgtgaagccatttggacaacgcctggtcagcagttgtatttggtccatcatcgccaattgcatcgggcaacagataattggaatcgattgaatgcaactgatcaaaatcggtgagaattgtcggtgaaatcagacgacgcaatttgtccaaatgattgccatcaggaacgtacaaatggcgaatgtttgtcgcaaaaattggccaaatttgacggataaacacatcccagatcggttggt

SEQ ID NO: 23633 - DNA, 1605 bp, Heterodera glycines
aaaatgaatttctttactctaatcctacaattttaaataaataatctcatgtttttttttttgcagagaaatatttttgccaccgctgcgacaaagtatttgttcacacttcctcttaccgagtaatttttaatttatttagttttaatccttatatacaatttaaccaaaatttaagcgccattactactcggtccatttttccggattgccgtacaaatgccgtttttgcagcagccaattccgcggaattgtaattaaaaaatttttttattaaaataaaaaaactttttaagcgtgagagaacacggcacatgactgaagtgcactttgaagaatgccttaactgtggactgttttaaataattgcatttttcattaataataataataataataatatcatcagtaacatgtgaaattttaaaattctatcgatatttgcctcgcactttgaacagagcattaattgtgtactgttgtaaatagttgaaaatattttataattataatatcaccatcagcaacaaatatgaaaatttatatttgccattattttgctaaaattcttcattaagaacccagaaattgaaaaaatgttaatgtaataaaccggtggaaagaattttaaaaaaaactgttaaagtaatggcaatacactcatgaattgtgatcatatttctcgacaccttatgttttgcttttttttttttttttgtttgctactgtgttgctttttgatttattttcaatgtttttgagcacagtgaaaaaacagaacgcgtgcgcttaatattaaccggttagttaaattattaattttaaatcatctgacgaacgacgagcgtttaatcattatgaatattttaagtggacccttctgtcctgattatttgatcagttttgatttggagttgcaaattcgaataattaaatggacaaagagttattatgaattgccagagatattaaaaattttggggcataattttgttctgtttcacccttcattcttcggtttaaaaatttggtgaaaatcagttaaaaccttacgacaattttcaaaaaatatccccggctcgctattattaccacttccaacgccgttgggtgattttttgggtttgaattattaacagatttttactaaagatgaccagtcatgttttgccccaattttaaaaatccaaaaaaatgcaaaatttctgcgatttttattactattttaaaataggaatttttagggcaattgtgccgacaaacgttaccgggaaaattgaaatttacaatttttaatcgggaattaccctaaaacaaaaacaattttgataaatcagaaaataaaatcaaattaatataaaatggccattttgtgaaagttttttgtcgtcttttagaaatgactttttttcgaaaaagtcaatcattggcaacaccttcaaacgacttttcttgacagtaaattcaacgacaattatttggcacctgaagacttaactttttactgaaaaaaataattttttctatcctgattgcggctcgcttcataaaaattatgcttatttcaacaaaatcttaccgaaaatatattttttctactacaat

SEQ ID NO: 23634 - DNA, 1619 bp, Heterodera glycines
gccaaaagtacgggaccggaaatcttaaaaattccgctctggtgaagaattgcgctgggtcaaaagtacgggaccggaaatcccgtaaaatcccgctccggttaagaattgcgctgggccaaaagtacgggaccggaaatcttaaaaatcccgcgccggtaaagaattgcgctgggccaaaagtacgggaccggaaatcttaaaaattccgcgccggtaaagaattgcgctgggccaaaagtacgggaccggaaatcccgtaaaatcccgcacccgtaaagaattgcgtggggcaaaaaagtacgggattctcgtccgcagtattggcggcattgttcaattattcctttgtccatttttcaggcactgattcgaacggcgattcgctgccccgacaatccgtgcgccattaaagcgacacttttgctcgctgacattcttcacattgtgagcaaataaaaggcataaaactgattaatttcagactaagtttgattaaaaatgaatttgccactcaattaattcatttttatttttttgcatttgcactaattttattcggtgccaaaatgtttcgggcattcaaatgtttatcgccccatggtagactaccgtacacttgccaagagaattacgtctcaaggcccatggcattgccgggctaatcaatcgggtggcacacgcatttcaaccagtgcaattggacgaagaaaattgtgacgagaagatgaaacatgacgaattggactggacaaattccaacacaaattgcaggcattttgaaatggaaaataaataaataatgaattaatatttttgcagcaatgcgataacactttatgcgcgacttgagcaaattgagcgcattcacgcccattccattgacgaaaaattggacgaaatgcacacatttttaataccaaatttggggaataacggcggaaaaggacagagacgccggagcagcgaacattcaatgccgagcagacattcgtcgaaggcgagcagtagcggacaaacaacaccagggggaccaacaagggtggatgaacagaacaaaggggggacgacgaaggacgaaattgggggtaaaaaagaagggggggggggataagggaagtggaaaaggatgagaaaaaggaaagggccaagtcgaaagtgagagaaagtgcaacgagcgagaacggcatggcaaagagagattgggtgtaagccacgagtttggcacggacccgtaaatacaaaaatttagggtggcgggtggtggaatcgcagacctttttttgttcatgtagtcgatgggagaaaaattgcacggttatatgggcctggtttggcatgtggcaaagtcgagagttaaaaggaaaagagcgagaatggcataatcgagagataaataagtgagaagggcaccgccaagttctaaagatcactgcaacctctcattaatctctccttaattctcgaacattggcgcgatatcattcctttttcccgtttttagaatgtcttgcaattttggatgatttgctgcctaaagcattcgttgacgcaccaaattgggcccaacaaactccgcctcagctatgctcaccgacttttaacttcgctggcgttgg

SEQ ID NO: 23635 - DNA, 1559 bp, Heterodera glycines
  misc_feature (24)..(24): n is a, c, g, or t
  misc_feature (67)..(67): n is a, c, g, or t
  misc_feature (96)..(96): n is a, c, g, or t
agttcagatcttcaacagcacatnttaaatgcaaattttttgctatttcttcaaattcaaatcactntaaagggcttgccgcataattcttgattntaacacagaaaagcctaaaggtgattttgtgctttcggctctgtgccaaaataattcactttttggaaatccctcgggtttgaaccggtataaaaactatcagatggcactttgtccattttttcaagttttgaaccggttcaaaaccggtttaaacgctttgctcagttgcccgttaaatttttaaaagacttaatttgctctttattctaattgattgggacagcttaaatgtcaaattcgcttattcaaaaggaaattgagcgatacaaagcaatgtaaatttttattaactccactttcaatgttcattatattataattaaacaacgcttttttcaaggctttaacatacaattttataagtgcctattaaaagctaaactttttttaggtatgagcgcgaaagggaacaatttgaagagtttcagcggtacagcaaagaattggagtccgaaatggaattggaactgaaacagcgtgaccagaaaatctcggagctcgaatcggtgaagcatcgactgagcaccgccttggaacaactgaaggttggaaagagaaaggaaagcattaaattttaaatttattctttttatttggtcgacggaattaattcttcatcatttcaaaataatttaaattatcgaataataaaggaacataagttttttggtactttcctattatgatgccacacccaaaaatttcaaaaaatcaacaaaagcgcgcgctgcaaaccctgagaagctggtcaattagacgaaattttatcttaattgttgcatttatgcctccgatctagtgttacgtgcgccttgtttgtgcgtccttttttaattttttggatgtggcctcaaacaggaaataccgtttttttaatcaaacctttattcagaccaaaagtgaaaaggaccgacacgagcatcgcacaacggaggaacagttgcgaacgcgactgctcaattcggacggacagtgcacggaattgcgccacaaattgcgcgctgtggaacaacaaaatgacaatttggagcggagggaaaggtttctttttgagggtcggttaagggacattccttttcaattagagaaaagcccacagaaccaaacactgaacaaaactgaagactttctaaacaggagattgatgcatattttctattttttgccccttttctcttggaaaaaaatattcggcgctacttgcaaagaggagtcttttgaaaattttttcaacctttttttggtcaaaattttttttgtttttttacacataatgatgaatattaagtattaacagcacaattatggtgaataaaatgtatattcacgatttttatccaaaaaaaaattacaaaacaaaagggcccccctatggtttttgataaaattcaaaatctatcactttataactagcgccaaatttgcttaataggcccaaataattgtcatattcttgatca

SEQ ID NO: 23636 - DNA, 1082 bp, Heterodera glycines
tttgggttggatttttcctccccataattgtttgagtcccccaaacggacccttgaaaaaattgattttttttgttttcggggcagtccccccgaaccgatgcgcccagatttatggggagaccgaatccttcgggaatagcttccctatagcctgtactttaattctgcgttggatttttgctccccataattgtttgagtcccccaaacggacacttgaaaaaatcgatttttttgttttcggggcagtccccctgaaccgatgcgcccagatttatggggagaccgaatccttccggaatagcttccctatagcctgtactttaattctgcgttggatttttgctccccataattgtttgagtaccccaaacggacacttgaaaaaatcgattttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttaattcgatcactcatattttttgctaattgagcagaagcgtaccaaactttgcagggatttttgctccccggtaaaggactaacttacactgaaataatggattttttttgttctagctggctcaaaaaaattttcgaaaatctgagt

SEQ ID NO: 23637 - DNA, 729 bp, Heterodera glycines
gacaaggaagcagatagattttggaattggatgcgggcgatggccaacgatcggccattagtggcattgaatcgaagtgaattttgttgaaaattgagtttttgttcgtacggttttcgaaatgggtcgaaattgatgccggattcgtggtcagagacaccgaaaacctaagaaaagatgtcctacctgactctcaaaatcgtttccagattatgggggacaaaccatgaacccaattgtgaaaacattttctaataggtatccatttcattcataccgtcgtttcattttcagcagaagttgattccatttgaagataatatttcaataaagagatttataatacaactaaaaaagtcaatattacaaagactgaatagtatttcaaatatatatttttgtaaataaacaagtgtgtaaaagcagagttattgaacaatagagatcacaaaaaagaaatataaaagtgaaacaattacataaaacaacgtgtacagttaggcaacataatccaatggacgattaaagcctcccctcctgttcatatattgacgatatttgcgcgcccggttgatcttcgactcaccagaggcatttccctcgacatgtttatttttagttgtgtcaaaattagaaaaacccatcattcgcatcatgtcctcatcaacatcgacaatttcattaatagggttagactaaaaacaattgaaatgttcgtacaagcttcac

SEQ ID NO: 23638 - DNA, 1182 bp, Heterodera glycines
actccaaatttagcgacgaaataattgccgggaaattggtaatcgcttattcaactcttagaaattggaaaaaggaaatatttgaatttttcatgtttgacgtattgtaattgaattgttttatttcgacgttttttgtgttgtgtattttattcttaaaaattttattatttaaacattttggcgcttcaacaagtgtctaagctaggtaatgcccataagtctaaaaaacaactaaatgtccaaaattctaaaataaaaaattctcgactcgagaatcgagactgcaaatgtcgagcagccttattacctacatttttttaatttaaattcaaatttttaaattattcttccctattaactgtttgttaaaaattgattaacaaattgatgaatgctcagaattagggccgaccaacttattggtcatttttggtgattaaaaatgaaaccctacatgcacaaccttatatttaatttaaaaaaacaaaacaaaaaaagaaaaaaaagcctgaaaatgatttttcattttttttatacaaaattttaatggattttaattatacaacaaaaaaaaatttgaaaaaagtctcggtctcatgttttgaatcgagaaaagtctcctgtttttgggtctcgatatctgtctcggctctctgcatcgtctgtggaataaaggaaatttgttcaaacagtaaggattttatcattatttctaatgaaattgtaaagcatacaaacgaagatgggaaaaagtaatctggctaatgcattttttaatattaaggtgatttaattatttttattcgggaccgaaaattttttagaataatgtgtatttaaacatcaatttaattaaattttaaaatatttataattaaaaattgataaaaaaatcataggaaaaaacaagatttttgatttttgcactttttttgtgaagcgcccaaatttcctttcttctaattgaagaaaacaaaattggaaaagctaaaaggaaacattcgaaaaacaatttacaaaggtgaaactattcagttgaaaaacatttaaaatatatatatatctaaaatataatactaacaacccccccccccccagggtttaaaatggggatggacactaataaaaaaagcccaaaaggtttgttacaagctaataaattaatttaattgtcaataa

SEQ ID NO: 23639 - DNA, 1256 bp, Heterodera glycines
catctattatatctttcttcattctacaccatattaactccgttctgttgataaaggaatttgaagttttactggattgtgattttaacacaactttacgtctaagattataagggatgtgaccagaaaattgtgggaatatgtcttttttaagataagtgagaccattaatgattttgaatgcctgaactaaatcaattgtttttctcctttcttctaaagtttgaataaatcaagtctttgtttgtaaggtatgtaaggaagtctgcatttaaataatgcaatttttgtaaaatatttttggcatctttctaatttatttatatcttttttgtttgtcggattccaaatttcaggcgcatattctaaaagaggacgaatatatgtcttataaactttggtccaaatacgtatagagcgggattttaaaattttggcaatattgcgaatccttaaataagcagctttagtaattttagtataatgattagaaaatcttaatttattatcaatcaaaatgcccaaatcactaatagattcaacctcattaataatattgttaaataatttatattgttgttttgaattatttttgccaataaataaaataaatgttttattttgggagatgtttaaaccaaatgcattagcccattttccaatattttctaatgcaatatttaatttgcttctttcatcacgagttttgtaagagacataaattttgacatcatcagcaaaaagcttgatgctaactcccgaagggattacctgcgggaggtcattaatgtatattaaaaataacagtgggccaagaacagaaccctgtggaacaccggactgaatcggatgtaaattagaagatttattgttaattttaactctgtaaaacctatcccttaaaaattcagataaccaacttagcagttttcccttaatgccaatgttatgaagtttatttattaaaatgtttataggaagggaatcaaaagctttccgaaagtccacataaatacagtcgatatttttcttaccgtattgtcgtaccaatcttctaatactgtaattagttgagtattagtaattaaaaggtcagactcgagaattcgctgaatgccttcgtaatacgaccgacacatttcattcaaaatgtaattttgtcattttacattttactgcatgtcaaagcactgtttttggtactaatgtcgtttacagaccataaaaaaatagtttttataaattatacatttaaa

SEQ ID NO: 23640 - DNA, 1660 bp, Heterodera glycines
  misc_feature (7)..(7): n is a, c, g, or t
  misc_feature (22)..(22): n is a, c, g, or t
ttatttntgccgataaaattantttttgccccccattcattcaaacagcagcagcattcagttcaattcaaccttatttttaaccttggacgagaagaatgttgcgacaacaaagagctgtgattttttgaaaatttttatacccatttgatttttttttgtacgtttgggggtctatcaaaaacaatttctaagttcattagagacattctccgttccttaaaattttcaaatatttacttacgcttaattccccctaaaagtccttatttcaaggactgcctttgaatttcatatcccagaaattgagccttcagtgcggagggagtgattggcgattcttttttcaacttttcatctaaaaatagcaattaagctcccggtagataggtgcgcgcgcgcctacttcttttatctcttcatttttgaattttttgttgtttttttaactaattgatccccctaatatttgctaaaaggtgactgatttttacattattccaatttaatgcaatttttctcctaataagaggtcaataaagcagatctatgcgcataccttttttatcccttaatttttgaattttctttaacatggtcgccaaaattttgctaaaaatgtgtaatgacttttaaattcattcaagtttaatcgaactatttgacacctgctgctactgctgataggattggattttgaattcgttcatttttgggtggtccaaatttaattggcccgccaaaatcagtttttcccttttttttgtccagcaggcagatggctgctatataccatctcattatatatgtgtattcagcgctttcactattctattgtgttggataaattacattttggggtaattaagtgtccattcgttttatcgccctctttctctctccactcatccaaaaattcaaaataatttacatacctaattagaaaatgtttttacctttcgaaaacaatatttaaatttataaaatgcaattaaaatgaaactgaagaacgggtatttgaaagattttttggggggggggggctttctttaattaggggcactaattagtaacatgcaaaaagacggatttttttttgaagatttgaacaatttcgttttctgttctatccaattttgtttatttatcacggagcacagctagaggaagaatgagtccccttcttcatttgtcctagcctcagacaaataaaaatttttttttccaaaaaatatattttccacggccactccaaaccgcctactttggtgctatcatattttaataggcaaaaacccgcagaaaaattaaaaactaaaatcctcgccctaattaatacgaaccaattaatttttcagaaaaattaaaaactaaaatcctcgccctaattaatacgaaccaattaattttttttctatttagcattcaaaaatattattaaaactgagaattttatttttggttgatctgtttattttggttttccactttgttacctttatcggtcttatgcataaaacaatttgtcatcacgtccgactttgtgcttttgcatgacggcacatcgcccacaataaataaaagttctgtccttgattcccgaccctaaaattgaatccctgctgggtcggcgtgctttgttgtcaagtttatcttatgc

SEQ ID NO: 23641 - DNA, 1031 bp, Heterodera glycines
tttattataaggcatgataacccgaaaggcaaatgaccctttagggtgcggagtgacgctttcgctggtcaatgcccgcatcaaatcacgcgacgcgggcccaacgatgtccaaagcgatgaagttgttcgtcacgtccttcagaaaacattcattccattaaatgccaattttatttatggcatcaaaacccagagtagtcccccggcatagtttaccccagaaaaacttttcaaaaaaattttcggcaattttttggtaaatttttgaaaaatttaataattcatttaaatttaaaaaaatcatttttgttagttctaaattgtccaatttgtccacctgtaaccgcacgtccatcgcccactcgtctgcccaacgttgaatccaaagggccaaccgaacttgttgaacagtgggagccacgatgaaataccttggaacaagaggaaatcaaatcgatggacattttaaaataaatgattcttacgaatcattgcccattcggctgaccgttgcatcggacacataactgaacaaaaagaaacaaaaataaagatggacgaagctcaatgaaaaagacgatataacacaagaaattcttggtttaggagcgggccgagacgacccaggggagaggataaaccgggtatttacacaaaaacaggaacttttgaacctgtactccaattcccgccccctctggacaggtcggctttgtaaattaaaatggcacactcacccgccctgttcattatgcattccggtgtaaattgtgctaaaaacagtatctcataagcaaaaatcagaaatcaaaaagtcccacgttccgaccgcacggtcaatgttagcagaacagagcttttgcagcaatggaaccacgtcagggccactgatgtcaaacttggcgaagctggtcatgtcgatgatgcctaacaatgggttcgaagcattttagatagtcaaaattagaaaacgggtcgcaccaacactttcccggcacgcctcgtactcacgtgccaccatcggaaacc

SEQ ID NO: 23642 - DNA, 82 bp, Heterodera glycines
cctgaaaggcgcgatcggtttggcgccgcgcgccggtgccgctgtagaaatccaccagcggcacttccgccagcgcctgcag

SEQ ID NO: 23643 - DNA, 938 bp, Heterodera glycines
  misc_feature (932)..(932): n is a, c, g, or t
aacattaaatacacgtgaaaaatgaaatgtgatcgatcaattatcgtcgggaaaggggcgacaataagcaaaagggaaattaaatgcgaaatgaaataaatgtgagaatgtgaaattcatagggcttcggccggcaaacaagaaaacccggatctaccttacaatattatggtccccaaaaaatacaagacctctttattgagtagatactgagcttctcgaatgtccgtcattactgtttaggcacagccctaccgtatctaaaacagtgccaggattctgagaatcgaatgcggtcagtgttcaatttcacatttgtcaaatgggcggatgaatttgcccattttcgtgtgattaaagattatggtggcactgctgaagaagcatatcccgaattataaggtgctcctttctgcacaaaataaagaagaatttgttagacttttgtattatgcccaatcgctttgtgatcaaatcgccaatgaattcaaaaacgaaattttttcggcagaaaaacaattaagcaaaactgttgaaccaaataatgcagttgtctttctcatttgctgcacggattcttttaagtttttggtcggtatttattcaaatatataaataatagttattataaattattaaataaccttatttttcaattacatacaaattcatttttgcttattccatatcggacagagcatcaatcgcataattaagaaggagaaactcgaaattcaacctgtaccaaatgctgggcagcccttggcaatctttgaatatttttgaaagttgaataatttaaaaataaataatattaattacttaattttacccagaaggtatgctcttggccatgctggaagaccccctttgtttcccgattaacacatggaatcatcatgaaagcgtcttaatgacatgggacgtacaancaacgt

SEQ ID NO: 23644 - DNA, 1446 bp, Heterodera glycines
  misc_feature (441)..(441): n is a, c, g, or t
  misc_feature (1348)..(1348): n is a, c, g, or t
  misc_feature (1361)..(1361): n is a, c, g, or t
  misc_feature (1410)..(1410): n is a, c, g, or t
ttcggcttttgagttaattcaattggttccttttattaagcatgtcaaactttggcttctcctctccccccccccccctcccgttttttgctcatcgttcgttttccgttcgttcgttacatttatttacttttctattgccatccgacatactttttcttcatttcaatctcttcgaatatttcaatcattcaatgaattctaagcgcaaagcttttgtttatttgtttttggcccaattcttccacgatcaaaggggggggggaggcgaaatgggggacaaagggggaaggtgggagggggaggggacacgcgatgattgtgtgagtgggtcaatttacaaacgaaaagacgaagaaaaagcatggaagaaaattcaaattaatttaaaaaaatttaacaataatgaggatcaatcatatgatcattattataaaaatncagagtgtttgtaattgggcccaatcacttactaattaattggttattgaacccaattaatttactaattgatcaatgaatcaatttgcattaataatctcgttcataagctaatcatttatcaccaaattgttatttaatctcaaacgtttaatttgttcaaatattttccatttttatgcgctgtattattttatgacattggcagaaaatccgtaaattattttgtttaaatttacattaaatcatttttattaaaattaaattaaaaatgcatttttattaaatcatttttcttttcttttgcttcattcgcccattaattaaatattttaccgtttcttttattacatgttattattattagtaatattaatttttttgatcaattttcgccttgcatttgcgcgaacgcatataaaccacgggacaaagcaaaggaaaatgacaatttcccccccccccctttttccattcattcgtccgtttttatatttcattttatatgtccaattaaaatttgtgcatttatttccgattgtcaaaatggcaattaaaattggccccgttcgttcgtccgctgattcccccgaaattgcaaattccaacaatttccgccgtttgtccatcttcgaccgaacgatcgaatgcaaatcggccgatcagcttttaaatcttatcggttttaacttaactgaatttcggaaattcctaagtttaatagggcccaaaaatccgctggtccttttcgtttggattgccatggctttggtttgggccgttatggccatgccaattatgtgctccgcctttctaatggacgatttttgttcgtcacagaaaacaggagacaatggcactgactctgtttgttccccgaggccgggcacagtgacagccgacgtanagcacatccctgnggcgggaagaagcatttggcaattcggcataacatttagtttaatttgngatccagtcggagttacttggtggacattgcaactt

SEQ ID NO: 23645 - DNA, 1184 bp, Heterodera glycines
tattcatttatccatctgctactccgttaatctgatcaaatcccttctaattgctccaccaggcgagcagacggacgcggaattctgccaaccggtggccaaactgcttcaaaatgcgtgcctggtccgaggacagttggtcacccgtcttgcacacagtgaactcccccaaaagctcaatggtacctgtcgatggcaggctttatttcgggggctctaataggggagggctctattcctcaacccccctcaaaaggtggtgctttatttcagagggccctaatgcagggaacgactcgatccctcaactcccaaggggggggggggctttattataggaaatataatatttatttaattaattttcattgttattaattcacattgaaaagattgccctgtgcagtaatattgcgatgccattgtttgtgttgtgcaacggcttctactctgtgcaacaaaattgtgacgttttttgcacaccagatggtctaatgccaattaagaccttcgaaaactcgtattataagcaagattcagtgtgtgtgaattttaaattatttttttattattaccatttaattgaaaatttttgaaatttcaatgccatggtaatgggtgacaaattgttttgtaaggccattcagccattcgtccgtttaaaactgagcaatgaagaatttgtacttattcgcgcaatcatttactcacatatgggtaagctaaggcctaaaaacattataattaatgagttaaaattaatctggattaaattctaaccgtatcgattgaatgcagagagagtttagccttttttaccttttcatagaaataaggaattaaacaattttgatattattaaatggcattaaatattttctataagcatacaaaaattccaaaatttcgttaagttacataaaaattatgaataaaaagatttaagaaaataaaaactacttttccgaactttgttgaccgtaattgaataaaataagattttcttaaatttggttgtttccaagaaaagtttaaaagcttaaactgtgccgcactcaaatgaccccccactttttaaatgttttattatttcaagtttcgcctgggcttagtgatggggcacaaaaattgttgtacagtgaagcggagaaatattcttcagtgttaatgagtgttgtgcaggt

SEQ ID NO: 23646 - DNA, 1200 bp, Heterodera glycines
tgcgccgcgacactttcgccgcccagtaaaaatagacatttgcgccgcgacactttcgccgcccagtaaaaatagattgcgccccgacacttgtgtcgcccagtaaaaaagaaaaatagacatttgcgcgtcgacacttgcgccgctagacatttgcgccgcgacacttgcgccgcccagtaaaaatagacatttgcgccgcgacactttcgccgcccagtaaaaatagattgcgccccgacacttgtgtcgcccagtaaaaaagaaaaatagacatttgcgcgtcgacacttgccccgctagacatttgcgccgcgacacttgcgccgcccagtaaaaatagacatttgcgccgcgctagacatttgcgccgcgacgcttgtgtcgcccagtaaaaaagacatttgcgccgcgacacttgcgccgctagacatttgcgccgcgacacttgtgccgcccagtaaaaaatagacatttgcgccgcgacacttgcaccgctagacatttgcgccgcgacgcttgcgccgcccagtaaaaaatagacatttgcgccgcgacacttgcgccgctagacatttgcgccgcgacacttgcgccacccagtaaaaatagacatttgcgccgcgacactttcgccgcccagtaaaaatagattgcgcctcgacacttgcgccgctagacatttgcgccgcgacacttgcgccgcccagtaaaaatagacatttgcgccgcgacactttcgccgcccagtaaaaatagattgcgcctcgacacttgcgccgctagacatttgcgccgcgacatttgtgccgcccagtaaaaaagacatttgcgccgcgacacttgcgccgcccagtaaaaatagacatttgcgccgcgacactttcgccgcccagtaaaaatagattgcgcctcgacacttgcgccgctagacatttgcgccgcgacatttgtgccgcccagtaaaaatagacatttgcgccgcgctacaaaacccatttgcacctttcatttaaattttaaaatgatttatttaaacgagaacctaaaatattaatttggcttattaaatcttcatttttttttgttttccatggcaccaaatttgccgtttctgctaatgcacgcattgataaaaacaaagaaatacgtgttgtctatctttgtgattaggtgtttttttgcatttcttttaatttc

SEQ ID NO: 23647 - DNA, 1267 bp, Heterodera glycines
  misc_feature (24)..(24): n is a, c, g, or t
agttggcgaaatgtccgaatttgncttagtggcgagctcggcatgcaaataacgaatccgaaaagcattttttgggtaatgaaacgtaaaaaaagaaacttctttcttttttggccattattatctattagctttacagacgtacaataaatctctcaatccctggacaataaattgtaaaatttttaatgtaaaaaatgtaatttagctttttaatgcttagaatttattggacaaagaatcgatttgcttattcaaatgtcattcacaatgacgcgttaagtattgagcaaattaacatgtaaatatttcttacattataataaaaaaagtaataaatgtagaatttttataataagttttatattaaaatatgttttttgcttcaaattttatgaatttttaaatttttcttctaaaagcattttaaaagcatcaaaatttgccgttagatggtatgcatgttaacttattttctggttatctctagagaccggataacaagcgtctgagggatcccgtcaaatccaattcccgattaaccccaaagattcatggaaaacgatcgggaggtatcccgaccaaatcccgatcctgattaatcataaagggtttagaaaaacattcggaagggatcccgggtcaggatcccgtccaaatctcaatcccgaggctttttcgcgatcccgcgcgggataatcgggcttgcttcatttcacattctttcccgttcggtctttaggtatttattactctatttttaaaggattttaatttggtttaaaaccctttgtttttggctttagccgaaattctttaatttaaaaagcattaaaaggaaaaaagtgtgtccccataagaaaagatcttcaaattctcaaagaatttaatttttaaaagcaaattttcttccattaaaattaaaattttatgttgacatattttaatatggggtggagtcgttatttaaaaaagccatcaatatgatttgatgaaaaattatttataacttagctgaaaagcaaccaaatttttaattcttgatattcgatagcccttagtgttctctataagtctacaaaattttaaaaaatttcgttaagtttcaaaaaaattatggctagaggaactcaaaaaaccttggtttttgagcatctttggccctaattttttttaaaacttaacgaaattttttgaaattttgtagactgatagagaacacttaggactatcgaataatatcaagaattaaaaattttgttacttt

SEQ ID NO: 23648 - DNA, 921 bp, Heterodera glycines
tctagagtcatcgcacatggcatgtgaaacaattatcggctaaatatctccttttacggaagttcgggatatactccattcatcgccagcaatttcttcacatagccgtccacatccagcttaaaataaatcgcccagtatagtacagaagtccttaataaaggcgatcccaagtgtctgcgataatctgtgtaaccttcataagccaatttttctgggttttcatcaaatttctgaatcagctgcacaagactttcaataagtacagtcgcagctttctttctgttgccgtgtttatcctacacatcacatcagacaaactatacctaatacaatatttacctgcagtccacaatggtctaaaggaaaccttccttcattatccaccaagtatgggaaccctttattctctagcagcttttttatagcttcagtctcaccgtagaaagaacaccatgtcaggggggtccataacgtagtatcattctttttgttcgggtcagctttattctgaatcagtgcctggatacactgaagcttatacctactcgtctggtagttatgcaccacacaagctgatagcagtggtgtatttccgaacttatcgatagtatcaacataatgacccagtccaattttttcagcacgctcacacagctgagtcacgagactgtagttctggtccagagctgctctgtgcaaaactgttctagcatttttatcgactctctgcagatcctgatattcggcgtctctgtcgttgttcagtgcattgggtgactcaatctcttgatttaaagctaaatttgaagggaattgttgcatagagagagtaacatgatcgacatgatcgctgaggcctgaggattctcttgcggagcgcccctcgggaacagacgataggattcctggagagtttcc

SEQ ID NO: 23649 - DNA, 819 bp, Heterodera glycines
tcaaggacaaaattctatacgcaagtttgaataacttaattgagctcgctggtgtcctttccaacggcaagcccttcaaggatactgagctttggaactcccttgttaaacaattagacgctaaattcgacagacccggacctaaatatgttcaatacagtggatggaaccttgtctcctatgagttggaagccgctgaagagaaagctcctcatgatcctgcaagcgagagattttgggctgaatgtaaagatggcaccagccactatgctatcctcagacatgaaatcagagtggcttttgacagaatcagaggcagcttcttgaatagagttttgcaaagagaaaccagaattgccactacccttgataatttccaggaaagacttgatagagaaaagttgagaaagagccttgaaggagctagaagtgcaggcattaatgttgattcagtgatcggaaaattgagagcataagatatatgaggaggactaagtgatcttttatatatacgtattgattgctttgaatgaagagtatataattgcctaccttgaagcaaataaggaaaaattcaactacaatcttttgaaataataagaatattgaataggatagtgaaactgctgcttgtttacaaatgagtgaagtaattggtttggaattactggctagagaaagaataatctgctgaaagatgaagtcgagttaaaaaaaacacttttttagatacgaagagataaacgcaattttttgctccttcaaggcttcaaaatactagtgagatttttttcggtgaaaattttcttataatcgatt

SEQ ID NO: 23650 - DNA, 1415 bp, Heterodera glycines
  misc_feature (1347)..(1347): n is a, c, g, or t
  misc_feature (1406)..(1406): n is a, c, g, or t
ggctaaaaaaagagatgcgcagacagggaaaactaacgctttctcagtgctgtagctgaggggtcaaatagtactagttccaccccaacagactccttttcaccagcagctgagcccgcaaacccagacaaagaaaatgctaccaatagtaaaaataaccaccaacaaaacatcactactactgccaccgctactttatcatccgagacgccagctgagcaaattttagcagatcaagataatagtattgctgagaaagacgaagcaggtacgccgccgccatcaagtggattaggacagtccggtgatgctgctgctacatcagtgactcaagttgaagatggtcgaaatttacctcaagcagccgcgttgacctccaataacccaaaaattgttgctaaacaatcaacagtagcgacagatagaaggaaagagaaaataattgaaaagctgatcgacgaacaagtggaccgaatggtcgatggaacacatgcacagcagaagatgctacaggaagaaggtaaagacaatgagagtcaacaccgcatttcaacatataaactcatcgaagaagtgctacatggtgagcatggacagctaatgtcgcaacagcgcgaatccaaaatggcagctgaatttgcgtacaatgaaataactcagcgattcggcattagaatgggcccaggagtaatgcacgttgatttgagcaaacagctgtcctatgtgttggggtttgatcacaaaacacgcatttacaacaatcagtcggcaaaatatccacctgatctgtctggtggtgtccgtcagctgtacgtttacgcgcctaaactggtggaggattccatcataggtgaccgcatggcaccgttgctgcgagttgtcaacgtgtcagggacaccagggttggacatgccagaggttatatataccaatgaaatttttcattctctccaaaacaaacgcatttctgaaattaacattgaaattcagacagcatttggacgttacgtaaaatttggttggggaactacagtaatcacattacattttagacaaaaactattttagcaaaaaaaaacgatagttatgacgcacgttgtttttaacccggacaacgtaaattggtccgcgttccttgcgttacagcagcagcaggagggaaatggcgaacttcagtattttgtaggcagtaaatttcagcgtggtggcggtctgttacaaaatatttcgcggttcctgatgcctgtagccacaaaccttctaaagtctgcctcaaaggagggcatttccgcagggacacggatgcttgacgatctcgcgcagggaaaggcgtttaaggagtctctncaaactcaggctaagcaaggatttgagaatctggccgaaagctcaacagtgcggaaggntgggcggca

SEQ ID NO: 23651 - DNA, 1794 bp, Heterodera glycines
ttgatttttcggccatgaaaaaattattacccttataagtgttaaaggaggcatattttcatcggatcatttcacacaatttttcacattaattactcctaaaacaaagatcgtaaactttcgttggttttgtccatcgaatgtgttacattttaatatagtcatagcatcaaggctaaatgccttgtcatatgaatgctttagcataaatcaaaaatattccgcctttaacagtatgttgttagaaattttaaatgagtgtattccaataaagcgtttaaccaagaatgatttgactcctaaatacccacaacatttattagcatccatcaaagaaaaggctaaattattcaggcaagctaaaactgacccatccaaaaaagcactatacgatagcatttctttacatataaaaatacaaacaaataaataccatagccaaattgagaaaaaggctatttcaaaaggaataaattcaatttataaatatatacaaaaattcaatgtcaatccctttgaaatacctaatctaatttatgaaaataaatgctatcataatagtgctgagaaatctgaattatttgccacattatttgccaattcatttaataatagtgaaaccgacccaagctatacatgcttgggtaatattatagaaattgatcaatgctttatatcggatataaattttaacatcatcgagacccaaaatcttctgaaaaaacttccgaataaaaatggcacttctcccgataatattagctataaaattttaaaaatttgccattcttctctgtcaactgttattactgacttgtttaggatctcattagacattggttcacttccagacatctggaaagaatcaattgtttttccgcttttaaaaagggtgacaaaaataatcccgaaaactataggccaatttcattaacctgctcactctgcagggttatggaaagaattttaagcaaaaatatttacaattttctattaaaaaacaaaaaaatttcggaatttcaatttgttttgttagaaataggtctacaacgagtcaactaataacagttgtggaagattggtacgaggcaataataaatgaaaaaaatgttgactgtatttatattgattttcaaaaagcatttgactcagtgccccatgaattacttttatacaaattggaaaaaataggtataaggggcaaacttttgatgtggataaaggactttttgagtaataggacttttcgtgttaaaattggggatgatttatcctccagtaaaaaagttggctctggcgtcccccagggctctctgtccttggacctttattatttttgatttatattaacgatcttcctgatgctttgccatcaggagtgaaaataaaattatatgctgatgatgttaaattgtatatttgttataaagcaagaaccgaaacagaaattatgcataaagcattgcataatttatcagaatgggcaaataaatggcagatcagaatctcaattaaaaaaacttttgtacttcatttggggaataaaaaccccaaagaaatatataaaattgatggaaatataataaatgttgtggatacaattagggatttaggcataaatattgataataaattgcaattttccaatcatgtcacacaaataataaagaatgcatatttacgtatgcgttctttatttcgggttattaaatcaaaatcttctaggatttggattattttgtacaaaaccgggggggggccgttattggaatatgctcctgaggttggaatcca

SEQ ID NO: 23652 - DNA, 1280 bp, Heterodera glycines
atgtcgcctttaaattttgaaaaaacataagcctattaaaattttgaattttgaagccgagcatgcactagcaacgaagtcctttgcgcgaagcgctcatgtaatgcatattcttttcatctctcacaagtatactgtctacaccgagcaattactgtgcaaagccaactgtctacaccgagcaactactgcgccgccacacgctagtttatattaccatagagaaaaagggggactcgtcttaaaaactaatttgagtcgaacggctgtcgggaggggtctgaaagtagtggaagggtcttacaactttttgaggcgcatctgggaaaaatatgggttttccgctccggtggccaactgagtcccggcggctaatttctcacttttgcttgcgtttgaaggcccgtaactttttttctaaaactctgatcaaaaaatgcttgctggtaggattttaagttgaagtgttttctaattttcaaaaaaaattccaggcctctacctatacttggaagggctgcagaaattggcaacttttcagtaccaactttgcccagttcagtccccgttgaataactcattaggctttgacctgagcgcagggtggccagcagacttattgtagagctcggtgagctcgatttttccagattttaaaatttcaaaaattttcaaaatttttcgagctaggcctaaaaaacggttttttggtttttgaattttaagaatttttaacgaattttcccagagaaatggagaccacttccaaaacatagtttttcgagctctatcgactggtattttttttggaaaaatttcgattttttcccggaaatagaaaaaatttttggcctgagcgggacatttgagtcccgggcccataactcgtcgggggttggttttagccaaaaatggccttagggcaaaattgtagagctttttaagctctatcgaatggtgtactacatgttggaaaatttcaaaatttttcgagctaagccccctagaaattttcgggaattttttttcgacgaaaaatgggggtgaaaaatatttttctggggtaattttggggggctgacaacgaatatgatgcaattttaagtttcataatttttggaaatttttaaaaattcctttattttttgggaaattttttggcccccccggatttttgggggaaaattggaaaaatataaaaaccccggggggagggggctctcaattttaaataataaaaaaaatttttaaaataaaaaaaaaaaaaaaaaaaaaaaaaa

SEQ ID NO: 23653 - DNA, 1970 bp, Heterodera glycines
atcatggaaagttatgcccgtgggtgcgaattgtgggtcagcggcaagttgcgcggtcagcgtgccaaggcgatgaagtttgtggacggagtgatgatccattcgggtaacccggtcaccgagtacatccaggaggcggttcgccacgtgcaaatgcgacagggtttgtgttttaaaatatggaaaaatattttgggatctatttgaaagatcgattaaaagggttttcgggtaccaaaaatacttttgagttagtttccaatgccatgcgatcccatttttctatttttttcgcctctttgttcaggcgttttgggcatcaaagtgaagatcatgttgccgcacgaccccaagggacagatgggaccgcgcaatccgttgcccgaccacatccaggtaaaatgttctacaaaaactgacacacggaaccgcataactcgggatggatacaagccggaggatctatttttgaaaaaaaaactccatacctttagattagagaaggacggagaatttgctattaaaaatctaaaattctggttttcctagacaaaaataaagttttgatacttttccctaaaattgttccttttccattacaggtcaaagagccaccgattgacgtcgcgccgaccacgccgtactcggagcaccgcgaaccgatgaccactggcatgccgccccagacacaaatgccgcccgcccatcagcagcagcagctgccgatggttggccaagtgccgtccccggcacagttttaattgtgaggaagaaccgctgatgatggtcatgatggaggagggggagatgttcaattaaaatttgttatttgtgtgtcatcggcacagaccacccatttttgttccgttaaaaattctttgttgttgtttttgttttcaatgatttttgttattgctgatgaagcatcgtattgaaacatgtctggaatatttgaaacaagaatatttcttggggcttgatttgactacttttgtccctcatgagcgttgggaattggcaaatttgcctcacttttggcccattgttttgggctgccttttttcgtacattttggttttatacgattgctttcattgttttcagtggtcacacattccgacgcaattacttcattattttgggattagtacccaacgcttttcttttgcagcttttgaacaatgagcggtggcatttatggcggaggtgtgtgccttccttttgcaatttatgttttttgagagtgtccaacatttgttgttcctttttcagatgacgtcggtgcattggtgttcgaccccggctcgcacaggttttgatgggtgatgggtgcgcaaattccgtctttttgtacgccattatatatggcaataattgttaaaaatttgcaaaatctcgactaaaattgcatttaaatgacaatttttccatgtcctcgcctggccatttaaaattcttttcatttcatcccctggaatttcacaaaattcatttctaatactgaacctacaaaattacatgattttccttttttcgattttcgtcatttaaccattatggttttgttcagtttccgcgtcggttacggtggcgaggagttcccccgctttgacattccggcacgggtcggcgtctgtcctcggccttccgccggcactgacgcgtcccaaaccgctgacgccacaattgaagaggtggcctcaggacggggggccaacgccagcaacaaattcgaccattacattggcacaacaaagctgaatgtgccccgggccggcatggaggtgaagccgtacatgcgggagggcatgggtaagcgtgttttgggggcttggcgctcatggtaccaacaaattggatggattgacccgtattatagttcgaaaattcagcgccggggagaaaactagtagtttttagccgttttcgctgcagatgactaattttacatttttgagtcaatttgcaca

SEQ ID NO: 23654 - DNA, 1995 bp, Heterodera glycines
  misc_feature (1729)..(1729): n is a, c, g, or t
  misc_feature (1850)..(1850): n is a, c, g, or t
ggggagtggaaattatttttcttgggtaaattatggtgctgatcacgattatgatgtttgtattaagtttcataatttttgaaattttttaaaaattctttatttttaggaaattttttggcccttggaaatttgggttaaaatttgaaaattcgtaactcacttctatgttggacgattttaatacaataaagcaattaaaatagagaaaaataaggagaattttatgggatttaattggattttctatcatgattttaaaaaaagtaattccagaaattctggaaattttcaaattttcaaaaaaaaatttatacctcggttctgaaaagtcattctggaaaaataaaatactacaaaaatccgcaattttttgcgctattatataaattttatttggcatttttatcactttcttacgaattgttacaaaaataaaagtgattttgggattctggaccaaaggggggtgaccaggatttttgatgaaaaaattttttcacccaaaatcttccaaaaacatgtcattagggctattttatgacgctgatcacgaatacgtgatcagatttaacttttgacatagtcaagacctcagaatccctgtgtgattggggattctggtacatgttctgagggggggggggcaggttcggaccctgacggtgtaaattatttttctattatttttgagttaattttcattacatttaatacatttaaatgttttagttttattaataattaataaatttttaaatttgctttaattatttttagagaataatgattttcatttacataattaattattattttttaattaaagaatttcagctattcttttaaaattgaatttgtcaaaattttttcatttcaatttaaataaatattcaattattatacatttcataatttgtttttgattaataaaagtgtattttattataaaaaactgaaaaatataatgcattcgattttttatctatttttaataaaaataattccttatttaattttaaaccatgttgtacctcttcctcacgtggttgtacctcttctaaccacctttgtacctctctaagcactgttatacgtcttttaatcactgttgtacctcttttaatcatatttgtacctcttctcatcacttttgtacctcttctaatcacttttgtacctattctcatcactattttacctattctcatcacttttgtacctcttctcagtgaccaggatttttgagtggaaaatttttctcaccaaaatcttccaaaaacatgtctttagggctatattagggttctgattactaatctgaaatgagatttcagttatgacatcgttaagacttctgaatccctgtgtgattggggattctggaacatgtgctaggggcaagttcgaatccggacggtgtacatttttttctatttatttttgtgttattttcagtgttttaaataatttaaaatagtttttgttttattaataatgaatatctaaatgtattttttaaattaatttttttagtttaaataataaataagaaattctttagatttatttaagcaaaactagatttaaaaattggatgcatataataataattcatttaaaaacaaaataaaacaaaagatttaaaataaattattccctttattaactaaaaaacaaaatttacatttttcgatcaaatatttctttacgtacgtcaagatatcgnattggtttttgttattcaatttctctgagtcatttttgtcacactttcccacccaccctttgttgttaaatcattaaaaacctcgattctgtcaatgagccataactttttatctttgcanaaaattttattcaatgtccccggttatttttcttatatcaaaatgttcatatttcattcccttggcttttttgtgaatttttcttttcattttttcagctgtgtgtgtaataatattttgaatggacatttcccccttttttgac

SEQ ID NO: 23655 - DNA, 1541 bp, Heterodera glycines
ccccccccccccccccaatttcttaatcgtttgttggatcgcttgccatttttgatttatggtgaataaaaaaggggaataacggcccccggacggatggatctttgcgtcgctttgcttttcttttgctttccctttttgttgtccgccgttttccattgcccccccccaaaaaaaatatgcaattttcactttcggccgggtgatttgtttatgtttttgtgatttgctgctctgtttttgtttatgggttcccaaaatctgtgccaaacaaagaaattgcgtataaaagcgttgggacggcggcagcgcaaaggcacacggataataataataataataatgagttggcatttgccattggcattttccaattaatttttatttttatttaaattactttcaatttattcagcatttttataatctttcaaatccctcactacgaaatggaagagccaaagcctgcccaaacgtcgtttttcctctggtgatttttggggttctgttgagggattggaattgaccgagcgattgtttaggatgaacgaaaacaggcacagattctatcagccggggatgactcaggcggacgtggcaaaggccgcaggtcgaacaaacggagggaactgaaaaacggatggtcatttgtccatccaaaattcaaatcccatggacctatccaagggcggtgcccaatttcccgtggcatttaggcgaggaatggcgtcgcatgtccagttccgagaaggccaagtggggagagaagtcggtggaggacaaagaacgctacgtccacggcaaaccaattaattaggcaatcggaccgtaataattgactctttcagaaatgaacgaacagcgcgagaaagaagaaggggaggaagagggcgaatgagaaagagcgaagggacagaagatgagagagaggacaaacaaacagaaagaatctttttggattccaaacttaattaatattaattggccatttcttttgccttttgtttctcaaataaatcattttgttaattttcaattggggacataaaaaataaaataccgtaaattctctatttgaaggccccttatcttaaacttccaaaatttggtcattttttggataaatcattaacaaatttgaactttcaattcaaaattgtgctaaaatgcgtttttttggcgaattcttttacataaaattaatttaaaaattcttcagcggcgcttggggatccccggttgggtcatccccgctctttctccccgttcccggtttgggtaatactggagaatctgggcttcacccaaaaaaaaaattttcttgtgaaaaaaatgaacccggggttttcggtgcttctgatcacgaatatgatatcaaaatttgcaaaataattgactttatcatttattttgaaaatcatatattttagaaattttgaccaacatggcagggcaataaatgttgattgtttatgtcttcgactgttctatgatcatctcattgattaatcaatagagatgatgcatatctggatgcctca

SEQ ID NO: 23656 - DNA, 2051 bp, Heterodera glycines
ggtcggtgtagggactgctcagtttgtccagttggactcgcttaagatggacaaagcgagacagcggttcataccattggaaaaggagcactaaacgggggaacaaacttaggaaatgaatatgaaaaaataaatattaaaaagtgaataagtaaagaagaaaaaaaatgaaagagtgctactgaccagcgtgaggaacggcacaacaaaggtaaaggttttcgtcattgatgctcctttccacgttacactgatagcaatcgctaaaattcatgaatttgcaagcaaaattggccaataatttaacacctttgtggtaatcacccaacttccccgatcctgggccaatcaccaagcaaatcttggtaggccaatctccatattcaactgaccgtgtctccggcattcgaagtgtgctcatcaatgccttcggtttcaacttctgcggcaacttgtccagtgatttggccaacttctgagtgatcaattcctgctggaacagctgcaacatctcatgtctgtacagatacggtgtttttccctgcagtgcggtgagtgtgtcgttgacaacgtaaagccaagtgcaacgacgctcatgaagctaacaattggacgaaatgacaaaccggcgaatcgaaatttaatcttcgacagagacatacttgaaagagggcttcctcctccgtggtgaggtgtgtgagatccattgcaaaaatgccctgctcggcaccgatgatcataaactgtttacggttggccgggtggaaatattgggcacaacaattgacatgaattggaatgttgtgcaatagggagacaaaacactgaaccaatgctgaaataattaaacttggcaagggaaaacgaacgaacagcgcccattgtgacttggggggttggcaccttcggaaaagcaatgaaagggtggagtttcataaggaaagggacaaccattccgaagcagcaggtcatcggacgggactggaatggctgatggatgtgatgccgattggcccacggagtcccatgggaaaaaggaggagccttcgaggaggaaatgcctaaaaaacacgaactatcatttacgaagcaacgaattgacctgtaatgttgaccatcgaagtcgattttgagcgtagtttaagccaacggctccgaaaggactcgtcaatgcgcgcgaacaatcggttcgacttcagttgggtggtcggctgttcgcttgccgaggaaattggtcggtgtgcccgagggaacagtccacgcaaatcgcgcggtctcctggccacccgagcgttatttggtggcgcctttttctttggcgactggtgatttacggtggactcttcctaaagggacaacattccgtgggttccaatggtcacccgttgttttcattgctccttttcggcccacctgctgcagtgtgtcgtctccgttccgttcgtcctcttcgccctgtgaggcgagcagtgtccgttccgtgtggtacgactgctgccgcgtgtcgtcgtgcccattttccacggtttccattaagaaaacctcctcgtcgtcagcgccaaaatgaaggcgttcatgggaggagcaagcggagcaagacgaaggcggagttgtggcgactgtgaaggcattcacccgctggtggtgctggctgacacgtcttcttgcaagcgcctcgaaattttctgaaaattgatcaagtgaaagagtgaaaagacggacgtttttaaattcaaataaaattggtttaaaaaaacaacttgaaaaatatgtatttttgagactcgggaatcccgtgcctcgttgttacaataattgaaaatgcgctaaaaacatgccatgttccgactcaaattccaattgttggttataaatcatctcataagatgggttcaccgccatttccacttcaatttgcaattgctcgtttccgtcagttgcatttgtttggtaaaaatgttcagggtgattcacccggtcgagcagttcacgtgtgagtcgtgcgctcagcaccccggaaacgaatgggtcagccttttttggttgtttat

SEQ ID NO: 23657 - DNA, 1552 bp, Heterodera glycines
  misc_feature (23)..(23): n is a, c, g, or t
  misc_feature (77)..(77): n is a, c, g, or t
  misc_feature (172)..(172): n is a, c, g, or t
  misc_feature (1502)..(1502): n is a, c, g, or t
tcagtcccgggtctgtactctcnagggatggttcccgcaaaaaaatctttcgatttcttccatttacagaccgaganggaatcgattgatatataatttgtacgatttggtgaactactacacccctaatttaccatatttctaaatatgttaataacaaaaatccaatatnttttatttaattttattgttacactaataatatttaatcgtatgtttttgtcagcatattaaaaggcaaaaatacattttaacaacttaaattttaaacttattattagctttgttaaatgtttagaattaagtaattattttaatacaaatcaaccctcaaatttactttgtctttaagttctcttttttaaaattaaatgcaattttcattaaatccagaatttagaaatatagaattaaaaaaataaaacttaatgtgttttattgagctttatatttatcataaaatttatttttacaataaagaatttaattgataaaatttcagcaccgccttacctcagttctttaaatgaattcccattaatatttctaataaattgattttcaaatttattttcataaattatccatttgttgattaaaatttaactgatatactaaaatctatataatcacacagttttattttaatattcgaataataataataaaacgtaagttggaggagctcatatagatagatgtaaatccaactaactacaacaataacgtaaaaaaccatgcgactgagaaaataaatctcacaaattttttaaaaataattttactcaatccaataagctgtctcacaagttcattccatttagggacgagaactatatggttccgtctttttggcaatataatttaataataaatatgaatagatgtaccatgtataaaataaataaacaattttttttaaatttaattaaaggaattaaatattgaaaaatactggcaatttaaaaataatacttaatattttgaaaataattttagaatttttgcgatttaaaatcaaaagggtcgaactagaactaacgtagaaagggaaatataacgaaaaaggagaagaataaaaaattggaaaaaattcaagaaagttaaaaaatatatatttaaacaatataataataaatagtaaaggaattaatgccaggattttaaaattgtttataggttttcgttaattcataaatacaaaatgccagaaagatagaagaagcgattacattttaaaagatgcataagaaaaacaaaataatatatgaaaatttctaaagaaaaaaattaattatttaaatttaaaaaaattataactatttattaacaaaatgtttcaaaatatctacattataaaaacttgattcctcctattctcttaataaaatgatccccaatgaacgagttttataacagaatgctattaaaatttcaaaaaaattttttcataaattataatataatctctatcttatttcgtcgtccataacaaaaacaanatttacatcaaaattattattaaattacataaagcccataaaatatgtaa

SEQ ID NO: 23658 - DNA, 1222 bp, Heterodera glycines
aatcaaagggtgggcctttttatttcttttttcacccattcatttgttgcgtataagttttcctgattttctggcagcacttttttttgcaaatttattttttacccaattcccccccccccccctctaaaatttcgctttgttacagcttctccaccgcgccattgaccgcgtgattgtggagccgatcagccgagagccgaacccactccgacagcagggcgcttttttgagactcaaatgcaaggttgggttttggcacggaaaacattttcgattttttttacgcatcccaccgaatttttaaaaatttttgccatgcttatttaatgcaaaattttttagaatttcatgcacctctgttttgaaatgaacgacctctccgactgtcaagcggtggcccgttccatcgagaagctctcaaatttgcgtagggttttctcttttttaattactgattttccccgaattatgaaaaaaaaagttttttacgttgaacaaccgcaaattgccattattttggtggcaaaatttcagcaaaaaaatggcttttttaaaaaacaaaggaatttaattttatgcaaaaatggaacaattattggcggcgcccttacaaattagcggccccttggtatgcccttgattcaccgccaccacggcacagatcggagattttgggacaccattttttggcactggaattccgcatttaggattttttttttgggttacggaaccccattccttggcacagatggtgttgcgcatgactaccccttctactaccggtgtccgtttgtcgtgttggacaacggctgggaggcgtacagcgtggagcagctgctgtttgcccgactccaactgcacgccagggacaagtggcgcatcagctcggtcaaccgtggctttgaggtatatgcaaagagattttggggaatggtatcggcaaaaaatgtgccaaaaaaacaaagttggacaaaatgccgacatagggacaaaaatgccggcacagtttccgaacaaaatgccgactaatttccgaacgaaaaggcaacacaatttatttataataaattttcttgacaaattccaacatattttcctttcaaaacgccgacacatttcaaaggtcaaataaataaataattgaaaaatatcgaccgataaacggtctaaaatggacaaaaaatagcaatggcactattttttggcacaattgctg

SEQ ID NO: 23659 - DNA, 1071 bp, Heterodera glycines
  misc_feature (42)..(42): n is a, c, g, or t
acagacgagcagaggcaaaggtaagcagggacaaaaggccancaagatggggacaaaacggcgacataatgaagaggacaaaagggaaaaatggtggacggacaaaaggggccacaaaatgggggacaaaagggaaaaaatggtggacggacaaaagggccagacataatgaagaggacaaaagggaaaaatggtggactgacaaaagggccacaaaatgggggacaaaaggacgacataatgaagaggacaaaagggcaaaaaatgagggacggacaaaagggcaacaaaatgaagggataaaagggcaaaaaaaatgagaggacaaaagttcagaaaaatgggggacggacaaaagagcgacaagacaaatcgtcatgccaaaatgggacaacaggggacaaagggacaacaaaagggcgacataatggagaggacaaaagccaacaaaaacgagggacaaaaactaggggacaaaagggcgacaaaaatgaggggacaaaagggcagcaatacaaatcgtcaaaagaaagatgacaaaatgggacattaggggacaaagggacaacaaaattaatggacaaaagggcgaaaaaatgggagacaaatcgtcaaaataaggggggacaaatcgtcaaagaaaaggacaacaattctaaaaataagtgttacgaattcaggcggtggctgtgaaagtcagatgtactactcgcagtggaagtacgtctacggcaatgtgtcgcgcattggcacactgcgcgagtcgttggcacggctcattgacggtcggtaaatgaatgttgccttttatcgaacgcggcacatgtcatgaaaaaatggaaaatgggctgaatttccccctcccaccagaggacggtcccagggggtggaggccctatatattttttccaattttcaagtatccgaaaaattttttcaaaaaaatttttttggaaacaaatcgcttaaattttgaaaaaaaatgtttggagacgtggatgacaatagctacacttttttaacaaaattatcgatttgaatttttggttgtcttttttttaacccctaaaa

SEQ ID NO: 23660 - DNA, 1733 bp, Heterodera glycines
ggtcctttcaaaattccgaattgtataattaaattaatttttgaaattcaaattttgaaattcaaaatcgaatactaaaaacattctcgtcaacattactcactcgcccgtggcatcggccgactctctccgatcaaattcagtccaaaatcactcgatttttactcgccaccgatcatcgatcagacaattttctgaactcagcgacccatcgggcgccgacaaacgtttggtgcagcgcagacaaaccctaaattcgggaaatttctctattttgatgcattagggaatttttaaaataattaaacaatatatgatcaaaaaccttaatttaaaaactaaaattcagcaataaatttttattttacccatttaaaaaaaaatttaaatctaaaaattcaaatttaaaatgttcgaaaattaattttttatttctgaaataaataatttcactcttttaaatcactaattaggggggttaaatttcaccaatttgagaaaataaaatggcccacatttgtaatgtcgcgcataagtgaaaccataacgaacacatcgccaacatactgctctttggcgatcaaattctttatttttattttatatttaggatattaaaaaaaaattttgacttaattttattatatttaattttcccacttttaaactgcccctttggcaatgcttccaaattgcgtacaaaattggcgcgtccgtgcaaatgccataaaatttgttcaaattgtcatggtcaatgaaacgaagctataaaaatttaaattaaattaattaaatacaattaaaaaaatttataacaattaattaaatttataaaattattaattaattattaattttttaattataaattaataataattaaatataataagatataaaaactaaaatcattttaatcattcaaaaaaatattttgttagattttttttctcaaagatggaataaaaataaacttcgtttattaaaatatttttaatttttcgtaatttaaaatttttttattatcactattaatctttttttttaatttattattttcatttagttatgacaaacaaattatatttttaataaaattaattttataataagtaaaaatattttaaaagtttttttatgtataaattatagtttcaataattaaacataaaaaatgaaaaaaattatttgttattcaatttgaaaaatttttattttttaaaatgaaatttaaaaaatggcatttcaatttcaaattttaaaaatgtatttttttcaattcacctttctaagttgtcctaactgtttggcatcgatgcgcactttgaccaaatatttgacaccaaacacaatctcccggttgtacaaaaaatgggcataagtgtccgtctccaactttttgttgttgctgcccaacgtcactttggtgccacctgaaaaaaagacacaattgaatttgtgccaaacatagcgccaaaacatttagttaaattttcaaaaatataccccctaagaaatgaaaattttctcaaaaattcatctccaaaacatagtttttatttttttgacaagaatatttgattttcaaattagctatctcaagtactgattttgacttaattttgttgctttttgatctttgtcattttaggcctctaaattcgaagctttttccattttttaagtgcctattttatggcttttttttcgaaccaaatcctagtaagtaagcc

SEQ ID NO: 23661 - DNA, 1093 bp, Heterodera glycines
aaccatttcaatttgagttcgggaaaacaaaggaaagcgacattgtcggaaaaaattacgataaaaaaaataacagtaaaaatgtcgaaaaatttagaaaaagccctctaccaagcgatttattctattcgcattgtcaaaaatttgtttgaactgaacctccatcgtggccatgtcaacaaaactgcggtctttcacatgcaaatgttgtattttgactgccacgtattcgtcgcttgacttcagcttggccctgtgcacttgcgcgagagaagcctaaacgaattcgaagaccactcagagatacggaaaacaaaaatgccattataatgtaaaattaatctttgttaattgtatagaaatgaacaattaggaatatgaaagtaaaacgcacagcgccacatggacgggagtcgaactcgtcgaaaacatcgtcaaactgtaaaattgtagtgagtgagtgaaacacggcaaaaaaaattaatttacatttttgtgcaaactcctgtagaagaccgtcttcatgtcgtccaaacttctctccggcgctttcgagaattcatcgtgtcgatgagcatcttaataacctacagtatgactcaaacaagtagataaaacactgagacatttttgttttttaattattgactttcggtaaacaaccattccgctacttcaaaaaaacaggaatcctgggaccttccctccccctcttcataacagcaaacgcattattggcttatattggcattataatccatctcagtttattaagcaatttttaatctcaaacttcgtttgaagaattcatcactccaatgttgacaattatttgttaccgcacaatacgcctttacaggcatgtttttgaaaatatcgtcgactgatgcatatgacagagagacatctttcctacggatttcttccatataatcaacataatgaccgaacctaaatcatttaatattcgcttactcccagtgaaaattaaaatttttcagattgaaacaaacctggaaaattttccttctccggaaaaatcgaatggtttcggcatttctttggagcattcttgacatttcactgttaattt

SEQ ID NO: 23662 - DNA, 1040 bp, Heterodera glycines
ttgcatgtgtaattgtagctaataaatatatgtgcatggtgcattttatgccgttgaccattaaaaacaaaattttcgacttgaaaatcgacccctccaaaacttaattttgtccaccccccaattaccgcttcaaattttcacatcggttgagaaacccaatttttttgtaaaatggaggccaaaatggcaaaaaatattaattttttggcgaaaaacggcgaaaaattttgtaaaatacaccccataattcgggatttcaaaaaaccaaaaatacacccctaaaaatcggactttttgacttcagccccccacccccaaagccaagggtctgactacgcccttgggctggacaatgattgaaaatagattttaaacattttttaaagaaaaccggcagtgtcaacactctcattcaaagcatcggaattggagggttaaggccgaacactctgctcttaagttggcccacgacagaagtgggcaaagacgaagtggccgactcggaatatcgaacattcactggtgaaatgaaaagcgagattgtctaaaaatgaatcagatcaaaatcacattgaatttccgatttaagacaaattgttggctggcgcggttaatggaatggcacttttggtggcgaagggaatacctgaatttccgagcaacgttaaattgagtggctatttggatgtttattggattgtccgagatggcggactgtgtgtgctgataacttttctgctggaacagaacgaagtttggagcagttgcaaaactcgaatcgttgcagtcgctcgtccgcaagaaaacagcgcaaaactgaagaagcaaatccaaaactacctttaccaattgcgaatcgatgccgaaattttggtggggggggggcggggggagtgatcggacggttaattttattcactcattgtcaggtgacaaaactcaatgacccagaactgtcgataaccgcttacgaacggactttgcttatggaggaaaggacgaaaatgctgaaacaaatccaacggcgaggaatgccc

SEQ ID NO: 23663 - DNA, 856 bp, Heterodera glycines
tgccatcgcaacgcaacaccagaaaagcaactctcgcgagacaaacatttgtggcatccgctgttacaggaaaaaaatgaacaatgggatgcgcaaagacaacagacgaatggcaattaacgaactcttagaatgaaaagccgaaaattcattcaaaatcattaggaattacataatattaaaatttaagtggaaaataaatttcatttctttatctctcttttctctctctctctctctctcgcgttttctctcactccctctccaattcgtccgcaatctctggccatgtcgcctcataaagcgcaattcccctgggggcttttcgccctcagataggccccactttccttttgtccctttatttctgttttcatcatccgtcacatttcttcttcctctcccttccatgttcttcatcgccaatatttggatttatcattcttctccgatcgtttcttttccatttttggcccttttcctccaaaatattcccgccaaatgcaatttgttctcttcggtgacggcgccgtccctttccgatgtcatcgatcagaaagtgtccgtcgtcgtcgatccaatccgtgtggttttcgacaattcgtccgactttggcggcaccaatcgcttctccaatgacttttcttctctttgatctctttctctccaccgaagtgcaaattgtgaggagcagcagataaagccgagtgaaaggtgctaacaattcgtattctgttcatttccaaagattgcactttaaagcattgggtgggacacgcgcatctgtttccgctggaattgtgaagggattgggccgggtcagtgagttgtttcgggggaggcggggggggggggg

SEQ ID NO: 23664 - DNA, 1654 bp, Heterodera glycines
  misc_feature (1641)..(1641): n is a, c, g, or t
taaagcatgcctgtacaaggggggggggtcatccaagaggtctcgagatcggctttgcccccccccctcccatgggggggggggggggggggggcagagcccatttccattacgatcgtccatttttcaattttttgcctagtgaagacctttttttttttgctcttcgggccaaaagattgttttctccagtgttattaaaaaattttgaacgccaattcctttcaagatttccgtttggggccggggttcccacccgggcaacgacttttttgcggcgcttttttcaaaaaactttgggaaaagggggtccggcggtgccgatatgcgccgccgggaaattttttcatttttaatgcgatttgttaacgatttttgccaaaaaatgcctaaattttgcatatttctagcaaattttcaccaaaaaattaacaattttatgcttttaagccaaattttaaagaaaattatagacgaaagggaaaaaattgattttagttgatcgtaaaaatctggaatttttttgaaaaaccggcaaaatttttcgatttttctacccctctcttacgatcgacaattttcctcacaaatcggtattagtcgatcgtaaaatttttgcatttttaatgaaatttgttaagaaataaggcacttttccgaattgccaatgagaaaattttataaagtttctgtttttatattaacgatcgactttttcgctgacttttttttctctacctcatttttcttttctccttcttgaatcattgaagaattccgaattggttttttcggtggaccacgtgactcatgtgagttgcggtgccctggttgaataaagttcgcgtaaattttaagataacaaaaaaggattttcggtaaatcagcgcccattttggttcgggtcgaaaaagtcgggccgcaagtgtcgtttttggatgtggccgcaaatgtgcgaaaaaggctcttaagaaatggtccgcaaatgtccgaggcgcaaatgatttcagtagttatggacggtgaccccccgggctccgggggtggtgtgaaaacatgtgttttcacacctttgagggtgtgaaaacagctgttaccggcaggtgtccggggcccattttcgcgcaaaattttttcgcgtatttttttcggggtactgtattttaaaaaaattttttaaaccggtgggtgtggggggttattttttaccacctttttttcttattatactgtaatttttttaataaatttttttcgtcattatactgtatttttttttattaataaatctttctccattcggcggcgttggctgttggtcagcgaacgaaggggggggggggggtggtgatggtggtgccaacattcatctagaaacaaatttgctgtctcttcgttattccatttttctgcgtatgaataagcggacggatcggcgctttaccggagggggggggggtcaattgacaaaagttttgaataaaattatggatgacaaaaggcggcaatggccgacacaaagatggaaattgtaaaaaagggacgcttgagggggggggggggcggaatggccagaggggatggactgatcatcttcatctgctttcattattaacgatccgacgacgatcatttctccantagcatttttgtg

SEQ ID NO: 23665 - DNA, 1043 bp, Heterodera glycines
aggaaaacaaaaggactactcgagataatgtatacctttctagatttaagaatgttaaaagtgggacattacttaatttgtcactctgtatttttgacaaaacgaatttttattttaccaattaaaataaattttttttttctcaaaatccattttgtcagctgcaacacgtcaaattcgattgtgctcgcagttttggcttgtcgttggccagccaattccgttggctccaaactttccatgtgatcggtcttttccttgctcggctaagtgccatttttgtcgaaatgccatcgctcattttgtactcacttcctactcttatggtatttttacatctaaaatttttaaattaaatttatttttagttagcaaatttggcaattttctttggccaggctctgttcagttttgttccgcacattttgctcgtttttgcaattattttcttcgaaggaatgctcttcggctcgggctacaccttttttggcaaaatccatagaaaggtcatttttattaattttatttgtgaaagtccgctttagcacaaactgtgggcgtaagagtattttctagagatcgacttggacctgtatataggcccggatttttcctggatccaactccaggtccaggctattttttaggcaacctggattttgttggacctgtgtttttctggattttgtccaggaatccaggtcaaatatgaaaataatgaccaaatatgaaaaacttggatttcctgaacaaaattttagaatttattatttcaagtgatcgatgttttttcaagttttcaaaaaatgattatttagatataaaaacagattttcttttaaaattataaatttttggaggttcctaagaaattaattcattttttcaaacattgttttgcttttaaacaaatttcaaaaatacaggtccagccaggcctggatccaggtcagaggagcctggatttttcaggacctgggtttcctggatttttatcaggaaatccagtccaacatgaatccaggcccagcttttttcaaagg

SEQ ID NO: 23666 - DNA, 1750 bp, Heterodera glycines
  misc_feature (28)..(28): n is a, c, g, or t
agcttttgagggaaatttatggtgtggnccggcttgaaccggcatctcaggcttccgggaccaatgttttaccagctgaactatcgaacataccctcaacagctcccaattttctcaaatataaggaattgttgccatgaattgatccattaatcttcctctcgagttagcttttgcttctctatcccgtgtgcacctcaaaacttcagcggacaaatttttgggtcatatttttttcattgtcaaccaaattaagcatcatttttttgttctctatctctatgtctctaccatttagtaaaaaattttcagaaaattaaattggcgaagaaagactcttgcagctttttcctggtttggacctgttttccgtgttttgcattgaccgattgatcatttttggcttggacctcttctccttgttgttgcgcattgtccggttgatcttctttggcttaataaatttaataattagctctggtaaatgttcattttttaaattaccatggaataattcgctgagttctatggagagacggatcactctggggtcaacctcgaggttcttcttctcattgttaccgctccaaatgaaaacatattttggaggagctgaaatttaaatttaaaactttggggtctgtttttcggattgatattattttaacatataaatgtaaaacttagttttgtgcgaatcaaatcaaaatcaggtaaaaaacactaattttcttcgtttacttttttatagcaaatttggaagttgaaatgatcgaatttttcattaaattttatttcaaaaaacttttctctaaaaaagcatcaatcttaagtcgaaatatcaaaaaaatttttattaaaaaaacattcactttatgtgtaattaatgagaagatttaatttaaattagggttgctcccctaccccgagctccccggtccccgaccccgatccccgacatttttgggcctattccccgccccgacacccgacatgtcgccccccgaggtccccggcccccgacattttgccccccgactccccgacactaattcggggaattggggactccgagcgttgtaaaaattaaaaaagttaattcaacaacgaaggggggaaaggttgaaaatttatgaaattttgaacaattttcttaatattaattaattaaaaattccgaaaaacttttcggcggcgcctaccggcaccgccggccccccccaaaattcaattttttttttttttgtaaaaaatgtcccaaaatttcaaaaattggtatttttaggaaaaatctgttaacaaatttcaaattttcaaaaaaaaattttcctcgcggctcctaacaccgtcgccctcatcacccctttgttccccaaaagtttttctgaaaaagagcgccgcaaaaaatggtggtcaaattcgatgttgagacgggttcgcaaaaatttctgtttaaccccactcctttctacgtatttttaaaccagggcttccatcgaaaatttttcaaaatataaacaccaagtccaaaataagattttagtgtcaaaaatatgaacatttttctatcagttatttttccaatttattcgatcaaattttatatttttagtcttctattatcaattttgatattttggagaggaaaatgcaaaattataaatttcagtaaattcgggatcaaaagatcaaaaaaattttgcggcagaccttaaaatttcttgaaaaattgtgacattatctcttactg

SEQ ID NO: 23667 - DNA, 1938 bp, Heterodera glycines
  misc_feature (1679)..(1679): n is a, c, g, or t
  misc_feature (1687)..(1687): n is a, c, g, or t
ttttacttgcacttatttgttattgaaattcgaaaaaatttattattattttaatgctcaaattaccgtgcacaaccaaaatgagatcagagaaacttggcattccgtccagcgcatttgcctcctctttgaaaccacggcgcaatggcgtgttgccctccgcgcgggtcacccaacgcaacactgtcaagggggaggggaggggcataaattaaaaaaaaaattaataattgatagtgaaaagattgactaattacattccaaaaaaccaatggaaactgggcaaatcgaaatgtctaaaaccaaaaaacggggcgccccagaatttaaaaaaaattgaagggggggggggggacgagctgctcccaattatttgatggcttaaatgtgtcccacaaattctattttctttttacaaagttatgtttccttacctctcatattccccagtttctcccaaaattcgggtccacgatataacttcccccccgccccccctttgcattacctcgacctttccgtccagcaatgaaaacgtccacaaccgaattccacttgacctccttgtcattccatctcaatgtggttaaaacttaaaaaataatatttagcaaaggtaatttaaaaaaaactttcccaaatttgattttttggcatcccaaataccttaaaaatactaataatactggaaaaacgtacattattgggggggggggggtttgctaattatcccatagttttgcatgtgcctggctttttgctcgactcagcgtcgctgaacactggcgtttccgggatgacgttgtcccgaaaacttttcaaatgatgcgcctcaatttcgtcggcaaaatcggcacggattggttgaaaggagtcggcataaaaccatgaaccacgctggatctgcacttttaaaatcaaattaatgaatgacaagtctcggtggaatttttttttaaatatttttcgtcttgcccccccccttcttccactacaataagcacttaaaaatttaattcaaatggagaggaaagaagcaaagcaaaatttagggaacagttctcgcctccgcccaatttttaaaaaattttcaaacagaatttaaaaaacaaaaaattttttttttgatatttttaaagagaaaaatttactatataaaactttccaaaatatgatctatttaatgcatttccgggttatattttgaaaaattaagggatttgtatcgttcggtggtggcgaaaggcattggcgggttgaacgtattaattaaaaaaatacaaattttcaaaaatttctttttgcaagacaaaccttgagtgcatcttcgccccaatagatggcactcactgactccatctgttcatcggcacaataattgccgtccaatacaatcacagaattctgcgggatggccattttttccacatgcgcttttgccgcttcgtccaatggcatgccaacttttcttcgataggcaatctccaacacagtcgaatcgaaacctggaaatttggttagaaaagcgcagttttgcggggcagcaagtcgtccattcacaaatttccttagctaatttcatttaaaaattccaaaattttcaccccgaatatcgaaaaccgccgaaaccccccccccccccccccctcccactgttcctcaaaaaatttggactttcntttgcctntctttccccgagccccccccctgtctctcttgggctgaagcttcccttgcccccctatggtaattttcgattttggcctggatttgaattttttttaaaaacaaaacagagcggcgcataaattggaaaaaactaccccgcctaaaatttttttgtggcataaatgaacctaatttgagctaaggatcctttaaaatggataatggaacaaatattttgggcaattctcgcgcggtcttttaaaaaaaaaa

SEQ ID NO: 23668 - DNA, 1358 bp, Heterodera glycines
  misc_feature (1324)..(1324): n is a, c, g, or t
ttcttcgtaaaggttgaaatcaacaaaatgatctaaacagtcttaaaatcctattttaatattcaaaaattaattttaatatctcttctttaccgatttttttgtggtacattttcgaaaaatttaaaaatgttcaccaaaaattcttttaaaagatttagaaagaaggggggggggaagcttgggcaccagaaatttgggcaccgggaagtttgagcaccaaattaaggatttaaaaaataaaaattattttaattgtctataaattgcaactatctaatttaaaacaatagtaaatttaataaagttaggaatagaaagttttcttaacgaatattcactcgattaagcatgcttgtttgctaaactcattaccattaattttatatcaatgccaacacatgtattatttacaatttataacattacaaggttcggtctgttcaagacttaattttatgagtttaaattgaattagacgggtctcttgttatttcgggccaactaagccggtattcaggcctaagtccaaacagaaactagaacacgttttctacgtttaaacaaccgtaaaaatgactaaataataagattgccagtttccatacataaattttgtcgccggaaagaatgctaaaaagtcaaaaattttaccaatatgtataaatcccgaaatacttaaattatgtataaaactccgacatggtaacgagaaggccgtaaaacaaaattaaaagtgcctccctaaactacaatgtgccgatatccagttttaggcattaaaaacctggactttttggacaatttttttttgtctttttatgccgaaacgtatttaaaacgggtataaatctaacaaatttcccaaccggcgcttaaaaagtccttatatcataaaattggttttaaatcgcaaaattttatctttttttcaacaaaagtgtaaacaaagcgcattaaaaattacagaaaatttactgcgcctaaaaataattaaattacaagattttgtcaaaagtatcagccaaataattcagcgaaaattcaatttcccctcaacatatgattaatatttttatctcaaattgcttcttccatttaaaaatactctcccgacaaatttttagaaattccgcaatttaatcttcaattcttttttgctttatttgccaatatgttttcattttctccattttttctttctccgttaatctttctcctccattcattccaaattgtttcttccattttcgaattgttccataacttactccaattttcttgccaatttcggtataattttggtgccattcttttgccgaantattttcttcctttttgcttatattcatttttca

SEQ ID NO: 23669 - DNA, 1977 bp, Heterodera glycines
  misc_feature (1321)..(1321): n is a, c, g, or t
tgttattttcttgtatttctaaatcccagagacattgcgctttcgtttgttaccaagaattttttttaattttaatcattttctcaacaaaaagcactaaaatttcaaaaatgtttcacgtcggcgcctatcggcaccgccgggtcaccattttagcatattttttttgaaatttggacataaaaatgacaaaataaaaaccgctagaaatgtctgtttttgctctacggcgctgaaatttttaaaataacactggacaagtaagaaaaaattatgtgccaagaaacttaggatggccactgattggacgcgtaattagaattgagccgaaatttgttaattttatatcaattagtgcactataattaattatcctcatagaaaattttcctttaatttgaaataatcaatttcaaagtgcaccccaaaatgcgcgccttcgtctcccactgcggtttgaacagtgtcagtgaggcaatccaatttggagtgccaattttggccattccgctgcttggcgaccaactgtacaatgccattatggcacgtgtaaaaggcattgccgtccaattggacattggccaactcaacggggagggggccgaacagctgctggtcgatggaattgacaaggctaattagcaccagctaattatgtctttaataagtttaattgctttgcaggtactaaacgacccttcttatagccaaaatgtcaaattattgaaacgaaagttcgcttcggccccttttggggccaaggaaaaggtgatccgataggtggaattcgcagccgaattccccgatctgaacgagttgaatttgccgtgggaagaagagctcggcacattggcctattattctgtggacatcattctgtccattgctgcaatgttgggaatatttgcttggattcttttcaaattggcaaaatttttggcaagaaaatatttgatttctgtcggaaagggagggcaaaagatgaaaatgaattaattgattattttgataaaatttttgtttttatttgttatgttcttttttgaaattaaaaaaataaaatgcaaatgcaaaaaaaatacttgctttttaacaggaaaattaattaattaattatgtgtctaagtagcaaaggataaaagaaagtaaatgaataatgatcagaaaaaacaagttagaaaaggttgtattttccaaaaaatgatataagatttgcagatttgtgatcaacagggatgccaaaaatatgcacgaaaagtagacaaaatatgcgcataaatatgcaaataaaatcatgaaatatgcacaaaatcgcaaaatnatgcaccaaatatgcacaaaaaacttaaaaattaggggtgcaaattaattaaaaaaaatttttttttctcatagagtttatcggttgtttttgcaattacagatcacagatcaaaaatttctcgatttacggcagtgaggcttcctgtttacccactcgcacatccattcagatttggatttaattttaggcataataaaaattttttcctaagagatattaaaatcggaaaatatttgacgaaaaatggcaaaatatgcaaaaatctgaaaatatgcacaaaaaatggcaaaatatgcatgaaatatgcataaaaacccaaaatatgcaaataaaagtcccgatttttatacgcaaacacaaaaaagaaagtgtttttcctactatttagagcatggagaagccaggaaaaaaaatatgcatttgcatatttttggcatccctggtgatcaatataaaagttttttttcgtttttgtccaaaatagtattatgagaatggctttagttttcgattttgagtttatgaggcatcggcaatatatttgatcttcgaccatcgccgagtctttttcaaaagcgtattcgaatctatctatccgtccgacaagaataatgaagcgcctctttttgacttaacctcaataaattcaataa

SEQ ID NO: 23670 - DNA, 1626 bp, Heterodera glycines
ttgtctaagtgttcgttcattcatccgttattatttcccccctcagtcagtgctttttcgttctgccaatgtgcccttctgagtttgtgcctttggcatgacttcgacgcttcgcggtttctgcctttcccccgctgatcagcagacgaatcttttctcattttgcagtgaaatggcgacgaacgcatcacagaaaaggaaggagatctatcggtggcatttgacaagcaaatgaatgcctaatttcgtcaatttaaaactgtttaaggtataaagcgtcgttcaatgtttatgcgatgggatggtcaaccaaattggacaagtgaacactcttttcgcttttattttgttttttcattggtttagtcacctcaaatttcgcttggccatcggcagtttcatcgaggaatacaacaacaaagtgtccattgtgcagctgcacgaggaccaaggcgaatttggccatctcggcactttcgaccatccgttcgttcccttccctttccttttatttcttccgtttagttacccctcgacaaaggtaagaactgacaatgagtaggctctatccgtgaagttcctccccatttgtcatcattttctcttttcggtgctgtggatccccgatccaaagtcggcttttcctgatttattagcgaccaccggcgattatttgcgcatttggcgaatcggcggtcacaacggcgcttcgttggaagttcggctggacaatgtttgttagggagttacaaataatcgaaaattgctgaaaatgcctcacagaaccgttcgtctgagtattgcgcgcctctcacttcggccgattggaacgaagtggacgtgtcactgattggaacgtcgagcattgacacgacgtgcaccatttggcagatagaggcatggaaaagggaatttgtagcaaatttaaatgccaaattaaagacagggcaagcagtggcgaacacggaacacgcaatcggagggaatgtgaaggtaacaaacgaacgcaccattgggggagacgaatgaatgtattattctttcttcgcctaacagacccaactcatcgcacatgacaaggaagtgtacgacatcgaagtgagaggggacagagacgacacccctccccaccagggatggcacggaattccgaaaaaattttggacgtcggaatgccatcctttctccccaccacccccaattgtgccttccctttcttagttctctaaactgtcctcgggacgcgacattttcgcatcagccggtgaataatgaaaaagaaacaatccgttaaaatgcaaattgacaggcgctgacggaagcattcgaatgttcggtttgtgttgcgaaaggcgcagcaacaattaattcgcttcttcagatctccgccacatggaatactcaacaattgttttcgaagaaccctccaaaaagcctttgctcagattaggtgggccaaataagaaaaggaagggaataattttaggttttagcatggaacaagcaggaccacaattacttggcaacattcgcccaaaattccaacgaagtctgttttttgttttttatacggtccgaactggactcaatgcttttcagatttacattctcgacattcggatcccg

SEQ ID NO: 23671 - DNA, 2017 bp, Heterodera glycines
tttttctttagcacttgattaaatttttttcttggcatttatcggcactttttggacattttgccctcccataatttttcagattcacgaaggtaataagacggacataaagcatttgccatggactgtgtgtttagaggacattaaatcttataatgccacagcaaatattcacgagttatccttttgatagcatattatttaatcgacgttttcgaaattatattgggtaaaaattttaaaaaattaaaatggaagatttaaaatttaagtacattaaattcacagtaaaaattgcttataactatgctctaaagcagccgagtttttaattcttgatatcattcgatagcaagtgttctctatttgcttgcacaatttcaaaaattagttaatattcaaaaaagttatgacgaaaattttcaaaaaagaaggaaatttttttgaaattttgcagactgatagagaagaagagttagtgctatcaaatgtcagtcattaaaaacaaaactattattctaaatgctgaacatcagctgtactaaaatccgattcccgagatttttgggcatcagatttccgatttcctttttgaaaatttttggggcctcaaatgctttccctgctgatgaaaagtagagcaagacttatgtgtcttgggttcttctccatcccgaacaaaaggaaaagaaaattcagggggcgactcagaatttttcctaaagataaaaatagcactctcaccgaatttgagtgtaacaggcgacattcacacatccccgatcttaaggaccaattttactttaatcacttaaaataccagtagtgaaattagtttcttacaaatgtaaaaataagatgttaggcctaaaagaccaaaaacaaagttttatttagttttcagtcccattccatattttcagaaatttttaaaaatttctttacgaaattttttttattttttcccgaaattgtccgcaaatgtccgtccgcaaatgtcccactgcggattttacgcatttttaattgaaacagcgcagacgatttttcacttgattatcgtctaatccagacaatcttggtatcaaacgaaagctcttaacatgctctattagccttaccaaatcgaaaggattttcaagcctagaaaaaattttattaagaaaaaacttcaaaaatttcgactttttgcaattttcagtgtataacttttttggtaattgtctaatcgtgaagcagtagcttagaaaaagcttctaaacatgttaagctttcgaatgatatcaaaaatgctggatttggatgacattgaaaaaagttatacaaagctttcgtggaaaaacatgttggcgcccaaacgagcgcgcccaaacgcagtggacccggttagaataaacctcaaatttaggggtataaaactgtaaaatgacaaatttttattttaattacaaaactaaaaggcctaggccttataattagggcataaaattatatggatccatatttttttcctggactctgggaggcctgaaacgcacgaaaaacatgtttttagcttggcttgaagcttctaggatggatttctatatccatatttttccatatttcgatatttcaaaaataagcaaaaaagcgaaaatttcgcttttcatcttgatctttcgctaaaatgagtaaattttagctgttcaaggatttttttgctacttcacctacttcccatggacgaatcgagctgaaaacaaaagccgcagagacatgcggttttttgcattatgtaacaaattgtcctctttctgttagaaataaggacacttgggagccctgtctaaatgtgatcatagaaactcacatacttgcaaaaattttgagcttaggggtcgacaaaaccaaagggaggaaccttttggtcgcaattttttttaaatacctaatgcggcgctacttgcaaagcggtcctttttgaaatttttttacactttttttggtcaaatttttttttatataatgatgatat

SEQ ID NO: 23672 - DNA, 943 bp, Heterodera glycines
aaaccccttttcctttgttaaatatggaaactgataatcggtatttatctttctcttcattacaaacattttttaagtcttttttgtaaaatataaaggggttttgaattcaatcactaattagtagggattcgttttttaggcataaaaattgcaaaaaggcacctaaacagaaataatcgtaaaataggcattaaaaagcacaaaaatcctcgattaggcacaaaaataggcaaaaagcatattttaaagggtttttgtcagtaaaacatgcaaaaaacgtaatcaaaaaatggatttttatcaagaaaaaaaatcaaattttacagatcaattttttgaaacttttttcaattcttaggtgtatgtatataaatcctgaaagaggcgccaaaatggcgaaatatgcataaaataataggtgtttatgcaaaactttattctaaaaaaaattcaataaaatatctttttttgtgaaaagagggccggcggcgccggtaagctcagccgggaaaattttttaaattaaagtgagtgttatgtgttaaaagattttcactaaatatgaccaatttttgagattttgagctcagccaatttttatgaaaaaataagtctgcaccgtcgtgggaaaattggaaattttggccattttaaacgattttcactgaaaaattgcatttaggtcaattttgcgctttgaaaataatcatttcaaaaagaaaaaatcatcattgaccccttgaaatcagcaaaatgatgataaatcaccagagttggctaccctggcaataacagtgaaattttaaaccctccttttttcatttgatgtgcgaaaagaaaatgtagacaaagcctggttaatttagtttaaattttttcgagattttataggaatttagagccggctgtagagttgtttattggaaagcgagaagaaatt

SEQ ID NO: 23673 - DNA, 1559 bp, Heterodera glycines
tagcaattttttgaatatatcacagaatgtatgtggatttgaattcatatatattttgttagtctaagaacacaggcataactgtcagttttatttgcaaaaaatattcatttgagaatatgtatggtctgtttgtgtttgtgtgccatttgaatgacggactgccgacctctcatttttttttgtttgtgagaatgaatgaataaatgcgtgagaaaacccactgtttatatccccagcatttgcatcaactcaattctttcatttattaacacggcgattcaatttttggctcccagtgcaaataagtttattatttatttaagaatcagaacgccaaaactttgcaaaacttaaaatttattggggattttcccttgtaaaaatgcaagagccgatctcgagttagaaaagaaactttcaaaaaacaaaagagaattcgatagatggggtcaaaatatgggcctatgaaaatttcaagaaaatcgcaactttggaaaaatttttacgactgggcaaagttttttctttttctctcattttgacgcactatttccatgtctctaacatataaaataacacatggttcatttttttgccaataaacaattttttaaacttttgactaattaagaaatattcttcagaattttcccttcaaaatgagcacaaaatggttttgtttggtctattattggccaagttataagctaaaaaaatttcataaaatcaagggtaaaatatagtgtgtaccttttactgtttgcatttgttcttttggcgttctgtatttattattattttatttatttgctttaaaaaattgaaatttatacacaaacacaaggaggaattgaacttgagaccccctttttgttgactaactcacagaccactaagacgaaaaatccagcatatttgtacttggagcccaaaattgggccgctgtgtttatgattgtctaaataaaatttggtctttaataaatgtttaaaaattttcattcatttgttaccacattttaaatatttttaaaaatattcgactcaaggttggtacaaattacttttgttcaacgctgagttattgaaaatgatctttacgaattaacttttcagaaaaattcaatcacagtacggtttatgaaagatggtgcaattattttgcaaatagttggtctggctttatataaattgagttaaattgttcagcattcacttagaaaaagattctatttttcaaaaactttagatatcaaatttgctcagtttagttgggagtgaagggagttatgctgatcaaagtaaatagtgcaaacaagagaagctgcgggaagaaccttaataaaccagaaaatgttttctgtgtaactgtttaattagcatgaaatttttaaaccaaatgaaatttgacatatttttaaactttagatgatcgtgataaatgatgcagcgcaatgttctttttcagcttcaaatttacccagtatttctgagtcaaaaaatctaaaggcccgtgcgaaaaatggggcgaaacaaacaataagcagttttactgag

SEQ ID NO: 23674 - DNA, 2647 bp, Heterodera glycines
  misc_feature (106)..(106): n is a, c, g, or t
aaagtactatctcaaatagctaaaacatttgatccatgtgggatgaatctccaaattattttagctgctaaactttatcgtcaagaatcgataaatggaaaaaacntaaaatgggacagtaagttatccgattcagaagaacaaaaatggaaagaactaatgcttacatgggaaaataaagagatcaaatatccacggaaattatttcaaaataatctttcagaacataccaaatttcaattacacgcttttactgatgcatgttcaaaagcctttggcgcagccatttatcatcgaattgaaaatgaccatcaaatttattagtggtgcctgctaatatgccaaaaggcaaaaggacaattccaaatttagaattacatgcaacaatgctatgtgggaaatacataaattttgtgaaaatcgaattcgaaaaggaaattaagattcaaaattgcactatttggtctgattcaaccgacgttcttgattttgtaagaagtgaacgcaaatttgacaaattcattagaaaagggtacaaaatataaaaaagtggcatttaaaacatataaatggtaaaaataacccagctgatttggcgtcaagaggaacatcagtggaagaactacaaaatagtgaaatatggtggaaaggccctaattttctttcagaaagggaaaactcttggcccaaaacaatacgagaatatgacccaacgaatccaccagaaataaaggaaaaacaaaatgttatttttgagataaattcagctattaaggaaaaggatttttgtgaatttgaaaaacatttcaaaagattttcaaaatgggaccgtttaaaaaattcaattgcttacgcactccgggcctttaaaaaggaaaaccaaaagaaggtttcccaaaatatggaaaaaatttcggatatcaaaaataaaaaaaatggaaatgagataacaaaaggaattattaaattaatcaggcctttagaggctaaagaaatccctaaagctgaaaagctgatttttaaattaatccaaacaaattcgtctccaaccaaatctatattaagaaatttggatttgttcaaagatgaggatgatttatggcgcacaaaaggaagaattttaaaaagtggtttaaattataacactattaatccaattttcattccaaataattcatatattgcgactttattgatcagagatgctcatatgaagacaatgcatggcggtcgcgaattggtgaatagcaaattgagagaaaatttggattcctaaagcagaaggaaaatttatgaaatattaaaaagaaaaaacaaagaaaaatgcggaatttgtgcaaaatttgcaaataataaatatacatatcctaaaaaccctcctctaccagtgtttagagtaaaagggaaaagtgcatttgaacatgttggaattgattattttggacccctctccgtaaaaactttggatggcaataaaaaatgttggggagcaatatttacatgtttaattgtaagagcaattcatttggagttagtttccgacataagtgccgaaaaatttcttttagcatttcggcgattcattaaaagaagaagagtgccgaaattaattatttccgataatggtacaaattttgtattagcaaataaagcactaaaacaaatagtactcgaagaaaatatacaaaataaattatggtcagaaatttatcgtgatccgacggtacaaaatttttcatcaaatttgggaattgattggcaatttaattcgccatatgcgaattggcgcgggggagcttacgagagaatgataggacttgtcaagacacatttaattcggagtttaggaaaacaattattgagctttgaagaattaatgacatatttaatcgaagtcgagaggattgtaaacgaacgccctttaagctatataacccaagatgaagtgattgaaccattaaggccaatcgatatattaaatccgacagatggagaacctttctcactaaaattggatccaacatttgatcggaaagacgtgaatgaatattttgaaaagaaaactaaaagagaagaattatttgaaatttacaaaaaagcaatttttaaaagcgaaattttttggaaggaatggagtgaaaaatacctattatcgttaagagaaaagcacatcaataaaaataaagaaggaaataaatacccaaaaatcggacaagtagtaattgtgagagaccaggataattatccaagatcaatgtggaaattaggaaaaattttcgaaattctttctgataggactgttaaattaaaaataggaaaccgaatggcggaaagacccacaaaattattatatcctttagaaatagaggatgaaggcgaagaataactatgattttatataatttaattaaatatatatatatattaataaaattcaaatttatttattgatttatttagactatataaaaatgttgatattttaattttaaataataagattttttctcatttatcatatcattattttgacagaatgagcgacaaccaaagcagtgatgatgaactgatgtattcggcggatgagaatttcaagatgaaagtctcggttcaaagcagaaaaaattatggacaaaattccggaagt

SEQ ID NO: 23675 - DNA, 2212 bp, Heterodera glycines
  misc_feature (102)..(102): n is a, c, g, or t
tcccaaaccagatgataattaatccaatttttcattgtctttcagatcaattttgcgccactgctgatgggtggcccataaagataaagtcatccgttcccntggtcattactcattacatttctttttttatggaaaaataattctgtgaatgttttttttgtcccactgctgattgatgataatgaataatcaaaacattcgtccattaattcattcattccatacgagcagctattaaatcatccgacgaccaccaccgccgcaaaccatcccattttacacaattaaattaacaattttattatttattttcatcttgtattgaacataagcattaccattttcataaaataataaatgaattaaattaaataaataataattctgccttaatcccttatataccgtgccgtaatcattcatttcccgctttctcagcggcttgtcctccgcatcgtccgccgtgttgttgtcctcctcttcccactccgtttcgccgtgttcttcttcctcctttgtttcttttgcttgtcggccccggtgacgccgtcgaagcctgccgtggaccaaattatcgtgttggttttcacttttttttttcttttttcattttttccgagtccttcgtcctaccgtaatccttaccctaccgtaattaaattaactccaattttctgccctaatctattttgtgccctaatcattcatttccccctttctcggcgggctgtcctcctcgtcttccgccgtgttgttgttctcctcttcctcctccgtttcgccatgtccttcttcatcctgactgtccgtggaggcgttgtgcgcggagggcgcggggcgttcattttcattggtgctcttgcagtggcagccgtcctgcagggggcaaatgctgaccagcaggctgccgacagcatacaaattaatgtaggtatattcaaaaatataattctgtttttattgtattttttgcttttttcgtccactttttacttttatttttttgcctttcattataggggtgggacggcggcgttttttccgtggttcgcgaacgcggcaatttgaatccgtgactgtgggattttttttttttgcgcggcgttccgtggatattctgtgacaaattttctgtttgaagtcgattgtcttctctgaatacttatatatgctctctctctccctccgctcctctctctctctcgctctctctcccccccgctcctctctctctctcgctctctctccccccccgctcctctctctctctactaagaaggggcggcagagagagagagagagagggaaaatgaatacccctttcatagcaaagtacgaaaggaccattcgttgtcatcactcacatggtgagtcgggtgattaatgcatttcaaaaaatcacaaaaattgctatgtttttcaaccaaaaaatatattcgtgcaagaaatgttgaaattttttatatgttcgatagccgttgtgtcctttatttctctctataaaattttgttgaatctcattaaaattgatattaaaaaattatttttgctatatttatttaaaaattctgacgaaatgaaattttgcaaaaaacttttcaccaaatctttgagaaatgaattcaaaactttgttcaacgaataattattgtaaaaaattagaaacccattaattatgacgaaaaatttttcatacattaatatcccaattagtgatcataatctcataattattcaattataaaaaaagcatgtttttcaaaaatatttaacaaatgctaaaaatttgaaaatgttggcacacaaatgtaagtaatgccaaatcaataaaacaccggatggaatatatatatatatatatatatatatatgtgtgtacacgctttcatcaattaataatcatcagaaaaataatgttcttcccactcgatctttcaattttggccttactggatgtccatttttaactgcgttcgcttcgtttttgaatcgtttaatgatttccttaattggaaatttcaaaaaattaaatttactcattttattggcaatccaaaaattttttaaattttttctgggtttttttttaaattaaatttttacatcattctgatgaggcccacaagcgaatttcccatccaaatagatcaagttgaatggttgacaacatgacggcaatggatatcgacaaactccgatgttgcatggt

SEQ ID NO: 23676 - DNA, 1145 bp, Heterodera glycines
aattggtccgtttgacaccgaatttattgtcattgcgcaaaaaacgtaaaatggcacggcaaaagttggcacaatcgttccgaattcgtttgttcagcagcaaatacaccacgggagggcaaccttttgcaaaaattatttttattttttaaaataaatatgctaaccactcgaaaaaacccatgcgtaagtgccaacgatgatgtaaattttgctgattctgacaaattgcattgagatgtaaattacggaggcaattgaattgaacaaacttatgataatcacttggataaaaatctgaatatttataataaatgattgaaaagataattagctttttcaaaaattttgcatttttgcttaaacaaaaaacctcattatagtcattaaaatatatttgtttattgccattttttctgcccaagatgactgatgtgtttggtggcctgatgacattgtgtaggtttgccaacaaagaattacaggaaacaacaaataaatgctggatagaccaataataacgatgtaattatgtgcagaagctatcgtgttggagtactgtaattgttaaaatttattaattacataattaatttttcttacaatttctccaaaatcgtccgtatagccaacatatgggttataaaaccacgacaaataaacaccactaaacagaacgggttttgtgaacatggctattgcaaagccataacaaattggcagcgcaaataaataccgtaatttattgccttaaaaatattctttattattaattaattattctaatcgtctaataaaaatattgataaaaatttgaccactaaaaatggcaaatgccaactctggtcttaataattccatgcatctgttaattgccagcaacatttcgacacttgtttcggcataccacaaagctgaattaaaaaaatatataataaaattagaaataataaaaattacatacctgctcccaatgctccggttgtataaatcagcaatggatagtcacaataaacggcaccaataatgccaagaattcccgtttccaacgcattcatgaacaaggccgactatggaaatttaattaaaaaatacaaatacataattaataaaatatgagaattcatgaagcagacaaagcaatt

SEQ ID NO: 23677 - DNA, 1558 bp, Heterodera glycines
catttcaatcactgggactcaactcaacagcatttcaatcactgggactcaactcaacagcattccaatcactgggactcaattctcctgcatttcaatcactgggactcaattctcctgcatttcaatcactgggactcaacccaacagcattccaatcactgggactcaacccaacagcattccaatcactgggactcaattctcctgcatttcaatcactgggactcaattctcctgcatttcaatcactgggactcaacccaccaacattccaatcactgggactcaattctcctgcatttcaatcactgggactcaattctcctgcatttcaatcactgggactcaattctcctgcatttcaatcactgggactcaattctcctgcatttcaatcactgggactcaacccaacagcattccaatcactgggactcaacccaacagcattccaatcactgggactcaattctcctgcatttcaatcactgggactcaattctcctgcatttcaatcactgggactcaacccaccaacattccaatcactgggactcaattctcctgcatttcaatcactgggactcaattctcctgcatttcaatcactgggactcaacccaccaacattccaatcactgggactcaattctcctgcattccaatcactgggactcaacccataaattcaaattaaaactgacctgtttaaaactttccacctaaatttgatcccgcaagtggcacgtcaatatcccaattgcatataaatattccactcgaacacaggcaaaacatgagttgtagcatttatattgctttttctatccatcaaaggatttttctttcattttttattactatcataacatgctttttattcaaaacaaatatcaaaaaccaaatcagattcttttcatattataagcaaggaaaagtacaaaaaacgtttttaagtaacaaacctttttcattcaagcgaattataatgcatttttttaatcaaacaattctccattatcgtttacataagcaaaacaaaagctttcatatcaaaatcacatcaattaacaaaaaaaaaatttagacaaaaaaataatgataaacacaaattttttcttacacacaaaaacagaaccttcatataccggattttccactcaaacaaacacaaaaatgtgctcattattttattaattattttatataataaaagatgggttataaataaggaagggatgcgagacaaatttcccattatctctccctttcctttcttttactctcttttcttttccattgcaatttactctctttttttcccactccctccttctcccacacacacgcacgcgtccaacagactgctgctgcacagcagcacgcgtctgttcactgtatgcccatcacacccgccgctgcccgcgtagacagacaatcagacagtgcactattttcccaccttttcctcgctctacttttttcaaatcatttttaacgcaaaactcaaacaaaacgccacacaaattcaaacactggacacacacatacacac

SEQ ID NO: 23678 - DNA, 1945 bp, Heterodera glycines
  misc_feature (24)..(24): n is a, c, g, or t
  misc_feature (1902)..(1902): n is a, c, g, or t
tttacatttactaccaaaaaaatnagtggcgcaattaatcatttaatgttaatcatttttcgccgacgccaacgcctttttttcctccaaaatttttacaaaaccaaaaaatttcgtcgtcattccccggcaggcgtcgtaggaatgggaaaaaaataaataaaaatcatgaaattttaaatttaaacattccgtgtcctcctctgctgttgtgcgagtgccccccccccgctccccctcctgctggtcctcgtaaaaaatttgaaattttaggggttccattgttcgctgtcctccgccggtcactgatgcttgggactcccatttccatatattttctgccatttcactccatttaaattcatttaaatttatttttaatggtgggctaatccaaatcctgacgccatcccccccgcccgcccccgagtcggccttcgaacttacaggtcgggcgcaaaaccgagcacaaaaaaatctataaattacggaattcagataattgacttttttgaccaacattgaacgctatattagcataaatttgatttttttgcactataagaaagtttatgtcatcaaattattttgaggctataattttgttacagcaaattggaggaattttcagataaaatttcttttttttcatataaactttcaattttttattgggtgcttcttagtatttgtgggaaacatgtattatgaaacaattttctgcccgattgatcaatgcgaagtatgagaatatcaaaaaaatgttgaagccaagccctaattttgttacagtctgtatatcttattccatattgatgttatgtatatgtacataagtagggaacggatttctaagtttttgcttattttttctgcggctttaattcgacgagaaatgcacgaaaaacacattttttgttcgaaaattttgtgttttaacgcacttattcgaacttagaaatgcttattttggcgtttcgtgcttaaaaatgcttattttagaggttcgcccttaaaataagtttttgtacttattttagcgttttatgcttattttcgttcttatttcgcgatttttgggaaatttattaacaaaaatgcaataaaaatgataaatacacccctaagaatcggccaaaaaaatttcggaaaaatacacccctgagaattgacctaaaaattttcaagaatacactcctaagaatccacccaaaaaatttcgtaaaaatacgcccctgagaatcgacccttaaatcctgaaaatttctaaatgtacttcatttctaactgcaatcagtaaataaaattgtttgacttaattttaactaatttacatagagaaaacagcaattttaacaaatttcacctctacatttggaattttttcatgcttattttcgcacttatttcgcgcttttttcgcccttatttaagcacttattttggactttttcgcgcttaaaaatccgttccctatacataagtgagctaatgaaaattcttggaaaatataatttgaattgattatttgcaacattatgccaaaaaaaggagaattgcaaaaaaatagaaacgatgagatagtgcatgtctttttttctctccacagttacttaaattgactgaccattgtgcaacgtcattcatcattcattcattgctcattcaccacttcttgttcacttactcgcacacgcaattgaaatcaatatgaatgaagcattaagcaatgcaagcattatgtatgtgttagaattgcattacatacatgcataaaacaagtcattaaattgcctatttcgtcatcaactttttatcctgaatttcgttgaaatcatttttgttggattaatttcttttccccgctcatttctaaaaaacgttttatgtgtaatgcaccanaaaggttttttgagtcctaatcaactaacctattctcatttaa

SEQ ID NO: 23679 - DNA, 1437 bp, Heterodera glycines
  misc_feature (17)..(18): n is a, c, g, or t
  misc_feature (1350)..(1350): n is a, c, g, or t
  misc_feature (1371)..(1371): n is a, c, g, or t
ccaccaacatttccaanntcgccgggactcaatccaccagcatttcaatcactggggactcaatccaccaacattccaatcaacgggactcaaccctccaggatttcaatcactgggactcaatccaccaacattccaatcaacgggactcaaccctccaggatttaaatcactgggactcaatccaccaacattccaatcgccgtgactcaatcctccagcatttcaatcactgggactcaacccaccaacatttcaatcgccgggactcaattcttctgcatttcaatcactgtgactcaacccaccagcatttcaatcactgggactcaacccaccaacattccaatcaacgggactcaatccaccagaatttcaatcactgggactcaatccaccacattcaagtcactgggactcaattctcccgaattcaaatcactgctttcatatcaaaatcaaatcaattaacaaaaacgaaaatttagacaaaaaaataatgatacagcaaaaccacaaattttttcttacacacaaaaactgaaccttcatataccggattttccactcaaacaaacacaaaaatgtgctcattattttattaattattttatataataaaagatgggttataaataaggaagggatgcgagacaaatttcccattatctctccctttcctttcttttactctcttttcttttccattgcaatttactctctttttttcccactccctccttctcccacacacacgcacgcgtccaacagactgctgctgcacagcagcacgcgtctgttcactgtatgcccctctcacccgccgctgcccgcgtagacaaacaaacagacagtgcactattttcccacctttccctcgctctacttttttcaaagcattttttaacgcaaaattcaaacaaaacgccacaccaattcaaaccacggacaaatacatacaaacactcaactttaatatataggatcatagccctcgtcaaagtttaagtcctttattcacaagaatgttatagtaaattaaaaagtaaaattgctattaaagcgtgtatataaaaataaaagaaactactagtgtataaaagataggaattaattcacactctgccgagtcattaagtcgttttccgaactgctttcttccactgttccaattctttgtcccgctgttcgatgttcatatctggacgatactcagttgtttttccctcccttatgcgttgttgcaatttgcacattgtatccacgcttaaaagtgaaacttttgaaatacattaattgttcgactcaaacatttttttacgtctcaatttagtgaacttacaaaacaanacaaaaacgactacagtctanatgcgaaaattttaggttcttcgaaattcactttcgaccaaaatggcaggctttgttcaaacacat

SEQ ID NO: 23680 - DNA, 1396 bp, Heterodera glycines
gcccccgggccatcactcgccacggccatcaccgaacgaacaaccgatcattccccccacattttgtaaggtctgtacatttgcacgtgaatccaattgttgtttaggggggaggggcaacggacgacaaacgatcaccccatcacatcactgtccccccaccactccgctgccatcactgtgatgagtgcaccaaattataaaaggggggccgcgagaggggccaccccaaaacgaaacgaaacgcaaaggaaaagcaaaggaataaataattaattattcactcattccatcgcgaagaagccaagccatcttcaccagcaattgcccctctcatttcattcaattttcagcaattgtgccataattaattattaattggagaacaatgtccgtttccgtcactcaaacgatcactcgaaatcggaaaagtgcggaaaagatttccgagggccaattcctttcaatggaagtggacgaattgcaagagttggaagaaaaggcgaaaaaggtaacacccaccgcttttggcattttggcacaaattaattggcacaatttaagacgcagttcaaaacccaaattgtgtggcgcaacgtgatcctgtacctcattttgcagaccggggcactgatcggagtttaccaattgttcacaagttcaaaatggctcaccgttttttggtgtaagtttttaatttcaacgattattacccaaaactttcgttacgaaatacttttaaatgcttttgtctttccttagctttgccaaatggccaattgtttaggccttttcctttggatggtcagcggagttggcattacagctgggccccaccggctgtggtcccacaaaagttacaaggccaagtggcccctgaaggcgttgctggtggccatgaattgcgtgtccttccaaaatgacatcatcgaatggtctcgggaccaccgatgccaccacaaatggacggacactgacgccgacccgtaagcattggcagcagaaaatgccaaaagcgaccaacaaacactccctcagacacaacatcaaccggggcttcttcttcgcccacatgggctggctgctggtcaaaaagcatccgctggtcaaagagaagggcgcctccctggacatgtccgacctcacctcggatccgttgctgatgttccagagaaagtcagtcgcttctccttgccgttttgatttggcatctcctctttgtttctgttcaggtactacttgcccttggtgggcatcttctgctttttgctgcccactgctatccccgtgtacctttggtctgagtccgtttgggtgtccttttgcacttccgcactgttccgctactgcttgaacaagcacgccacgtggttcatcaactcggccgcgcacactt

SEQ ID NO: 23681 - DNA, 977 bp, Heterodera glycines
aattttgcaaaatgtccttatttggacccaaaaatcttattttttggccttatgttctgattttgaaaattttccgatgagaaccctggaatatagatgtaaaaataaaaaattattatttataatattaaatactttaaaaattaacaaatgaaataaataataaacaaattaaactcgccttttttccgtctccgtcgcccaccaaaaagtgcacatccgcgtactctcccgtgctcagcatcaactttaggaaagcaatccccgctttggacatgataatttcaataaaaattttagtaactaaattttaggctccgattaaaaatgaaaattggggcaaatttatttggaagggcaaaaaataaataatgttgcggcaaactaatgacctaaaaatgaacataaagcagagaaatttgcaaataatgtaaagttttgtttcagggaattgcgaaatataactctctataacttttttctttgtcatccaaatccaacattattggtattatgaaagcttaacatgtttagaagctttttctatgatatcgcttcgcgattagacaattaccaaaaaagttatgcccgaaaattgcaaaaaagttcaaaaattttgaaattttttcttaaaaacatttttaggatggaaatttcatataaatacatttttttttcttggcttctccatgctaatatgaaaaaagttgcttttttgtttttgctaacaaaaattgggattttttattacatattttcgcaatttggcacatcaatataatgtgtgacagtttaagtgatacgtgacgtgctaattgcttttgtttaaatatcatttcatcatttatcacgttatccgtctcttcaattccgtcaacagctgattaatttttaattaattttattcctaatttaataaatccccccccccccccgctgcatggccacccatttagttgatttttaaaatcttttgg

SEQ ID NO: 23682 - DNA, 619 bp, Heterodera glycines
aataaaaattttttaaggtacaacgagaacaaggagacacccttttatttgaatgaagaattgaggaattattgcagaaacgacacggagatattgctgttatcgattattgagtttgggaggatattgatcaacgacattacgaaaggattcgagccgttgccgaggagttgtacgaatgctggggtcgcgatgaatatttttaaagcaatgtttttgttgacggatcatttatctattgtgccggagaagggatatgagcggtgtgatagagcgagtgctatggccattaagtatttggagtggaggagcaagagggatggaactgagatacggcacgcggggaatggaagagaagtcaaaactggaaaatttaaattggatggatttatttcaaatgagggaggtagggacaagtgcattgaggtcatgggatgttacatacacggatgtttgaattgttatgacccggcgcggagctgattggaggaaggaacggcccaggaattgaacgatgaaacgcaggagagattggtggagctgcggaagactttggaggtcgaagaagtttgggtatgtttatttatttcatagaaatttttatctccggttttttagg

SEQ ID NO: 23683 - DNA, 1541 bp, Heterodera glycines
aaaagtcgaaattttgcggggggctttcttaataaaatttttttcagacttgaaaaacttttcgtttttgataaggataatagagcatgttaagagctttagaatgataccaagattgttggatttggatgccaaagaaaaaagcttaagtggaaaaacgagctggcgccgaaacacgagcgccgaaacgcgtggggtcccatttgatttgctgtcgaatcttcaaaaaaatatttttattttaatacataaaaattataaaaatttttcaagacccggttggacccgacacccggaaccctagtttgaataagaaattcatttaaaatccgcttaagtttgacctccaagtcaaaaaggcaggcctgtgcatatgccaaaaaaacattgcgcaatttgaagacgggaacatccaaacacggattgacaaggccagggatattgtactttttggctaattaaaaataattatttaatttaattactataaataaaattcaccggcgtaaagcactgccattgcattgtctccgtccaattcactcaactcttccgtatagatgaagcttaacatcactttgaacgctgctgcttcaacatcggggacctccacgggacaattagcagaggctaattgaaaattaattagtgtaattagtggaggccggttgaaaaatgaagaaagtgaaagagtaaagtaatcaaaaaatgggcaatgaaaaaaggttaattaaaaagaaccaatcaaatcgcaaattgaaacaatgccataaattaattttttattcattaatattttaccaaattccgttttttcgttttttgagtcaaaacggaacattgcctcaaaaacctcggaagctgacctcaaaatgagtttatgtgctggcataagcttaaaaggattgaaataaaaaacacaatcaaaaaacgaccaatttacaaaatctaaaaaattttcacttatttttaattaataaattaatttttaatttgaagactcgcctcttttccatcaccgtcccccaccaaaaaataaacatccgcgtcctcacccgtgctcaacaaattcttcattcgttcaaccaacgatttggacatgataggcaaagtcgaaatcgtagataaatatcggctaaatgcctttgttctacaagataattaatcgtattccatgccaaaaacaatgaataatttaatgtcaaagcccccccccccctcatttctgtttttttttttggaaaattcgaaatcacaaaatggtcaggggaagacaatggcacaaaattgatgcgcattgttttattcatttttaacaaaatgcctatggcagtaaaaattgaatttcaattttttatagaaaatatttttgattaaaataaatttattgaaaaatgacttcctaataaaagattgttcaacttaatattataattatgaaaggattaaacaatttacggcaaaacgatgacctaaaaaggaggaggagaacagaaagaaacaaatgtaatttgaaagaatcaatgggaaattgtataaag

SEQ ID NO: 23684 - DNA, 944 bp, Heterodera glycines
aattgttctggaatttttttctcagcgcatttgatcgtgaaaattttggaaaaatggctatctctttttctggtctacagtcaagggaattccaaccgcactctcagcataatgacgccgatactaattgttctggaatttttttctcagcgcatttgatcgtgaaaattttggaaaaatggctatctctttttctggtctacagtcaagggaattccaaccgcactctcagcataatgacgccgatactaattgttctggaatttttttctcagcgcatttgatcgtgaaaattttggaaaaatggctatctctttttctggtctacagtcaagggaattccaaccgcattctcagcataatgacgccgatactaattgttctggaatttttttctcagcgcatttgatcgtgaaaattttggaaaaatggctatctctttttctggtctacagtcaagggaattccaaccgcactctcagcataatgacgccgatactaattgttctggaatttttttctcagcgcatttgatcgtgaaaattttggaaaaatggctatctctttttctggtctacagtcaagggaattccaaccgcactctcagcataatgacgccgatactaattgttctggaatttttttctcagcgcatttgatcgtgaaaattttggaaaaatggctatctctttttctggtctacagtcaagggaattccaaccgcactctcagcataatgacgccgatactaattgttctggaatttttttctcagcgcatttgatcgtgaaaattttggaaaaatggctatctctttttctgggctacagtcaagggaattccaaccgcattctcagcataatgacgccgatactaattgttctggaatcattttctcagcgcatttgatcgggaaaatttttggaagaatggctatctctttt

SEQ ID NO: 23685 - DNA, 1903 bp, Heterodera glycines
cttctctcatactcaaaatttcattccctccaatttcctttcatcgttttcaaaatgatgtggatgttcttccacactcaaatcaaggacacggttctattcaaatggtggaaagtcgaaactgtcggaagtgagtttttggatgaacgaatgaatgagcgcgttctgtttaaaaggtcttctgatcacttgtttggtcatgtattttggtgccatttgcttcgaagccatcaaatggcttaggcttatgcttgaacaaaagtcgcgtcagccgaactccgccaattccgccggactcaacatgacagaccaaaacaaaacagtgccaatgactaagtgagcaatggaaacggagggcaggattatgcccattccctcccatcagtcgccggtacgccgaatcgctcctctcccgggtccatcttctccagagtgttctgttcacggttcaactgctgctctcctacctgctgatgctctgcttcatgactttctctgtttggattggaatggccatttgtgccggtgctgccaccggtttttggctttttgggaggagagtgccaatgttggcatttgcatcgagcggagcaacggggagcggacagggatatgcgagcaccggccgaacggaactccattaaaagccatgcattcattttccccaattaatttgcatcgaataaacgcatttggccaagtgccccgtcatgtttcctttctgtcgaatgttttgtcactttgtgtcaatcttccgcttatgtttcttcgcttgtatttgcttttgctttcggttatcgttagccatgccaaaaatggacatgaccttccacttccgtaccagtgagttcattctcctccgagaatggcttcctcagagtattttcggtcggtttgccctttcctctctctctccaattcccttctctcccttttgttagcttatctcttttctttgcttgctgtgctcgccctttcggtggcttatgaattgctgcgtgtgttcagagccatccttttccaaatcgctgaaagacgtcagagtgaagaggtcagtaagtcaatcagtcctctgcttttgctttccgataatcggtccaactgatcagtgatcgctttcccagtgttgttcgccggtggcgagtgctgccccatcctccggtgccattaccgcctcctcctcatccgtcgccgcctgcaactgcttgtctccccaactcttttacaatgtcccccaatggtcgtaagtttcccgcgccctcccgtagccaaaaaaatttcgatgggggaataacccaactttttttattttttttgctcttgggccaaaaatatttttccagtattataagtttttcaaaaaaccaattttgccattgaaatggtgtaggtgccgccggggaatttttttcgaattttcaagaaaatctcccattcccatcactttcagcttctcctcccaattggtctcccatttccatctcttccaatctctgctccatttcattcagttttttttgggtttctctctgatgcttgttgccatgacgtgagccatcaaagttaagcattgtccgcttctcccacttcgttcagttacaatgtgcccatctttgtcgccctcctcttgggccattcgatcggttactttctcaccgcccctctctatcgccatggattggctgaagaaaatcggactggcggagattgctgctgttcataaacttcactttttgtttgcataaattcattagcaattaagttaaagcgttttaatggtccaaatgagaggacaatgacattttggtggagtaagagccggtcaaacaattaatgaggggcaattgccctcaatcggaagtgctcgccctcgctcgctttgtccttggcgaatctgcgttga

SEQ ID NO: 23686 - DNA, 763 bp, Heterodera glycines
atattgtaaataaagtccattaatgaaaacaaaaaaaatcacaagtactttaatatacagtcaaagttattaaaaaaaccgccaaatgaaaaatttctttagcatcagctcctgtcatgattttattatatacgatcgttttttgaattaacaaaacaaaaatgaatcacttttataaaaacatgcttaataataaattaaataaataagaaaatttttaaacttgaagaattataaaacataaaaaatctattttaagcactttgagaataattagggttgaaattagatgaattaattgcaaaataagtaattttttagttaattactagtgaaaaaggcgcccggaaaatgcgtcagtgaaaattttattgtcataaaaacatgttccttgtgttttcgggggcactgaccacgaatcctgtatccaattcgccaattccgaaccccgggcccgaattcgaacaaaaagtcgaaagtccaaattttcgaatttagcatttttggttcaaaaacggcataaatgatctcttatttaaggattgatggcttttagtttgttttcgtgtatttaaaccggtttttaagaaaaacctaatttcgaaaattttgacttttgttcgagttcgggtccggggttcggaatgcagaacaatcttcttataggagtttacttctatattacaatactaatgccatagaactttattttaaaatatttgtatcactgacgcattttccactgaccgattttccggtcacg

SEQ ID NO: 23687 - DNA, 926 bp, Heterodera glycines
  misc_feature (33)..(33): n is a, c, g, or t
aaattttgaaaattgctggggttattccttatncagataaggaatgccagttttattacgatttataagaaaaaatgcatggcacaaagcctcggtccaagtggtagctcatgttagagaatgactttgaataaatcagggccagtattttggatgactagaactttatgactggttcagaggctttattctcctatacctaagccataaaatatctcgagatgtcctctcaagtgaccataaaagtcaattaaaaaaaataaattcgctacaaaaaaagttaaattaataggacaacaataattttaaaaataaattgtgtattttacactctgttaaaacaccataaagcaggattaagtcgaatttttgttaaattaaccaagatagttttatcttttgaagcgcggaagaaagacgatttaaaagtaaaccataaataatttaaaccaaaagtagtcattaattgttattataaatgaataatgcaaaatttacacagtatgaaaaaaaaatttatgaaaaaatcgtactatattttatgttatgttgaagccaaaccaattaatcaattgttaaaaagaaagtgttattaatataaactttaacattttactaccaataaaaaagtaatcctaaagtgctcttgcttgcctagcgaaaacggaggaatttttcatctgtcttaactcttttaatatataatgtttaaaaacttatctttaaaaaataattattttcctaattatgtttttttatcagttttaatcttctaacgtttttttttgcattaaagcatttattttaactaattattcaatttacgattgatatatgtttttcctgaaatatcgttaaagagattttaagtcaaaataaaatattaaataaaattaatatctatttatttattaaattattctcaa

SEQ ID NO: 23688 - DNA, 1509 bp, Heterodera glycines
tctaattaaagtaatgacaactgaacatgttcaatcctataaatggggataaaacatttgaaaattttattttaaattgaagtaatattattacattaaattagtgggcagaatatggtcaattaaataaaattgttttgaggtaaaattttaataaaaaagattaattgttaaaattaaaaacattgatttaattcataattaaataaaagtttttcatctaaaaatagcaaaaattaaagaaaatattggtataaaaattgaaaaatgaacgcaaacaaataaaaaatttttggtttcattacaattttattaacatttagaaatttagcaaatcaaatttctaaaggactagaaaaatttcaatttaaatatacaaaattaactatttacaaaaatactaaaggcgatttttgaaattggtcaaaatttatagtttttaaggcacaatttggctaacaaacaaaaattttttctcggataaaattctttggcgtagcttaaaaagcaatgttaataaagtttatttaaaaaattaattagtgttttttttaattctataacctagagcaagaaaagcaatataagaaaatgaaatactttcaataattaaaattaagaattatattaaaatacaaaaaagttgttactcaaaaaaaaggaaaaaactcaaaaaagataaatatctaatttaaaaatttttacatattagaatgaataattaataatttcatatactgccaaattcgaaccaattcatttaatttttttaattcaagaactcattttgttacagataatttttatttgattattaatttaaaattatggatttatgtattttaaaaattctaacattgggtatcaaaaatgttccaccataagtatatttcgaaaaagaaaaatatataaaatattataaatctaatttacaaaataattaacttttattaaatatatttatcaataaaaataaataaatctaaaaagaattggaaaatatgaaacaattattatgctgatgaattattgcggttgaaatcacataatgatttatattttttacaagatgaaattacaagttttaagaattaggcgcagaccatttatgtaaaccaaactagcttataataaatacagtatcgcaaacactgtaataaataacccttgtttaaaaataattttaaatttgctagttttttacaataaaaacaaagcaaatactttaaaagtataaaattataaagttatacgtccacgaaattcactgttgtcacctatcgagcctagaaacccgggaagtttgggcacaagagtaaggaattaaaaaataaaaatatttttaattgtctataaattgcagccatttattaaaagcatattaattaatcaagttacgaatagaaagttttttaacgaatattcactcgattaagcatgcttattttggctaactcattaccattcattctatatcaatgccatacatatgtatgtattatttgtatc

SEQ ID NO: 23689 - DNA, 832 bp, Heterodera glycines
atgccatgccattctttggaactctctttccccgcgttgaatgaatgaatgaatgccgctcatggtcagtcagtgttttgcccgtgcttttggcattggaaagatccgtcagacaaacatttgttggtgatgatggagggggagggggaaattgtgcttttttaacgcctaaaaatacacacataaaattcaaaggacatttgactgtgtaagaaaagataatttttggagaatttcaccctttttcccgtgtctcatttcggcatttgtttaaattttccttgaattttcaccctttttatgtctcgcatttcggcactttttccatttcttttttcttccaatggcaattgccctgaaacaactgaatttttgtgatctgtgcatttccgacgaaaaaatggtgacggtattttggaaagtgaaaataaaggcataaaataaaagtaaaatatctgaaaatgacaaattgaaaataacattcagccaaagactgtcaacggcatcagcaaaaggcacttgaattagcataagtgaaatggttgacaatgccgtgggcatttgaatacattctgaagggttttgggtcggttgaattttaattttgacacaaagggggagtcggtgaaatgtttgtcagtggaagagggggaagggagggagggggatgaacagagaaacagtgccaataataccaagggaatttggcattcggtagaaaagaaaaaatttaaacgaagttaaacaaaagaattttgaaagtgtaaatgttttaaatggctcattaaagaagtgactattttcgtcagaacagagccaaaagttagtgctg

SEQ ID NO: 23690 - DNA, 1663 bp, Heterodera glycines
ttaaatagtgcaaaaaaaaggcaataatcagtgtgatttttaaattcgcgcaaaaatttatgccaattaagtttttggcgttatgtacaattttgtctacacttgagtttgtgacgttaacccatagttgtacaaggtacataccatattcatttctaccagcacctccagactccccaagttcccaaaaagttttaaaaaaattttgccgtaataagttcgaccgccgacctttccaaccctcggtcgaccggttaaaggcgaattcaggaccctaaattaatttatttggctcttttttcgcagtcaggctttttgattatttttgtgactttattcccgtcctaatgccaccaacgagtaaaaaaacaggtattaataatgcaaattgaatttgactgtgttctttaatttaaaattttttaggaaaggctgtcgcaaaggctgtggaggccaagaagaagctggccaaaggccagcacattgtgcgcaaaaaaaacatgcgcacgtcggtgcacttttaccggcctcggacgctgaagctggcgcgttcgccgaagtttccgcgcaaagcggtgccgaaacggaacaaactcgactccttctccatcataaaacacccattgaccaccgaatcggcgatgaagaaaattgaggacacaaacacattggtgttcatcgtggacgtgaaggccaacaaacatcagatcaaaagtgcggtcaacaagctctacaacatcgaagcacagaaggtttgtccactctttgttttggtcaagaaaatcgagtatatgcaaattggatgagcgcaaaactgaatttttgggggccaaattttatttaagtttcaacttttcgaacaggcacttttaaaatagcgccgaaataccttttgctcacttcaattttatttattcgtatagatccgcattcgacttaggcgacatcaatgatatcttcaatttcttaggccataacttttttctttcttagtcaatgcctaattctgttgccaaccgaaaactttcccagtattttttaaacataagaaaaggacgacattggtaacaaaaaaaagctatagcataaaaaaactgaggatagtcattgattggacgtctaaaagtcgattgaatttcgcaattgtgagcataaatgggaaaacgtccggtcctctaacaaaaaatcagtatttcgtcatctgtattaattatgttggttgaataattaatttttaaatatttaatgactatcaaatatcagtcacaatcacttgtatgactatgtctaattctgtttaggctatcgtggcttgaaaaaataaaatttgaacccgatttttgacaggcgcaaatgtcgggactttaagggaagggttattcgaatagttaatacgctttatctcaccgtttttttttctaaggtcaacactttggtcacaccagatcacacaaagaaagcgtatgttcgcttagccgccgattatgatgctttggacgtggccaacaagattggtattatttgagtatattctgcgctttgttttgttgatttttgcgaataaattgttgctatgtttttctgtattgaattgaaagtccatatggaaaaattataccattttttggcgtcggaattccgtaatttttgataaaaaacggag

SEQ ID NO: 23691 - DNA, 1924 bp, Heterodera glycines
tgtaaattgtataaattaaataaatccaaataaattgcatatgccacggtataaatcaattgcatgaacaccctgtaaaatgggctaaataaaggtggggaaaactcacaaatgcacataattttttttatcactaaaattcattcattaaaaattataataatttaatatttatttctaaatttagttacaatgattagaaaagaaaaatttcaaattattttatttctaataatctccctgtgtttggccataactctgatcaaatcggcatgcccaacaattgtacatccaacggcagcggaaggtggatttaaattcaatttttttgcattttataactgcaagctctgatcggtaagcatagggttaaacccaaaaccgatctgaatttattctgttgcacttcaaattagatgagagttcctctaaatgaatttcgaagaattttgttttagaaaaatttctgttttcttttttttttgactttttatgaaaattcgcaccttgactagggtgttgctccccaacatttttttaaaatttctccaaccatcccgactaattttgtcgaaaaaatttcctacctgtcccagactgttctctcaccaaatgtcagggcccaaccctaggtaagacaggccatttcaaggaatataaatttcatttttcaaaaagttctgatcgtttttctgtttggcaatgccaaactgaacacattttgagttccatttttggctttatgcattcgttaattccataaagaacgcaaagttggcattctgtcgtcgtcatctccgttggcgccaaacacatcgccagaaacaagcattggaaatggcatttttgaacctcatcaacaccgtcggcgttggcgccgtggaaaaagtgcaaaaaaacaatttgtgaggagtcttagcagcaaatcgatgaagagcagctcgtatcggaccaagtcaggccgacgtgtgatggaggaattgttgccaaaagaagtgcttaagaagaaatcatttctagaaaagttgtttggcattttgtctaaaaatgcctgtcataaaaatccttcgaattttcagggtgaaacaaaaattagtgcccacaagcagacgtacatttaagctatcacttaaccgggtatagttttttttgtgcatatttaaaaaagccaaatatttatgagtttttcaagaaaatatgttcgaaagttaaataaaaataatttttaaaataaataaaattattaaattttttaaaattaaatttcaagatcaaaaagaaacaaatgcatcttgggtttgagatggcactggccaaaacgttgccacaaatggagaaaaagaaggaactgctcaaaatgttaatttacgtggagaatgcactcattttagtgaaagtaaaattaacaaatatttaaatttaataaaaaaacatttcttttataaaatttaataatattaaagtgcagtaattttacttggcaataagaacgaactggggaagcttttgagtagggttaagccccgagccctcggggggcaaaaagtcgggggaggagacctcggggggcgacatgtcgggggtcgggtcggggggagctcaattgtcgggggtcggggaccccgatcgggtagtgtttggcattttttaacaaggcatttgaattaaaatttgaaccttggaattcgctttccgaattatgaaaatttttgggttgttaagggaactttttcaaaaaataaaccaaattttttgattttcgagccaatttttaggaaaaaatttggagttttggggggacggcggtgccgataggctaggcgccgccgaaacgttttttggaatttttaattaattttattaagaaattgttcaaaatttcaaaaattatcaaccttttcctccttcgttatttaatcaactt

SEQ ID NO: 23692 - DNA, 1047 bp, Heterodera glycines
ttggatttttgctccccataattgtttgagtaccccaaacgtacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtacttaattctgcgttggattttgctccccataatgtttgagtacccaaacgacacttgaaaatcgatttttttgttt

SEQ ID NO: 23693 - DNA, 1799 bp, Heterodera glycines
ctgtggaatgtgagcaacaattgttggcgttctgttgccttcggtggttgttgttggcagtgcccggcccacccgctgcagcaatgccattcccagcgaagtgacccatcaaagcccagcggaggactgaccatggcaagggatttttggtgggggggggggggggggtaaggactaatacgctgcattttgccgatgtatcgcgctcgcagccccggacatctaaggggatcacagatctgttattgctctatttcgtagtggatgaacacagaaaatccctctaagaaggagcgcccacagaagcaatgagccaactatttagtaagttagagtcacggtcgtagatcggaataaaccagacaaatcgctccacaaactaagaacggccatgcaccaccatccaccggatcatgaaaaagctatctatctgtcaatccatacagtgcccgggccgaaagagtttccccgtgttgagtcaaattaagccgcaggctccactcctggtgcagcccttccatcaattcctttaagtttcagctttgcaaccatacttcccccggaaccggaagactttcgtttccgggaagctccccaccagggcgaatagatccgccggagcgatcgctagttggcatcggttacggccagaactaaggcgtatatcagatcgccttcgaacctctgactttcgttcgtgattaatgaagacattcttgcctaatgctttcgctgtagtaccgcttgctacggtccaagaatttcacctctcacgtagcattactaatggcccccggatgatctctgttaaccattatctcggtcagcaaaaccaataaaatcggaccgaaatccttcttctattattccatgcacgaacattcaagcgaaacgcctgtttgaagcactctgatttgttcaaagtaaactcgccagcccaccgacgccgaccggtaaaggccaacgccggggaaagaccggcagaaaagccaaccaaaccagtaacacacaaagtgtgcaccggacggctagcacagatccaactacgagctttttaaccgcagcaataattctatgcattttgagagctggaattaccgcggctgctggcaccagacttgccctctcatagatactcgttaaagggtttaaattgtacccattccgatgaccggcctcataagagatcggtctcgttatttctcgtcactacctcctcgcgttgagagtgggtaatttgcgcgcctgctgccatccttagacgtagtggccatttctcaggccccttctccggagtcgaacccttatcctccgttacccgtcatcaccatggtagtcagatacactaccatcgaaagttgataaggcagacacttgaaagacacgtcgccggtacaagaccgtgcgatcagcttagttgttctgagtcaacactggacgcccggagggcgcttggttttgtggcgaacaaatgcgctccgctctggggagattggagctttggtgcatgtattagctctagaattaccacagttatccaagtaagaagtcaaggtcaagtaaattatagctggtgtaatgagccgtacgcagtttccctgtctggcaggttaaacttacacatgcatggcttaatctttgaaatgaacacatcagttcaggcaggatcaaccagatagctgctagcgagcgttgccaagcgccgctattacagccgtcttgtaaagacggatagtttcagcagaaacaactccgttcagaggaagcgtgcgcatgggcagcgaaggagacagagcaag

SEQ ID NO: 23694 - DNA, 2197 bp, Heterodera glycines
  misc_feature (777)..(777): n is a, c, g, or t
atcattaaaaaattttaaatagttaattatttctatattacttcatcttatattattattattttgatttgttctctgtgtcaggttagcgtttttcattatcagtccgttgtttttcatttaatattttacggtttagtattccttatataaaaagtattaacaaaattatccgaaattataataattttgaatcggttgtgaaaaagaaattacaataagtgtcaagaaaagctgcgatcgaaatttccaaaaaatattattattttttgttatttattaataaaattaaattatttggcagaaagtgttcggtgagcgtgaattatatgcaaaattttttaatctttttggctgcttacatggatcgtttcgtgaaatcagccacaaatttaatatttttgttaacattaaatagctctaaaaattatttatcgaatttccaaaatctaagggctccatttttaattattaaaaaaaaaatttttttttttggtggggctctaattcgggaatgggggctttatttttttaaccactcaactcaaaaggggggctctacttcagagggggctcgctctaattcaggcgtgtgggtacaattcaataaataccgtattacagttggtatggttttttttttgtttacatgcccataaattgagcctttagctctgttaactttagtaaatttaagaattttgttagctttgtaaagttatcttcattaagtattttagaatatttttaattaaataattcttatatttatattgntttaatatgtatactttaattaatattcttaaaattcattttgtgaaattttaataccgcgcatcagatgaaattatttttttgctgatctttttcctgataaataaagtttttatttatggattgatattatataccgtattttctctaattaaggccctgtctccattaaaggccctgtctcctattatgtccccctttctgaggatgttgaaaaataatcgcccgtctctatttatccccccgggggataaatggaattattatattttttaaatcttatttttaataaaaattaattttaattaattctaaattgaaattcatttaaatgtttaataaacatgaaaaaataatacagaaaaatcatttactttacttttcttaggagtgtattttcccgatttttttttggcatttttagtggaatttttcggtaaaaaacatgtcactattttattaactatttcgaaatttttcatcactaaaagtcgcggccctagtcattaaaaatctggtcgagtcggcttttatttatttttttctataattatgtttttttaaagaataaaattatggttaattaaaaagttttaaaaataaaattcttgcgtaaatctgcattttgcatcacacatttattatatcaaagtcagaaattattttaaaaaccatattttgtttattttattttcatggcgaagaatttaaaagaaaatgatatttaaatggattttatctatagtttattattaataataaaatgttttttccgatgcttccgcaatgtaaaaataacttttttctagaccaatgccaacgcgcttcaaaaatgctcgataatgatgctgaccgggcagcaagcagtggtttgcacgcagtcgcacagttgtaaagcccgggaacaatggcgaattcttgaaacctatttctatttcactttcagaataaataattttttaatttattttaaattttccaatttatatttttaaatatatttgcggcacagctttcattaatgcctcatgtggtgtggtgctcgaacctcgagtatcttccaattaaaacggtcggatgaagaaatattctcaatctaattaattgtatttcatatctccttttaaatattatttgtatttgtttatacgaactaggggaatcttatgccctaaattgtagaataaattttgataaatatacatattcctgcaaaatttaatattttatttttgttaaaatatatacattaataatatttattagatttttttcgttaaaattattttctcaagttttaattaaattaggagttctattgaatttattaaaaataaggattatttcattagtttacttcttttaaagaaaaataattatatgcatataataaaaattttcgggtaaaaagtaataataa

SEQ ID NO: 23695 - DNA, 1595 bp, Heterodera glycines
  misc_feature (1510)..(1510): n is a, c, g, or t
aattctataatttcaattaattgctttttgtgctcagattgcccccatttttacgatgccaatttcgggcgaactttgcacttcttcgttgggttgcccgtcagtttactatttgcatggaattgttaccataattttattcactatttttatgctggtaattacaaggagaaattataaataataattgataattaaacaattcattaataattagtaccaccgaaattcaccaaacaaacatccgatgatgggcaaaacggaaattatgaaagtaccgaaagacaagattttaaaatttgaatttcaaacccaaatttaggtgatgttcaataagggcgcatcaatttacagcggaccatcgatggacggaaaaaggccgcccaagaagaaaaagtcacggaaagtgccatattgggcaatgtattcggacaaatccatttgggcaattttggtaattgggcaaaaaagtataaagaaaattgtaaggaaaaagctaatttaaggtggcatcgttcggtaattttatgggcactcaactttcactccaatttatgcccacttacattaacaaggcaaacaattggcacttttttaatgggttaattaatgaaaaagttttttttcatcatgtctttttataattgttccgttttttcattgcgtcactttcgcaggtccttcacatgccaatcgaacagacggggatggcatcggcaatttcacccgcaattatgtttttcatcaaactttttgctgggcagagctctgatcggatacagtaaaacaaattgataaaataaataagtaaaagaaaaatgccaaatttgtctttagatttattagtgacggaagaaaattgcgcatttacaacaccctttcgctgggaatgatgggccttcttttcattgttttggcattgctcaatccgaacaaaactccggctttatgtttggtgaatttgttttgtggcttcgctgtctttgatcgttaaatctctcttttcccaggtcattctgatcgtctccacttgcattctcggctttaactcgggcggatttttcaaatcttcgcaaatggcatttgttttctaacaaaatgcttttgattatgaattattggatcaaattcgattttgaggtgtcgcgtcagcattcccacttcactttggcaaacatttccttcctgaattgcgtctctatgctccttgtgccgttactcaacgaaattattgcaccggaaaacgaaccaggcatttttatgggggttaatctgtgtggaaaatggcaattagtgaataatattggggggtttaatttcagaaaattgggccattgttctgtggattcacgggatcattctgctgttgacaaatgcctttttctgtgcgttcgcttcggcaaaatccgccgaatggacaaaggacaatttcaaggacaccaaaaagggatggaaaagtgaaagactcaaattgaattaaaaaaacattttatataatttaggaaataanattgcagtgaaaaatggaaattgtgcagaaacaccgaaagtcattacggtaggaaacgaagaagcgacagtttaattgaagaaga

SEQ ID NO: 23696 - DNA, 1877 bp, Heterodera glycines
ttcagttacggccatacgtaaaattttcattgcctaatactccaaaaaattacacgtaatagatgggagttttaacaaaaattcaacatacatcattttgaatcggcggggcaagattctgcgcaaaatgattgttgtgtgccgaaatttggaggcgcacttctgaaaagccatttatttgattatttaaaattaagaaattatgataaatgctattattaaagatccatttttaggcaaattacgaaaatttctgcgcaagacgcgttttccgcttatttttgcgaaaatacaccgccgatttgtttaatcagaacatttataccaaaccagcctaaattattttaatttcatccaaaaatacagcaaatgtataatgcttatttttcgatttttctgccttttaggtgactattatgcggttttttgtgcccaaaaaatgaatctgtaattttcataatcactgaaatattttatatggaacatttttagaactttgtttaatcgaaataacaattacaaatccacctaaataatttttaatttaattcaaaaaatacataaaacgcaaatttaatttttatgtcctttttgaaacaaatcaccaaaaatttatttttatgattattggattcttccaaattttacccaccgttgtggaaatgtatgtcaacgttgagcattaattcatccgacacatttgcaaaaggaattgtgccgcgtccgccaagcgcccaaattattcttctgatatgagccgccgttttgttgcattggttggccttaaatatcaaaaattaaatttgaattttgttgattttttaagctgccaccattgttgtcgaatttttttgcagataatgcgaaatgaattgaatttgctaaaaaataaaaagtcagttaaatttaatatggaaaagcaaaaagtaatcacaacaggtaaatatttatataaatgaatttggataaatgaatgccccgcggatatgagtcgagcggagcggtgggagaccaaaggggggggggggggagacgttacaccgttcagaataaaaaaagaaaaaaactgttcaactaaatgtaaatttttttccacatttttcacttcccatcaagcatcctttccacctgctgctgtaaaacataatggaaattgccggacttagccattagcaacatttacgttcgcataagctaccgccacttcccccacttctctgcccccccccctcttttcatccgttcatcccttttgcttgcccccccccctccggctgtcagccgtccccacaagctatgagcatttttgcgagattttatcgggttaaatgttttattttctcatgaaccccccccccttctcccgctcaaccgttcgctacggtcgccgccgacttggaaactgaatgtgagtttagtgcagataaggagagcagcgactagggctgcacacaattacggattaatgcttatgaattacggaaatttgtgttatttttggaaaaattacggataggaaaaatggttgtaccttaatttaaacgtacttgtgaaaaatctagggttttttgtcttgagtctcgggttttcggtgtcagtctttgagactaaacgagattagagactgagttttttacaccccctaatgaatggcttttggtaaacctcagaaagatagtaatttatttttggtaaattttggctgtgcacagaatgctacttatttgaccaaatctatcaaaactctggtaaaaagctcaattttttcattctgtggcgcctagaattccaaatttttcttaaaataaactaaaaacccataaaaatttgttattattgacaacttcatttagcaaagtgcaaatggttagacaaag

SEQ ID NO: 23697 - DNA, 2170 bp, Heterodera glycines
attccctatataagaataatataccccagtttcaagcttaaaaactaatttaagactttttagcgcgttttatgggtcgggagtggtatcattcgatagggttttggactggctataaggaaaaactatcggcatcccaatcagttaagaattgttcgaactgcattcgaaaaacaagtcaaaaaatcacacttttttgaatgtcccatttttgaacgctttttgcatgccttaaaagtggtcaaatcaaaaaacaaatatgtttgtgcacatctacaaactcttggcttccgaatgataccagggttgttttggtccgggtccgggaagtgccctaaaaagggagctcaagcacttttggtcgggatttcttccaaaaaagaaggaaaaggaaaagggaattaaatggaaaggaggcaagtgattcggtggtcaagtggttagtgtgcttgcctttggttctgtgatggctgatggttcgagtcccattaatttatgggattttcccgtcaaatattatatttaaattattcgttttaaaatttatttttaatgttttttttataagaattttatgagtgagttaaaagagaaagaaaggcataataaaaaatatggaggagcaaagtacttttggataaaaattgatttctttcctttctttcctttttttatatgtaatgcacactcgccagtggtctttaacctcgccttttcaataagcaaaaaatgtctcctccttttctttccccagttcattatcaattgtttccatttacatcagttttttactgctcctacttttattcaataaatatttccaactaaattattgctgttttaatagcataaatttttagtttttgcctttggtggtggtgggcgacggctcgggtcccacctattctgggtgttttcatccattattttattacattttttgaacgattttattttttttaaattaattaagtttattaaaaataatttattttaaatattaaaaataataattctttcttcctaatttagcccaaaaatctattgtttgaccttttttgtgcaaaatcatttaaaaaatggagacaaattaataagttacctaaacataaaattataaatattttatgccaaaaaaagaaggaaagtgaaaaggaaattaaaaggaggcaagcgatccggtggtcaagtagttagtgtgccttcctttggtgctggcttcccatgggttagagtcccatttcttctgattattttaaagcaaatattatattgaaatttttctaatttttgtttttttacaatttatttttttaattaattaactttatggtattttaaattaatgataatgattttttgaattaataaaataataaatatttttaattaatagaataataaagtctaaattaaatattaaaattaatcgaataaaaattaaaataaacaaatattaataaaaatttaaataatttataaatctcaaaatgagttaattttaggattagacgaatccgggtatttgggcaaaactgggtccggatatttccgggtccagcaaagccgggtccgggtccaagtttttaaaccgggtacgggaggaacagaaagtggaagaggaacagaaagtggaaaggaacagaaagtggaagagaaagtggaagaggaacaaaagtggaagaggaaaagaaagtggaagaggaacagaacgtggaagagaaacagaatgtggaagagaaagtgtaagaggaacagaaagtggaagagaaacagaaagtggaagagaaacagaaagtggaagaggaacagaaagcggaagagaaagtggaagaggaacagaaagtggaagagaaagtggaagaggaatagaacgtggaagagaaacagaacgtggaagagaaagtgtaagaggaacagaaagtgtgagaggaacagaaagtggaagagaaagtggaagaggaacagaaagcggaagagaagaagaggaacagaaagtggaagagaaacagaaagtggaagagaaacagaaagtggaagagaaagtggaagaggaacagaaagtggaagagaaagtggaagagagacagaaagtggaagaggaacagaaagcggaagagaaagtggaagaggaacaaagagtggaagagaaagtggaagaggaacagaa

SEQ ID NO: 23698 - DNA, 1477 bp, Heterodera glycines
ccccctccttactgtacctcggcatcgtagcggtccaaccgcacactgtagtgactgtggacggactcgttgataaattgcaccattacgcgctgcacggggctaaccaatgttagctgaaacccgtaatggaacgggacgccaaaagcgaccaaaagagagcaaaggaaaagcgaaatgggcggcagacggcgcatttgggcgggtggcgtctcttgtgcattagcagaagacgggcaggaaaagttgaccattaagcagaatggaaataagctgaatgtgcgaatggatttaaattagtgtcggcacggtaaccgataacaaagggtaattaccgcgtaaattaccgccatgttttggaaaaaaaccgtaaatttcccgttttccagacgacttgatttactgctgactgctgaaattacatatttaccggtttccataaaagattttcatgaatttaataatttttgagggtcatagaatttggactccacaaaaaaacgatcattcttcttcgattgaaaagtctaacccggaggttttcgggttttttttatcaagatattagatttgcaaaaatcattgatttaaaatagtggcgtgcttgccagagagaaataacacacaaaattcatggtttaatgtgagtttttgaatcagagatcttaattccttctcaaatttcaattttctcaacatcgcttgtgggtgatagaactcctaaccaaagtaattgcctcaaatcctctaaaacttcacttaaaacaatctcttgacaggttttagtaaattcaaaaattttccgaacttattcttagtttcttctttaggatttgattaatagtgagattctaaaattattcttttttgggcaaatccaattgtcaagtttcaaacagtttaaaattgattacaggcattttaatgttcccttaaaaagttataatttcaaaaaaattaaattttcacaaaaaggcttatgtagtaatttacaataaaaataaattgcgggaacaaataagaattttttgaaaaaaaaaattcagacccaatttaagaaaatttaatttttattaataatttcatgaaatgaaaagattatttgaacacttaacaaaaatttcttctaatcaatgaattaatgaatttatttataaatttcaaaaaaaacatttgataaattttgtgggttttgttttctacaaaattttttccccaaaataattaaaaaactcagccctcatttttatcagtgtatttttggacccggataaatcgggtcgggttccgttaatgggttttcaaaataaattctgtattttgaaaaatccggatatccgagtctggaccggtctgttttgcccggagccgtctaaccctacttttttttgtttaaaagcggcttttaaatgaattgaatggacgaattgcttaatttaaaaataaaattaaaataaatttaaaaaatacacaaatt

SEQ ID NO: 23699 - DNA, 1975 bp, Heterodera glycines
  misc_feature (21)..(21): n is a, c, g, or t
aaattgctgttgcttctcacncaatgggatcatttgcaccccacaaatcaaatcggatattgttcaaattggcatccgaataattggcatgccgtagagcaaatctgacatagttaaaattggcgcccgaattttcgcggtttttccacttaactggcgccgtcgccgtctccccaattgggcaccgtttcaacaaccaattatatattatttcgttggatgattcttcggtctcctgtttcagtgtcagcttttctttcgtccgttcgttcaccaattcaaatggttcaattggcattgtgtccacccaaaaataaagttgaatattgtaacagacagaagtggtggcacggcgaaatgtctaaacacaaaaattggtaaaacaaaaacaaattgacgaaaatatggctagacacacctctttgaagttttgtccaaagcatcgccatcgtcaaagcccaaatgacgaatgtttgtcgcaaaaattggccaaatttcacggataaaaacatcccaaatcggttggacatccgtatcaattgaatgcacaaacactttcaatttggtgccatttctgtcaaagaatcgcttcttggagcggagaaatttgatcacggaatagtcaatgtacctaaagcaagagaaaaatgctttagcgtacacaaaagttaaggatgactgaatttgaaggttcttaaagctgattttgttgggcaacggatggtccggcaatggaaatcccacaaatttgccatagccaccaattaatatagacactttcggttttggtccaatattgtttgcttttggtcctttgtccttgcgaattacgacacttctccaaattgtcaattcgctttttctgtcgaaatgtttgtccaccaaaacatcgaaacggtcggaaagcaatgccattttgaggccgagtttggcatagttaaaagatgggagaatgtccatccacacgtcgttacaaagccaactgaaacatggaaaaaatggatgggggaaaatgaaaatttgtaattttaaatgaaaattttgtaatttttcaaaatatttgctgaccggcggttcattttgtggttcaatcagcacaggtctcaccaattttttcaatttaatttgtgtgtcacaaagggcaaaaaaactgtgttaacttaaagcatagacaattaggaaaaatgagagagcgcaaaaagaacacaaaatttagagaaggtacatgctatcgcatgaaaagctcaaaaatagcatttttacctattttcctaaacatattttggactttttgggaataaaaacatattttggggtttcggcagtttttgtcatatattttggcaattctttgaaaaaatttgatttttttaaacaaaaatgtcttttttggcagcaaaattcttggccaaatgcccaaaaaatttttcaaaattttttattttttttttcattttttgaccattttaatgatcttttcatttttatggcaaaattcaaattttagcgaaaaatccgaaaataagcattttgctagcgaaatgggtaaaaaatgagacttttatgcaaaattcacgtatttattaagtagtttttttcagtttttggcacatattttggccttttttggtgtttttagcacatattttgggggttttttggcacatataaatccgttccctgttcatagcatatacgaagaaaaaatatgttaatccatataatttacaaccctagaaatatgtacaaaaagtgttcaaaatatgtacataaatatgtaaaaaaaaatcccgaaatttgtaagaaaaccccaaaatatgtaccaaatatgtaaataaaattgtccaaatggttgcacactccgacaactgatggtcaaccgaagagattgtttgcagtgattatttggatccaccaaaaattgattggatcaacaactacaaagaggtgtctcgccatttttctcaaatttttt

SEQ ID NO: 23700 - DNA, 1314 bp, Heterodera glycines
aatatttaaagatttaatcagtataaatacttctataacttcatcactagtcaacatcaggtccttaaactacaagtttagtgaacgagaaagaatcaatatataaataaagacaattaagcaaaataaagtccataaatagataataaatggaaaaatttatatttattaagtaaacataaatttgagaaataatgtcaagaacggattcagatttttaagcaaaaataaatcaaattaataaaattaaatgactttcaaattttcattaagggataaatatttattttttatttgcattattaaaacaaaataaaaagtagatgaattatattattcattaaattttcaatttttgataaaagaatatttctcaccattttcgaagaaataagaaaaatttggaagactggtttaaatagaaaagcttagctcaaattatattaatctttcagataaggatgaattaaatatgcagaaaaattttaataaaaataataaaagagaattggaacaaggtcagcatcaaatcttaattttaaaatgaatacactgaaattcataattagtattttttactaaatgcaaatagaaaatctttaattataaaatcatcatacaaaatagagctcattgcgcgccataaataccggaactcaccgcctgaattcattatttttagaaagtccaaattaatttataaatactttaatcatttaaaataaatttaagtgaatacttattggaataataattgctttgagttttgcaatttctatattcataaaactcatggttcgactttggaaactgaatagaaaaaattgagaaaaactaaaaatcctttcaagtaagttctaagaaaaaatatcaaaaataaatttattaaatataaatttgcaaataattcgaaataaataaaaataatagcaaaaattcaaataattcaagtttttaaatctattccggatccaactttataaacctattccgggtcaaactttttaaacctattccggatccaactttataaacctattccgggtccacctttttaaacctattccgggtccaactttttaaacctattccggatccaactttataaacctattccgggtcaaactttttaaacctattccggatccaactttataaacctattccgggtccacctttttaaacctattccgggtcaaactttttaaacctattccggatccaactttttaaacctattccggctccaacttttaaacctattccgggtccaagtttttaaatctattccggatccaactttataaacctatt

SEQ ID NO: 23701 - DNA, 1814 bp, Heterodera glycines
tctatcaattttcatgtttttgcaattttattatcattcatttttggattttcactttttattttccaataaattttcattttttctattttttgttcctccgttattttactgcgaatgccaaaatgtttcttccatttctcaattattctttgactaactccaattttcttacaaatttcgtcataattttggtaccattcttttgctgaatattttcttttttgcttatattcctttttcatttcaatgaatttttgtacaaattctaatttttgttcatcagtttttgatttatagcttttttgtatttgtttttgaagaccaaattctttaatccatttgtaaatatatttccgatttgtccccaattttttcgctatttttgagttaattttatcccattcttttgctgaatattttcttcctttttgctttattttttctttaattttataatattttccaattatttctcgttttttgagttcatttcgcctttcttcttctttttcttgccatttttctccaaatatttcatcaaatgatttctgctgaagttttttcttttctgattcaattggaataattagggcaatcaaaaataaaaataataaaatacagaatttcattttcaatattttattttatttttcttcaattaaatggcaattcattttttgaggcatttaaatgattttttttcttattagaaaactgaataaatcattattttacttaataaaataaggaaatcctgtttaatttcaaagaaataataataataattttatcttaatgacaaaataattgccaattggtaaattaatgattaaataaattttattactttctactggagctcattcgtaaataataaacatattttcaataaaaataaaataaattcacaatgtaaagagattttagaaaaattaatgcaattttcgaattaattttattccattcttttgctgtgtattttcttctcttttgctttattttctcttttattttataatatttttcaattatttcccttttatcttctttttcttcccatttttctccaaatattgcatcaaatgatttttgttgcaatttcttattttccattttaatttgatgaagttcgatgatcaaaaatacaatcaaaatgaataattggtgtagcttcattttatttaaaaattcttaaaaattaacaagcaattattatttttactataatttaaacataaattaaattttataaatgaaataattgttagaaatcagaaaaaaacctatttatttgaaaataaatataagattttattatttgttattttactgaacaaattagtggcaataataagtaaaatattgattaaatttaattttccattaattacattttgttattgtggccgcagaaaaataaaataaattcgtaaaacaactcatttaagtttaatgcaaacgctgtacaacttttagagtttcgctacctaggcttatcaattttttgatttttcaaaaatatttagtcctttttttgctttttaacataggtatttatgttatattttattaattttaacaaatgatcatcataaaatttgcattattctccattcaactaaatattataaatttaatgaaatgtgaaatgaagtgaatgaatggatacaatggtttttggcatttctcgggttgatgatcccttttatccacgggtgccatttgtacatggattcaagtacgtgcttggatttgggtatctgttcatcgaaaattttggctgtacttaattctttccccaagtgattttt

SEQ ID NO: 23702 - DNA, 1352 bp, Heterodera glycines
ttttttgccattttataattcaacggtttgtccaccattcccccagtcccgaggccacattccgtgcaaaacagcgcgagccgccgaaaaaaaaagtcctttgcctgtgccaacaatcgctcatcgcccgcatttccgccactccccgaaccgtccgcagcgtaccaatggaatgtgtacctgttcataacagcactcatttatttttatgaatttggctaaggtcgagagtctcgacaatctgtagaaaattaatgtgccatttttgtacatgagtggaccaaattcgcctggcagtgcgtggtacaacgggtcgtacagtgacatgtcgtatttgggagtgccgcaaaggatcaaattgtgtttgtcattggcacgaattgccttaaaaataaatttgagttttggattcgaaattgaaaggccaaatgacttgaatgacgcgattgtggtgctgcaccatcacattccatggcacagtcacagcttcgttccaaatttcgtaaatgatgattttaaaatagccgtactgtgacgatatttggccaaagaatttgaccgcttcttctgtgtgtgggtcgtcgctcgtcaaatgtcaatctttgcaaaattaatttcaattttttatctaaattattaaaagtccaaccgataattaagtaaacgttccacttgttacatgcgttaatcactcgcttcaatttttccatttctcttaccgggttctccaggtaaccgttcggttcgacagccaatggggcgcgaatcttaaaaattttaattgagtaaaattcgcaaaactcttcatgtcttccaccagaatcaagtcatcatcgcatagcccatacttttaaagtatgaacttgaaaaattaatttaaaaaaggggaataaatgttagtttgttaaatttaaaaaattttactattgataattttttttattttccattcataataaattaattaatgaatagagatgattttgaaaaaaatatgcatgaaaatacaatagtatttcacttctgccactgttaatcatttgtcagatttattcggttaaaacgaggcaattaattagtacggcactctttccacgttccgctcgctcactcaccacattgacatgccaattgcacttcagctgccggatgctctcttcgttccaaaacgtgtcattgtactgactccaaaatagagaaacgccttaagaatttaattgttttaatttgtttaattatgctttccccttttgcctattaatcgtgcaggttggacattctccgcaacgagtttatttcctttaacactcaattacggtaggcaaatttggtaacattttgaagatgcccta

SEQ ID NO: 23703 - DNA, 1166 bp, Heterodera glycines
tttttaccattttttttttaaaaaattataaaaataaaaaggaattaaaaaaaaatttaattttaaaagtaactcaaaattgaaaaaacaataaaaaaaatttttattttaaattttttaaatttttttttaatgtttcgacgcaaaataagaagtaaatatattgttccctatttattttcgaataaatatttacattcatttttattaaatattttcagttacaaaattaatttttatttaatatgcacagaaaaaattaaattatattcagaaaatatttttcgatgaattaaacagattttattcgtcttaactcctatttttgtaaccatatttcaaaaaatgaagattgacggtctgctttaaaattttgatgaaataattctacgacagagctatagtttgtttattatcgttttttaattgttacttagttctatattttctaatatattcttgatttgactgcattgagttacgtagttgattgaagaccttttaacaatttttttataattaatattagttgcaaattattcttttttcaaataggtggataaattttttatttaaaaatgaaattttataattctttatcttcttgagcagccaagtacaagttctttcacgaaatataatttgcttcacacttgacccttggatatgtttattcatcagtatttattatgtaattttcaaaaaaaaatcttttcaaatatatctattgcttttcctgctacatttataaaataaaaattaagctaattgcagttatgttttataacaaattttactaaccggaatttaataataaatataatttttatttaataattataaactttcatttaaaaaaaatgaaaattgggctcgataaattataaaattttattgtatgaaatttaaaatacaaataattagggatgcgatttttaggccttctccgtaatgggaattacaaaagtaaaatagtcacaaatgtaaaggataatcagattaatttaatattcataaatattattttaatccgtattttaaaaattaattttatttaatataaatattcatttaaaaaatttattcattatatgcggaataaataacaattaattacgacattttacctttttttaaaatataaaaataaattaaataaaaaaaca

SEQ ID NO: 23704 - DNA, 1582 bp, Heterodera glycines
ttctaatcacttttgtccctgtcataatcacttttatacctcttctaatcatttttgtacctcttctgatacccaaaatttaaaaacgggagcgaagcgccggttcaagcccaaccaagtttaaaaacgggcgcgaagcgcccgtatgaggtttcaatgaggtagcgaagctcaagaagcgcgaagcgctttatcccaagctcagatccgacggttcacgcacccgctatttacatgtttatattaatttaaacgtaaataaattttttaaattaaattaatattttttattaaataaatgttttaaattaaaattagttattttttaattatacaatttcatgaattttttaaattgatttatcaaaaaattaataaatttaatttaaataaatattcaattattatacacttccaagttctttttaaattaataattttctaatcactgttgtacctctcataatcactgttgtacctcttctaatcactgttgtacctctcataatcacttttatacctcttctaatcatttttgtacctcttctgataaccaaaatttaaaaacgggagcgaagcgccggttcaagcccaaccaagtttaaaaacgggcgcgaagcgcccgtatgagtccaacaaaatttcaaaaacgggcccgaagcacccgtccattccaaaccatatttaaaaacgggcgcgtagcgcccgtccaagcttaacaaactttggaaaagggcgccaagcggccgaaaaggtccaacaaaattttaaaaacgggcgcgaagcgcccgtctgaggccgcgaagcggccgaaaatgcacatcaaaatttaaaaacgggcgcgaagcgcccgtatgagctcaacaatttaaaaaacgggcgcgaagcgcccgtctgaggccgcgaagcggccttaaaaccccttaagattttaaaataaattccaaatctctaaaaaaactcaatgcttatctaggtagcgaagctcaagaagcgcgaagcgcttttccccagctaaatagccgacggttcacgcacccgctagtttatattaccatagagaaaagttgcagttcgtcttaaaaactaatttgagtcgaacggctgtcgggaggggtctgaaagtggtggaagggtcttacaactttttgaggcgcattcaggaaaactataggttttttgatccgagcgccaactgagtaccagggaccgatttctcacttttgcttgcgtttgatggcccataactttttttctaaaactctgatcaaaaaatgcttgctggtaggaaactaagttgaagtgttttctaattttcaaaaaaaattccaggcctctacctatacttggaagggttgcagaaattggcaacttttcagtaccaactttgcccagttcagtccccgttgaataactcattaggctttgacctgagcgcagggtggccagcagacttattgtagagctcggtgagctcgatttttccagatattaaaatttcgaaaattttcaaaatttttcgagctaggcctaaaaaacggttttcgggtttttgaattttaggattttttaacgaattttc

SEQ ID NO: 23705 - DNA, 1363 bp, Heterodera glycines
agtaaactgccgcattgtagacttttcaccagcttcggagcccgaaaatttgccgttggtcattttcaaaacattcgtgtgccatggcaacacctgttccaacagtgaaggacagaaaaagcagaacaagtgcgcgtttggaaacggcactagtaccaagaaatgtaggaatggaaaggaacaacaacaaaatcatccagtgatggagaaggcaccaattcgaaatgccgcggacaacaaaaagaggcccttactcacaaaaaatttggtggccccactgaaaacaaagaaactgccgaccaaaatttctgaaatatttgagtcaagtgaaacgcgtaagcaccggtcggacccggataagaaagtgggcggtttagaacaagaaaaagtgtggatgccagtcgacaaggcgaagaaacgcgtttggagaaggaaaaattatggccaaattcagttagggacaactgaaaatttaggtagggggaaggtgagcccaaaaacggcttcgtcggcaaatgggatgttgggtctatgcgaccgcctccttgtttctcgatcccaatcgccataccaccgcggcgagactgacgccaaatttggcccaagaattttttatcgtggaggaaaatgtcttaaagagcccgaccgtggaatgttaggagacggacgccggcacaagctgaactcgcccaccacctatcggatgccgaatgagcataaaaggcaggggacgcctttttcttggagggtcgggatgtgttagtatttgaaatttggcgtttaatttgtttttaattatgttgtcccttcataattttgtctaattgtctgtaattgttatctctcatctatcgatatttgccactcccttcccagcagaatatgttcccccaccgtcttcccttcaattcattctgttggcagtgcactttcatatttgtattttgttcttattttcctccgactcttctcccattttattgttgcggttttaaataaagtgatttgtctccgtcttggaaatatttgtggaggagaagcagtgtattagcccgacccgaaaagcattatttagcacgtggcgctcctggcgaagagttagctgtgccggcattgtggatttttgactgttgaggagaagccaatttggagaaacggccagaacaaacgcattgttgcggttctgcattcttccttcgctgccgacagaacaaacgcatagctgcggttctgaattttaacgcattgttgcgattcaccaaatttcatcccactgctaacgcattgctgcgataagtgaggattggcgccgacttatttaacgcattgttgcgaatttcttggatttggaacgccgaatttt

SEQ ID NO: 23706 - DNA, 1435 bp, Heterodera glycines
tttaggaaaaaatttaccccgtttcactcattgatgtaatgttctctgcctttgcccaattaaaaaaaaaggggggcgggaaccaaaaatattttttaagaaattctgatcttcagggaaatctgtggggtaaaaattcagagtaaattaggtacctttctcggccaatttttatttattttttagtgtctgatcagtgatcacttaaaacattggataaccaaattttgtaaaaaatgggtaaaataaagaaaagtgggaaattaaaacaaaaacttgaaaattactcaccccctcccccctctcttcttagcaaatgccaaaatcgggcaattgattctcttgatatttgagtttcctgcctgtctgtacagaattactgtaccttctggtagcgttgaaaatatcgtggcggaatacgcaaattgagtgctcttgcggcggcatgggaagcaaacaaaaggagggggctaagaattataaatttttaaaattttcgatttaatttttcggactttgtctcgtccgtggtgtcaatttggattggtctcccgtcaaagccggcccattgttgggcagcggaaacagaaagtgaccggttcagtgcggacagctgctcctcctccatctcttccaactcctcctcatccgatgccacttcgccttcctcagcaaaaatttctggcactgattttgccaattttggctgccgttgctgtttcatttttggcactctgtcagtgtcatcgatcattttggcattctgttggtttgattgtcgccgccggcgtttcatggacaaagccaaactttcgctggcatttccaccggctgaagggggtgaagcatcggtggaagaatcattattttcggcattttcaatctgtgctatgagcgcgttttccaaattgttcagttgctcaatgttcgggtgcaattctttctggaaaggatcaaatatccaatttcctaatccggcaggcgtcaaagtcaataaattttgatgcccaattttctcgggcatttttgggataagttagggattggcacattcaatttaaccaggatcaatgggagaatgtcgaattatttagaaatttcatcgtcgattctcaaactgataaataataataataattctattaaaaataaattttataatttgtgtaatcttccgttttcatatttaaattaaatttttttttattaccttaaatgggtcacaaatgattgtttcattgtccatcccaattgactttgcgtcttctggcggtttggaaaaaaagtcccgtcatattccgcgcaaatttccaagtcaaatggccaccgcctgagaaaaaaaaaatttctaatttgacaacacttgaaaaatatgacaatttctatggaaaaaaatttggccccaaattgggggggccccctttttacaaaaatt

SEQ ID NO: 23707 - DNA, 1491 bp, Heterodera glycines
cctccgcttcctcctccccctcctcctccgcttcctcctcctccgctttctcctcctccgttttgccctccactgcttcctccccctcctcctccaccgactcgtcccccaccagttcctcctccacttcctccccctcctcctccgcttcctcctcgtgcgtttcctcctcctccatttcctctcccgtccccattttctgctccatcaccaccatttataacgccatccacatccacgtcctctacctcactctcttcaaccacttcatcatcattcgcctctctctcttcttcctctctctcttcctcactccgttcttcctctctctcctcttcttcctctctctcttcctcactctcttcttcctctctctcgtcttcttcctctctctcttcctcactctcgtcttcctctctctcttcttcctcactctcttcctcatcactctcttcctcctcctcattttcatcaccaccatccattttctcacccgccttcaaaaagttgtgccatgcattgtttaaactatacaatgcttctttccgcttaaaattttttaattatattgattaattatattatagaatagtataaaacttcaaacaaaaaaattatatttgataaaaaattattcactttttattaattttaggccaaaattttactaaattttaaaatttttaaaaattgataaagaaatgttatacgttcaaacatttaatttttcaaaatttaccttcatttcatgaaattttcaaaaaaataataataataataataatcaaacccaccaagaaagacacatccaacaaaatccagccggcttttcgggactgatgtttctgcatccgcggcaaccaaggagtttgaaaccggactgaagagaagcgtgccaagacaaaacggaatgtctgttgacatgttggacaacgccgccgcagatttgttggttcgatgtcttcatattcggtggtgcggttgtcgtacaattgtttgtacaattgccaattttcgttgaacaatttggtctgagaccaatgcagatgttgatcggaacagtcctgttgttgtgccgttgttttccgtcgttttgctgccggcaactcgactggtggtgtaatttggcgcccaagtcgctggagaacaaattgttgtcgcatttggttggaagcgcagatccgtcttgaagccccctacaatttgtctgtaaaagaaaaaaatttttatttcaattaattatgtgagaatcaaaaaaaacaaaaaaaaagaagcaaaaaaaaaaaaaagtttttggtgagatttttgactccaatggatgaccattggacggcattacgcaacgaaaatcaattggagaatagttaaaggcgtccaatggtcactcattgacctcaaaatctatccccccccccagaaaaagaaattgtatgagcaaaaaaaatgagagaattgcttatttccattctttctaatccatcgtacagtcac

SEQ ID NO: 23708 - DNA, 2236 bp, Heterodera glycines
tctcttcatctctcttcccctttctcctcctctctctctcttcctcttccactcctgtcccccatccctttcctattcccctttcactttctcttccccttctgtccctcatccctttcctattcccctttcacttcctcttccccttctgtccctcatccgcttcctcttttctcctttctcttcctcttttgtccctcatccccttcctctcttctcctttctcttcctcttctgtccctcatccccttcctattcccctttcacttcctcttccccttctgtccctctttaataaatagtaactaaattttcctaattttctccatcggcaccaccagacagactcattaattattttgagggtagcttttacgaaagtaaaatgacgtaattcatccatcatagttcattgatcaaccaacgcctgatgacatttattgaaacgagtttaaaaattgaattgaaggaaaaaacaaaaatgaaacatttcgtgatggtgatacatatgtttaattgtattcccatttaacaataatagttcacctttaatttcttattaacaaatatcccaggggcggaaaaggaaaagggcggcccctctttttgtgtcaacctttcccggcattcttctctgatcagtctcggcgttttgccaatccaatttgctcgagtaagacattagacgcccttctgttcccgaggacactttctggatcggattcgccatgatttcacttttaacattggatataaaataaataaagtgattagggcgtaaatgcatttaaatattctccccccgcccccctaattaacccgagaatagatacaaaaattttcatcaaaattaaaacaaagttgaaattatttctcttcttttctcggccactcattcaacattactagggcttccttttttaggcacaaaaaatcgcgaaataggcaccaaaaaaagcattaaaaaatcgcaaaataggcattaaataggcacaaaaaacctcgaataggcagtaaaataggcaaaaaaatttttttataacgctttttaggtagcaaaacacttaaaattaatcaaaaaattattttgcttatatttcaattgttttaaatagttcaataaaaataattttaaaccaaaaattttatgaagaaaaaataattaatttttggtgaaaaatttttgtgaaaattttttcaattcttaggggtgtattttctgaatttttttcagtcgattcttaggggtttatttttcatttttattgcatttttgttaacgatttttacggaaatcctgaaaaattcgtcaaaaatggcgaaatgggcataaataggcattaagcacaaaaagtccaaaataggcaaagttaggcattataaaagtcatcgtagacaccccaaaccaagcggaaaatacgtttttcgtgcttatcagtacgtattaagtgcgcaaaaattttaggcatttgcctaaaaatcgcatccctaaacatcacatttaaagctcatcgtctcattaaatgtcaatattttgtcatcaacaatgttctgcttttcgcttctttttttcagtattttcctcttaaagctttgaaatcgcaccttaaaaagttcattggatttgttgaataaattacttaattaaaaaaggacaacaatattaatttggtggatttaaaaactaaaagaattattctctttgagtttcctttaatattttgccaatttttcactttttatttttttccaacaccaaaccaacgaacattgggcagttgttggacaaacgatttgttcaccaccggtgccattttggccaattgttccgcgccggtgtacaaatgggtcatgttgaacaaccgttcgtacacacacaacaaagcgccaaaatcgaaggctggcgaaaatctgttgaagaaaaaatgagggaatgcggcgagtcgggccaaatcttcgacgccaaaaatgcaaatgccatgacgaaaatgggcagaggggcaggaagtatccggagcccacaaagtctctctgaaagcttggtaatggggttatgttcggcattttttagagactgtgagtgatccaaatgagaatgcgaacctcgtcaaatattttgtgggccctgcctttttttggttgaagcaagtctgcgtaaagccgcccggcgcgttaagctgatcagccgagtgcagagtgatcagcataatttcgtcccgtccatagccgatcagat

SEQ ID NO: 23709 - DNA, 2465 bp, Heterodera glycines
ttatcatattgatatgcaaaatatatgcctttcttaagaacatatttgaaatttacggctgattcattaaatttaaatataaatgtgtaacataaattcgtgttttatcagttaaacatagaaaaatctgaaatgtgtatattttaataataattttatcttttgagtatttaataggctaatggggtacctaagattttgaattcgtcaaaattatatgttcaacgaaaaacacatttatagcctgttggtttgagcttttggggcatatttctataggcatacttttggcattttttcactttattctaggggcccttcaaataaagaaaacattatgatatccttgaatgttctggtagaaaggattaatatgcaatcgtaatgacataagctgctccattttgattttaaagggataatcaaatgctaattgatcccgattaatagcatttattggctatttaattttgactattaaaattgtttccaaccttaaaaaacatcggctgcaacttttgcatcaaaatatgcgcggagcgctcttcggaggtaaaattgagcaatttgttcgtaatttcgtcgtcccaaatgttgttgccaccgccttctttgctcggcttgagcacataattactcggattaacaattgcatcctaaaaaattcaaatccaattaattctcatttaagtgattaatttatgaatgaatgaattcttcaaaatcacgagctccgtggttttgctggtcattttaaaaagtcatatttattttcaaaagtttaaacattgttatcttcattgagacgcaataaaactaaaatatttattcgttgctctagttattcagttatgatggataaactaatataaaaaaattaatttttttaaacccagtcgattctttttttgaaatgtctcatgccgaactaattaccaagagctataataataataatacgaactatttaaaaatttctcttgcctctaaaaaagaaaaggtaagcttttaatttcatttattaggttgggcctgattaaaataaaacaattttcttctatgcttatagttaaacaattattaattgcttcaccttcgtggcttcgatggccgcatcgtcctgatcagtcaagctccacagcccggcgaacgtttctcttatggcagcggcttttttcggattttcaggcagaaaacgctcgaccatcccgggttgcgcaagcaccttaattagtgaaactaattaactaattattttaaatggaaatttgtatctgaaagtaaaaagattaaaattaaaaaatatgttcacctgctgcgttttcttcatgctggccaattggagtccgctggttgggcttttctgaacagcaaccataaaaatgcgaattgtgcgggaaaatatttcgcaaaaattaaatgagttaaattttcagaaaatgtttatttttccttgactttcttattaaatttacagcaatttcgtgtgtttaaatataaaacttttacattttttgacaaattttagttttcggaaaattggcctaatttgaatatttctgaaaagtgatttggcatttttacaattatacgtacaatagcggtggaacgttcgatcatcagtcgcatttcccaatcatcttcgcttggcttaaagaaatcagtgacaaagtaaacaatggccaccgtccgatcatcaaaacgcagtttaaagttgtcatcgagtgttaatctgaagaggaaatattcgagaattggttaaacaaaacgcataattgaattttttcagttttttaataaaataattgaaaaaatgcccaaaataattggaccgttaaataataaatataaagtttttaattcgtaggcttaatggtgttccccttttctcattaaatagtgctaatttaaatgcttttttaattgtttttttttgccgaacattcacacaaaaatcgcctgacaattttttaaatttggtttatttcgaatttggattcaaaaataactttttttgaaatttttatgagtaagcaacagaaaaggatgattgccttgaaaaaagtacatcttttgatgcttctgtcactccaaaagaagtaattattcaaaaaaagacaaatggacactctgccgaaaagttaaagttatcccatgtatcaagagaacctctaatttcggaaccaaaattcaaaatatgacagggtgacgttatgccagagattggttttttacccccccccccaccgatcgctttaatcacctgccatttttcatcatttccgtacattccgggtatccaatgcgcacagtttccgctttatgctttgtcaaacgccacaattcatattcaatgtgtcgctgtgcaaatcggtttcggtttcgtcggtgtgtgatgaacagaatgatgccttttggatcaccaaatgcgtacctttaaaataacggtaatgacgggatcagaa

SEQ ID NO: 23710 - DNA, 1453 bp, Heterodera glycines
ccccccctgtcccccaaaagttctttggaaaaagcgccgcaaaaaaatcaacttcgatttttcatgcttagaatctcacaaaatgcttatttcgaacaaaaaaattactcaaatcgatcatggacaatcaaaaatataacatttgaacattttatacgtgttttgaataaattttgtaaaaatgaggcttttttgcctgccaaatgagactttttaaaattttcatctggcaaccctgtccatgatggacttgtgaatgctagttgcggcaatggaaaaaaaattattgtagattttccgagtaattgcacaaaaattcctcaatttttaataagggaaatttctttaattccagtcttcgagctaaaagtaatatttttttcaccaatgttatttatttctcgtcgccgggagaaaaagcaggagtctttgcagttgatttttcaatcaacccacccagcagaataaaaatcgctggaaaacattaattttgcaaaaaaaaatatttaaaactttttgggagattcaggggggacaataccgggaggtggatattgatatggaaaacaagctattcccgaatccgtaccgtgttcccatttaaaaaacgaaaatgtcaggaggacgtaaagaaattttgaggatcttggtctgcagcgatctctaatacttacaattagtcatgcaattcaaaaggattttctgttaatgaacaacaactactgctgaactaaggcggacgacgatggaccagcggggggggggggaatcgaacggacgacggacctgcgtacggaagggcggaaacggacggaccaacgggagaatgaacattggcgacggcgattgtgaacggcgcagaggcagaggtgctgtctgtcgtcacaaaggcagcgtcggtggttgtgaaggcagcattgctgcagcattcaatgtccacgccgctgttcacgcaaccgtgcacaatgaggcggaggacactccgcactttgcagaacaaatactattaaaattcattaaggatcagtatattaaattaataaataaactcgccgcaagggagagaaggaggatgcccagcacaacgcaacccacaattattctgtaatcgtccattaaaaaagagtacaatttttaaaccgaccccaaaggaaattttgtgacgggcgtcaccaccgggacactgctggggtccacaggcaccttcggatcggctttctcctcctaattctcctcttcttttggtggagttggcaccgggcagtcgcacggcggatcactgacgttttcgaaaaattgctttttgatcattgtgagacatttaaaaaattcactcaatttttatttaattatatttacggctcaaaaaagcaatacatctagcagattcccatacaattgtggagtttttcaaaatgtatattaccgtccatgaaaagctgaaaaggcctga

SEQ ID NO: 23711 - DNA, 1127 bp, Heterodera glycines
tacggacactaaaatgccgtattacagtcatttaaaaattgccattataacggtcgctaattaccgatattgccagtcactcaaattgctgtaattacagtcagtacaattgtccttattacggtcaaaaaaactaccgcaattacggtcactcaaattgacgtaattacgtcatatcataaaaataccataattacactaattctgggttttcaaattattgccattattgcggtcatccaatgcgcatacctgagtggccgaacgcgttttcagccatatgtgcaggatggatgaggaatacagttgaaccggcacagtaacaatgccactcgtgtttgaaccgcccaattggctactgtaagaaaacggttttttcgctttgcctatgacataataattaaccgaataatgccccaggcaaccactgccactacgatacaaactccgactactgtaagcacaattgtgtgctttttggccatttggaataatttaggaaaaaaatcctctaaaataggcaatttttaaagaatgcaaaaatggaaatctgttgacataaaagcaaagaatttagataatgtaaataaaaaaatgactttcttatcattaaacaattttatgaaatgattttttcaaaaaattggcagaccataaacaaatcataaatcaattaactgaccgcgaaaaatgcgttcaaaaatgtcaatagaactaaaaatgattgataacaaatttttgagaaaaaataataaaattttaaaatgtttgtgttaaataaaaataaaaaaataaaaaaaaactaaaacttaaatttaaatttgcattttattttcaattaagtaaaaatgaatgcaaacacattaaatttaaaataaattttgaatataaaagcaaatttaatataaataattggaaaaaaggcttatagaatgaattgacaaaaataagaaatatatcaaattttgaaaaacattttaatgttttcatagattaaatttaatagaattgaatgaattgcctatcgaataaaaatgtttttgtgtgatttaaatataaaggattaacctccctaaactgaacaaaaaaaatatttcgcgatggattaataaaaaatgctgtggtca

SEQ ID NO: 23712 - DNA, 1666 bp, Heterodera glycines
aaaacagcccaaaagctgaatccatcgggcagagttgtaaagttttgccttaattaaaggaaaatttatgaacggaaaaaaaaagttaattagcgattatgaacaattacccagggcaataattaagctaattgcgcgaatataggcaatatcaattttataaataaaaatttttagtttaaatttatttaaatatgatgatttgtagatttttcaaaaagtccaaatccaacttcacataattctgaacaatcaactagaacggatctaacttcccctgaaaagcaaattggaaaggctcgtgcaacaaaaaataatgctgctggaaataaacggtaagaaaaaatttaaaaattttttatccctaccagtttctcccactttctttccggaacgggccaactccgtctggccaactccgtctgagccaactttgagtaaatataactcttgaagttattgaccgaatcaaacaatcttgatatcattcgaaagctcttcacaggctctattagcctactaaaaattacagaaaatttcgaactataaaaaaagatagaaataaaaaacttcgaaaattctgccttttttgcggttttcaactgacaacttttttgagagctgattaatcactgagaaatagcttataaatatcttctaaacatctagggcttttgaatgataacgtgattgagcgaaaatgtgcaacatccataaaagaggaatagatattggaacaatgggtgagcaagaacctttttgaagtgggggcatccattggggcaatggacaaattaatgttcgaatgggcgaacattggatggaaatagcagataaaagcgatgacactttggttgaaataactgaaaaagaattccgaatttaggggtgtaaaaagacaaaatttattcaaaaaagtaaaaaaattaggccaaatctgtattgagctaaaaaattttaaaaccacaaattcttgtcaagaaataaataaatttttgagattgccacgttttttgattgttcgagtcgtcgtcgtggcactgtgaagcgattttgtgtataaaagtgaatttttttgaaaactgatttttgacttttttgttcgaattcgtgttcggggttcgaattggcttaaaacagatgccagaatcggtttccccgactctgaaaaccctaaaataagtttatttaaataaaaaatatttttgaaaatctgagtacagataaaaaaatatcggaaaaaaagattagttttgccttcgaacaccttgaaatgtattgttttgcaattgtgcgggtgaaaatgataaagaatgagattttttgggatttttatgcaaaaatcctttgattttcaaattttaagtacatatttcgcacatatttcagcattttttagcacatatttttattacatatttcaggatttttagcacataaaaatccggtctctaacaatcaatatcctgcttactaaaatatatattttaccaattttttttatgtttaaataattaatattatatcattatgccatttactcaataattttattttataaaactattttaaaaacaatattataaatcataagaggtttactgatttataataattgaaaaatatatacggttttactgaatatttgctatttttgtattcattt

SEQ ID NO: 23713 - DNA, 742 bp, Heterodera glycines
tcaaaaggaattttaaaagatacttaaataaaatcaattttatagaattttaaaatattgcttcctgattctcaacaaacccaagcaaatgtaattcaaagtcgagaagttctttgttcaagaatttatagcatttaccctaaaaaataaataacaaaatttcaattaatgtttctcataaatatcaaaaaaatcatatattcgggcaaaattgtaaaaaaataactatttattaaatacccataagagaaaaaaataatcattagaccctttgctagctaataaatattgacatttaaaaatgaaaaaaataaatttattttaagataaacgaaaataatgataaaaatcattaaaacaatttttacatggattatattcaattaattaactacgccgtgataatagaaaatttaaatttaatattaaaaatataaaaaaatagtgcaaatacaaatcagtaataatataacaaaattgtttaaaaagttaataaatgataaagatttgttattatttaaaaataataatttctgaaaacaaattttttatcataataaaatttaaagaaattaaaaaattatataaataaattgtttatattaattaataactagcgggtgcgtgaaccgtcggatctgggcttgggataaagcgcttcgcgcttcttgagcttcgctacctagatatgctattgcgttgtgaagagatttagaatttttacaagattatctgggatttt

SEQ ID NO: 23714 - DNA, 1366 bp, Heterodera glycines
ataaactaacttttaatggctgaaaaaagtattttacagcaataagatcgttcaatccttatgataattgggacacccccaaaatacactgaaattcgggaaaatcttcgaatgagggggttggaaaatatttggaaaatttatgtgagatttcattttaaaattaaattcaatgaccaaaacaaataggtgtaaaaataagttttaaagtaattggttaaaaaagaagtagcaagatcccagtaaaaatcccgtcaatttttaacgggagtaccggcgtgaactggagtaatttccaaatttaaactataatttttatatacaagatttaagccacaaaaaattgtgaaataggcacctaaaagggcaattattttcatttattgtcttttaggtattaaaacaagtaaaatcttaatcaaacgctaaattttggttgaaattattaattaataaggacaactttttaaaccagaaaatttatcaagaaaaattatatttaatggaatcaatttttgggaaagatttttaattcttaaggggtgtattttctgaaaatttatcggtcgattcttagaggtgtatttttcctttttattggttttgtgttaagatttttccgaaaatactgaaaagcgccaaaatcatactgtatttccctcaaacttttacagtacctcttacatttacttttgcataaggcctaaccacactgcaaatttcagaatttttatgcacttatgatttttaaagaaaaaatcagttttttccaacctgaacgtcaacttgggggagtcgtgttttaaaaaggcgattttttgtaaaaaaaaagttttacgaatatgaaaaattctgaaattttgcatagagttaggtctcatgcccagtattttcatgcgaaatttcaagccattatgataactcctaactgaattaccaaaatcaacttgagcaaaactcaagtttttggaacatcaaaatcctttctctactaataatgactgaattagtaccacacgaaagctctatatctttgaagaaattttaagctttttcaaagcgattaagcaacccataaaagttaaagcttaaaaactcgggaataatcaaactcattaaattttccaagactttaagccaaaatccaagaacgtccttggcatccaaagacggatacgagccccgttttaaggtcatttaaactcaacaacaaaaaagtgtatttgacttaaattcccatccccaatgatgacgaatttattttcctttagcacagcagacgaaattcgcaattcccaaaatcggagtggagagaaatcttagcatatttcaaaaaaaagaaaaattcttaaaaatatttaaatta

SEQ ID NO: 23715 - DNA, 1763 bp, Heterodera glycines
taatttagacattatttcattgaaaaatgttcggcgctttagctgtggggcgcgcgaatattgtcaaaaatcaggcccgaccaatgcccgaaattggcacaaccgtcgcactgtttttggcaccaaatttggcacccaaaaaattcggacaaacttttacggatgatggaacaacttcggcacgatgagacggtgagatttttggaagggggaaggattgggtcaaatgtatgccatttttgtcatttgcatcttaaattacaaaaagttatggcattatattaatagtgcgtttgtttttactattttttgttgtattattttcaggcctcttcccaattcgctcctttcattttcatgccaaattgtgctccgttttttgcttggttactgtcacaacaacaattaccttacagcaacgggcggcggcacaaagcaacaaaaggtgccgacaatggcattgggctagggggaagtactgcttccgcctttgttgtgttcggccgaattggcgacgtcgcgcaacggaatggaactcgccgagtggagcattcccttttcgcacacccaaattggctgaaaggagcggaaatggttcgaaagcgatttatatttaaaaaaacaaaaaaatcgctgaaaattttgacacagggggaaacgacctgttccgggttaattgtgagtagttcatttctccaacgccggttctccccttcagttttcccctaaccaaaatttgttcctaaacaaatagtttctaaaaaaattaattcgaaatatgtgatcctccgtcctccatcaattttcaggtctctgatttgtgttccgacgttgccacaaaaatggatgaccagaagcagtgcgtcaacactacgacgaacaatggtcttgtccaccatcgtcgattgtcgtcaaaattggaatggctcgtatttctcgtggaggtacaaaatgtttattaattatttttaataatttattttccgattttagcagtgccactcggtggcatcgtccaatttgtcctctcttgagctgtctttggccccatcagaagccattttggtgagttttgccaattcaattttcaacatttgctccctttccattttggtctcgtttctcggcctctgtgttcgtcacgctgtgctccattttccaacacgttcaacaaacattttgccaaaatggcagtgccaaatttcgattttctcaaccgaatgtatgcacaaagaaattattgtaaaaatgaattcttgagattttcgaaatatgcttcacattatttccttttaaataattaaaatttattaattaccttcctaattaggtaataaattgtcttccccccatttagcccacaatttgtgtcccattgtcccactttttggccagcatttgcagtgtttacaaagcgcgcattgactccgatgagcgctggactttgctcaaatttttgcctctccgtttcttcgaaatgccagtaaaaattgcgagagaaaatggtagaagtgccgaaagcgaatttttaaaaaacattttgattttttaagaaaatggaaaagtctccggagacggacaacagaagctcggtgaacaaattgccgaattcaatgcgcgaacaattgctctgtcgcattttgccaatgcgcaagcgtcgcccaaaacaactccgattttgtcaaacaacaacggcacaatcggagaccgaattggcaatgggccaacggaagcgccgaaagccaaacggagagaagagataa

SEQ ID NO: 23716 - DNA, 1976 bp, Heterodera glycines
cgcgcatcgcggattcaatttgccgcgatcgcggatcgcgcaaaaaaaaaaacgccgcgaatcgcgcatcgcggtcgcgctccacccctgatcggcaccgccggaccctgaactcagcaattgttgtaaaaaataatacgtttctgatttttgataaaaaatgtgtaataaactgattaaattaattgttgattggataatttaagaaggattttgttttagttttttaaaatatttaattttttagtcactgaaaatattttcccgttttgtgcctggccaattttaaataaaatttctgcccgaccattttccgtaaaaataacaaagaaaaaattttgattaatttttgtataaaaaaaaattcgtctcgtctcgtgtctcgtattttatttccgtctcgtttttctcgtgtctcgtgtctcgtattttattttcctatttgcaacggttataggacatttgcggtccggacatttgcggcctgctggaaatcggacatttgcggcccgacaaatgcggtcggacatttgcgcctcggacatatgcggcccatttcttatgggccattttcggacatttgcggcctgctggaaatcggacatttgcggccaacggaacgccaaattatcacttttttaattccaaaaacgatatttgcggctcaactttttcgactccaaccaaaatagtgctaatttatcgaaaatcgtttttcctcttgaattttcgatgaactttattcaatctagtaattttaattgggtcttgtttcgctggtggggagagagagagagaaagagaaataaggggagagagagagagggggagagagagaaataaggggagagagagagagattaaagagagagagggatatgagcgaatatgcgctgttaacaaatcgcattaaaaattaaaaaatatcggcaccgccggaccccctcccctcgctcattcaccaaaagttttttggaaaagtgcgccgcaaaaaattgttataaatctcgtttttgatcccgaatgcactgaaatttaggatttgcgtatttcctccccaaaattgtaaaatcgattatgggaggtggaaaatataatattaatacatttttgatcgaataaattgtaaaaataactgttttgacgcaatttcgcaaatgttctgattttcgaccctaaaatctgattttttgagcctgctgttctgatttagaaaaattttcaatcgcatccctggcttatttcccacctgatgccctcgggcgaccaaccctttccaccaattcattgacagttttggcaactgtttccgcgtcactgtcaaattcatgctttggcgtgatcaatattcgacttttttccgaatatttgccgggctttggcggcacactttggtgaagtggcgcgatgatcgcaatgcgcaaaggctaaaattttttttactaattaattttcataacaacaacagttaatgtacaatattgcaacccgtaaaaactaaatctttttttttttgaataaaaaaccgaatttttatttcaattaaaatatgattttttggtatttttaaattgtcattgaccgaataaaaattatattcatttttgtttttttcaccacaacatattattaaactaacatttttatattgcgactaaaaataaaaaaaatatttatctaaattaattaatggttcactttaaatgccttggcaaaactgttgtcgctgatcagtggaggatccgacgctgacaaatcgtcaacatccgaaattggtgatcgaattgatgattgaaaggtgaatgcgtcatggagcggtggagacgaaaacagcagatcttctggatcactcgctgagctaattgagcccgggaatttgtcaagcgaggacggcgatgaaacggccgaatcgctttttttgatcaataacggggccagcagagggttgggttgcattttgatggaggcccagcgct

SEQ ID NO: 23717 - DNA, 1541 bp, Heterodera glycines
gggggggggggggggggggggggggggggggccccgggcgagggtgtggagaaaaaaaaaaaaaaaaaaaaaaaaaaaaaaagggggggggggggggggggggggggaaaaaagggcccctttttttttgtttttttttttttttgtggtttcggggcccccttttttttttcccccccttaatataatttttttccccggaaaaaaaacttttcccaaaaataaaaatctttctttcccccccaatggggggcgttttttttttttccccccttcggggggggggttttttgtttttccccccccctttttcccttttttttttctttttcccccccccacattttttccttttttttttttttcccccccaaccccttttttcccttttccggttttgggggggttggggggggttcccttttttcccttccccttttttcccctttttggggggggaatttttttttcaattttttcccttttctttgaccaattgccaattgtcccttcctttttggccgttttttttatttccgtcgcttttcctcccctcccaaaatgggggaagttcgctttcactcggattacgtttcctccaccgcggaatcccaaatcatccaaattgtgctcggttttgtcgtctgttcggtgctttgttcgaattggtgtcaaattgcaaattaacgtggtaaaaacacacaaaacattttgaggtatggcgggtacagctgtttcggggagggccgcctcggttatgtgagcggattgaactttgtctgtttgatgattaacatgtgagttgagggaaggcggcactgacaaagagcaaacgcaaatcatcgcctgaggaattgtttgttttcataataataattgatagaaattgtcggattccccccccccccaatcggttgtcttttggtaggctaattgatcaacaattcactgatcagcagctgataattggcaatgggctcttatgcagtttaacccccataaatttttttcgcatttcatgattaaaaatgccaattaataggttttcggggtcgctgatcacgaatccggcatccgtttcgaccaattccgaaccccggacccgaatttgaacaaaaatttgaaattccaaattttcaacaaaattcacatttactgcaaaaaaacaattaaaatgccacgaaatgtgtgagtaaaaaacaagaaattattggattctttcacaaggatatacaacgctaatttgggaccaaaagttaaaaaactgttcattgtgaaattttggagttcttccattttcggttttatttttggggattcggaatggtgacagccgttcaaaaacacagtgttggcccattacaccacagcaccaacccctccctccccttccccctccactttggaatttgaacaaaagctcggcacggcagcagcgattggtggatacaaaaggccttaaaattcacagcaagtaatggatggacaaaggccagaagactgagtggagagacgaaagatggccaacgaacggccaaatt

SEQ ID NO: 23718 - DNA, 845 bp, Heterodera glycines
atccttttcctcctctttctccccctccttcttccgtcgtatttttccttttcctctctttctcttccgactctcctccttccccactgctattttcatccttttcctcctctttctccccctccttcttccgtcgaatttttccttttcctctctttctcttccgtctctcctccttccccactgctattttcatccttttcctcctctttctccccctccttcttccgtcgaatttttccttttcctctctttctcttccgactctcctccttccccactgctattttcatccttttcctcctctttctccccctccttcttccgtcgaatttttccttttcctctctttctcttccgtctctcctccttccccactgctattttcatccttttcctcctctttctccccctccttcttccgtcgaatttttccttttcctctctttctcttccgtctctcctccttccccactgctattttcatccttttcttcctctttctccccctccttcttgcttcgaatttttccttttcctctctttctcttccgtctctcctccttccccactgctattttcatccttttcctcctctttctccccctccttcttgcgtcgaatttttccttttcctctctttctcttcccgctctcctcctcccccactgctattttcatccttttcctcctctttctcccccctccttcttgcttcgaaattttccttttcctctctttctctttcgattctcctccttccccactggtatttttcatccttttcctcctctttctccccctccttcttccggcgaatttttccttttccctctctttctctt

SEQ ID NO: 23719 - DNA, 1798 bp, Heterodera glycines
ggcgaaaagttggcgaaaatggcggaaaaaaccgatgacattttggtcgatgtaactgaaaatggatggagaaaaattgtataaatttttagcatattagccaattttacaagatgctgatgcgttcgaaaccgatgactttgcgtggcatttcaatttgcggaattggcaatgcttctccaccatcattgacaatttccacttccttggtgccattctctccaattttgctgtgaatttgaataaatttcagcgcccatttgcgagttttgaagtgttcgtccacgtaaatgccaaatcggtgactgatcatcgcaattccgtggccaagttgtgaaggcgtaagcaaatcgaatacacaaagccaacaatcggcggagatgaaactgaaaaaataaatttcaatttttgaaattttatttgttttttacattttcttttttggtggttttttgaagtggttccaataaaaccaaagaatggcacaacatccgacaaacattggcacaccaaacagactaaaaaatgaaaaggaaaatggtgaaattgtgaagaaatacgaaaaacgtacagaatcatttttaaagacattgtcagggcgaaaaagtcgcagagagagagagacgaaggcgaatggaaaataataatgaaaatttctttcgtcgctttttatatgttttccattacataacaaattagataattatgtttgtgttggaaacagggctgcacgcaattacggattacggattacggatttttgggatttttccgtaattttgatccgtaatttgacttttggattattttttcgagacgatttcttgtaagattatttttataaaaaacaaatttttctattttttatttaaagggctacccgtatttcgatttatttaagaattaaaatagatttataattttttattatttgttgttaaggctatttgggtagttcgcctagaaaatagaggcatcacttttttgtcacacctatttttcacgcattttatgaaaattcataaaaccttagccaggtgaggggaggaattccctccccccccctcccccgcccgaaatgaaaaattaaaaatttttacaggaaaaattgggacttttaaatttttttttgtcgatttttcttaataaaatcattaaaatttaaaaaaaaaaaaatttgcccggcggcacctatcggcaccgccggaccacgatttactcgattttaccttattttttaaaattttgactacaaaatggcaaaaagtagtctttttttggctaaaaatggttacaattcctgtttttgctgtccggcgctgaacttttttaaaaaacactaaataaattttaccaaaaaaaattcttcggattcccccccccccccccgtaattttttttctggctattaaaatgttgaaataattatatacatatacataaatccaattataatgatcagactttcaaaaaattttcaaaaatcaacccataaattcaaaaagaatgatttgatcagacacaaaattataaattatttgtaaaatttaaataaaaaatgaagaaactccatcaagaaaatcagttttttgatttttattaatcattatttaaaaatttttttctaaaattctgacaaaaattgatttttaaaaattacggattgcggattacgggaaattacggcgtttttggacccccgtaattacggattacggatttccgtaactgagaaaatcgccgtaattacggattacggatttccgtaattgcaaatccagttgcgtgcagccctggt

SEQ ID NO: 23720 - DNA, 860 bp, Heterodera glycines
  misc_feature (794)..(794): n is a, c, g, or t
agttttgggggcgcggcggggccgataggcgccgccgggggaaaaaattggaaattttgatcatttataaacagtttttcactgaaaattatccaatttataggtaaaattttgaaaaattttatgggaatttaatccaattcttaggggtgtaaaagtcgcgtttcgcgccaaaaagcgaaatgcgaaaagcgaaatgcgaaacgccaaaaaatgcgaataatgcgaaatgcgaaaagcgaaacctaggcacatccctggtatatattgcttttaaaataaattaagcgatttcctgaaactgtaattgattttaaaaatgtttaaaaaaagaattaagaggcccccggcattccgataggaaacgtgggacaaatttttgaaaacacaggtcgaatttcaggcgatggtaaagaattggggtctctaatttgttttatattttaggcgcaaatcagttttagagggtactgatgacgaatcggaattcgtacatattttgtctaattcctaaaccccggatccaaatttaatagaaatattttaaataacttaatataaattatcatcgctagggacgcgacttttagtgacgaaaaatcccgaaatagttaactaaaatagtgaggaaaaagtgctaaaatagtgaaaaaagtccaaaatagtgacgaatagtgacataattttcagccaaaaaatgagcaaaaaataatttttattcactggttgcacttgccaatgagctgctacatttcttttataaaattctcttagcaaatattgacattttttanatcaaaaattttgtcaagaaaaaaaatttggggggaagaatttttgaaaaaatttttccaattctt

SEQ ID NO: 23721 - DNA, 873 bp, Heterodera glycines
aaaaaaaatattttggttcgattcttagggggtttaatttttagattttttagcatttttgttaataaatttttcaataaatttcgtaataaggaaatatagtgacaaaaatgtcaaaaaagggaattttccgtattttaagtgacgaactggcaaaatagtgattgctagggaggaaaaatgacgtccaaatgaaaaaattttattgcagaactgcgttttttagaattttttagattaaaaaaaatctaaatggattttctagcctagaaaaactttttaagacacttaaattttcaaaaaatttaagaaattaaaaaaaatcagctgaaaaaattcgtaaaaaaacttaaagaatttttaaaaagtttttacattcgtgtttcgtgatgcaacaatgatcgagccaagtgatcagcagcagaagtgaatgaatgatttatcgagaagtgatcaaaatagaatgaagtttgatgtatataaaattgttcttttgttgcggtgtgatcacaatttgtattatatatttatatatgccttaggataaattaagcggttttctgaaaccgtaattggatttaagaatgtttaagaaaagatttaagaggtccgacattcagataagaaccgtggggaaattttttgaaaacacaggtcgaatttcaggcgatggtaaacctccgatatggatttcgcgcatcatttgatcctgagtacccaattcctgcgcccagaaataagacaaagaaaacacctgcttaatagcaaggtgagagccggcgaaaaaagtgccaacaaggcagcccatttccggacgattgcactgtgcgtttttgcaactgcattttccataatgctgatttgggcgaggtt

SEQ ID NO: 23722 - DNA, 2179 bp, Heterodera glycines
tgtgaaggagggcgaggagaaggaggaagagcctcgagtgaatttgcttatctgctgcttctcgttgccactatttgtgggtggttaagaaacttataattgtgaaaattaaaaaaaatttatattttgtttagagccggaaattaaaaaaataataattaattttaaataatgcaataatattattgagattaccatttctcagctttgtgcccgcttgatcgggtggctttcagcagttcctctactgctcgccatgttcctgtttccatttgcttcctcgtcaacatttgattttataccagaaataattttgttgggtaatttatttggttattttttaaaattaattttcctaattttatttgatgtttttacattaaggcgccgaaatgctttgtgtgctttcactgttttttggccttcagcatcatcagcccaattatttgaggccattcctattttttggcgtattttaaaaagcatttttttcgtttgaataattatttttaaggtcatctggaacttggcacttttgcttttgctccttttcgccttggtaaaatgtttgggctgttttgaaagtagaaatttccaatactccaccagaccgtggcatgaaattaactacgcgctacgagaccgaaaccaaaaaacccacgaatttatggaccccgaaacagagactttattcttagaataaaaatattatttttacagcaatttttaaggcttagatttttaggaaaccagcctgttttttacggaaatgaaatacaaatatgtgacttttgcttttttaaatgcctaaaaatttagtaatattttaaaactgaaaaaatttatcattttcccgttttaaccgaaaactcaagcttcatagtttgtttgtaaaaaatcttagtcgagaccaaatgcttgagaaagttttccgagtctcaaaaaccaaaaatttcttgatttgaggatagtgaacagctctaggaaaattaatgccatgaaattttgccctaaaatctcaatgcccttattttggattccgaaatggataccatacagtacattttaatatggtaccttttttaatatcgaattgtttgtgtcaccggcacggttttgtgttcaattggatctgaccgttcaaacattgctacacggcaaccagcagggcagcaagcacgcttcactgatgcccgaggaacatcaaaacgaagacggtaataaatggaacagaaacggtccaagggtgggttacggtatacggagtaacgcctcaccagaagcgagggtggatccgaggctaaaactgcccctacccagacaaaccagataggatgaaagattcttaacaacaataaatcataaaacaggcatagattataatttttctccacggtggcacagaactccccctcccaaaaaagctccatggtaaaaataagtaaaacgtactatggtcaattatgttatatttaaatcatttttattaccacaaacaaaactttttatttttttaatgtcattagaattctaagttttattctattaacattttttgactttgtccacttttttggaacctaattatttacttgatttattatataaattactaatttggcctaccgaattaaatcaaaatgtttatttttgttacttctaaaacaattttggtgtatttttattggaaaacaattatgaattgttccatcataagttccattaaagccgtccaattcaaaattctgatcatatggtcttcaaaacgcagattagaatatataattattaatttttgtttattttagcacccaacaacacgacatttaccatggcattttgttttatcactcttttggccataattattctgctcaatggatggttgttgaacattgttttgttggcatattttcatatgcaaaaggcatcatactttcatactttaccctccctccatattacggtaattaccaaagaaatttagctgcaaaacgaggacaaatgcattcgacagaaattgttggttaagccaatgaggaggcgtacgttagtggaggaagacatcccagcgccaaatgtaaaaaaatgcattaatagtctcggtcatctagattttttgcaattgggattttgcaataaaaaatttgagtctttgtgccgattctatcaaaattaa

SEQ ID NO: 23723 - DNA, 1017 bp, Heterodera glycines
cgaaaatgcaggaaaacagtgaaagttttagaaatatttcagtgtcgaaattacttagtgacgaaaatgtagtgtcgaaattacttagtgtcgaaaatgtagtgtcgaaattacttagtgtcgaaaatactcagtgtcgaatttacccagtgtcgaaattacatagcgccttaaatttgagccaagtgatatgaaatcgctcttaaatattgcaatgggtcttgacccgctcgttgttggaattcagcgaagagttgccgcaaattgttcttgttgtagataaatggactttctcttaaggccctttccccttatcccatttgccggtgcattgtgaaaatcggcaacaatgtgctgccaacgttcaaattctttaagcattcgcttaacaaatttgctgaacagtgggtttggttcaagaagggccccccaaatgttatgccacgcttctaacgaattgttgcttcttgaaagaccaatttcgaggcgatgagtcagattccatagctaaattacagaaatatgtaaaagtagatagtcaagaattttttaccgctattggaaatagcatttggggaattacatttaggcactcatgtttgggaaacgagaaattttgacgtccattaaaaattttttacggtgatcactgatcagacactccaaaatttcaaatacataactttatttaaaaaaaaatagttttcactaataaataattctttattttatttcagtgacgaaaggttcagtgacgaaacgttcggccaccaaaaaaaatttgttatacttctcgtgtaccataatttattaaatctatattgtctatctttatatcttaagcaatatttggttacttattaataatgtctgaagttgaaacaaatcgtcacaaggataaattaattaacgatggactcctttacattttcgacaaatttaatgttgatattagtttgaaattctggcgatgcgaacgaagggacgaatgtcgagggcgaattcacaccgacatga

SEQ ID NO: 23724 - DNA, 927 bp, Heterodera glycines
  misc_feature (914)..(914): n is a, c, g, or t
cggacccggggatctctagagtcattgttccaacggctttcactcaatgcattcgtttgtttgttttgcctcccttttcaatgcttttcaccggcggcgtgcgaaagggcggcacaaacggcggaaagtgcgttcgccgccactctccgcgcagcggcggctcattacgcccgcttccgtcgcattcactccccggatcaaaggagcaaaacgcggcttcgcttttctcctccatcgatcgcaaagattgacaaaaagctcatttaaacaacggcaaaagtgcccatttggcgttccttttattctgttttacttgttgaaatggacaaaattacacatttgccctcggctgtgtgagtccctccccaattccccccctttcgcacccatttcaatttgcatttctctcctcttctgccgctctctccatgttaaccggttacaaaggtgacggatgccctcgggggttggtggggtgtcccccgcggggattgttttgtccgtgctcactgcattttgcgctggtcagacattgccccaggggttctgtctgtctcccccacccctctcctctctcccgcgcattgtctctctctactctttgtctcttgtatctcctcgccaccacactctctcctcaccgtccattcactcactgtgcataatttgcctcattcgccgccgcacattcaatttgaaatttgagtggtcacacccatcacaacaataatctttcgccccgggcacagtcatcgatcgtcgcatttgacaagaaagcatcgcgggcattcattcatttccgcagattcgccctttaatacaaaacactctcccacagaaaggcaccaccccctgtcattgctaatttctgtagcttcatcactttcaatgtctttccccaggggttaactttncaccccccccccc

SEQ ID NO: 23725 - DNA, 1938 bp, Heterodera glycines
cacatattctgaaacagaggtttcaaatcataatttaacacacactaattgatcggacccaatcataattattttatcttttctctccctcctctctctctctccctctccatttccctctctctcgactttctctctatctctactctcttctctctctcctctccttctctcccacccctctctctcccctcccattttctctccccgcgtcaattaatttttgccaaatttgattgatgtggccttttgcccacaacaattcgtcgttcattcattttcattttaggtttatttattcattgttacagtactttttgaattggacgcgcgatgtttggagcagaagaaaatgggggaaattggaaatatttgaggagacagaaaaaaagagaaaagaaaattggagggagacagacaaaaggcgggggatttggggaagaaattgaaaaaaggcaaaaaaggaagaggaaggaatattgtaaattaatggaaaatgaattaatgaaatggaaataattaaataatagccatagataattaaaatggagagagagagagaggggtagagaaagatagaagacagaaggggtaaaggagagagggaaagatagaagagagacagatagaagaagaaaaagcgagagagagagagagaggagagagacaagaaagataaatcgaagtcttttgtgttcaaaaaaacataaactgagagaagcaaattagtaagatcaggggattaaagagccaatttctgatcattcaacaccgccggtgataaaaaatgctaatgaacggactgattaactcgggaagaacagctcagtgataggttaagcttaagcattaaactgaccattcattttcatccatggaaatgtctgaactgtcgtcgaactctgctgatgatgtctttgctggtggctgtgatcaacaccggcggatgagaaatgggcggacgaagacgaagaagaagagggacaatggacagcggaggaaggggggaggacgagggaagaggaggaggagggcacggcaccgtagaaactaaacggaggggggagtggtcgaagaatggcacgaagacgaacaaaacgcgagagcacagaaagaaatgccgaattgggatttgaatgagggaagaagggccaaaagggaaggaatcagcggatgattgatggtcggatttaaatgatcaattgattaccaccagctttcaaaatggtaaataccctcctcaattgcttttcctcggcttctcgcccgcccccccccccaattaaatgttttaattttacccaacggccgccgctgctgccgctgtgtttgcctctgcccaatgagcggccaacatgttcttcatgtactcgcaaggaaccgcaggcgcgcaaagcgccggcgacggaaagccggcggaacccatcgccgaagcgacgcccccctcggcggacatcgctccgtcgaagaacgccttgggggcgaactccttgaagaaatcggagtattgttgtgccaatgttttccaaaatgaataccttagctgtgaattctttttgcacgtcgccgcatggccaaacggacgaagcgccgccgaagagagccattgggccgacggagacggcgccggaagcggacgaaacggcgcaaagggcggccgaggaacccatagcagagcccacggcattgttgtacatgacgaaaaagcaatgggagaggtggaaagtgccgatcgaaactgctgaaaaaggcatcaaaaagattgaagaagcaaatagtgaagtcggacgaaagccagccattgcattttgactttttaaaattaaaattttcaaatttgctgcttgcataaatatgtgtgttgaatgggctaaagatgtgctgctctctctctctcacggtctttctctctctattgggataaatttgggggatttg

SEQ ID NO: 23726 - DNA, 1960 bp, Heterodera glycines
  misc_feature (14)..(14): n is a, c, g, or t
  misc_feature (42)..(42): n is a, c, g, or t
  misc_feature (47)..(47): n is a, c, g, or t
aaatagtttatttntattatttttgcattcatttaccatgcnaatanatgcggttgattaacgcaatgtctttgaatgatggcttttccctctgcccagttgtacgcatgtaaaaacggttgagggtgaccatgccctttaaactgaactgggaggatggatatatgtaaattaccaaaaataaaacaaaatgtgaaattaaaaattgttttcaatttataaatattttccattacccattttttcttagtcgggtacgataatgcatgactgaggcaaagtcataagcaaatccaaaatttttggtcctatttttcggctcgaaatttgttttccagtcctttaatagaaaagcatttttgttatcttaaaataattacgtcgtcatcttttgtgtcggttacaaatttgatgaacttgcgcgcatcgtcacgttggtgttcatggtggaaaccaattgcatgcaagagctcatgcacaacggtcccaggctatcaaaaaacaaaatattagccaattattatcgtccgtcccatcggcaaaattgcggtttcgtatatatcaattacaaaactttcaaaaattcctttaccatttttgagaaattaattattaatagggcggggaattatatggacataaaatcgcaaaaatatggaccaaaaatcgcgaaatatcgacataaaatgctaaaaatatggacataaattttccaaaattgagtgtataattctaaaaatttcttcaaattcgctaaatgtaaagtaaacctattaaaaatagctaaatatggtatcaaaataccattttagaagaaaaaaatatgatacagctaaaatttgctcatttttaagcgaaaaaccaacccaaataccaaaatttccattttttgcttatttttaacataaattaaccaatttttaggaaaatttaaatttaatcaatattttctacaaaattttgctaaaaaatgtctttttcggaaaaattttccgattttgggtggtcaaatccgaatttatctgatggggggccgttctaatagagatttttttgaaaaatgccaaaatatagacttaatgccaaaatatggaaatatggacataaatcgcgaaatatggaaaaatatggatatggaactccatcctagaagcttcaaaccaagctaaaaacatgtttttcgtgcatttcaggccccccatagtccagaaaaaaatatggatttccatataattcccctccctaattattagtgtgaattaggaatctctcgcttgtgtttatttctacatacatttcgttgccccagggacagtttttgccatcctcctttcttcccgacttttgaccaagtgtccccatcgtcaaccacagtgatcccatcggttggattgtttctcagatcggtggtaaattttacgcatgtgtgcttactgaaataaagtaacagtcaaaaaaagcgtaggagcttcaaaaaaggcaaaggtcattttttatcattatttttatgtcaatttattgaattttgcattaaatttgctaacagagcgaatagacaattttaatatagggttgccagatctgaggatttatcctcattttgtggctttttgataggtcaatgaggatttttttggaaaatgaggatttgaggatttttgtggctttttgagaaattttgaggatttttgaggcttttggggaaaatcctcagaatcttttaaattttgataaattggcataatgtttggcaatttaaagaattttttaatgaaaatatactaaaaatatggtcaaaattcttaatttttcccccggcggcgcctatcggcaccgccggaccgtaaaaatccttactatcggcaccgccggaccgtaaaaatccttactatcggcgccgccggccccccttgcgccccaaaagttttttggaaaaagcgccgcaaaaaaatcagcttcg

SEQ ID NO: 23727 - DNA, 641 bp, Heterodera glycines
aaaacaaaagtttgaaagaattttccgtaaatttgtcaccattgtatgaaaattacaaaaaaaaatttttttaaatcgctaaaaatttgtcaatttttcttggaatattccgaaaattaaaaaaaaattacaaagattctccgggtgcaattcggttccctcccggttttcatttttttttctttataaaaatttgccactcaattttcagtcgtccaaaattctgtgcccaatcagtggggaggaggtgcgcttgaaggaactgttgcccgtcaaattctcgcccatcgatccgcgcatggaatttgccaaattggtcgcgcagcccaaccgctacaaatgtccgatcacgcacgacgtgctgaccaacacgtctcgctgtgtgtacctgaagacgtcgtaagttgatgtcgtgacacaatcatacatgtaaagagggtgggatcaatgggataaaaaaaatactcggaaaatcacattttttggccagccatgtacaccccagaacatggccgctgaaacttgccacaaaaaaatttttttttaatatctatatccggcaatgtttcgaccggggaaaataaataaattagaaaattctggaaatttttttcaaattttcggtgggaaatgaccggggg

SEQ ID NO: 23728 - DNA, 806 bp, Heterodera glycines
aaaaatagttgaaaaatggaatagtcccttttttaaccctaccggaaaattgagagtcaaatttggcaatcatacccgaaaaaaatcgagctaagtccaaatcaaggtggatatatggggcgttggcatattccatattcgatttgtcatatttaaaaatagtgaagaatagatagtaattattttgcctaacagaaaattgagagtcaaatttagacatcgtagccgaaaaaatcgagctaagtccaatcatgtggatatatggggcgttggcatattccatattcgatttgtcatattaaaattagttgaaaaatagatagtaatttttttggctaacagaaaattgagagtcaaatttagacatcgtagccgaaaaaatcgagctaagtctaatcatgttcatatatgggtcgttggcatattcctttttagatttgtcatattaaaaatagttgaaaaatagatagtaatttttttggctaacagaaaattgagagtcaaatttagacatcgtagccgaaaaaatcgagctaagtctaatcatgtggatatatgggtcgttggcatattccattttagatttgtcatattaaaaatagttgaaaaatagatagtaatttttttggctaacagaaaattgagagtcaaatttagacatcgtagccgaaaaaatcgagctaagtctaatcatgtggatatatgggtcgtttgcatattccatggtagatttatcgtataaaaatagttgaaaaattgattaaagagaatttgaggcaaacagaaaattgagagtcaaatttaga

SEQ ID NO: 23729 - DNA, 1907 bp, Heterodera glycines
aaaaaaaaattttaaaattattttttttttttaaattcatacttattttaaataattttattttgtttttatcaattttgtttttgttgtttttttaatcacttcaaaagtttgttggcttcattttatgtatttacaaagtttacactaaatatttggcctcggaagtgataacaacagttttattttcgcaatttctctctatcaaacctaatgaattaatttttgtaaaattttttatttaattatttaattaataatacatttttaatgtgaatttaatttctcactcgaaatttatttatgaaattggcgggaattactatgttttattgcatttttttattcttctcttttgtgtatgtttaataaaaaaaatcgatgtacttttttcaaccgagaattctcattaaaaattgcttttcttcaaactctcgaaattaattttaatgcattaagacacaaaaatattattaaaaattacagcaattaatagaacttttcatgacaaaaaaatattttaatttgttcacacatttttaataaaatttaatttatattattaatacaaattttcattaatttttcaatttatttgccttaaaataacttttaaaaactaacaattatcttttttcaattttaaaccatataatttcgcattttccataaataaaacaataattagtttcataaacgctttttgatcatgccgaatccaattcagaaaagaatacataattttcgccgcaccaattatttcttctcatgaccttccaccatttatataatcataattagattttttattcctccccgccactaattgctatcacatttttggatatatttgtattatgatgcactgccaaaaaccggtatgtcacgcgaaatgaattttaatatgaaaagattttaattaatttaaattttttcataattttgcattcttttttttgtagctttaattatttttattaatattttaattaaaaaaataacaaatataaaacatatttattcatgcattaaaattttatataattgctaaatgaatttatacaattaaatacctaaatttattctaacattaaattaaaatgattatattatttttaaataaattcacaatttaaaatatattaaatttacaatatatatttttttaattttacgaacgaattttattataaaaattgcttctttcttccaaaatattaaatttgaaccaaattttaataagaaattattaaaatgatttacttacttttcaaataaaatataaaaacccgcgatttatttatacttttttaaatttattttttaattttaatctgaaaattgcttttatataacaagaaaacaattcaaaatattttaaattatatgctttcattaattaataaattaatatttttataaaaataaaattatgaaatttctaaaataaaaataaataaacaaacaatttaaaaacatattgacccattaaattttgcgtctaacgcaccacacattttcctcctacatcctccgcctcattgcctctaccacaattgtggaacctgaactacactaccaggtcctccctcacaacctcattaggaaaacggccaaatgttctcgcgacaaggaaattgaactcgcaccgttgtggactaaattgaaacggtcatccaaaattgtcactttttcgttttagggcccaacttttggatttggcactcaatttcttttacaagttaaagtaatttttccccgcattttaactggatttgcagcgacgttttgatggacagtctcccattctttaaccatgctcaactcggcctcaaattggagctggattcagccccgttctgatggccgtggacgacaaacatttcaacagcaaatccgcgctgaca

SEQ ID NO: 23730 - DNA, 1802 bp, Heterodera glycines
  misc_feature (39)..(40): n is a, c, g, or t
  misc_feature (139)..(139): n is a, c, g, or t
  misc_feature (147)..(147): n is a, c, g, or t
  misc_feature (1794)..(1794): n is a, c, g, or t
aaaaatatagaaataaactaaaaacagttgaaattactnnttacatgttaaaaatttaaaaatttagcctattaaatatttttaaaaaatttattatatttttttttgaaaaaattccgacttccgagttccgacttcngacatttntggggtcggaattccgacttccgaaaatttttagtgcctcggaactccatccctgatacaagtgtgatttgccagtcaaattatgtgctaatattttgtttgcccctccccattttttgataaaaaatttgtttcagaatcgtcatttgagtcaattgactaaaattgttggcatgcgaaaaactgttcaaagtcgttggtcgtcagaaagcctttctcatccgtgtccaattcccatcaaaataacgcaaattgaattaaacattttttcatcgtataattttgggaaatatttgacttgacacacattattgccttgttctgctgatctaagaagtgtagtgctaattaaatctttttttttggtcaatcaacgttcgatacaattcatttattgggcgaatttttcgccgatgcgagattaatttaatcctaatgaattttctaaatgctttgaaaatattagttaattttgttccattagcatggagtgggaaacagcgaccaaacaatttccgaaaatttttggacaattatttttgaatcagggaaagggaagcaaacttcgaaattgacaattaatcgtgctgatgcatttattaaactgccatccttaaaaattgaaaaatatttttaaaaatttcgagattactttcaaatatttttcagaacaatgaaaaattccaacgaaattctcagagaaattgggaaaagcttctttttttcaaaaagacacagaaagcctttgcttttacgagtaaagtaccagactttccaaaactctttaaataattttttcatgaatagtaaaaaaaactgaaatatccttccagtgttagcggtgcaaattaataggccaaaagaataggggtttatcaaaagcactgaggtagaattttctgtgccacattttactctatatttgatttattttcatttcatttttattacggtattcattttgtaattgaccaaattttgtttgtttgttttctttttggaaccatgtaagagcactaatgtgcctgccgtcttccctatatttcttacactgagatttaatttttttttaatttctaaacttgaaacagagcaagtctcttggtattttgtagggttcgagccccgtgggcgggggtggcttttcgcgggggcgggggtttgatttgaattagctcaaaaaatctcacaaaaaaataatttttatggatgatgtgtttggctccacacattcctttagtcgatgtttcgcctcgattcaattaatttttgcataaattgcacagtttttgtctaaaaaataccgataggcgccggcgggcgaatttgaaatttatactctattttctaacagatattcaccaaaaaaatattttccgataaatttttttgcttcggtatttttattcaaaaaaaactagttatcatgggagggggggggggtccatcggtgcttataggcgccgccgggaaaattttttgtgtatttttaatgcgatttgttaagttttttcaaaaaattgttcaaattttgcgattttgagcaaatttttcaagaaaattaaggatttttaaggtacggcagtgccgataggcgccgccaggaaatctttggaaatttcggtgcaatttattaacagaaattgntataaaaa

SEQ ID NO: 23731 - DNA, 1711 bp, Heterodera glycines
tcgggttttccaattcgaaaagtggtcgtgtcccctgaccatttccattctggtactcttcgcgtcgttcgtcacattttgcacgtttatgccgttcatctgtggcacaacctatcccttttgattccgaaatgtttgtcaggcacattcatcatcattatttctctttattgggcactccgtttccgatttgcatataaaatgaaatcatatttcttaagctaatattcaattttaacattgtaattgataatgcgtaacaacagaactcatttttcctctccaaatgcccttttaattatgactatatcatgtgtctccaccgaggaaggtaagcctaaaaatcgactatccaaataatggaatgttgtcaccttgaaggagtgatctgatcattgtggtacaattgacttctttgatcagcacaaaaagtacactgaggtaaattttttcagattttttgtgctctataaaaaaggttacctgtcttcaatttttgaacttctatttttacagcaaattttggacaattttcgggaattttttgtgtggttcttaatatttatggtgagggtatacttggtaaaaatttcagctcgattggtccatgggaagtaggtttagcaaaaaaattcttgaacttataattttgttacagactgtataagcttcaaaccaagctaaaaacatgtttttcgtgtgtttcaggcccccctcagtccagaaatataaatgggaaaataaatattaaaagtttaaaatttagtgtataacctaataatttgcaatagacaaacgcatataaccataaaaaaaccagaaaagaatgtaaatatggggtgtccttattttaaatgcacattgtaattaataaagaaaaatttatgagtaaaaatcgacaaatatataaagcaatatgtaaagcgagtcaatagggagggaaatgaacaaaaatgaagagaatggaccggaaaaataatatgaaaagaggtaggcttaagaagagacgttttctatggtcgaaaaatactgcatttaaatcttagccgaaaaccgcgcactttgtttttcatttcttcgagttgctctgcagctgttgctgcagctgagaggtctggcgcatgattgtgccaattgcgctggtgatttcggcattcgaagatgaatcgcttacggtgacgccgctggattttccgttgatcagattgtatgtgtaggagtactggtttatcattgcgatgatttgcgcggtagtcggcacttggtcagcactgacacaatcaccggaaatgccattggcaccgtttccgtcgacggtttggttcagctgttggccgaactgattctgactgagttgcaatgccacatcgtccagctccggtttctaaattataattgcacttaattacaattataaattgaaaatatttataatgggctcaaattgcccttttttgttcctcccttcgcctatttccatgaattttcggcaaaagtgccgatggtactttttgacagatattttttatcataaaaatgtttgcgcttattcaatttcttgatttcaccgtgcatgatgaagaaccatcgtttgcctgttcaccaccactatttccagtgtcgccgttctttctgcagctggtgccgttgttttgcaccaactgatcgtatccataccataacaatacgctgatcgcatgcacacatgccg

SEQ ID NO: 23732 - DNA, 1681 bp, Heterodera glycines
caagggtaattacagtaatcgttgcatagttcgtcgagagttacggtcaagggtaattacagtaatcgttgcatagttcgtcgagagttacggtcaagggtaattacagtaatcattggcatcgaggagttatggcaatggaagcaataaaaaacatttgtatttgggtggacgttttttgacaggaaaaattgcgttcaactaatcctttgaatttggggatcattaggaaaactaaaataatttctctcaatttcagcattttcatcataatttagttaattattttgggaattttcacttagatttttcttcaacattttggaatttatgaaggtatttctaaattttcattttttttaattttaaaaatttatttttttttaaattaaaattcgttggattttctttcaggtgatgtttctgtcagcacaatcggttgctgaactgttctcaatcagaaattggctcaggttcgaaagggcacggcattggtcacaattttcccgtcattttttcaaaattcaatttaattattttttcagatttttggtcgtccgccaacgcattccccatttgatcttgggcatccaatttgcgtgggttgtcgaggaaaaaaagaaaaagcaaaaatcatcggccaatgccatttcgccaaaaaagcgatgccggacgatttgcaacaaaatgttgactgtttttggcatcaaaaaattgggcaaaaaatgaataattaattattactataattaaatagatgatgaaattagggtttttccattaacaaacaattacttttttttcaaaaccatgaaatttggaaaaaagtcatgaaaaacggtggttgaatgaatcaaatgcttcttctcaattaaaataataattattaaatttatttttatcttttttgctggatcttccgcgctctcttcggcttttttcccccaatttaaaattgcccttttgttggttaaattttaatttgttccattatttcgcatcgatcaatgagtggtggattatttagttttaacaattttaagggcattttttggccttaaacgtcggattgtttagggtgttttagtggggtttttgggcaattctgttttgaattttcttaaattcaataccccactttatcaagaactaattaatagggatggaattgtgtccgtccgaatgaaagaaattattaaaaaaggattaaaatcaacattttttaattaattcttcatttttgtttatttatttaaccgattaaatacaaaggtcagtgagcggtggcagcggtagaaaaaagagagagaaattgggacaatcaacgaaacaattgatcatccatcatcaatcatcattatcaataataccaattaatttggggggtcgtcaaaagtcaaatttcgtcttaattggtcagtcggcacagtgccatagatcaacaccatcacattactcattcgttcattaattaggcgtgttaattggtcatccattagccgagcaacttccgcatttggtcctcctgcgagcggatgacgccgtcgttgcgctccgtcttcttttgaatgcggtccaacatcagattttggtcctgcacctcgtcgcccagcgcgacgccaaacgttctcagtcggcccaatgggcactcatcagatctgagtggtggaaaaagtcgttt

SEQ ID NO: 23733 - DNA, 1734 bp, Heterodera glycines
gtcttttttctaatggtcttaggtagagacttatggtcttgtcgagtgtgcgctggtttttagtgcaatactaattagcattcaacgaaaaaataacttttgtgtattttgtccggccgggtttaccgtttaaaagattgaattgcccaattttgttcacttgtcgtagttttgaaaaacgactttatcagcataaaaagttatacaggctgaatttgtcagaatttttggctacaaaatattgaaaaaagtaagaaattattactgcataacacatgaccatgactgtaccgcgtgaatctcattttttgtcattttaaagcctctgttatcggaataagtagcacattttaattaatgatttttcgcacaactcaaatttaaatacatgagaaataattacagaagttaacgaaatcttttttaatgaataaaataaaataaaatcttaacaagcatgggtatacaaaataagtttcagaaagctttacatgcttaatcacaataaaataaaataaaaataataatcaaataaattaaaattaaacaaaataaaatttactgaaaaattctaaacatatacttaaagtgaaatattctgataatattgttaaccaaataataagcattattttttattattcttttataaataagtcagtttgaattaaaattttaattcaataaatggttgttttaattttttacaaataacagaaaaccctaattaaaatacatagaaaaaattcataccgcaacattcgctctactctgtttaaaacaaatataaaagttcaataaatattaaaggaaaccatacattgaattatataagatagaataatatatcaaattcaaaacaattgtaaaaaaaacaaaaattatttacaaaacattttgggccgactagcaagggtcaacgtggccctatcgcgaacaagacacgggctcaaggtgttttgcaccaaaggtgcttattaaataaaatatcatatgcctaaagtaaatgcagaaaacaaaatataaataaattagttcatttaggtagcagaataaataattgttaaacctaaacaggcatggcattcaaggaaagaataaggaagattcataattaaaataaataaaaaattattagtcatttgcattgttcaaaagtaaattttaaagttaacaaagaaacaaaataactgagaattaaagtactttggaacgttaataattaaatttattaaacaaggaaaatgcttttttattagtaaataaattaatatttacaaaatattttgggcagactcagcacgagcaacagttgcattaagtaatgctcggtttaaatcacatgacagtcaaaaagaccaatgaagaactcatatttttataataaaataacataaaaaatacttattcttttgtattgtacagtcaactttaatacaaacgcattaaaaaatttaaaatatatttaataaatagaagaaaaccctaattaaaacacaaagaataaaaattcctgcccgaacattcgttctactcatttatgacccaaatgctaaatgcaagtaaaaaatattaaaaagagaatatatcctgagtatgcttaaatagaataacatatcaaatactcaaaacaataattgtattttgggaccacccacaacgagtaaatgttgtgctgtgaagagctacgaaatattaaacaaaataacgttagaaataaatgcagagaataaa

SEQ ID NO: 23734 - DNA, 832 bp, Heterodera glycines
ggctggcaggtctggtgttcattcgttttatttgtctctttctttgcctgctgtccacaatttttttgcttttgttttccctttatttgttaaaaaatgctaaaattccatttaaataattgtcagactttgagtgatttaatgggtgtgaattcttttggacgacggatcaaaagaaatgttggatttacttttagtcaattggaattaggacaatttggggcaattagtgcaaaatgaattgatgaaatacttgcggagagaacatttttcagatcggctcaattgatgggaggaggtcaatgggaagaaaattgggaagggaggcactcaaaactcaaaatgaggggcaaatgaatgagtttgacatggaactttcagagaagggggtaactgacacatagaacgaatgaatgaatgacattgggcaaatcgggcacaaaaaagcaaaagattcgaccctcaaatcgcggttgttgggtcgaggtcaagcagcccaaggcacgccttgagatcatggaatgtttgtttgggtggcaatgggagtgactgaccgtgccaaaaccaaccgcaaaccctccaatttgaagggggtgtgaaggaagggagggaatggacgaatgaatgatggcacactgaaatggagaggggggaggggtggggggtaatgcgagaggcaaagggagagggagaaatgaagccgggggatgaagcagccaaaagagtcaatggaagaaaggcacacttctaatttgttcaagccgttgcttgtgaacagagtgggtggcacagaaaagtgccattggtaattctccccctccctctcgcccac

SEQ ID NO: 23735 - DNA, 1924 bp, Heterodera glycines
agccctagtgactagatcaatgttggatttttattcattattattaaataatttaggcgggacaaatcagtacccgtcccaacataaacctttgggttgtttttattgaaatttgtgccctatttcacacacttttctaagaattttgtatccaattaatcctaatcaatgtgcagggaatttgtgttgttggcgatgttcgcttgcctcacctcatctccttccaacaaattttcttctcataaaaaacggcgtcactttttgtggtgttttacagaaaaaaggacaacagagaaagagacggatgttcttaatttccttttgaatagatttattagtttattttagagctgagcgcgaccgggactggtactgaaaaaaacgtacaaatgagtaccaagtcccggttttgaccgggactgggatttgtcccggttttttctcggtttacccagccaaaaagtcccgggttttcaacccgaaaagttccggtaccgttcagctctatgacttttacaatattgaataaagcatatgttcgggtggtgacacttttccatttaattatttatttattttgtctatcctttccgtagtaagacagacactttatcgattgcccaccaaattgtgaccgttttccctccctcattcattaattaattgcattttggatgctcactttcgtattgcttttctgcgcctcctcggataaaaaatattttttgtcttcaataaataaaatatttaacagattttgttgtattcctataaatttcaatatttgtgaaaatatcaatatatgttatattaactaattattgctaatgtacaactcctttaagttcgataaattgttgaatcaaaaattgatttaataaaatatttattatgtgtttttcaaagcaaataaaaaacaaattctaccataataggagtttttaaagaaaatttttataatgtttatttatttctcacctaatgctaaatcaaattaaaacaaattatacaaattgaatatgtatgttttggcaaaaataaaacccattaaatatttaatagaattatcaataggaattatattaaaataaaaataacttaagtatcaataatataaatgactaataaacaaaatagtattaagaaaatcatttcttttttgagccaaaaaagtaaaatatataaactcgaaaataaatttttttttttaaacaaactcatatagtaaataaattcaccagattataaccttgttaaaagtgaatagaatttaattagatataaaaacaataaagaaaatatcgagtcatggaatgattataaaaaaatatatactagatacttttttgactttgaagtcacattcgttatggaatatatgtccttggatgattgatgcgtgagataaatttagaaaagaatgcaaagtgttttatttttgaattaggtaatttcgcaaaaacaggaggagtcattaattgacaaaaattgccacataaaataacaaaatttaaaaacaaagcaaagaaaaaggggatttattttcggcaatgcaatttattttgtgccaacttttcttatttattttaaaaataaaaaagcgttaaaatcaaaataaaatagttcaaagaaaagcaaaagtcaataatataaaattcaattgatttaaatatactacatctcattctctcaataaaaattcttaaaaattaatggaagatatccctcattatttagggacaaatcgcaattcaacgagattatgctaaattcattaatataaaacaataacaagtaaaaattataatgattcattataaaaaaaaactccagagattttttaaatcaaatccatataaaaataacgaagaaattattcttataagtaaaagctatttacataataaatatatgaaacatgcaa

SEQ ID NO: 23736 - DNA, 1863 bp, Heterodera glycines
ttttaaaattattcaaaagtaaggatgtaggtaaattaattgttacaaaaaataataaattttaatgagaaaaataaattttatttatttatttgtgaatttcaaataaaaattattattattgttgcttaataattaaataatcaaggaaaatttcgttaattgctttctttcttgggcacccttccatgccttccatggaattttttaaattaattttataataattcattatttatttataattttttatttgtgaatttcaaataaaatttattattattgtttgagaaaataacaatttgataaatatttttaattaattagaaaaattccattaattgttttctttattgggcacccttcccacactcatttcctttcataattgattgtttgtttagccctttttatgggtattggaattaatttgacctgatagaaaaatttgatgagaaaattcacaataaataaatttaattatttattaataaaaagattcaaaataaataattattaattgtttgctagtttaaaataaaatatttattattatttttagaataaaatttatagtaaatttaaaaagaaaattatttgttattatttaaataataataaaataataataataaattaattaaacatttttataataatttaactaataaatattatttaattataaccctcgttcctttttcctttaaaatcaaaaattgggaaaattccgttaattgatttgtttattaggccttattgcagcactcttccccttcttcattgatttgtttattttgttcatcttaaggggtcctgtaattaatttggtttagttaaaataattatgcaaaaaaataaataaataaaaaaataaaatattgggctcataaattaaatttagataaaaaaaacattcaaagccaaagagttagaaaaaataaatttgcatcaaagtataaaatttcattgaaattttaattgtttgaaatttaaaaaaatatttgttattattttaataataattaactaattaattaattagaacattttttaaaatttataaataaatattatttaattatacggtcccccatttctttttcgctttaagtcaaaaattgggaaattccgttaattgatttgtttatttgaccccccttcccttcccgccacccgaactcgccatttcccttatccctcgctgcaacccttcctcgccactctcgctgccgagcaatttctcgccatttttctcgttgcaatgtactctcgccacactctcgcccccctgccaatcgctgctgcctactctcgcccccactgccactcgctgttgcctgctctcgcccccctttccctgctggtgacgtcaaattttccctttatgagagcaaattaatgtttatcatcaattgccaatgtggccgagtggttagtgcgtcagtctggccgcccccctggggttcggatccgcttggtgcggggaatttttggagaattttaaatgaatttaaattcaacgtctttgacctttaagacgtttaaaataatttaaaattaaataaatttaattaaaataatttgcataaagtcgcgcagtcaaaaaagtcgcgcacccccctgcaataggtttgggtttgcaagaaaaagtcgcgcaataggtttgggtttcaaaaaaagtcgcgcaataggttttggcttcagtactgaaaagtctggcgctcaaatggcccgcgctcacttggcggcgctcaaatggctggcgctcagttggccatgcacccctcctataggtattgatttcatcgctagggtatggggggctacagtaatccggacaaaaagtgatgggtaactact

SEQ ID NO: 23737 - DNA, 1556 bp, Heterodera glycines
gtttccttatgtgctgaaaaagactaatccatcaaaaaaactgtgcggcagagcgtttaaaccagttgttgaaccggttgaaatcacgaaaaattgccccgtaaatcggccaaaatctgtttaaaaaataaattttgcatcatttgaaagttcttgacaagccaagtctaaaaatcagggtataaagtcgaacggacgcattctgaccactgggacaactgagtcccagtgaaaataaaaacttcagatgatggatgaacaaaaataacttaacaagtaaattttacaaaaatcacgcgcggtttggcgctttttttttaaaccattttttccggtttttaaccgattccaaaatctctcagatagcgccgcttcaatttctttctctgatttttaaacaagtttatcatgggctttgaaattataccaagttgtccaggttttatcttttaaaagcctataatcgttaaatttttccccttttttcgagttttgaaccgttccaaaagccggtttaaatgctttgccgcgcagtttttcttgacggtttatgtcgttttagcccataagaaaatctataaacgtgtttttcattaccaatttttgtcggtgatttataatttttcttgaaataccaagatggaaaaataataaactttttttttcaaatttcccctgtggcactaattaattattttttcttacaggtccttgaaattaagtgtaagaaaaaattttgcccatgaaactgaaatccgtaattagggatgtggacaaaggtccataatcaatgatttataatttaaaaagatttaattttttgaaaaaaacagctcaattaccagcataatgaaaaaggctgggggggggcaaccgaaaattaaggccctctaaaacctaaagacaaacttatcttttttttagcttttaacagtattttttgtggcgctcgcttttttcaagaacttttagtgtcggcggtgcccacaaaagtgcctcctgttatttgttcatattattagctaatttcagaaaattgaaataaaaccatccgtaaaaattgaaaatcaaaacttagtttattttattttttgtcatttttgctttttttcaaaatcttcgtaagatatttacggtttttaattcttttgatggatatttttcgataaaatattcaaaaataatgatccaaaaaagtgaaatcttactgatttaatgtttttctttaaacaaaaacgtgattcaattttttaaaaaattctcaaattctcttaatattttaagtgcgggtttccctttgcatctgaaaatttaggcatacaattagcctttttaaattaaattaaattcaaaatttcacaattttgccaaacagcatttcaatataaagagacggatgaatgggaattgccattttcaaattctcttttaataataatcaatttaacttttaaagattagtcataggcgttttattttcctgtcattcttctaataaatgagcaacaagtgagtgctactcattaatggtcagtttatttgaaatgagtcaatga

SEQ ID NO: 23738 - DNA, 1493 bp, Heterodera glycines
  misc_feature (1366)..(1366): n is a, c, g, or t
  misc_feature (1404)..(1404): n is a, c, g, or t
gcaataacttttttcggcgtgcaatttcataaattttgataaaaaaaatagctgccgagaaaaactgcactgacaaatttgtggggtttttgataattttattttttatgaattttctatcctcgtgcgcccatcctccgtttaaattcagttttttttttacaaaatctcatggtttggttaccaagtgtactgattttagagggtaccaatttgaaaaatcaaatgtcctgaattttgaggtctccgataaaaatgcaaaaaggctagggccaacgtttgcactttttcatccggtgacgcataaaattcccaatttttcttaaaaaagagaaaccaaaatctcaattgtcattttttgcgtaaatatgtaaacaaatttctctcaaattttgaaaaattttccggcggagccatcggcactgccggaccccctgtttctcaaaaaatgaattttggcgcaggataaaaatatcttcttacaaagaaatcaatttaatagctttcaacattctctattctatactcttaattattccattgtgaaattgaatgtgccttcgcgaaagtgtgctcatcaaaaatattgaaaaagtgatggcttgcttaattgaatttgcaaaacaattaattttctgaattattcatttgatatttgataaaatgttactcctattttattattcaaaatgcattgaattctttctcttttttgtttggctttgcttatccatccaattttatttattaaaaaaatgaatttttactgttttacataaatttgcgcattttcattttttagctttgttttgcatattttcaaatgtttcgttcgccatctgagccaagcccgttctcgtcaactcggtgcccccacgatactcaggcgcgctgtggacgtccgtactgtccatttgcacaccaagccgacgacactgtcgacgtcgttgaaggtgaaggaatgccgaagttcggcgggagggagtcgatgtaaatattggtaatccttcggaattggtgtcatgacaaaaaaatctaaaaattttcttacaaaatcactttccatggtaaaaagctgcgctgttttctcgggttctttatcagagtgcatttttttttaccctagaaaaaaaattaacgaaaatttattctcagaagtggcaaaaactcaaaaattgtacgaatgagaaatttgtacccgaaatgtgatttttgcattttcgaatttgttcaaattcggtgtccgggattgttttttgcaagaaaatcccagggacccttttccatgctcttttaaagcaaaaaaatatgttagaaaatgtgcgcctccagcatcggtattatctgacattgaagccagcctcanaacaacaacaacagaaaacccaatgggattccccctcnaaaagccgttgttaaaaaaaaattatattgaaatttttttacgaaataaatttttttttgtaaaattgaaaaaaatgtcaaaaaatttc

SEQ ID NO: 23739 - DNA, 924 bp, Heterodera glycines
aaaggcgccatgagaatgagaggctccaaaaagtaactgatacaacgttgaaccccacagtcgaactccaattctcctccatgaattagaccaggccgaaaactgagttccgtacctgtcaaatggatggcatagccaaaactattaagacaaaaatcaaaggactgaccgtttttactaagtttgagctcagttccattcgtcaatcttttgatcatggaaagaaaaatgcgctcaaattcttaagaaatcaaaggattatcggggcaacttgtactcaacttttattaaaataactgtttttttaaaaagatttaaaataaatttagtcctagaaaaatgaaaaattctcaattttttaaaaattctttttttactaggtcccattaattagccaccttcagactttcaaaaataaaaaattctaacttttttttcacgagatatcggtttttccgactctgaaacccgaaaagagaagtttattttgaaaaagtttgatttttttttgaaaatctgatagataattaacaagtaacaaaaaaaattccttttggtttaaaaaagggtacttgtgggttatctgcgtccagattttcaaaatttttttttcatgaataaacttgttttaggggttttcgaggtcggaaaaacagattctggcatctgttttgacccaattcgaaccccaaacccgaaaaaagttttaaataaaatttttatttcgaattatcatgacaacgaattttccaaataaatttgttacccttcagtccaggattgtcgtcgtaagaccgaatctttgtaattgtgattgtcctaccagttagtagtgaaaaaacaatgtgctgtctcaaaaaattgcatccttccaattgtaattcattgtgtacgcccattgcggtgacttaacataggaaaata

SEQ ID NO: 23740 - DNA, 2002 bp, Heterodera glycines
taaataagtttaaatcgcgcgattaaacattctcaattatcaaattagcatggttattatctcttttttttatctgctggttacaattagcccaaacgttcgatgattctttctgcaataaatttggcaccgagtttgggcattggctgttgacgaatgaatgcgaaaatgaaaatagtaatggaaatggacacaatgttgaattcgagaaaatcgttgcccttttccaataaatttttcaacaattcgacaacatatgaagctacgtaaactgagacgatgaacatcaccaggtcaaacagtgacaaatcaccgccattttgtcgtttccgacgacgacggcttcgggacggacatttgatggcacgtaattgttgaggaacggcgccaaatttggaggaatgccacaattggatgaacagctgcaccatgtcgcttggcattggcaccgcgtgcgatgtcaacaaagctttttgcatggcttctttgtctggaccggcacccattttgccacccatttgcgcaaaatgtcgaacattttgacaatttgtcgcaatgttgggtgttcgtctgcccgtgccaaaatgtcggcaattgtgccacactttccatctacagtaattttggcttcaatttctctcttcttaaaaaattccaccagttttttgccatgtttttgcagtgccttttcaactttcttcacaaattgttctgaaatgccattgtccaaaagttggccctttttcaatgcttcacaatatttatcaacttccaaatatatttcaaccgaatcatcgccattatttttaacaattttatcatgcttttcatcattttgcattccgccaaaagcaatggcgcaattaaggaacttcgaaaataattggcaatattaaataaaaattaatgtacaatatattttttaaaacaattattaacaatttatcttttacagaaactcacccaagttgttttgcttgttcatcatcgaatttttcattaaactattagaaaactaaaataaaaaattttatgaataaaattttaccgtttatttttaagagcagattttcaaaatcctcaatatttacttcattttgaccacttctgatgactagggctggtaaaaatatggatataaaatcgcgaaatatggccataaaatatggaccaaaaatcgcaaaatatggacataaaattgcgaaaatctcaaaatatggacataaatggcaaaaacgtcaaaatatggacataaatttttcaaaattgagtgtaaaatttcttcaaatttattagttgaaattgcatatgagatatatttccaaattttttgactcggtaaggcgctttgacaaagacggctttcgttttggcaattaccgtatatgctctaattatagcccatgggggattatttttcaacctcctcagaatacaggggataattggagactgcggtattaatagagactgggctataattagagcatatacggtagtcggtcaacattcggaaattggtctcgaattttttcggcaattctgtgcaatattttagaagaaaaaaaacatgaaagttaaatttattaatttttttagcgcaaaatcaaccacaaaagcgaaattttcgcttttttgcttatttttgacataaatttattaatttttaagaaaatttaaatttattcaatattctcgagaaattttggcgaaaaaatgattttttgaaaaattttcggtttttgggctcaaaaaggctaatttagctgatgggggccgttctaatagaggtttttttgaaaaatgccaaaatatggacataaaatatggaccaaaatgccaaaatatggaaaaatatggaaatatggacataaatcgcgaaatatggaaaaatatggaaaatatggatatagaaatccatcctagaagctcaaaccaagctaaaaacatgtttttcgtgccgtttcaggcctccccagcccagaaaaaaaaatggatttcc

SEQ ID NO: 23741 - DNA, 1531 bp, Heterodera glycines
ccccgattctgatcagtcggagggaatggcacaactcacaacgctttccacattgtgtcgggggaacggcgcaacttcccgtgggaactgttaatgtgttcaatggtgcacagaaggatctgaacagtttgaaagatacgccgatgggagttgtccttcgatattccattcccttttctctgtccttctccaccattaattatgcctaattaacctaattacctgctttgaagttgccgtttttcccgcgacactgtccaacctgaaaatgctttgtccgtcttttctttcaattggtccgcttttctcttctcacataaacgcgtcactgagttggcccacaactgcgtctcgcatttccaatgctcggctcgtctcgacaaaaagctgttaattggacatcgttatctgtcattaattggaatggctttcccaccgaaattacgtcccaaatgtgctccaattttctcatgtcgagtttgcccatgtcttaaataaacgttttaagcggcgtttgcttgcactgcttgccgacctggtcgaaggtgtcgcgaattcactcgctgactttggttggggaaacacccgatggcactaagcaaagggtttgggcgaggcgacgctgccaccacgggacggaggccgtgctccaaaagtgcccttagggcggggcaaaagcgttttcggacggacgaaagaacggcttcttgaacgccgtccaaaatgcactgagatgagaaagacatcagcaaagcgggcaaagggccaccaaacaaacactgttcagttcgtccacactgagcgccgccctttcgggacggtccaccgccaaaatttgattcttcctcagcacggtgaccaactcatcgacagccaactccaaatgtgcgcgttggtcactgagcaaaggaccatttagcagttgatgatttttattagacagttaattagtctaatcacccgtaatggttgcccaacggcgtgttcttcagctcgtttcgctcaaagttcttcttcgtgccgctttgtgctgctgccactgtcccattttggcctccaaatgtcaaccattggccaaaccatccgccgattgtctgcgattcatttgccatattaaacacggaattagatgtatcagttttggcaggagcatttagcggtccctttgagggtgagcaatgagcagagccaacgggaaagagtgccgttgccgccacttccccctgcagaaacttaacgtactgctcgaggtcgattatttgggtgcgcagttggtccaccagttggtcctgcaattggccaggtgtctctcgttggcacggcactctcttgccttttccctcagggggttcagtgccttctccaagttctgctccagtcgctgtctgaactgctccatgtccttgtcctcctggcaatggtccagcagttccttcggcagtcgcattttctcccgcagtttgtccagcaacaacatttgtcggcttcgcaattccctcaatggcaattcgccgggcccaagttgtccgtt

SEQ ID NO: 23742 - DNA, 1838 bp, Heterodera glycines
atttgtcgcttctaatttgtctgttcaaattcatcctttgggatccaattggtgccgagaagatgcacttttttccggcaattgccaatttgtatttcgtcggcgtttacagtcgcaatgttgtgccacatattttgattgttgaacgcattttggcaactgtgtttgtccgctcatatgagcattggcggggctacctgttcacaatcatttgggctccgatcgctgtaagaaatttttgtattttcaaatattaacggagttaaaatttaccaaatttttaccccccccatttttatgtaggaataaaagaaactaatcctttcttggaaaaatatttttctgtcatcaaattatattataaaatatgtaaacttcttaaatggcaaaattttctcgcattttttttttataaatttgagttgggaatccattagtctgaaacccaaatattttttagtggattttttttgtaaattttattaatcttttaacaaattccttaacaacataaattttaataaaagaaaattcctcacaacattttcaatttaaatcgtatttaaaatatatttaaatgttttagttgaccgtttgcatttacattgccttcactacatctcctcatagtgtccgaccgcttgccaatttaattacaacagctgttgaagtgttgacaggaagtgtggaattggccattttcatgaaactttgcgcttataacttaaaaatttatcaaaaaatgatgcaaaatgaagggcaacacagcctatcattacgctaccaggcaattttgaatttttcaaatttaatttaaattaaaatagaaattaaataaataagttttattttaaaaggtaaatgagaattgatttttttaaagcattttctttgttttcggtgtgcttttttaaacagagttcccaacttttattttttcaaaagcaaaaaaagctccgatctaagatttgccccccaaaaaaggttttgataattctcttcgggaacgacctttttttttgctcttttgtatcaataatttttgcttctctttttcaaaaattttaagcaacaaacatcctaaaaatttttgaagcaggtacttaagttttagaaaaaaacaaaataaaaatttattttcgatcggaattcaattttggaaatttataatgtactctaaattattttcatttaaaatggaaaatggcaattaacgaaattgacctttcccgttttagctttctgagaacattcgcattggcaagcaactaatccctccattatcgctcaatttatgcgccataattacctctgcaattagtataacgtggagctatttcggcctaccattttactatcacttattcattttgttggccaatttgagctcggctatcggctttctcattgaattgctcattatcacgtaaaatttttgtgctcgaacattttctaaaatgagcaaaaatgggatgagatttttagtcacgaaaaaaccctaaaaatagatgcctaatgaggcccaaaatatacataaaatatgcaaatacaaatttttaaacaattttctcaaaagacaattctcttgaatcaaaatctgtttttgaaatgagtaaaaaataaaaatttaaagaatttttgattaatagattttcttaaaattttcaaaaatcaggactataaaatagttaaatttctgaattttccaaatatgtgattggctgcgaggtgggacttaaacaactagaaaaataatattttaaatttttaatttgcgaaaattgaaaccaaactcatttcataaataaataaacaattattaaaaaaataaataaatt

SEQ ID NO: 23743 - DNA, 475 bp, Heterodera glycines
ttttttcctttgactctaattttcatcactaatttttcactcagaccctcattcttaccagtgcttgtttttcccggttcccggttgccctaccgggaccgggacctgagcttttcaaaacccgggaaccgggacctcggatgaccgggaattcccggcccggtcccggtcccgtggcactctagtctttactattctcagaagagtagtagaaaaaagacggcttcacaatgattcatgaatccaggaagcaaaacaaaaactaatttctcgcaacagaagccctaataaacaattaacattttgagcattacggttgtgagacgtggatcggctcttgtatacaagggaaaatcccatttttttctttttgcaaagtttttgcacggaacccgtcagttgggcccccacgtttgggccccagcatgtttttttgctataacttttttctttgtcatccaaatccaacattgtt

SEQ ID NO: 23744 - DNA, 1193 bp, Heterodera glycines
aattatgtaatcaataactactaattaacacctttttatgcataattattgcctttttatatgattgaattctctccagttccaatgactcacgccacgacccaccccaccaccatccgaatgagaaaactgccattcctccgcatgccattgaacgtcgtctgccagtgacatgataacaccggtaatcaaagcatactaaataaacattcttcgcccttttccccctccgcaattttcctgcctaaaatgtgtgccaaatcagacaaactcccgccgtcttccgctgcttcgtccttctcatcgcctgcgtatggtcggcctccgtccgccttcaccgccgcttcactgaaccgcgcggggtcgccctattcaatgggcggtggttctgagtacggcggcagacggaagggcgtcagttggtcggacgtcgtggaggagccgaagccgacgactcggacccggtccgactcgcccccgccggcgtcattcattcgccattcgatgccggtgccaaatttcatgccgaaatgattttcaagagtcttcgcaatttgacatataggcattgggcaaagacagtccttcgggatatggaacggacgaaggacggcactaccgaaacggcgcatcggacgatggcactttggacgggggacatgacggacggcaaaactatgacagataccgtcattcttcagtagggaacgagtgaaccaaagcggggagtaacggcttgctttctcatttcagcagaatccgttcgatcgtgccgatggttgggtttcgtccaacccgtggaccggatcattggaccatcggggcggccgaagccgtgacaaagagcgacaaggccctgggagttttttcaagcccgacctgcccacttattcggcattgggacggagtccggacaatttcaacccattccaaacgcatttgcatcgggaggaagccaaagggttgaggaaaagtcaggagagagaggaactgatcaaattccattcttacggcgatcacaaagtgtcgggcattgaaatgaaaccgaagggatggacaggaggcgaagtgagaagaaaggagtgaccacatgagaaaaaggcttaattaattacaccccccaagattgtgacggaccgggagatcatgaaaagtcgattaaccacgccgctttactattcaccgatcgcgac

SEQ ID NO: 23745 - DNA, 1851 bp, Heterodera glycines
  misc_feature (48)..(48): n is a, c, g, or t
tacaagccaacattagacaaacattttacaattactcgcaaaacattntgtgccaaacattttatcttacaatttacaatccaacatttgacaaacattttacaattactgcaaaacattttatcttacaatttacaatacaacatttgacaaacattttacaattactgcaaaacatttgtgccaaacattttatcttacaatttacaagccaacattagacaaacattttacaattactgcaaaacatttgtgccaaacattttatcttacaatttacaatccaacatttgacaaacattttacaattactgcaaaacatttgtgccaaacattttatcttacaatttacaatccaacatttgacaaacattttacaattactgcaaaacatttgtgccaaacattttatcttacaatttacaatccaacatttgacaaacattttacaattactgcaaaacatttgtgccaaacattttatattacaatttacaatccaacatttgacaaacattttacaattactgcaaaacattttatcttacaatttacaagccaacattagacaaacattttacaattactgcaaaacatttgtgccaaacattttatcttacaatttacaaacatttgaacaaactttttacacttactgcaaaacaatttgctatctattaaacattgactcaaacatttacctattataagaatttactcatatttttaattgaattcattcaaatatttgaaaaattaaatttgattttacataactgcaaaatttttcaattttatttttataaaaatttaaaatcccagtcccaaaattttaaatgttagaattttttttaaatttctaatttattttcattactctccataagttgggccacgttcatgcgatgtggccgaactagacggggacaaattggagagcatatgcaatgaacatgaggacggggaagagtgcggtgccaacgtagcaattgaggaagaacacgagggcatttccaatgaaataatgccattgccatactcggccgagaattgcttgggaaacttaaaataaactcttgaatttagaattaaaactttaaattaaggaaaattggcattcaaaatttttttaaaaaactaattttttcgaaaattgactaaaaaattcgcagcaagttagaaaaatttaccgaaaatctttggcattccggtgccaaaaactgtccggatagtgccgtatttcccaatattcaagaagagcaacagttccgattggtactactgtatttaccatctttttggcactcgtgccgtcgttgttgcttcgctcggactcagttggcggcaatggggtgacagatgccgacaaaggttcttcatgtggggccaacggtgcaccgccagcagcagagtccggcgatggcacagtatccggcgggaatgttccaccgtatgcaccacgggccgactttggactgcgctccagcgtggaacaagcggaaaagtcttcgacggttggcagccggatcagccccaactcggcacatggtgaacagagttcgtcatttcggtgccgccagtgtttgtcgggtgttactgtagctgaaagatatggtaggaaaatatactgtatcataattataacttagctaaaactatgctataacttaatcggtttaccattttcgcagcagccgatgttttctgggagcacacatccgttggcacaattatggacccattttctgtaaaattcaccaattatcatttgattcaaattttggcgcaaaaaacaagcacctttgacgatccgtagcaatcggagcattgtcataggtaagcgccggtttg

SEQ ID NO: 23746 - DNA, 955 bp, Heterodera glycines
  misc_feature (894)..(895): n is a, c, g, or t
cttgtcaaggaatacagtactactttgtctatttgtggaacatagaaaaagggaaatattactcttttcgtctaaccctccctccctttttgtgcactatttcgttttcaaaattggaccacatttttttaccccgaccaaccctaaaaagtctttcaaatattttttataccaatgcaccaaaatttaaaagttcggagggattatccataattgacattgatctcatttatggtaatttgttttgacagtgattatttttataatttattttcattttattgcttgttttctttattcacttgctctgtttcgctataattttgacagttacagagtaagtggtccccgcccttctgtgacttatttttcttgcttaataaataaataaataaaagatttttctcattttccgacgcggttcccttataaattgacaggtttaagtcaaaattttttagtcaacttttcctcccattttcctattagccaaacacaaaaaaaaaacagtgcgaacgccactaaatgaggatggaaaagggatatgccggcacttttttttactcattttttaaacccatcactttgctataaaagtcacaaaaatccaaacaaattaaatgtattcaactgaaagaagcaacaaataaatgtgaagagcaattcctattcataatgatcgatcattcattttttaatttcgccataattcgttcactttttcttccgctgctgggcccgggattcattaaatcatccattgggtccgcttctgctggtggagacaatggcctaaaattaggacaatttaaatttgaatattaaagcaaaagctgttgctatcacaaactcacccaatgcaatccgtgccaccattaagaataatgaagactnntgtcaaattgtccgtcttttcatccttccaatgaatcgtccccccaatttgacatcgctt

SEQ ID NO: 23747 - DNA, 1862 bp, Heterodera glycines
  misc_feature (17)..(17): n is a, c, g, or t
caaatcaaccaaataanttcgaatcaaatgattttaccggctgtgagaaatcagccaagcaattctgatcagaccaagcaactgagtgtaaacgatgattccaatatgcttatgcgagtaaatccagctaataatttgccagaagtgatagcttcagtaaccaattctcagcagcttactgaccagaataatcagccgttgacggaaaatccaactgatcagtctgtaagatcaaatcaaaacaatcagcatgaaattcaagaaatattacatttaccaatgaaaaatcaacaaaacaataaaagagcagcagcaccaaattcacgacaagaatttggatttgatctggagaaagtgccaaaagcaaaaaagggtaaaggtttggcagaatggttgggtcatagcatagatcaaaagcagaaaattgctgtcgaaaacgcgtctgaacagccaactattactgatcatattaatttatcgtcacagacaacccaattaaacaatttgaataatccaacaaccaatcaaagtgtggttgatttatctgacaaaactttaagtacgaggcaaaccaatgaagtcggtccgttaaactcaatggacaattctgatcatcaaatgatgggaaacgctgttgttcagcaagtcgcatcagatcagtcatgccactcgacccagactgacaaattgtctgatcaaataacctttacaaaccaatttgacccgaacaatttggaaaataaattcaattagtccaatttcatcaattttcaattatcagggcaaaatcagacaaataatgataatcactctgaacaatctcaaccagttacacaacaaattaaagatgcacaaacacaaatattgccaaagcctgacggattgttaggctggctttatcgcaatatggacaactcagaaaatcatgacaattcgtttgaccaatcaaattgtcctagccagaaaaatcaaactaattattccgctgatacgtcaacagatttattaatgttaccaaatacagtaaatcattatattcattcaaatccaatgatgactttaagccaacaaaattactataatcaggaaaacccatcgacgtcaaccaatcaatcaacttatcctgatcacgcaaacacaatggctttgaacaatcaatcgatttatgctgatcaggcaaacacatatgcattgaacaatcactcaactttttctgatcaaacaaactcactggcattgaacaatcaatcaaattatcctgatcaggcaaactcattggcaatgaacaatcagtcaaattatcctgatcaggcaaactcattggcattgaacaatcaatcaaattatcctgatcaggcaaacacattggcattgaactattctgatcaggcaaacccattggcattgggtaatcaatctacttatcctgatcgctcactttttatggcgaaccaaaacaatgaagttaacggtcttattccaacaattgattctgatcaaactgatcaaactattttgcaatcaaataaaggctccacggacaacaactgcagcaaaatgtgcaagttcagcagggaaatgttccgacaatgctaagcatgacaacgccagtgcctgaacaaccattcgatgggacgcattcaatggtttctcaatatcgaatatttttgtacccattctttttggggtttttgttttttatttaattattaaaaaaacataaaaaacaagaaataaattcagaaccttaacatcaaatcaaataactgtggccaaaatcggccatttgaagaacccagcacatcatcatcatcagttgacaatctgaatggttcaggaaatgaattgggttggtaaagagt

SEQ ID NO: 23748 - DNA, 2080 bp, Heterodera glycines
  misc_feature (37)..(37): n is a, c, g, or t
attctgaaaattgtttatttatttcaagacaataatnttgtaaaaaacacctgttgttcttcagcagacacaatcccattgatcattttgatatttgcaaatttaaaataaatatataaatattttttttaatttagaaaatgatgcaagcaagacttagcgatgctcgagattcactctcagtctcgagtcacggatttctcagtttcggtctcgattttcgatacccaagacttttttacaccccaaccaatttgtgaattgtattaaatctttttgggtttaactactcctttttcattttttttaattaaataattcgaaatttttcgtttggcgtttcaaacatgaaatctagagcccggacgggaccgggatcccgccgggattttgccggactcccggtcccggcttttttggacaaaccaccgggaccgggagtcccggaaaaacgggagtcccgggatcccgtctcggtccattttccaagtcccggtcccggccattagggccgaaaaaacgggactaaattatacacccctaagaatggtatattcgtggattaaaaggcaaaaatttatacaattttattttttaaacattttgacaaacttttatgtaataaaaaggaaattttgtttttttaaataatattttgtggattggtggttagtgcttcaaaactagctgtattttttgttatgagttcgatacccgttgaagttttcttttaaatttatttttttttctgataatagacaaaaataccagggatggactttcgcgtttcgctttctcatttttttttttagccgtagttttattacatggcggacaacgacgaagagcatgagaggctcgccgaacaggggcgcgagtggaaagctgcgcgccgggcggagagcattgccaacttgtttggcggtgcgccgcccccggcccaggatgaggaagacgaggacgaagaagtggaggacgaaggggtggaggacgagcagcgccctcgccgtggtgagttacggaatttttttaaatactgattatctaataaattcagcgcgaagcgcagggcgacgcgggggtgatgaggacgaagaggaagatgaagggggtcgggggcggcctcggcgtcgtggtagttactttttttcatgctttttaaaattaatgctcgccgaacaggggcgcgagtggaaagctgcgcgccgggcgcagagcattggcaacttgtttgccggtgcgccgcccccgcccccggcccaggaagaggaggagggggtggaagaagaggtggaggaggaagaggtggaggaggaggaggacaatcgtcctcgccgaggtaagttactgaattttttaaaatactgattatttaataaatttagcccgaagcgcggggcgacgcgagggcgatggtgacgatgaggaaggagaagggggccgggggcggcgccggcgtggtagttactttttttcatgctttttaaaattaatgaattaagttcgctctgcctgaacagccaacgaattggagagaaaagtcgaatgatgaatattttcgattacaaacaaaccactttatattattgtttgtctcatctgaatgcatttcatttccgtggtttcctttaattgtggacatatatttttaatgaatcagcgcagccgaaaagtcgtatttaaatttctttgttgatgtattttatgtttcaattaggccgtgccttagtcgagtagaaatggtttcgaactgatgaagtcggcacttgtctgatttcgttgggtttcgcaatggttaattggtgctgcttcaaattttggttttgctttcgacttttgcttgcttccatcgcgcacttcaattggtagaaaaattcctcaatttttgataagacgaccaattgatgagttttttaggtttgccgccatttacgtcaattgcattttctttacattggtttgttatgttaatgacttgtcttattttgtttctttttcagtggaaatcatatgacattttgtggttttggactcatttggctctttgtgtttgttttcctgcgcttcgaccgaacaataa

SEQ ID NO: 23749 - DNA, 1869 bp, Heterodera glycines
  misc_feature (1812)..(1812): n is a, c, g, or t
aagtgagccattatgcgtattaaacgaaatctcttgcgcaagtcgttataattttattttcgactttatcttaacaaatgaataacagatattgttgttggacaggttttaaaagattgaagatgttcaaaaacagttaaacaatcatctttacaaagttgtttatcaatatttttagctctataattcaattttttaactgattcataatcataggttcttttcttttttttcttgcttcattaattgttaaatcaaatactgataatggtaaaactttatacgaatctttaaaaactatatatatttttttattaattattaatgaatctttaataaaaagtttaattcaaaagaaccctgattgaggtgtttttaaaaattttatattatctaattcaaagttttttattaaataacaaaatataaactctcaatcgaagtttaaattgtgaaaatatatagttattgattctttatttctttttaccaacaaaataacactgtttaaaaaggattgaatattttaattccgactttttcgaagcaaaacgtttttatctccccactttcatccaaattttatgttaaatagtaatttgtcctcgaaggaagcatcacagaaacaagggttcgacagacgtttaccgcactcccaacagccctaaaaaatatatatttttaattcctcctctcatattaccttatatttgtttatttttattcttttattttagccttaatagtgaaattttttttttcgccattttcaattccttcttgaattaattcttgaatagttgttatatcattggtgttcccacaaagataactccgatatttaatgtaatttgtcgccatttacacctgttgctaaaaaaagttttatttaaattatcactaaaatattttattttgtgacaaaaccagaaaaaaatacccaattttcttaaattttattttcaaattcattgttattaaattccgttgtaaaaaatctgttaaaacaatcgatgatcattaaaacaacacaaattattattaagcttaaaaaaattgcaagaataataaacccaaaaaaattatctcgtgctttatcatgccaatattcataatcttgacacatctaaactctaaatgtataattattaattataaaatagaaatatttaacagtagaaacaacattaaaaataaagtttataaatttattgttctgtttattcaccaataaccatatggaataatctcccaatccgttcctattattccttttttaaacgggcttatattcttttcgtaattctcgtgttaaaatcatgctgtctcgtgacgggccaaatttttcatatttgaaaaattttatcatgtccttccttattgtaatctaaaatcatattcttgaaatcatcatggccgaattcattattttgttgaaggtaatgcctaaaaatatcaaaaacattattgtataaataattttaaattacccctaattttggttttatgccatatttgaccgtctgagttattttatatttaattgaatattgcttgcttcctccttaaacaaattctaatatgttatttcccgaattttcatgtgacatttctctgaattcatttaattgtaatataaaaataaacagtttggttttaccctaaatagtttcaaaaagtaataggatttttgccaataggatgtctataaacaacactatctaaaataataaatggtaaaataacaaaattaggtttaccggtatcccaatacagtaattgattgtccttattttgatctattgaagcaanttatataaataaattcgtgcttgacttgtagtcctaaaccaattttactcaaccata

SEQ ID NO: 23750 - DNA, 956 bp, Heterodera glycines
attgtattttcctccttttctctctgttctactcattctctcgcttcttctctttccttctctctctctttttctatctctctcctttcctctctctctctttctctcctcacttccctcttttcctcattttctctctcattgtctcccttttctctatctcctttcttctgttctctcctcgttcatctccacactttctttctctctcgtttcctcttctctctcctcatttttcctctctcaccttgacataaacaaatgaaagaaattcctttttgagtctcaatcaatggagccacaattttctacaaaacattttgtgcaccatgttgaacagcttggaaaacgattgttcacagtgacttacgatctcaaaattccacttccaagctcaagttttgcgccaggcgatctttttggccatcttctcgcccaaaataaatttccgctcccgttttataagggtcagttcaactaactaaactaactagtggcaaatatgttaagtgttagctggttttgaggtggctacctattctaaaaaataaaaaaagggttgatttttttaaagcttgctaaattttttttggggggggggggtagaatttttttttctgaaaaacaacaattgtatcaccaaatctcattgacaaaaaatccccataacatgcttgtacataattgcatttgcatttcagctcctcttaaaagcattaaatattttcagaggtcagagtcaaatttgaaaaatttgtacgcgatgaaacacgcaaatttgacgccaaattggtgaccctgcgcattgaaaatgctttaaaaactggcgaaaatttggacaactcttcgcttggcgcaggcgcaaacagcagtgccgacgatgttgtgaccacaaattgcgatgttagtcaccacggaaatgtgcatcatcttttttcccccatttcacttaaaat

SEQ ID NO: 23751 - DNA, 891 bp, Heterodera glycines
  misc_feature (875)..(875): n is a, c, g, or t
ctacggttgaaccatacaaatggtcgttatgaaatatacattgtaggtaagaataggtattctcagagaatgggtatgcatattttctacatcattagacatgtgggtgtcattcaaatgacgttattatctacgctggagccgatacaaatcgtcggttagaaatttccacagtaggtaagtataggtcttctccggtaatgagtatgcccattatcagcatcattacccatgggtgtgtcagaacggggggggggtagttagttgcccgcgcacccggtaaaatgtaaaaattttctgtaaaacgggtaattttttttaattacttaatttttcttaactaatttgaccccaaatttcctaaattttacccggcggtgcctaacagcaccgccggacccgaactttcttatatttttgcctaaatttagtttcaaaatggcaaaatttggcaaaatgtaaaatttctcgtttttttcccggaaccaaaaatttaggaaaattacacttgacaaactatttttgggctggaagagcaaaaataaaaagctctttgggtgcgcacctcccgaaaattttctggttacgggcctgtacagtattccctaattgattaccatacaaataaattaaaattttcttcaatttttgttgatgtaatattctacaaagagaagttcaactttagaatttacaacctaataattattaccagcctgttataatttttttgaatcatataatggcacttttaaaattaaaaaaaaaaaaactaaaaaaccatttttttcacattttatagtgaaaaagatgatgattaaaaaaacgaaaatttatccatttaattaaaagatattgtccattttttattcaanatttttgcctttttta

SEQ ID NO: 23752 - DNA, 1749 bp, Heterodera glycines
tgattagaagaggtacaacagtcattagaagaggtactcttttgttagaagaggtacaaaagtgattagaagaggtacaactgtgattagaagaggtacaaaagtgattagaagaggtacaactgtgattagaagaggtataacagtcattagaagaggtacaaaattgttagaagaggtacaaaagtgattagaagaggtacaactgtgattagaagaggtacaaaagtgattagaagaggtacaactgtgattagaagaggtacaacagtcattagaagaggtacaaaattgttagaagaggtacaaaagtgattagaagaggtacaactgtgattagaagaggtacaaaagtgattagaagaggtacaactgtgattagaagaggtacaacagtcattagaagaggtacaaaattgttaaaagaggtacaaaagtgattagaagaggtacaactgtgattagaagaggtacaacagtgattaaaagaggaagaacagtgattaaaagaggtacaatagtgattaaaagaggaagaacagtgattagaagaggtacaaaagtgatgagaagaggtacaacagtgattagaagaggtacaactgtgattagaagaggtacaacagtcattagaagaggtacaacagtgattagaagaggtacaaaagtgattagaagaggtacaactgtgattagaagaggtacaaaagtgattagaagaggtacaactgtgattagaagaggtacaacagtcattagaagaggtacaaaattgttagaagaggtacaacagtgatcagaagaggtgcaaactgtgattagaagaggaacaattttcaatagacgtaaaagttgagtaaatcaataacgcacaccatctcaaacataagaatgtaataaacagatggcatataaaaaaatacaaattatggacaataaaattaattaatttgaaacaaaaaatttattcatcaaaaataatttaatttaaatttaaaattatttattaatttttaataaaacaaaaaggttcaaattaattaaaagcattgaaaatgacgaaaaaaataaataatgaaaagtttttataaaaatttaattcaaataaaaaaatgtaatttattattaataaaataaaaaatattttaaatgaataaaacaacgaaaacacgaaaaaaatggtagttattaattaaaaacaacgttggaaattattaattgaataattatttaatttgaaattaaattattttttttacaaattcaaaaaaaaataatgaaattctttaatttaaaaaaaaataaatttaaataatttaaaagaaatcttcaaattaattaaaaacagtcaaaataacccaaaaatgcacagaaaaatattgttacaccgtccggattcgaactttgcccccccccacaaaatgatgcctcagaatccccaatcacacagggattctgaggcactaacgatgtcaaaagtaaaatctgatcacgtattcgtgatcagcgtcataaaatagccctaatgacatgtttttcgtagatttttggttaaaaatttttttcactttaaaaccatggtgctccccccctttggccccgaatccaaaaatcacttttatttttatatcttttttaaaaaatgtgaataaaaatgtaaattaaatttatattatagagaaaaaattgcggatttttgtagttttttacttttacagtatgacttttcaaaccgagttatgaattttt

SEQ ID NO: 23753 - DNA, 884 bp, Heterodera glycines
cgcgttgatatttggcgttggcagaatgccaaaagtagagggggaaccagagaaaaagagactcaaaagcagagggaaccagagaaaaagagactcaaaagcagagggaaccagagaaaaagagactcaaaagcagagggaaccagagaaaaagagactcaaaagcagagggaaccagagaaaaagagactcaaaagcagagggaaccagagaaaaagagactgaagataacgcaaatagaaacatgatttgaagaataattaaatagtaaaatcagacaaatgaaaaaaggctagaaatagggggaaaagaagtgaagagaagaggagagaatggataacagagagagaataaaatgagaaaaatgtaacgcgaaaagataaaaagaaaaaaattacaattaagaattaaagaaagaaaatatataatatttaaagcagagaaaaataatgcttaagaaaaaaagacaatgcatcaaaggaggaaaggaaagaaaaaaaatagtgcgagaaaagagcgagatgaaaagagaaataggtaggtatcggaccggctcagttcggccccagcccagttttcgatctatcttttttctttgtcaacaaaatccaacaatcttggtatcattcgaaagatctttacatactctattagccttacaaaaagctaaaaaattttcaagcctggaaaaaatttatgaagaaaaaactttaaaaaattgattttttcagttttcatgttatatctttttggatatttgtctaattgccaagcaatagcttagaaaaagcttctaaacaccttaagctttcgaatgataccaagattgttggattttgttgacaaagaaaaaagttatagtcaaaaaattggctgggccgaac

SEQ ID NO: 23754 - DNA, 1720 bp, Heterodera glycines
gcctagctcgaaaaattttgaaaattttcgaaatttttaaatttcagaaaatcgagctcaccgagctctacaataagtctgctggccaccctgcgctcaggtcaaagcctaatgagttattcaacggggactgaactgggcaaagttggtactgaaaagttgccaatttctgcagcccttccaagtataggtagaggcctggaattttttttgaaaattagaaaacacttcaacttaaaatcctaccagcaagcattttttgatcagtgttttagaaaaaaagttacgggccatcaaacgcaagcaaaagtgagaaattagccgccgggactcagttggccaccgaagagaaaaacccgtatttttcccagatgcgcctcaaaaagttgtaagacccttccactactttcagggcgctcccgacagccgttcgactcaaattagtttttaagacgagtccccctttttctctatggtaatataaactagcgggtgcgtgaaccgtcggctatttagctgggaaaaagcgcttcgcgcttcttgagcttcgctacctaggctgtgaagcgattcaaattgatcgaagatgttagtgagaaattttaagaggtacaaaagtgattagaaaaggcacaacagtgattagaagacggactcttctttgcactcgacataacaatgtccaggacctttgaatgggtgtactttaggctactttaattaaattaattatttttcgacgggcgtttcgcgcccgttttttaaatttggttggggccagacaggcgtttcgcgcccctttttatgtatggagatgtttaggccgcttcgcggcgcctcgaacggacgcttcgtgcccgtttctaaattttgttgggctcttaaggccgcttcgcggcctcagacgggcgcttcgcgcccgttattaaattttgttgagggatttatgattaaaagaggtacaacagtaaatagaagaggtacaacagtaaatagaagaggtacaacagtgattagagaggtacaacagtgatgagaagaggtacaacagtaaatagaagaggtacaacagtgatgagaagaggtacaacagtaaatagaagaggtacaacagtgattaaaagaggtacaaaagtgattaaaagaggtacaaaagtgattaaaagaggtacaacagtaaatagaagaggtacaacagtaaatagaagaggtacaacagtaaatagaagaggtacaacagcgattagaagaggttcaacagtgattaaaagaggttcaacagtgattaaaagaggtacaacagtaaatagaagaggtacaagagcgattagaagaggtataacagtgattaaaagaggtacatcagtaaatagaagcggtcaaaagtgattagaagaggtacaacagtgatgagaagaggtacaacagtaaatagaagaggtacaacagtgattaaaagaggtacaaaagtaaatagaagaggtacaacagcgattagaagaggttcaacagtgattaaaagaggtacaacagtaaatagaagaggtacaacagagattagaagaggtacaacagtgattagaagaggtacaacagtgattagaataggtacaaccgtgattaaaataggtataacagtgatcagaagaggtacaacggtgattagaagaggtacaaagtcattagaagaggtacaactgtaattagtaaattcattaaa

SEQ ID NO: 23755 - DNA, 884 bp, Heterodera glycines
attcccccgtttttggcccttttcatcaccggctactcctgcccgtggtgcctattttgcctttgctttagccattgcccggccattttgtcgccgcttgggtcctcgttcgtttccgttgcctttggccagcattccactgactcaggcccctgtgtcccttttggtcccccccttttttcctgtgtttaccacagtttgattaagagtctggtgctcttccgactgaggtctaaccgggcccttttttcgggctaaacttgtaaaacaaacgggactaagtactgtaaaggggcaaaaccgtcactccttttttactcaactttttcgctttatctttctttctctcaactatgtcggccataatccggcagcaactccgcgctcttttgaccgccatttcttctgactcattacagggggccgattccgatttattgccaaacgaccccacttctctggagtccattagccttaccgccgagaagctctcgcggaaactaagcaaggcccaagccctcctgaaagattggacgattatcctttcctcgtcgagtaaagaagtcagagagcaggaaaatgctttgtttgactctttttcggtgggtgggcttactccgggtgaaatcctctccgacggggatgaagttctgaccaaattggaaataaaaatagatgggatccgggccatgacatccagggtcccaccctcccaatctccggcccctcccacccaaattcggccccaaattaatttgccatcactccagttaccggactttgatggaaatgagactaattggccctctttttgggcggctttcgctcacaccattcacgataatatgtcgcttaccggctctcaaaagctcacttatctggtc

SEQ ID NO: 23756 - DNA, 1973 bp, Heterodera glycines
agaatgaatgaatgaacgaatgaatggaaagggtgttccttaagcaaaatgcaaatgggaaatgaacaaatggacgaatccaaaagtgcttaagtatgagataagagaggaaaggcaaaaaatggtaaaaaatcggggagaggagctccctggcacagaaatgcaaaaacaaattgtgaatgggcgaaatgtgacggtccaaagttcggccgacgaatacaaaggaaaaatgggaaatcggagaaaatggggaaaggagatgttggacgatgatttgaaaaacaaaggccaagtggaagagcgacggccaaaggggacgataaatgcagatgtgagaaaaggagaaaaagagggcaaaatgttaaatagacaaaaaggaaatgaattacggtagccaaaatatgagaaaagtgtgaaatgaaatgcataaaatatgagaaaaacgacaacaacgacagcgtgctgatttgacggctcgtcatcgacgaggacgctgcttcgccgccgccccctcccgtccgttcggtcattttctccgtcattggatgctcttcgccgatgatgaacactgctcgtcctcctgctgtgcgtcgcgtccttttttcttcgactgcttctcctctgccctcctcctcctctgctgctgctgttctccctgtcctctctccttctgctcctctgccctcctcctcctctgctgctgctgttctccctgtcctctctccttctgctcctctgccctcctctactgctgctgtcgcccctgccctctctccccctgcttctctgccctcctcttctgctgctgttctgcctcccctctctccccctgctgctttccctccgctctctcccatccctccgctctctgctcctcctgctttccctcccccctctcccccctccgctctctcctcctcctgctgctgctgcttcccgagcctcctctcccgttgctgctcctccaaaccctgctgctgatgctgctgctgctgcttctctgtgcttgccccgagctggaccatctgctgctgctttaaaacatggggagggggtgacattttaaattacaatttgtaggaagtgatatttctcaccgaaaacataatactctaccaaggggtagagtatgcctacacaagtcccgccctccccatcccaatttgccggggtctggtggccgcgtcttcatctgtaggcgtgttggatgcaccaatacaagaattggacgctgttgtgcgtttttgaaaatgaaatggggaacagatgaaattattaaagagcccggggctcataagaaaaaaaaacattttgtaatttgttttaaataaatgttttggcaatttgtcaatttgggggtgtgtaggcgaaatgtcagtttgatggaatgtctgtaagcataggatgaaaagccccactctcatctttcacatctgcccccatgctcatctgccacccctccccccaattaaatcaattaattaaacattttacgaacaattaattaattagtaccaatttgtcatcactaattacccccccccccccacccccatctgtcggcaggttcaaagggctgcacccctcccataggcttgggtttggccaattagcacccctaattacaccacctgtcacttataattagcgtcaacctccaacggtcccgggggggttactactaacgcttgaaattcaatgatacatttatttaccaaagacatagaaatggatttttgagctacaaaatattagaagattttttaataatgtgcaaagaaagtttgtctatttttgtttcctgattttcagacattttccatttccatttctggcactatgcaaggtggacagaagtgatcatcgatgatcggcttccgtgccgaaatgatgaacgattgctttatattcgtccacctggatgagtgattaaattaaatgaatttaattattttatttatttttagtgacgt

SEQ ID NO: 23757 - DNA, 1088 bp, Heterodera glycines
  misc_feature (924)..(924): n is a, c, g, or t
cctatcatgctcgagagcattgtatgtgtataaaattatcaaaaaagagatagcatttttgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtaaattgcgcaccgccctccctatcatgctcgagagcatttgtatgtgtataaaatttatcanaaaaagagatagccatttttctgggataacctctaaatataaaaatcctctgtgaaaataaatggcgattgtgcacagccctccgtctcatacgcaagcgcttttgtgaggtataaaattctcaaaaaagaatagacattttctgggatgagtataaatttaaa

SEQ ID NO: 23758 - DNA, 1842 bp, Heterodera glycines
atggaaaattcttcggttgtaggaagtgctgtttcatttttcggcaaaatggactgaattttgttctgggcatccaacgaattggagtccttaccacagctcaaattttcggaaatcgggttttcaacaatttcggcccaacgcagtcccaacggatcacaaaatttaggcaactcgcctttccaatccatgaaccgctgttgtaaactcacagcaactttgtcaaaatccacacacaaacgctgtgaagtttcatagaaaagttgacctccgcggccttgtttgaattcgttgtcaattgactcacttatcataagataaatggtcatggctcggctgtacaggatatatgcatcctcttctttcccttcctgtattttcgtttttcctttccgttcgacttccatcaaaaagttgagccgcgtaaaattgtcgagccgtcgaagtgaataagtcaatcgattgtcaacgtttgcatgttttttgagcacctcataagattcgtacaccaatggatgcaaatttgtcgatgaagtccgcataattttgttttatcgacacgagataaaacaaaaatccaaatgtataaagcaacacgaactttttataaaagattttttggcgagcacaacacgagtgctttcgacgaatttgtaaaagtggacgaaataaggcggatgaagaaaaacccaacacgagggtattaaaatttgacgagcagttgacgaacccaacacgagggttttccaaattaggtagtcgctttttaaaatgagaactcattgaagaaaaataaagccgtccgccacctagctaacctttgttaccaggagcgccatgttggaaaagaagaatcaatttgtcgggggtttctttgccacacttctaaattttgcacaaatagtctatgaaatggccaaaacctgctttaaaaatccaataccaaacaaaataaattatgcgacaaataattaaaagacaatccaaaataaataaaattcgatcaacaacaaattaataaaaacacaaataaatcgacgaccaacaaaacgcctaaaattatcaccgacgacccttatcctttttatggtttgagaaatattatttataacttagctcaaagcaacataatttttaatcttgatacattcgatagccctaggtcttctctgttagtctacaaaatttcaaaaagtttcattaagtttcaaaaaagttatggctagaggaattcataaaccttgtttttcgaccgtctttggtcctaactttttttaaacttaatgaaactttttgaaattttgtagacggatatggaagacgtagggctatcgaatgctatcaataattaaaaattaggttgcttttgagctaagctataaataattatttaccaaatcatattgatggttttttaaataacgacatagcacccaagaaagtaggtaggcagaaaggtcgtcctcctcctcgtagtcgatgttgtcgtccagtgcttcgtatatgacattgattcgaatttataccttgatttttggtggtttaactcatcaagagctttcgaatgtgtcatttgaacggttttcctctgagatgaatggctctattccagttcacgcgtccaatcaatgtttacgcgtccacagaaaaaacatcagggctcagagacgataagaattcttttttaatggggctattagccagttctatgctttacttattttgaaggtttgaacaaaaatcccttaaaattccatttccatgccaaattccgatgctttgtcaagcaggacggtgttatgacaaaatggatcaaatttttaattttttatatcaatctat

SEQ ID NO: 23759 - DNA, 1125 bp, Heterodera glycines
ctgtcggattgtcctcactgtcggattgtccaatgtcggattgtccactgtccgattgtccgggatccacatcattgataactttttgtaaattaggcgaagtttttaaaaaaaacttcttaattaaaattttgattaattaaaaatgccttaaaggaagcaaaataagtcccaaactatgttttaaagaaaaaaattcattaaataaacaaaaaattgaccaaacaattcataaaattggcttgaaaaatgaaatttaaaaaaaagaattattttattaaattaaattcatgtagaatacacaaatattaatatcaaaattaatctaatgaactgctgaaaatgtggtagaaattgttaaaaagaaacttataaaccagcgcctcgttaaaaactgagtggtccaatggacaagtaaaattgaaaattatcaatcttattacaaatatttttgttttataacttatatttaaattctgtgtttaatacataattaaaatataacctaaatgcagatcaaaaatagcaaaatcctttagctgacaatatgtgaaaagtgaggatagattttgttcaacatttcttatctgctagtgtgctttttcgattgtgctaccaaaaattctttagtttggtcagcatataactcaaaaattgtggttttttagcgaaaaatataatgagctttgtttagctggaaaccgattcgagctctcatttagggatttgccggcatttcaattttcgataccaaacctttttgagctgtcgatgcctaattccgacaaaaattaattcactacatcaagaaaagggcataaaaactttctgaccgctgtaaacgagaattactaggattgttctatcaaaaggcaaaccacgataaatttgaacgagtaagttttttaaataattttatagttgaccaattttgcatcagtgcgtcgtgatgcgtgaagacctttggtaagagcggacgaaaaaatatgctctttaaaattggcattcaaaaaaaaatttctacaaattttcaaaaaaattttttagtttttgatagcatcgtgaaaaatcgaatttcttacccctacctaactcaaaatttctagcaatttttgggccaaaaat

SEQ ID NO: 23760 - DNA, 1040 bp, Heterodera glycines
caatcactgggactcaacccaccaacattccaatcactgggactcaatccaccaacattccaatctctgggactcaattctccggcattccaaacactgtgactcaaatctccggcattccaatctctgggattcaaatctgcggcattctaaacattgggactcaacccaccaactttcaatgacattccaatcactgaaactaaacccaccagcatttcaatctctgggactcaaatctccggcattacaaacactgggactcaacctcagcaaatttctttagcatttttaactttttgtgtgccttgggctgttgaacttttgcgccaaagatactcgctcggccgcttcgcggcctcgtactggggccttcggccccgccacaattttctgcccaatccaccatcatttaatcactgggactcaacccaccaacattccaatcaacgggactcaaccctccagcatttcaatcattgggactcaattctcttgcgtttcaattactgggactctattctctgcgtttcaatcaaaaggacaatccaccgcattcaatcactgggactcaacccaccaacattccaatcagtgggactcaacccaccaacattccaatcaacaggactcaaccctccagcattcaatcactgggactcaacccaccaacattccaatcaacaggactcaaccctccagaattcaatcactgggactcaacccaccaacattccaatcaacaggcctcaatccaccaacattccaatcaacgggactcaatcaaccaacattcaatcagtgggactcaacccaccaacattccaatcaacgggactcaatccaccatcatttaatcactgggactcaacccaccaacattccaatcaacaggactcaaccctccagcattccaatcaacgggactcaatccaccagcatttcaatcactgggactcaatccaccaacattccaatctctgggactcaattctccggcattccaacactgtgactcaaatctccggcattccatctct

SEQ ID NO: 23761 - DNA, 1801 bp, Heterodera glycines
tggcaaagttggtcggggatagtctgacttaaaatcctaccagcaagagctaagtcgatccacggtccaaagaaaaaatttcgtagaagaaaaactgccagcccgagtgacaaatcgcttctcgggactcagtcgtccgcgctgaatttttttctatagttttcccggattctcctcaaaaagttgtaagacccttccaccactttcagggcgctcccggccttcggccgggagattttgttttttgaaacgaaagtccttgtcaatataacgtatatactagcgggtgcgtgaaccgtcggctatttagctgggataaagcgcttcgcgctttgggagcttcgctacctagattagctatcgggttgtgaaaagatttggaatttttaaaaaattatcagcgatttttaggtcaattttctttaaaaaatttgctctaaatcacaaaatacttcattttttggtgaaaatctgtatcggtcaagggacaactccccgaaccctggtcatggacggtaaaaaagaaaaaaaagcgacaataaatctttttactaataattatgggaaaaaattggcgttctgtcacatttactttttatctttatttctctcacttttacgtactatctcttcattcttaataatgtaaagaacaacatttacttcgtgacgtttaacttttttcctacacgttaaatccactccaaattttgcatatcgatagagaaaaaaattacgaacataattggaaggtttttatgaataaaaagtgggttaactaaaaagttatggagtgattaaaatttttgcatttcttttcctctccttttggcgtactattttcatgtctctaacacatgaaaaaacaccaaattcgaaaattctaataattttggttataagggtacaaaatcactttggacatttagaatcaatagaaaaaagaataaatttagcattttggttagaaagagctgcctaggacttgagttataaggtgatgaacatttgaacctctcgacatcttttttctgagaaggacaaaattgctaagcattcacttagaaaaaagattctcttttccaaaatcttttttaaaataccaaattttgtccttttttgttgggaaataaacggtatattggcttgttcaaaaaaaaaaaacaaaaaagggtttttcccggggaaaggggcattacttttgttttttggggggggtgggggtttttttttttcccccaattttttttttgggaaattttttttccttttttttccccccccccgggggggggggcgattttttggtctccccccccccccccaaaaacattttaatttgtgtttttttttttctttaaaaaaaaaaagggaaaaaaaaaaaaaatggggggggtttatattgttttaaaaaaaacccccccaaaaattttttaaaaaaaatgtggggtttttttttaaaaaaaaaaataaaaaaaaaaaatttttttaaaaaaaaaaaaaaaaaggggggggggggggggggggggttttgtgggggggagaaaaaaaaacaaacaaaaaatatttttttttttccccacaaaaatttttttttttttttttttttttttttttttttttttttttttttttttttttttttacccccccccccccccccccacaaaaaaaaaaaaaaaaaaaaaaaaaaaaaaaaaaataaaaaaaaaaaaaaaaaaaaaaaaaaaataaaataaataaaaatataaaaaaaaaaaagaaaaaaaaaaaaaaaacaaaaaagaaagaaaaaaaaaaa

SEQ ID NO: 23762 - DNA, 647 bp, Heterodera glycines
attgagtaaaattaaatgaatcagaaaatgcaatttgggactctttggcacttttaaatgtttgctttttgtcactgtgccttcgccagcgatggctctgccgaagagtttgtcgaattctctaacagttttccctcttttgttggtccgaactgtgccgagaccagcaattggtaggccaatgtgccgacgatggctccgaaaaatgggcaaacgattggcacccaaaaccaaccgaaagaattgtaactgaacaacagacgaaaaaggcattttgaaattggacacaatttcaacactccctcacctgaatacttcccaaccgtacccagctaaaagtgtgaaaagtcgtgggccgaaatcccgcgccggattcgctgcattaccggcgttcagcccaaaagccatgttgatggcggtgagcataagtcccatcatcgccggttgggccacccgtgggatttgggcgtgtttgtcggtgatgatgccaatgatgaagcagagcatggctgtgcaacatgtcttcagtcgatgccctttttcttatctgatgagtgtttgtatctgcctaacctggtcaatgacggagcccaaaatgctcaaatgttcccccgggtaagtggcgaacacaacggccgtcgcctttg

SEQ ID NO: 23763 - DNA, 723 bp, Heterodera glycines
aaaagtcggtccgcaaatgtcggtccgcaaatgtcggtccgcaaatgtcggtccgcaaaagtcggtccgcaaatgtcggtccgcaaaagttggtccgcaaatgtcggtccgcaaaagtcggtccgcaaatgtcggtccgcaaatgtcggtccgcaaatgtcggtccgcaaatgtcggtccgcaaatgtcggtccgcaaaagtcggtccgcaaatgtcggtccgcaaatgtcggtccgcaaaagtcggtccgcaaatgtcggtccgcaaaagtcggtcgcaaatgtcggcccgcaaaagtcggtccgcaaatgtcggtccgcaaaagtcggtccgcaaatgtcggtccgcaaaagtcggtccgcaaatgtcggtccgcaaatgtcggtccgcaaatgtcggtccgcaaatgtcggtccgcaaaagtcggtccgcaaatgtcggtccgcaaaagttggtccgcaaatgtcggtccgcaaaagtcggtccgcaaatgtcggtccgcaaatgtcggtccgcaaaagtcggtccgcaaatgtcggtccgcaaatgtcggtccgcaaatgtcggtccgcaaaagtcggtccgcaaatgtcggtccgcaaatgtcggtccgcaaatgtcggtccgcaaaagtcggtccgcaaatgtcggtccgcaaaagttggtccgcaaatgtcggtccgcaaaagtcggtccgcaaatgtcggtccgcaaatgtcggc

SEQ ID NO: 23764 - DNA, 1626 bp, Heterodera glycines
tggaggggtcaattgactaaaaggaatttagaagaggaattttaaagaaatttgaacagaaactcaacgggaagctgttcactatcagcaagttgaacactcatctcggcatttttcaagtaattgagatggtactgattttcttaacgattttagaaataaaaagcaaaaacaaagggccttaaaattgccttggctattcgaattcgcaattggaacaccaataaacacatcgtccgtgtcaatttgtgtgaaagatttcacttaaaaggtaaaaaattggaaattagaaaaggattaaaaatggactgattttccgtccacccaccgacccgtttcccgtcgctcctttcgcagcgaaatgtgcgcgtccacttgcatagcacagaaagtgcacaggcgcagcattccgttacagcccaactcagtgccattcacctgccaagtgttgtactttaacagtttcacttcataaaatttgcaaaactcaatatttcatgatgtctgattgatagtctaattagctaattgtgaggacagagccaaccaatcattctttcattcattcactttcacctgacatcgggcgcaatttttgcaaaagagctgtccacagagtcggcagtgatggcgtcgacggaaagtgctaaacttttcattgcattcgtagcattcgttgccggcggagtcgggcatccttcaaaatgaatccaatgagaaagaaaagaaagcaaaagtggaaaaaaccaaccaaaatcgtctaaactcgctctttttatagtcgattagccgtttccgaaccaaactgatcggaccatcggacaaatcgttggaggatggccgggagagaccattttgatcagtttccgtgaggaaatcgggcacttccaagtcgaccgacggatgcgcttgatcagagtaaatttcgtcagtttttatgcttttcgacattttctcatagatagttgaggaagaagagtctaaaaaaagattggaatcctaataattttttacttaaatttccaccatttcgcgagaaagaagaagaatttgaaggtcggaacaaattggaaaacaaagagaaaattccgctgctatcgctcgttcgcgccccgaagcctttttcagcctccaaaggctcatcaaaaacgggaaaataaaccatggaagaggaggacatttcgaacaacaaaagaacagtgtcagtcgagaaaagacaacaagaccaatttgtacacaaagagctaaaaacgcattaattaagaaccttcgaatttcacacacaaaaaatatttaaattttatttcacattaaaatttttatcggaaaaaaaaggaaaagtttattaacgatttgtacgaggaatttgtaaatgaagattttttattcccagagaatttttgtggttttttagtgcccgttcttcggcttataattaatgtgagggtttttgattgcgtaccattgcattaatcacgattttaggagagggaagaaacatcgaaaaaatttaggatttttaatgacttgtcatttgcctgtctttgacaaacgccagctttattggcatgtgattcttgttaaagaaaatgtaagacaaaaaggagggggaaaacgggggaagag

SEQ ID NO: 23765 - DNA, 1530 bp, Heterodera glycines
aaaaaaaaaaataaaaaaaaaaaaaaaaaaaaaaaaaaaaaccgggccccccgtcacacaccaacaccaaaacacggtcccccccccccccccccccccgccccccccccccccccccccccctttttccccctttttctccccgctccccccgggggggggggggggggggggaaaaaaaagggggggggaggggaaaatttttttcccccaacggcggagggggtgccggggttcccccggacggccctctcgaggaatttttttcccggggggcccagctcgtgctgcccctcccttcccctcttgacatgaagtcgggcgatacgtttgccctccccccattttgttgtttcttttttcttccgtttgctgctgctttggccaattccgtgcatattttgggtgcattccttttttcgccccattccgtcgccgttcaaacgattttcccttggggcacaaaaaatggtaaattatgcgccaaaaattacgccaaattaaaaaattaataaaaatgctcctattttttttttgcaattgtgtaaaacaattttatcaattgcgacgaatttttcgttttctcccgctgtcctttcacctgcccccaaattccatcagcagttcactcaaacacaaatttttttcctatcatcagaaaacaaatcatttttcgttaggacaaaaaagggggaattttaattattacgcaaatcccccgggggactaatctctccgctgtgggaaatattgtattatgtttgtgtgcctgtcccccccccccccccccctacatttatcgtcattattattcatgcattattttccttaattgaagtgaatcagttatgtaaagtatgtatgtttctcatgttttcactattagctaccataatatttttgtgcgaaaaattaccgtaactttttttattgaatactgtacaatgggtgaaaggggacgactgaactcgggatcatcgtgttggtcgcagaattggctcgcaattgttcgaaaaaaactttttaatcagctagctaagcattaattaattaactctgagcaactgattgagagtccgtccgttctgtactgagttggtcctttggatctttttacgttttgccatgcctttttcttctttattttgtccgttccgttctgctgatcgggcccagcaaaaatcatacaaaaatcacagtgcacattcaacgcaaagggggggggggtgttcaaaagttaggccgccgccgtttcgtcccgtcatttgtctcaatgggacggaaaggggcgtcgggggaggggatgaatgctgctgatctgttggcccagctcaaccctcttgggtcagaagctctttcggatgcttcttcttctttacacgccaatcccccatggggaggacgatgctcttccccggatgcttcttacgcttcttcgtctcccctcggagaaaggatgcattttcccgggtgcttctgtctctcttttagcaatcgggtgggatgctttgtctccgcccgttgctctca

SEQ ID NO: 23766 - DNA, 1995 bp, Heterodera glycines
acatatatagaggaataccgaaaacagaagagcgtacactcggcaaagaaacttggaaaattctgaatcgaatcgtttggtagttgttagtttccagcatttctatatttgttattattttcatcttcttaaattttaataaatcaaaatataaaatcggtgatggctttaattccgataaattgtatacggacaacttttattagggaaaatcaaacaaataaataaagcattttaattcatcaaactggcagaatgccatgtgccactttttgagtcagcgaggacaaaagatggtgcagcaattggtcctcgcattcagtgatctgcagactgaccggacagatgcacgctttcttcccgtccaactccaattgaatcactctccgtctcttcccctcttttttgtcgctttcctccgctgctgcgtccttttccccttggttttcctcctctttcacttccacaagacttttgtcaccgcataattcgcacagtgtcccaaccaaaatcgattccaaattttgctcaatttgctgtgctttcgcaccgaaatccttcggaacatctggagtttttgaaaaataaaagcagaaaattggcacaaaaacttttatcgaggatagggttggtttgggcgtgaagaatggccgaaagtgtcgcatcggcaaatcttaaacggattaatttatgtttttatgcccaagaaatgaatgtggtaaaacagtaaaattcatttgttcattcaaagactcacaaatcattcacggggtttgacatccattcaacgatcacaatgtgttggacggaataaaaattgatagtaatttcgtcctgttaataaacaaaaaataaaattttgtgcgctttgttgtcctccttcctccacaaaccctgaacattttgaccacgtacgtcggtgttcctccgtttttgctttccttttgctgtttgtcacttgtcgacgcttcgtccgaatttgacacaatcgcatcggacgacagcagacgaaggttgtgcagcagcaaagggaaggaaccgtcatagaacacactttcacgttgggacagccgcgaattggccaagtcagtgtaagctgaacagaaaaagggatggatgagcatggccaaatagagcaacagatgagaatttagtcattgaaaagggactgactgaccgctgagttcattcggatgcaacaaatggtaattgaaatttcgccgcaccaaaatgccgctcacaatgctcccatcctccggcacattaattgccagttgtcctacaacttttgctgttttttggccacgaaaatataattggacggactccgtgttgcgcggattgtagaccttttgtgtttaatttaaaggagcaaaaataataataaacacctcaatttggaagtcggtgtcgtcctcgtattgtcgcagcacagctgccttcagccgattcatttcgttcatttcgccatggaccaaaattaaatttggtggccggagggcacggataaattcggaggtttgaatgtaatcggtgtgagcagagaaactaatataagccaccttggaatgataaaaacggaacaattagtcaattttcaatcatttgtttataaatgtcagtctgaggtcacctgaagacgcattggcaatctttggccattcagcgcaacaatttcctccggttcggacaaaatgtgctttaaaagagatagagcataaataagcaaacgaaggaatggcttattgtggattgaattacctttgccagtgttccttcaacacaatatccggcaattaaacacccgttctaatgtgaatttgtaaagaaattacatttgaaatgacaatgtattcaaattgttttctgcaccgtgtcccgacatttgcggtccagacatttgcggccccgacttttgcggcccgacatttgcgcctttgtccaaaatctggttcagaactaagttttttcaatcactgatcgcataaatagctt

SEQ ID NO: 23767 - DNA, 1464 bp, Heterodera glycines
tagagaccgactttttgaggtaaatgcctttttttctgcgcattagttccgatatattaagcataaataacgcattttccacttggtttaaggcttctacgttgacttttattatgcctttttttgcctttttcgggattttcgtgccttaaatgccttttttggcatttttcccttttggtgccttttttggcgtttttttccaaaaaattccataaaaaatgcaataaaatcgggaaaatacacccctaaggaaatgacttgaaaaattttcagaaaatacacccctaagaattaaaaaaattttctcaattgatcgccaaaatttcattttttttttcttgataaaaaattttaggtttaaaattttcttattcgaaaaacatttaataaccatttaaatgaccaaaattaagttagttaagttttacgtgttttgctccctaataatccttaataaaaacattttaaatgcctttttcaaaaatatattttataaaaaagaagaaaatgttttattattttttttatcttgttttctccttgtttgctttttctaatgatcattcaactggctcgtttactagatgcctttttcgcgattttcgtgcctttttcgcgatttttggtgcctttttagtcgctatctattaatgagaaaaacgacaaatgttacaaattaaaaaaacaaaacgccaaaaaaggcattttaaaaaagcaaagagactttaagacacattcacaacttcagtcaatgttttcttttatctccacgcgcgttgtgttgaagcggagcgtcgttctgtgtgcttttgcggcgccgccgacgccttccccttgggagcggtggacgaaagtcgcgagaatgggagcacccggcgacgctcgagagtacgacgactcccattttcctaaaattggagggggggggggggtgaaaacacaaggcttccatcgaaaatttttcaaaatcagaacatcaagtccaaaaaatcagattttgggcacaaaaatcagaatattttgaaaaattgcttttaatcttagactttattcgatcaaaaatgtatccaaatattatatttttcaccccccccccattatggatttaacaattttggggagtgaattagcaaattgtaaatttcagtgcattcgggaattaaaaaaacagatttttaacaatttttgcggcgctttcaaaaaattttggggaacgagggagggagtgggtccagcgatgccgacgtggccgggaaaaattttaaaaatttgagtgcaatttgttaacagatattgtcgaaaaattgtctaaattttgtgtttttaagccaatttttaagaaaataaaggttttttagggtcaggcggtgccgaaggcgccgccgaaaattttggctaattttttaacagatttttgtctaaaaaatcacctaattttgcgttaaactttaaaatttctag

SEQ ID NO: 23768 - DNA, 752 bp, Heterodera glycines
agattttgccaaattggacaatttaatggcactgtgctctccagtggcaattagcacgccaggtaatttgaaaaagttcaacaaaattcatcaaaaaattgcatttgagtgtaaaaggttccgattcccctgacttggccctgtgaaccgaccatttgagtacagaaaacagtcgccgtctgtgcccggccgcaaatggttccgttgtgttgtgcccattttgacaatgtccgcatgtgtaactgatcagtttgccattttttgaattttgttttgaaaaaagtcatcccactaaaagatagcttaaaaacacaggcccgtaaccaaagggggagggtgaattctattccaaagaaaaaccgaaagcttggtttttagcaatttcgtaaaatttctcaaaaaaatttcacgacgaaccatcggtaccaacaccaaattcccttatctcactcactttgtccaaaaatcataaaaagagtaaatgcttgtcagaaactgtagcaaatcgcagaaaaatcaaaaaaaaaaaaacacaaaagttcctggcccccgccgcttcttattgataagcgtttttctggttacgggcctaaaaggaaaaatttcggcgctacttgcaaagagggcctttttgaaattatcaaaaagcaaaaacaaaaggggggacccttttgtttgcaaaattttttaatatttaggcatgaaaaattattccctgaggatctttgagtccatgacctcgaaatagatgt

SEQ ID NO: 23769 - DNA, 881 bp, Heterodera glycines
acacgagaagttaaagttgcaccattgtgttgacttggctggcggtcagttgactcgcgagttgttccgtgtggaccgtcgctcgcttttgtctcggactgtcgtaaattcttaacttttccggttcgctttggtttctgcgcaccacatagcgagttcggaatcttcctctgttccgactcttcggttggccttctgacggagaggttggttgtatcgtttgcgtggttaccgggcttggaaccttgggcaccgcgacgattggctttggtggctcagcttttggagaagtcgttggccttggtggctgatacttctgcgccgtcgtcgtcgtttttggttttatcgctttttggatcggtgctgcctgttttggcgttggcaatttaaccggttgcagttgtgcctttcggctcggctgctccggttttgctgggccaactgttgggcgaggcgctgccggtttcggaacttccgtttttggagccgctgcgactgatttggggatgatggccttcgtttgattggcattttgcttcatcatttccaatctcatgttagtgtcggcgctgaattggtccaccggtagtagcgaccgtttttgagcgcctcccggtgactgtccttttttgggcactccgctgggaccatttgcattgttgatcatgttgaggaacatgccggcatctactgcgaatccctggtccgttgcaacaagtgtccggtcgcagtccttgattttttgcgcttttccgtcaaaggacagtgcgatttccttgtgcgtccacacgttctccgatgggtggaattggccatcccaggtgttcatgtgctcaaattggcactcggcatcagcgggcgttgaccaacccatcacagct

SEQ ID NO: 23770 - DNA, 813 bp, Heterodera glycines
  misc_feature (782)..(782): n is a, c, g, or t
  misc_feature (795)..(795): n is a, c, g, or t
aaatatttaagtttgtgagcggacaacgccattggacggaacaggagatgaaaaaattgcttgcttcaagccggaaggagcaattggaccaataggaatcaaattttttgcacgagtttagggcaactgaaacggtgaacgatggacgaaacgatcgcgatgaagccggcttatctgatgaatgatacagttttggatggagtcggtgatgacgacgaattgttcattttttgccccttttactctgaattgattttaattttttggaaaatgtgccaaataaattattaaaaaattctatttatccccctggcacataaatggagactggtagattatttttcaacctcctcagaaagggatatataattggagacgggcagattaatggagactggcatataaaaagagcaaatacggtaaataagcaatttgtttagtcggttttcgtttcttcattataaaatttaattattggcccagaaaacaaaaaagttaatttaataataaaaataaaaacaatgtaaacatttataatttaataatcgctgaacaatgtatttagttgcctaattagaaagaaaaatttcaaataaattcatttgcctaatttatagaattgaacaaagaaaaaaatacaaatgtatgaatgattgaatataccaaattagcacattaaaatgacttaaaaaaatgttatttttgatgtgatacgttatcacttataaattaaaaatagtaataatttaagtattttcttaataaattttattttagcttanatttaatttttanaaaaatgaaaatttatat

SEQ ID NO: 23771 - DNA, 2202 bp, Heterodera glycines
gacatttgcgcctttctggtgttcgtgctctgttttttacagttaccccatttaatttttgccgttttttgtcttcgtcgatatatacattattttgataaggcaactcagtcaaaacattctagtaaacggctgggattttgtcctctccaaaaattatttagaaaatgcgcgccgcaaaaagtgacgcagagaattaaattaaattttttgaaaaaaccacgaactcagagtaaagttatttcttcaataagaagcaagaaatattcgcataaattaattctaatctttcgtataacaatgctcacacttactttatttcattgacaaattggcaaaaaatagttacacgtttttgggttttatgaattactctgggagaaatacaaaagattaagagttaaaaaatcaactttcagggtattcaaaaaaacttctcccaatggaaaggtattccctatgttcatttgagccatatctattataattgcatatcatagattacaacttatcttggaaagcgcgattttttggatcgtggtgaaactgtcgacttaataggtaattgataagtcagttttttttttaatcgctattgtgttttagatggaatggttctaattgacgatgactatataaagtcaagcaaaaaagtgactgtccaactccttgcggcatttcgctatgggcgagaggatttggatgttttaggcttgactttccgcaaagatttaatctcgcaattatatcaggttaatcgcgtattttattacccacctccaattaaagcatttgactgtttaaggtttacccagcaacacaaaacgagtccctaaggccgatgacgcgactgcaggaaagactgaagaaaaaactcggtgaaaatgcctttcccttttggttcgaaatccctccgaattcggcgtcttctgtcactttgcaggttcagatttttctaaattttaaattataatttcctttttagccagcccaaggcgacacgggcaaaccttgcggagttgactatgaaattaaaacaatggtcggaggcgattcgacgcaagagaagcccaagaaacagtcagtttggaattcgaaaaaagtcagttaatcaactaaatttagcaactccgtccgtcttgccattcgaaaactcacttactgtcctcaattggagcgaatccaaccgatggttgacgtgaccaaaaattttatcatcagccccggtggccttcatctcgaagcgtcactcgacaaagaagtgatttgccacggaaactcctattttggctttaccttttttagatgtattaccacggcgaatcaattgcagtgaatgtgcacatccaaaataacagcaacaaaactgtgaagaaggcacgttcgtacttttgttttgacatgacaaaaaaaacattttacagataaaagttactgttcaacaaatggcagacatttgcattttcacaaccgctcggtatacttgcgatgtggataaaattgattcttggtaaatgaaatcaattatttattaaggggaagtagacatcaaattatttgagcatattcttaattggccagggttgtagtcaaaaaattttggaaaaaatgctaatgggatatattctcattttccggagcgttgcaataaaatggaatttattacttttattttcaaaattcattttgttgattctttttatcatttttgcatccgatttttattccagcgaaggttttcccgtcgggccgggttcaaccctgtcgaagatttactcattgtgcccacttcttttgaaaaacaaagacaaacgggggttggcattggacggccaattgaagcacgaagacaccaatttggcctcctccaccacttttgccgctttgagggtttgaattgaaattaaccctattggcctccaatttttattctcacaatcagcagtctgtccacgagaatctgggcataattgtgcaatacaaagtcaaaattcgccttctcatcgctggcgcattgggcggagaactgtcggccgaattgccattcactttgactcacccaaaaccaacggattcacctcatccaacggagaaaaaggcaaatgtcgccaattgccatgagcaacaaacaccgccaacgaatggggcacaacagagagaacagaaaggaaatttcgtggctgatgtcgatctcatccaatt

SEQ ID NO: 23772 - DNA, 993 bp, Heterodera glycines
aatttccaaagataaaaaatgcggtaaattaaatttttgggggctggggcgggatgcattaaaaggggctgatgggtcgactaagatttttcgattggatccgacggtaaaaagttgatcggaaatcaaattattaacggttcataaatttgactatttttttcttcaaaactacttttttgcggtgcaagaaatcggaaaattttcaaaaaatatacaatataataaaaaaatttctaaatattttaataggctaaattttttaattcttaaccaagtaaaaggtatttcacaaatgtttttagtatattcgcttgaaaaaattattcaattattttatcaaaatctttttttgtcatttttcattattttagaacatttttgggaaaaggagtgactatttacacgttttttacagcgcgatttttgcaaaaactttttgggaacttggaggagagtacgacggtgccgataggcgccgccgggaaatttttaaaaatttcagttcaatttattattagaaattgtacaaaacttacgtttttaaaaaaaaaatttaaaaatttacgacttttcatcaaaaatttcggaagtcggaattccgaccccaaaaatgtcggaaatcggaagtctttccgtgccatacctggtgcctatcgacatctgcgagaaattttatgaaatttaatgcgatttgttaacagattttgtctaaaattgaccaaatgacgcagtttttgactcaatttctacaggattattaagtaatccggcggtgccgataggcgccgccgggaaaatttcacaaattttgaatgaaatttgcgatgaaaaatgagttaactttaattaaatttatatttaatttatttaaaaatatttggcattctgtcttagaaaaattttcaaaaaaataataaaatcccgcataatcccgcacaaaaaatcaaatttgcggatcccgctgagggattggaactcaaaattctttgc

SEQ ID NO: 23773 - DNA, 2084 bp, Heterodera glycines
cgactttgcgacgcgatcggaaattaaataagccaacctttgagaaaggaaaaaataatcagtgtgtacaatttttatcattttatctatgaaaaaaaatcagaaaataactttaacgatgaaattttaatttatttacactttttaaaaatgatttttactttatttgagtttatttttatattttaatttatttttgacgtaatcttttacaaaattgtggtctttttttgtaagaatatatgttaacaaatcggggtcaaaaactgccggcatgaactttgcaaatgcagcacaaaaataatccagcgatgaaagaattgtcggttacagtaagacaatttcaaattaaatatttactctttattagatggtatatattttatttctcgagaatccaacccttatttgatcagaaagtcacaatgcctgatcaagatcgaatcgatatatcgatttgattttttggttttcaacggaaaagccgattggaccctttatccgcttgtccgatctctaattacctgatgatttatccggagactccatcgaagagtgataggcatcattctgctctgaactcgctgggtcatcgatcggaaaagtgaaattttcattgcccaaattggcacccttctccccaattttgcatttgcatccggtaaggttcaaaccagcaaaagcattagcgccacttaaatccgggcatttgtcactttccgaacattgccagcccatgtacacgtcatttggttctttaaaaaaaatattcgaaaaattttcaagaattttatgtccaaatttatacccttctgacaaccgtaggcaatgcaaaattccgttttcagcggaggacattccaagatttcaataatggcaccataattgctgtaatggcccactttgcattgcagcgctaaataatgcaataattaattgttttttttagtttataaatttatgaaaaattaaccggtggaatggaggccaaggcaaaaaacagcaaacaaagaaataaaaatgctcattttttcgactattatctaaatttaattgggttttttcaataatttgagaataattttcaaaaataaagtgtgaaaatggtgaaaataaaacgatttattgtacaagtgaataattttatcagcaaacagaatgtgtaatccaaacacttaacataccaaactgtttttggtgagaaatgattcattaaaaaataattcactgtttttaaattttggacatacgcgaccaatttaaaaaaaaaatttcgggattccaaaaaaaaaaaatacaacccttaaaaattgaacgaaaaaagaaaaatacacgccttaaaaaccgtaaaaaataattcactgtttttaaattttggacatatgcgaccaatttaaaaaaaaatttttgggattccaaaaaaagaaaaatacaacccttaaaaattgaacgaaaaaagaaaaatacacgccttaaaaaccgatttgagccgcccccaaagccaagggtctgactacgcccctgaaatatactgtatttcttttggaaatatgcagtcatttttgcttctcttgctgatgttttcttttcttttttttaaatctatgcttaactaaattagaaattattttcaacactaacaatattaaaagaattgaatcagtcattgaaacagtttaaaaaaagccaaccttgaaatcctatataataaagttgagtgtctgtatgtgtgtgtccagtgtttgaatttgtgtggcgttttgtttgttttttgcgttaaaaaatgatttgaaaagaaatgaaaagaaattgttttgaaaaagaagagaatataaagaaaagagacgaaaataaatagttaagatgaagaagaaggcaaaagaaatagcacagaaaaagaaggtaaaagatttctcctcctaggatgtagaggttagagggagggatggtgggaaatagtgcactgtatgactgtctgtctatgcgggcagcggcagatgggaggggcatacagtgaacagacgcgtgctgctgtgcagcagaaatgtgttggacgcgtgcgtgtgtgtgggagaaggagggag

SEQ ID NO: 23774 - DNA, 1103 bp, Heterodera glycines
tggcagcaaaatgttagggtaattaaaaagtgaaatagaagcagaataaatggagatggtaatagagagagtgtgtgcaaaatgaaaagggggagaggcgtagaaaaaacggcggaatatggcgggagcaaaaactcattttttaacgagaagaattcgaaaggatggggtcattatttctcagaaattatgtatgagaaaaagaccaacgaacgcagaaaaaatcgattttttatatacataaatagcccacaaaataaaactagttgagtgttgcaaaaaatggagggtggaaaagaaggggaaaaggggggggggagcgaagcgaacgccgtgggcatttggaggaacagtttttaatgtgcacgttcttttttaatggttgcacatatgtaatcgacccaacgttactactgtgtagtacataaatatatctacataggtatgtatttcattcaataattaatgggctgggaatttaagtcacgaaagtctcaaaaaagtcataaaaaacgccaaaaggagcatgcgaagacggagcaagtatttttaaccggtttaatcgcttctgatcaacttcccccacccctagatcgatttgtcttgttgagagctatcgattggtatcatatttgtcgggatccgtccacggaaaacatcgtataagtcaagagtgccaaaatggatggatttatacatatatttacggaaaagaaaatgtttgttttctgccggttgtgtactttaaaaatttgttgttaccctttgaatgggtgcggaagaataaaattgatttgttacgcctcacatcattttaatcataaaatggtaaaaaccaaatttttttggaaaacattaaaggttaattattaaataggtatgtatttagcaaaatatgtatgttttatttgttagcaaacagcagaaaaaagggaataaaaagcagagaccaatatgaattacataatttttatttatcttatgcacaaacaccggcggaaaaaaggaaaaaaagtcattgagagtgtcggaagtgattgatggcacaaagacacaaatggctgaatggcatacattgggccaaggagaaaatctgtcggggc

SEQ ID NO: 23775 - DNA, 2063 bp, Heterodera glycines
ttgttttcgtgtaaatttgaatagtgccaaaaatttatctaaaaaactggattaaccgtcggttaaaaggccctaaaatccacaaaaaatggtaccttatggaattccggacccgcaaaataggtatcccccattccccaacctcggcactcaaacaggcacaaatttttcagcattttccttaccggaaccccttcgtaatccgatggcggcacatagcgcaccttcttgagcatgacggcataagccgcgtcagcgtgccgcgcctctccccaatatttggaaccgtcattttttgtttttgatgttcaaatttgtctattttgtgacggcagaaattttgagattattgtttttgctgtcctccggcatcccgtttttaattgatctgtgaattgtaaatagcgatcaatacaaaacgtagaaagggcacgatcaatacaattggaaaagcatgcttgttcaatgtgttagtcaaattgaagggccgttgctggccatttttgggaaaatttgaaaagtggcgaaaaacagttcgccaaaatttttgaaaaatacacatctaataaaattacagcaagttttcgagttttttgatcagaaattcgaatgcctcacggcagcagggatatgtgtgttgccttcaaaaaataggcaatcgaaaacggtattccgacggctaacaataaaacatttgggcaaatttttaaaaaagaagctaataaaattttaaaaaaatcgccagaaccaagaagaatcatacggaaaacagaaagttttccggaaaaacacaagccaattcagaaattattttcctgataatacaaaccaaaacataaatagttgtccggaaaatcacaaaccaaatcaggaatttatttgcggaaaatttaaaaaaaaaacatttgagttttgtgtaaaacacaaataaaaatgttaaaaacaatctttggaaatataaatcagaaatgtgaattttgtttttgtttatacaaaaccaaaaacagcaaaatgtttccggaaaaactcacagcaaaaaagaaattttatccggaaagctcaaggcaaaacacaggattttatttagagcataaaacaaaatccaagaatagaaatgggtagtaagtttattttaaaaaaattatgagcccataattaatattaaatacgtaggggtttaaccagaataaaacttaatttatttgtttgacaataaatgaattgaaattatacagtgatcaatggaattttttgtttaaatttaaaaatatgtaagtaattttaatgccggcggtgccgtcaatatgcgaaaaatatgttttttattgcaaaaatggttgtttatgaatcaacttttaattaattacgaattgattgcaaaaatggggtgagctgtggaacattgggctcagtgtgaactgctcaaaaaagctgagaaagtttgccgccgtgggcctaattcaattcatttcagagggctattgataaagtaagtgtgcaagagtaatagagaagtgttgatggaattaatgacttttaaaaattcgtaaaagaacagtaaaaatttaatatttttttgtttaactttgtttgtctttttttgttaaattcttttttagaaattaaaaatgggtataaatttaattaaaatttataaattatgtatttatttagaaaatatggatgtacaaaaaagattaaaaatgcttgggttttaatcaaaccaaccaaatttgctcattaatattatcatgagttagttgggtaggtggaagttaaatgttttttttacagtaaataaattcaatttaattttgttaaatttaaatattaaaaaaaaaatttccttttgcattgtttgtttgacttaaaaatatgtaattttattaaaatacattaaattttgttgaacccgaaatcaatattatatggccaattggaagggggttctcagcgccgcgttttccattcgcattttgctgatgcaaaatggatttgtgatgcagcaacagagaagaaaagggtggtgaatcacaatgcaaaaggggcggggcgatgcagag

SEQ ID NO: 23776 - DNA, 2406 bp, Heterodera glycines
tttaaaactcggatgttttaaatttccttcccagttcagctaaaaaaggaggccacgggcgacccaaagcgacgccgcggggtgtggcagacaacgcttcggagtcgcggctgacggacgcattggacacggcgaatcggcacgcaaaagcagcggccaatgcaaagtatcaaactgttcaggtaaaatgggagcacaaaaaacatcaatgaaaaagggggtggcggaagtcagggatggacccaggattttggctcggtgagggcggcgtttccaaaaaaattatgacaagtggggcctggtaatgctgccaggcgccgccgtgggaaaaattcagaattttggcactattttttaacaatttgcagcaaaattacttttttttgtgtatttttgaaaatttagcaaattttcttggaaaattatgttagggaggtcggtcttggagctgggttcaaggtttttcattggttaagcctgccgctctgtccaaattaggccaaccataaatgcctgggttatggacagtaaaatccaggcggagaaagtaattgtctacaaaattgcatgagaatgtttacaggctcttcaactgcacaccaaactgatgaaggacgcggtggacagcgacgtgaagcaaaaagggggcgaaggaggcggcgattcggccaaatgggacgaagtgatggaaaagcgaaatgggaaaacaaaaaatggattttaaatggtgcccttttcaaggtgaaacgcgcaaaagcggaggcggaccgacgtgccaaattggacacggaaaaggaaggcacggcacgcgacgcaatcaaagaattggagaaagtcggtgttgaataatggggggggggggggttagttcatttgaaaaaatactcggcgaaaagtaaacaagacagcccctcccagcttaaatatacgaaatttattagaaaattgaaattttggtgaaactctttcaaaaatgtttcagaaaacgatatttgggttccgaaattaacagaatttttttttgaaggtattgtaatttttagaattttttatctagtatttttttgccaaaaatctaaaggacaacaatgtgaattttttctgaattcatggcgcatttattaatgctgattattttgctattttggattggaaaaaacttcaatttgtacccaacttttggcatgaaatttatgttcttgatttttttgcggcggtaaataacgcgtgcgaaaaatgaaatgcacccccaaaaatgggatttaatttttggaaaatggttgatgaacacactccacttgtttgcgacaaattttcaccacccttttcagctcattttgaccggctcacagaacagcgttggcgacgacgacggggaaatgcctctgttgctgaacgcccgcgagacggccaacaaattgtcgagtcgccttgacgagatgaacttgctgctgggccgagagcaggcgcagatgcgcattttcaccaactacaggcaaaatccaaaacgaatcaaaaaaattttgttttacaaatgcctatattttgaatatttcagcacctgggaaaacaggaattagtagctgttttctccaaaaaatttttttaccatttcgagaccaaatttcaaaaaaaaaaatatgagaaatgagggcttggaaatttttttggaaattttatggaaattttaatgtaatttgaaaagaatattgcttaaaacttattattattttttttaaacagacaataatacaaataaattcaagggacctcgtggagcagggcaggcagcaatgggcggaggagctcaactccattttcccgggcattgacttgcgcgccaaacagggccaactcagccacgaggagttggacgcgttcattgtccatggcacgttttttgtccctccttttacgactcatggcacaaaattattttgattttcttccctcattatcctatgaatttgactatttttagtaatttggctcaaaatgacaaaaaattggttatttttcagctaaaaacggctaaaaatttctaccttttctcctcggcgttgaaatttcgtttagactgaagagcaaaaaaaaattttatcttctggttcccccctcgcaatcagaaatgtttttctgatggtgggttgcaacaaacacactgccatgaatgaaaaaatatgggagagagttttgtgcgctgttaattgaagtcgctaattatagctaattggtcccttcattttcagcgaatatccgagttgaccagctcaagaggcaattggcggaacaccaagtcagtgttttgcaaaacaaacacacacacaaatttattcctttttaggccttggaggagcaacgagttttggaggcggtcgaagaacagcgaaagttggacgaaaggtc

SEQ ID NO: 23777 - DNA, 2292 bp, Heterodera glycines
cgaaaaagattttaaaaatgggctcaccgacacaattacctacctagtgtacattaaacttggccgtaaaggttggaaaacagtatcatcatatgttataataaagtccaaaaaataataataattagcagaaaacgctgacaatgagataatacaaccacgtaatgataatgggatatgaagggataaagcgtaagagaaaacatttgctaacaaaatgagaaacagaaaaaaaattaaaagatgattttatatttgtacataataaaagcgaagaaatcagtttaaattggaaaaatcaattcgagccccttaggcattgattgacgcgccatttgctcaattagcttttgttctcaaaatccaaattgtcgttcagagtgtcgaagctttcccagccttcgcctcatttgtcagccgactgctggtcaatgttgaagatgttccagccttttttggcctaaaaagccaaaaatatatgaaacacacaaaaaagaattaaaatgatggcatatgaaagcgaatgaaatttatccaaaattatctaaacataatgggaaaatcctaccggcgcagggaggggaaatgggcggagagacaatttggtgttcaaaacagagggcctttaagaaatagtcaaacatttttaaacaatttatattcgtctgcttggacatacggatgtgattgttgggttttgtccgttggatatccgttgtcgtccatcaaaatggcgtgccgtggcactcgagcagttccctggggaaaaacaatttcaaattttgatttaaaagttcaaaaaacagaggaaggcacctgcaacgcacgctgcgaggccaaaaaggactcagaacatttggggctgaccacgcccttgtcgatgagtgtgccagtcgggtatttcggtctgaaaacgcgggaccaacattttttttcattgaaatttgaatgtaatttttaaatccatgatttccatataatttttccattacccgtggctttatcgcattagctgattgatgttggatggtgtggatcggatgttccgcaatttgttgacgacagtcagtgtcagcttggctttgccaacggtgcgccaacaaatgcttgaccagcggcacttcgtaggccaaaagatgctgaaaataaaccatttgtttggggcttttcgaaaagcttttctttttggttatgggaaaaatattttaaaaatttcgaaaaattaaatttcgtttttaaaattccaatctaactgggcgaggaaaagagctgctccaacaataattacttggtaaagtccttcgccgcaagcgatgcggtagatgaccactgacgagctttaaataaatattttaaaataatttaaattatgtacatattttttattattaaacattatttaaactacatttaattcaaatttgccaagcgggcaatggcacacggtttggtcaatgaagtgcaatttttcgtcacgtggcttctaaattgttcttctcttctatttttgcggcacccccccccccccccccccaaaaataattaaaaaatgcgaaaaaaagccaaagccggccttctctaaatgtgtaaaaactcccgaaattatttaaatttgttatgtacatcaaaattttttcactctcaatattttcacaatttttgttaattttatgcatttttattaattaaaaataaacgttaaaatttatgaatagggatgggatttttaggggcgaaaaattccaatttagggacctaaataggtgcaaaaaattcgcgaaataggggcgaaaaagtttcaaatttaggggtgcaattttttaaattgctgttttctctatgtaaataagttaaaagctaaggcaaacaattttattcactgattgcagttagaaatgaagtaatttcgaaattttcggggtttaagggtcgattcttaggggtgcattttttgaaaatttttaggtcgattcttaggggtgcattttttgaaaatttttaggtcgattcttaggggtgtatttttcttttttattgcattcttcttaataatttccgaaaaatcgcgaaataagggcgaaaataaggacaaaacgccaaaataaggataaaaacttattttaggggcgaacactcaaaatagggatttttaggggcgaacatccaaaatagggattcctaggatcggataggggcgttaaaacgaaggtttttcgaacaaaaaatgtgtttttcgtgcatttctcgctgagttaaagccgcagaaaaaataagtaaaaacttaagaatccg

SEQ ID NO: 23778 - DNA, 1504 bp, Heterodera glycines
gagagtcagcaggggggcatcccgcgcaagcaggacatccaggtggagcattctgtcatccaaagcaccccttttgccctcagactgacattcgcatgaacaggggacggttccaattggtccgcaaacgcggccgttccgaagtgtggaatttgtttggccaagtggtcgacatgttgacgggccaacgactgccgtacgtcgcctgttacggtggggtgtcggacaatagtgatgtccgagagtctcggtctcgacttgagaaaagtcagtttctccaaatctcgagaactcggtctcgatcatcactatcgggcaggcgaacagagacactcacagacaatgggcaatttcagcgtgcaaagttttgtacacggacacgggcggtggaacggggaatatgacgcggcaccgctgctccatggggagtagctacaggtcggtgagaaggtgcggcgccggccataggctgtggaagttttcaaatgttaatttgctgtgaaggtcttcttcggacacgacggtgggcaacgagtcgatcgcctcttccgtcactcagtcgtcctcctctttcgagtcggtcggcggagtcgccggcacaggcaatggcattctcatgacaattccgcttcatcttttgctctttcttccagtagtaccgcatgggcccatctccccccaggacgacgcggccggtggaggccaatttggccacttccgtggcgaccagttttgccaccaaagtgtgccaaggacaccgaccgcaggcgcctcccgtgaggcatttgctcaatcaggcagcactggctttatgtcaggcggcacaacttcgagtatcttttgtcgcggttcaaaaccgctcagccggcttttgcttttcagacatatcaacgacaacttcggcttcgttcgactctccaggcaccgttcagcaataccaccaactccacctgaaccttggccctccccccatgctgatgatgagccgattcgccgccgccactgcctccggctccaccggtcagtcttttggccttccgtcgccgctaattgcgaaaagcttcccaactcagcccctcccattccgtcctgctctgccggtccttcgctgctcagtccgtttctgccccaccaccaacccccgccgactcagtcccagtctctgtccccgtccaccctcacctccccctcctcctcctccgtccccactcgcaccctttggcccgtcggcctcggctcgggccatcacttcactgcggcggacaaacagctgttcgttcaggcgatggttcagttttgtgcacaggacatgcacaactgtgaagtggtggaggtgaatgggcgaacattgccaagactcttttgcccttctcttcctttgcagggcgaaggcttcaaaaacttggtcgagactgtgctgttcatcggtcgccggtcgcacgagaacccatccgcgaacattttcgccaccatccgaaatttgatccccacagcccgacagtta

SEQ ID NO: 23779 - DNA, 948 bp, Heterodera glycines
ctcaagtgctacgtgagcgagccgggcgcgttggacagtgtgcgtttttttgttgtttgaatttggcattttgtttgttttgaattcttggcattttaggggtgcaaatttcggcaatttaagcatttttgtctaaaattattaaaaaatcagcacatttgcctaactttaagctaatgaggagtgtacattaaagaactgccactaaaattacggcattttatttttatcggaacaattttttgcattaagaaatggcatatttaaattttaaaatcacggttttggcatttttcagagtgccactgtggcaaaatttcggcaacgtatggccgaaggtcaagcgcccgcttcgcttacatctctttcttccgctccatcgtccgccaatgccgccgcgtcggcatcgtccgcttccgcttcatcctgctctgccaactcatcatccgcgcttttggcacgaatgccgtcgctgaaccgtcgtgccaccaccgcggtgatgcaacaggacgtacagcagcagaaactggggaatgatgttgttggcaacaccagcagcaggaaaaagaagtggggttgggaagccatttttttgtcggacaatttggcacattagggatgcgggaattgcttgtaaaaacgggttgttttggtccttaatccgggtcttgacgatctcggatcccgcgacaaaaatgagtttgaattcggatcaagggatgtcctacgtttccacccgtatcgtttctctccgaattttttttaaattgtaaacaaaaataatttctcccgaggttcgaacctgatttgaattcttgggtaaatcctacctaaaactgatccaacgtggaaatctcgcaaaatcccccacttgtttggcccctctgcttgatcagagatcgcccgatcagtttggtggagagtgcgctggcgggcgccggctcgcgt

SEQ ID NO: 23780 - DNA, 939 bp, Heterodera glycines
gtctcggtgccgaaacgggagggaaagaaacgacctctccccaacccaatagccttaattttttttagaaaattctaacaaaggaggggtcggcaagtgaccgccaatgccaccgccatttgagcattcaaaaaaagaagccaagacaaataatggcaatagaaaggacaaaaaaaggacaacagtaaaaggtcattctgttggggctacgcagctgatcaatggtcacaattctgtgcttatttgtttttgcctgaaaagattgtggaaaactttgattgaaaaattttgacaaaaatttctagaaatgctttttcttgcattttttaaataaattatatataatttatcgaaattattatttttgtttcggtgccgaaacgggagggaaagaaacgacgccgactcatgccaatagcctaaatttttttttagaaaattctaagtgtgatatatccacttttgctatgtcttttataatgggtataataatcaattttccactctatctacaatatttcatataaatgaaaatcctattaaaatctaatcgatgctttaactattttatataaatgaaaatcttaaaaaaatcggcgctttacgaattacaatttctaagaagcatggattttgtttatatgtgtaatataatgctattcataatgtagaatttataattataaattgatgacattgtataattaaagattatttttaaatgtttaaaataattttttcaaattaatattagagccggaattttgaaggtatccaaaaaatgaccaaatttggtatttttactttagggccaccgaaaaatgagtaaaaaaaggataaattagtcatgtttatcttccccctttttctgctaaatttctggatttgttcacaatggaaagccttggccatggctgcctgttactggatttcaattat

SEQ ID NO: 23781 - DNA, 1810 bp, Heterodera glycines
  misc_feature (1706)..(1706): n is a, c, g, or t
aaattttaaaaaaatatttaattaggtttaaaaaatagttctcctataaattttataatatttaaacagataaaaaatatttttaaaaccaatttacaatcctttaatttgttaatagcagaaaataatgtacattgttataatttaatattttccgattaatattttgtgtaaattaaaaaaaatcagaaaaataaattagaatattttcaggcgaatctggtgctggaaaaacggagaacacaaagaaggtgattgcctattttgcatctgttggtgccagccaacaagaagctgccggtggcgacgattccaagccaaagaatacggtcacattggaggatcaaattgtaccgtaataaatttttaaaatgaaaaaaaaattgaattgccaaggttcaaaccaaccccgtgttggaggcttttggcaatgccaaaacggtgcgtaacaacaattcgtcacgtttcggcaaattcatcagaattcattttaaccgtgccggacgggtggcttcgtgtgacattgaacattgtatgtcatgcaaatttttgtttaaataattattttattttttttaaattaaaatatttattcaaataaacaattattgattttcattttaaatgtatttttatttatttatttattaacgaaaaaattatatttttatagaaagtacatcaattgatttccaataaaatattttttccaatttagtttcctgaatgatttatttcattatatttttgtttaatttatttatacaaaaataaataaataaatttaattataatttattttataaaaagtacatcaattgattttcgaataatatttttttccgtttagtttcctgttgataaaccaaaataagtatattttacttgaaaacatttaaaaggaactcagttttttttccattaattatatcatataaattttaaaataattataaaaaaaaatattattattaattatttgtcgtggccgaaacggacttctatttttttggttccatcaaatttcataatttcattttttttcgattattcgagaaaatctgagagtgaaaatttcgaaatgacaaaaattttgagtgaaaatttcgaaatgacaaaaattttgccgatcaccagaacagaccaattcagatttgctcgagaaatcgcgtgtgattcgccaagctcccggcgaacgttgctaccacattttctaccaaattttctccgaccacaagccggaactgcggaagaagcttaagctgaccaagaatttgaaggactattattttgttgctcaagctgaactgaccatcgacggaataaatgataaggtgcaaatttcaacaattttaaattatttatgaaaaataaaatttaaaatttttattattttatttgaagttaagcgaaaattttgattttgatacaattttagtgctataattagggaagtgcattttttaggcaatgccttaaattcctgcgcacttaaatgttgaaataagcatgaaaaataagtttcatttgctttgaagcttttaagatgatttttaacgcatattatggataaaaaaacattttttttgcttaatgccctagcaccaatctgttcgagggatttatgccttttaaggaacctaatttgtgaattattgtcaatttattattaattaaaaatggtaatcaagttgattaaacttaancaaaaaataaactaaaatatatagaaaaataattaccaattttaataaacaatttttcccggggaagagagttcaagctcaccgatgaagcatttgatgtgctg

SEQ ID NO: 23782 - DNA, 1720 bp, Heterodera glycines
  misc_feature (53)..(53): n is a, c, g, or t
atggctcccgtgggatactactctcccagatatagggatagccaacgatgcantatggcgctgggcgagaaataaatttaaattacaaaaatcacaaaaaattaaatttctatgacagtattcatttttattgtctcctgtcgggtgttggtcgaaattgaaatgccgaacttgtctaattcattataactcgactcgagttacctatcaaaaaaatgttacaatttttagctttaattagcaatttgtttgttccttttaaggtgccaattagcgttcatttgttatatttatacacacggaaattcattatgattttggctaattttatcgcattatcaaaataaaattaggcgattgaaaacagaagaacttcccaccaattggttctattttagtaattcctgatacggtacgtacacaattattgacaagcatttttaacgattctcaaaatccccaaaaaacaattattcattctatcattaatgatcaatttggttaattccttttgtaccatgcaaataaatgcataatttatcatcattagggatcggattttgacttgaagcgaaaaaatcgccagcactttttctgtgtcaattcctctaaatcccctgctgttcctctataaacgtgtgctttaacatattttttgctcgcaagttaattcaagagtttcttaaatttaaataatttttaggtgttctaaaattcattgattgcccttgtcaaaatgatgatgctcaattttttgggcaatttcacaaatcgaaaaaaaaattcataaccctaattcatatggtgaacaaaacaatagaagcagatgaaaagctggagagcccatctgtgtgctgtgttcgattaacattaattggtatttgtgatgatgtgccatgaggggggatgccaaaatgtcaaacgtacattatttgatgaggcgaaatgttaaaatatattttacattaattaatggaccaatgattacacttttttaattttttgtttttaaactctccctccctccatatccattatcttatttgtaaatgatttcacacattttgtcatcagcaaattttttctcgttaaagaatttagttccctccttccgccctccggggctgtttcggcttttctcacgtcatatccatggaactcacaacattgtgacaaaaatcttccagaaaagccacacaaatatcgtgtgccggcattgccactctgcgccggagggtgcggcacgcaatccggcaaattccggcacattcaaaacaatatttaatgtgtctactcgtgctaatggccaaagtcaattttctaggaagcttatcttttctttcctaattatcatttaaaatattaataaatttagagacaaataatattaataggtggtttaaattagagtgcttgagtaccatagaaatactcaattttgattatttccccttgatacactgtagaaagcagtcatttttgccatgccaaattttgacccctttctctgtctcatcgtcggcgggtattcgccgacgaataaccattcaaaatgctattctgtacagaattagcgaattttgcgctctttctgataggcttactcattttttagagaaaaaatttccaaacctcctaggaccccgattgtcagtgttttgaggtgatcaggtcaccatgaaggagtagccggatcaagtagagcaaaagacttttttga

SEQ ID NO: 23783 - DNA, 1945 bp, Heterodera glycines
cgcccaccgccgcctcgtccaccaccgcggccattgccttttccaccaccgcgaccgccgccacgtcctcctccccgcttcgatcctgctccgtttcggccggttgcgcctccgccgccccgtccaacggtgcgtcgctcacatcccgcctgaccatttttcttcctgcgccacactcgcaaatggcaatagccgtcaaaagcagcaggaacacctataggccataaatgcttactatacattaacaaagagaaggaaaatgcaaaaatatcaattgacatttatctcgcccatctccgtgattttgcccagcgtgccgttgatgctgtccacgtcgagtgccattttgcgcaagttttgctgcacagtcgtttccaactccttgaaaaccatagcaaaattgatttttgaacatcaatttttgcctgcttcgagcgttccatggtgcgcaattgacgttccgtctcggacaactcgcgaccggtggcggcaatcagctgcttcaactgtttgacctgctccgccttgtcgccgatgctctcccgaattgtttccatttgaatgactttttcgctggcgttcgcccgtctgtctttgaactcgaccaactgagtgccaaaaagccaatttaatgtcagtcagtaatgccactttgcacctggttgctgagctgtacccggcgctttaatgttccgatgtgctccatggacaggtccaatttgtcgcccgcacgttccaacagtgtgttgtctttgccgacggtgccctcgtccccggcactgctggccaattctatcatgtccatgtgcagtgtgtttaggtccatcttgaaaagggaaacccgatttagacagggtcagtaaaacaaaaatccatatttaattttctttatcacaccccctttttgcatattttaatacaaaatgtataaacctgtttgacacaatgcgtttttgccgagtagacaatgaagaggacaaagtgaaaaaacataatcattctaatgctaaataaaaatttaattaattaaatgttaatatttttatatgccgaggaataaaccaatttaattgatttacaatccctcctctccctatggcacaagccacgtccccagcaagcgtccctccccaccgagtatcgacgcgaaaattcaaatttgaatttagcgccaaaaattgtaacaaaagtacaggggtcactactagcggaagagcgggattttgagaaatttgggggtttactggaatacaaaagccggcaccgagtccttgactttcaatagggaaccgggaattggaatcaacccgaaatttttacaaaaaaaaaaattaaattttaattgaattatttccaattgaaaatattatcaaattaaaattcgaatttaattatttttcaattttaagaaattttaatgataaaaataggaatttaacgaattttgtttattaattttgcacacaaattttttcgtctaattcaaaaggataaaaaagatttaaattaaaaaaatttaaattcgtgcatatttggccttttttgcatagctcaaagatttcagtgatatccgagacccaaattgtcccgaggtttgggaacaataacaaaaaacccaagaaaagctgtcctttacatttatttgaacaatgaaaaaataaatcaatgtttttttcctcagaaaagcaattatttgtccaaattgaaaaaaaaatatttttaaaacatttataaatgtcgatacaaatttaataatggttttatatgttttattaaataagttttttaattaaattcgtccataataagaattagaattcgacttggaaagcaatgttttattcagcgttcataattttgtcttaacttaagaaaattttttgctgaagaaaggattttgaatcatatgaaatttgagttgctctgaacagtttaattccagcgg

SEQ ID NO: 23784 - DNA, 1204 bp, Heterodera glycines
tctatttccaaaaattttgaaaaatttttctgaaaatgtcaccaatcgatagagctcaaaaaacgatgttttggaagtaaacttcgtttttccgagaaaaatctgtaaaaaataataaaattcgaaaacctcaaaagtgacgagggggcctagctcgaaaatttctgaaaattttagaaatttaaaaacaccattggatgcagcttttaaaactgttcaaaaagtttgctgacgacgaccagctcagcccaacccccagcgagttattcccgaaaatccaaaatccggttttttgcttttcaatttttagtcacgtgtaccgggaatacggtaggtcgtagagaaaaatgtttgctggccaacttgtagagcatacttcaacttaaaatcctcccagcaagcattttttgatcagaccaaagcccatcgtttcataggctcttaaaaaaacgaaaaagccatttcagcgccgctggcgctcagttggccaccggaccggaatgcccctatttttcccggatgcgccgtcaaaagttacccctgcctgcaaaatttcagctccccccgattagccgttcccgacatttttgtttttggaacgaaacgcactgttgttctatagtatataaactagcgagctgcacagagggggatgttgtgggcagtatactttggtatttaggaaggcgacgctgacatgagcgcttcgcgcaaaggacttcgttgctagtgcatgttcggcttcaaaattcaaaattttaataggcttatgttttttcaaaattttaaaggcgacatttgcagcttcgcggcctcagacgggcgcttttgcatccgtttcttaattttgttgggcttggacgggcgcttcgcacccgatttaaattttgttggggtcaaacgggcccttcgcgcccgttttttaatttgttgggaattttcggcagcttcgtggccttaggacgggcgcttcgcgcccgttttttaattttgtggtaatcattcggccgcttcgcggcctcaggacgggcgcttcacgcccgtttttaaattttgtgtgggatattcggccgcttcgcggcctcaggacgggcgcttcgcgcccgttttttaattttgtggtaatcattcggccgcttcgcggcctcaggacgggcgcttcacgcccgtttttaaattttgtgtgggatattcggccgcttcg

SEQ ID NO: 23785 - DNA, 1175 bp, Heterodera glycines
  misc_feature (1088)..(1089): n is a, c, g, or t
  misc_feature (1101)..(1101): n is a, c, g, or t
  misc_feature (1107)..(1107): n is a, c, g, or t
agaatttgtccaaagataagctcctttttgagctccttaatccaagcaattttttacccacgaggcggggaattttaagtgacattgcttcgttatttgacccattggggctctgcagcccgtgcctggtaaagtccaaaattttctttcagtcccttttggactcaggcaccgggtgggacggaccgatcggaaaagagaatgaacaaaaatggacagagattagctcggaatggtctggtacctcactgacattttcacggctaaccccgggcagccaatggaaactccaactgcacattttttctgatgcgggtcccaattcgtacgctgccgccgtgtatttgcgagccgaacgcaatggtcagacggaaacttcactacttttttctaaatcccggttgcgaccaaaaaagtttaaaaatgatgggctaaccatcccccggttggaattattggggttgctaatagcggtccgggccaaaaattttattactgccaattttaaccgttcttttgagaaaattattttttgggtggactcacaaatagttttatcatgggtggcaacccctgctcctcagccggttttcattgccaatcggcaatccgaaatcaggcaagaaaaagaggccttttttcggtatgtgcggtcttctgacaacccggcagatttgggtacaagaggagcatcatgtggggaactaaatggactccgtctttggcatacgggacctgagtggattaaagattcggaaagggaatggactaatgaattccgagaaatcgtccttccggcggaagggaacgacttggaaaagggagagccttctgtcaccttagccattgccgagcagtcctcgggcccctttttaaaccccgcccgttttcacagttggtctaaacttctgatcactacaacatttgtcctgtgttttttgagcaaaattctggggaaatccgagaaattcaaaagggcggtaccctttgttcttaaattagaaggattagaaccatcggccctccccgcaaggagtgtggccaaaaactggatcttacaaagggagcaaattaaattgagcccccgnnggatggcatttnatatgngactgacggactgattcgtctccggacgcgcatggcttacgcaagcaagccggaaagtttaaaaatcc

SEQ ID NO: 23786 - DNA, 1309 bp, Heterodera glycines
catccgtcgattttcctcctccgcccttttatgctctttattttcagcggcaatgacctcctccatatgcgcaatgacctcatggttttctttgatgggctcgtccattttctttttgtgttcttcgactgtaaaaagtgttaaaaaataaaaaaaatttcaaaattaaatttgttcaaaaaacaataaaaacatttccaaattaaaaactttgaatcatttatttcatagaaaataacttaaaaattttgactgagcattaattttatgacggattctgtctctttctctacctcttcaagttgtcctttagtgcctcaatccgttcgataaggctgtctttttccttttctgcgctcttcaaattgcgttgtgtctcttccgcgcgttggcgctgttcctccagccaatatttggcaacttccaactggcgctccaaatgcattttttccgtgtttaaattctgaaagttttattgggaaaatattgaaattttattgtaaatcatttaaatgaattttaaacatttttttagattaatctaatttaatttacgttgacttaaaaacaattaacaattaaataataatttttaatttggtctaaaataaaacagtttctttattagattttataaatttattgactgtcaatataaaatttaaatcatctttccataattagcaagaattctggaacagaattatatgaaaatttcaaaaatatggaaaatattttaaagttttggttttgtagaccattaaaaattttcagtgtatttatttttgctataaaaatgtttgaagaaatttaagtaaattttatgtttttcctaaaaaatctaatatttaatggatgtaaaattaagctaattttttaatataattaaacattttccctattttcgccatttaaaaccctgattgatcactcaccatccattcaaattccaatgcgctttcgctcgtccacgtccattccaagtcctcttccagctttttgtgctcttccaatttcttgggaaaattatttacggtatgtaaaaaggccgaaatttcttggacgaacattatggtattaaaatattttgtgccatttattgggagcccagttttatgcaacgctacttcacagcggtaaacacccaggagattttcgttaaaaaatcttgaaaagcataaaatactgaatttttaaaatttttttgaaaattaaactaaaaaatctattaattaatcaggaaaaaattaattgaattgcgccaattttccagcttaaagatcacctttttctcggcttcctgtttttc

SEQ ID NO: 23787 - DNA, 1169 bp, Heterodera glycines
aaaataaaaaaaaattaaaatatttctaaaatggaaaaacattttagaatcaaccaagaaatgccgattcattaaaaattattttaaaagagaaaaaacatttaaaaataaaaataaattatttgaaatatttttaatttcaaattttttttagcatcaatcaagaaatacgatgaactcattaaatggaacagcatcatcgtcaaaccgaatgcagcgcgaacaaacaggtcaaacaaatggtgatgctgctgcagtacctcgtgggcatccggctgcacaacggaacgctgcaaactcgtcctcattggacgccgctgctaatggacgacaagcgcagcagcatgccaacagcgcagcacaaagacccgacagaacaaaccgaccgcaacgcggtgaccaaacacgtcaaacaagcgctgcaaggccaacaagaccaattgtgcaaactgtgcaagggcaacctgctgaacgagatcaacaacggctgcagcgaaacaatgaaggcaccacagaagatgaagagaatgcactgcaggcaaaccgcgcgcagcttacattatctgacattgcagtaagcatgggttacggacaaatcgtgatttgacagattttagcttcacatatgtagattgaaaatagagctgctggacatttttttgaaaaaagcctaggtctagattctacgttggatctggacctggcttttcaggacaaaaatccagacttgccatggtctctggatccagccaggtgtggacctggatttttttgaaattttttaagggctaacaaaggtttaaaaaaatcaaaaatctgaacccaggaaaaatccaggccaggatccaggtccagttcgagttttgttagaatgagatgaaatttttacaggcaaaagcagtaaaaaaaggcttccagtatgtaaacgtcataattttttgatcatttaaaatttcttctaaaaaataaagcatgaaaatttttgagacgaaattttcaattggaaaaataattgtaaaattttgccgaattgtgcttaagccataataaaagttagcaatattttatcaaaaattttaaatgctttaactattcaaaatatatatcataaaagaaaaattttctaggcaggaaggcaaggaaaaatgcacaagtttatgcacaaataa

SEQ ID NO: 23788 - DNA, 1576 bp, Heterodera glycines
acacattattgtgtcacacgagagtcacagaacacaccactaatgtttatcaaaagcatgacacacattagtgtctcacacgaaagtcacagaacaaaccactaatgttgtatcaaaagcatgacacacattagtgtctcacacgaaagtcacagaacaaaccactaatgttttatcaaaagcatgacacacattagtgtctcacacgaaagtcacagaacaaaccactaatgttttatcaaaagcatgacacacattagtgtctcacacgaaagtcacagaacaaaccactaatgttttatcaaaaacataagacacattattgtgtcacactaaaatcacagaacaaacactattgttttatcaaagacataagacacattattgtgtcacactaaagtcacagaacaaaccactaatgttttatcaaaagcatgacacacattagtgtctcacacgaaagtcacagaacaaaccactaatgttttatcaaaagcatgacacacattagtgtctcacacgaaagtcacagaacaaaccactaatgttttatcaaaagcatgacacacattagtgtctcacacgaaagtcacagaacaaaccactaatgttttatcaaaagcatgacacacattagtgtctcacacgaaagtcacagaacaaaccactaatgttttatcaaaaacataagacacattattgtgtcacactaaattcatagaacaaacacaaatgttttatcagatatttggctatttggcaaatttaccacaactcttcccaacccacttacaaaaggggccgccaaagttgaagtagtgaatttctcgaaagtgagcaaaaagttgagtggccgaccgacaggttcaacacttcagagatgaaatcacaaccaattgtaagccaacagcatttcttcaatatgatggttctcatttctaaattttacataataattaacataacaaagcaaaatataattcgaaacaaattaatcccaataaactttgatgaggcacttaaactcaatctgggcaagctgttgaatgatggccacggcagatttcaaacttgtgaatgaattcacaacgaatacaaaaccatgagcgatcataaaactttagttcttcatgtcatatctaaattttataaacataattttgcataaaaaccaaacaaaacaaacttcaactaaaatcacacatcaaaagtattgggtaagacatggatggccgaccggccgttgatgaaaaaaaaatgccgaagcggcagagagaaagtcaatatatcaaacctgtagaaaattcaaattaagtaaacaattcatttttggctaaatcataaaaaatagacaaagactaaagcacaataatagactaactataagcatagacataaaatactatgcaaatgcattaattaatcagaacaaataaaaaacaaaaccaaacatttccattttttaaatcattttttaacgcaaaacaaaacaaaaacattttcattttcaaatcattttttaacgcaaaataataacaaaacgccacgccaaattcaagcaaggcggatacataca

SEQ ID NO: 23789 - DNA, 2001 bp, Heterodera glycines
ggttgattctggtgtcaaaaaagtgaaaccgatgccctaattaatgcacaattaattagtctaatttacgcgtacaatcaatgaccatcctcatttgtcagtttctttggccataactttttttgttcctcggacaataccgacattcttggtatcaaacgaaagtgtgaagtctcaggaaaaaagttatcacgaacttatttcattgagataagaaaaagaaaaactagtgcatatttttgtctcccatttttgatttggtgcttaaagtctaaatgaaataaggttcattaattctggcttgagaatcaatcatgttatgaaatataaaaaatttccataatttttttattttttttgtttcccataataatttatttgtaatttgcctttccatacacattatgtcggcgtgtgttcaattttctttccgctttttgtgttgcaaatgttgttagcttctcgcagtaaaagcaatttagcataaaaataaataaaaatgccataaatagtttgaaaatcatttctaataataaaaaagaaaattttattgttttatcatttaacgtaattgaatttttgcttgcaaattctctctgtcgaaaaatgaattgggtcattatttcccgggaacaaaaaaaaacttttgcgccgcccttttattaaaaaaacacaatgacctctttaatgacccagtggtaatttattatccttcgctaatttgtaagaaagtgttgaaacaggggaaacaattggtattacttacaaagttccccttttttaatttattaaaataccaggagggacccttttggtttgcaagaattttttgtgataataaattgtgaaaattgttaaagagaacattcagggtcgctaattacaaacctgaatcaatttttgactaattactaattacaaacaggaactcgaacaaaaatgcaattttttgtatcgaaaaaaacatccggtacactttttatgactaagattaagaataataacattggttagtgatcaaaaagtcaattgcaccaccatgatcgtatcactcctccagggtgatccgaaaaccaaaaaatggattgaaatcgggaaaactttgaaaaaatattatttttcaatgtacttacaaccgctaacctcaccactacagcctcctaaatagataaaaataaaataaaatttgaattttaaaatttaaataggcacgacctccgccaccgccgccacaattaatgataattgggccgccccacctctcccgccaccggatctcaaatcctcattttgaaataataaattcaaaatttggatttgtaaaatgtatttttttcgccaaattttgaaatattaaaaaaattttttaattttttattggcattagttttgttatctaattacatttttctgtgttctcatttttgttaattgtccccgttaatttcccttccagttaattttttaatagagattagttaattatgttcgtctgttctgctggtgttttaattgctttttgctgttttttcaattttttgattttgctaatggaattgtgaattatttgttgggtactaatttaaaaaatataattttataatgttatttaaatgtaattcataaaatgaaaataaatatttaagcttaatataattttatatttcaataaaattaatatatgaaaaggaaaagtttatttaataacagaactaagaaaagataatgcaaataacgaaaattataatgggaaaataatcatttataatgaacaataacatcctccaaaattacatctacgaaactgaagcaaatttctttttccactttcttagcgtttcatagccaattttcaattgctttgcaattattccatcgctaactttggatttctttctttgattaaaatattgcttcaacttttttaatttctcctcatcagaatgtcttttgcatgcttaaggaataataattgataaaaatctaattgtttcccttact

SEQ ID NO: 23790 - DNA, 1871 bp, Heterodera glycines
aaaattaatttaatatatttaaatgtaaaaaagcaaaatcaataaataaaccttcttaagagaaagaaaataataatgggcagagaaaataatacacatcatttgccaacaattttatcgaattccccccccccttattttaaaattaatttctttctctaaatattattcacattttacattttttcagcaatttattttttctaatttttattaatgaaaattttttttgttttgttttccgtcgtttgtttgggtttttccgtttgtgttggtcaaccgcatttattgcaagtcaaattggagccaagcctttatgaagaccagcattattatcaggtgattttattgatatatatccattttttaaaataatttccattttttaaaataattaaaaactaaattaaattttgagtggtaataaatggtcaaagcattttaagcaaatctcaaaactttctgtgcacttaaaaagaagagataagcacaaatattagataaagtttgaagcttctatagtgacttttgtaatgcatattgtgcctatttcgccttttttggtcctttcaggtttccagaaaacaaaaaaactcaactaagaagcgacctaaatttaaaaaaataaataaataaacgcctaaaagcagggttcccagatcaaaaatttcaaaagcctcattttgtgtcaaaaagcctcattttataaagtttattaaaacacgcttaaaattttcaaatgatttatttttgattgtccatgatcaatttgagcattttttttttgttagaaataagcatttttgggattctaagcatgaaaaacgaagttgatttttttgcggcgcttttttcaaaaaacttttggggaacaaggtgggccggcggtgccgataggcgccgccgggaaaaatttgtgatttttaatacgatttgttaacagatttgtcgacaaatatggccaaaaacattatgccaatttatcaaaattaatcaaaatttaaaaaatctgacgaattttccccaaaaatatttaaaatttctcaaaaaaccacaaaagcctcaaagcctcattttgaaaatttagcctcattgacctatcaaaaaacacaaaatgaggctaaagcctcagatctgggaaccctgcctaaaagggatatttttcatgtacaaaattctctgatttttatttctttgaaataattaataaattctggatatatttcatctacatttgaaaaattgaaatatatgtcaaaaatagcaaaaattatttattttcaaaattattttatgtacccaaaaagaatttttagtcgatatcatcaaaaaactgagaacgctttttcttaagagcttagtttgcttattaataaataattttgctagaaatttaatttcattgttttcgtaatataatctcattacaaattgcttttgaaaataaaaaataaaatcatattcgttaattaattagtgatccaattaataaccactctaaaagatcactgcaacttgcatcacaaatggcaccgtgccatccctaacaaaaaccagcgatgaatttgagttgcagaacaatgcttacagcactgttcagctgaaactatttaacaattattgcatgtcgctcaaataccaaataagtgtcacaatggtacacagaaaagaccattttctgaagatttgggtaagcaaaattggaattgggtaatttaataccaaatttcgggatgaggatttgtttctgcattattcttatctcaatgcttatttttgctctaaattttcatccttaaactgtaaaatgtgtaaaattttgttatgtaagaaaaagcattaagtgaaccttttttgacacatttactata

SEQ ID NO: 23791 - DNA, 1048 bp, Heterodera glycines
caatagtaaaaatactcacccaaaacaccaccactactgccaccgcaacatccgagaagccagctgaacaaaatttagcagttaaagataatagtattgctgataaaggtgacgcgggtacgccggcatcaagtggattagaacagtccgatgatgctgctacatcaacgactcgagttgaagacggtggaaatttacctgaagcagccgcgttgacctccaataacccaaaaattgttgctaagcaatcaacggtagcgacagagagaaggaaggagaaaataattgaaaagctgatcgacgaacaagtggacagaatggttgatggaacacatgcacagcagaagatgctacaggaagaaggtaaagatagcgagaatcaacaccgcatttcaacatataaactcatcgaagaagtgcttcatggagagcatggacaattaatggcacaacaacgtcaatccaaaatggctgctgaatttgtttacaatgaaataactcagcgattcggcattcgaatgggcccaggagtaatgcacgttgatttgagcaaacagctgtcctatgtgttgggttttgatcacaaaacacgcatttacaaaaatcagtcggcaaaatatccacctgatctgtctggtggtgtccgtcagctgtacgtttacgcgcctaaactggtggaggactccatcataggtgaccgcatggcaccgctgctgcgagttgtcaacgtgtcaggaacaccggggttggacatgccagaggttatatataccaatgaaatttttcattctctccaaaataaacgcatttctgaaattaacattgaaattcagacagcatttggacgttacgtaaaatttggttggggaactaccgtaatcacattacattttagacaaaaactattctagaaaaaaaaaacagttatgacgcatgttgtttttaacccggacaatgtcaattggtccgcgtttcttgtgttacagcagcagcaggagggaagtggtgagctgcagtattttgtaggcagtaaatttcagcgtggtgg

SEQ ID NO: 23792 - DNA, 1353 bp, Heterodera glycines
acgagacgaaaagccgcttattagcgggtgatccgagtgcgtgcgttggcacttcttgaatttccccccccatcattctgattattttcgggagttgccaaaagttctccggactccaatcaacagcagaattgatcactgatcccaactagggttttaccgttagagtgcacaatgtgagaccgaccagaatgaacagaatccaaccgccgtaatgattggcggagtcgccgccttcggcaatgtttgacgggggacaaaagtcgccgaatccgatggtcacctgaaattgggggaaggggggggggaattacaattgatgattgggcaggtgggaaaagctaaaagtgaaccaaagtgatcagggtaaagtacagcgaatcgagcagattccacccatgctgaaggcgagtgaaaagcacagccattgagagcatgtaaaagagcagcagcgacaaaacgaacatctgaggacggaaacggtagcgaaaatacggtaatgggggggatacggtagaggaaggccttacgcggcgcaattttcattaaacccacgctcattggcacaaagagtttgggaatgacatcccagtgtgccaaagtgggctgcattccgggagtcttttctcgagccaaagcaactcgagcaccgtatacgaaaaactataacagtcagccccataaattacggcacttttgtgtacggccccggcactctcagaaactgctcgccctcctcgtgctgttccctccggcgtttttgcctctccattcgccgttctctttcctcgtcggtttgctccttcttgaacaccgtttcaaggccatcctccaaccattcgccactccacaaaattatgtcctgagaattgagttttttgtttccctataaaaattctgaaaattaataatttaatggcaccgcaaaaaatttggcgacgtcggcgatggtaattaaagtcaacggaatgccaaagagagcgtagaaaatgcagaagagacggccgaacggagagatgggaactgggaatgagagaatgttcagcagcagatcgccaaagacattcattccaatggcacttttatttttattttttttaatttacccaaatttccgtaaccaatcgaagtgagcaaagtcgtggtgaaaaatctgacggggaaaaataaaattaatgggaaaagcgcgaataaaacgcacaacgaagaatggaagttccatttggacttgtgctggtggtgatcagaagactgatggtggtgaaatttggcaaaagtttggagattaaatgcgcaacccaacccaatggccaagtggcggcgacccatcgacagacggaagtgccaaattct

SEQ ID NO: 23793 - DNA, 1614 bp, Heterodera glycines
  misc_feature (12)..(12): n is a, c, g, or t
gggaccttttcngggtgaaaaaccgggaatttttggctgggaaaaccgggactagtctcggccctggtcaaaaccgggacataggtactcagttgtcccgttttttcagtaccaggtcccgttcccgctctactctaatttgaatcatcatccaatgaatttgtgtgcaaccaattgggcattttcattttacagttcatctacatacaattgtggtcagggttggacctttttgtcagaaatttggatcagaattgagaaagatgaattaatttaataattttattgactaaacttttttttttataaatcttggaaatttaagcaaaaaataaaaaaacgataataaaatgcatattgatgataatatattttatacatatatcaagcctaactaattactaattttcttttcaatttttaaattaactagaaaaataacaagttaaacccttaattaaatagaaaaaataattttctatttaattaagaaaaaaaaattatactttaattgaaactaaaaatccattttttacttttaattaaattgaaaataattttataccgacctcctcaaaaactttggaaatcgcaattccgacgtctcaaaaaaattcgacattcggaaatcggcatgccacatatctctgatatgggtggaacagattgtgatctcttaattccaacaaatacaatataatttgcttggaaggtttaaaaaagctaaataataattaaaattattgtttgagttaatgactattaattgctctccttatgctaattttcactaattactcttgagcaactttcttcagctgccccctgaattgaatttttgcaacacattgccaaactgttgcagcccaattatgccctcaattactgtcctcctgttaataatggtcatcaaattactgttgttgttgttgttgttgcacaatccccgcggcacgtggtgccaaaattttgagaaaagtcgcagcgtttgggtggagcaggggcttgtgaagggcaaaattttcaaaattgacggacgccaagtgcaaatttttcgtggcataccgtaagccgagggggggtcctaccctaccattttttaaagaaattttcccattcatgtgtgacagatacacggagcctccggttggaacaattctctctcaatatgaatatctttaaagttgattgagatatatgagaaagaaaataataaatatatataattaattaataagtataattacatatttgattgaatcgtttaaaatgaaatattttttatttttttgaaatttcacaaataaagcaaaaataaaattggaaaataattcatatattctatttttatttgttttttaagcattttttaaatagagaaataaatcttttattttattacataaaatgaattatctaaataaataattataataaattcacaaataataccaatatttattttaaaaaaatttttattttaaaatgaataaatatatatttgactgaattattttaaaatttaaaatttttttaaatgcctaaattttgccaaaaataaaaataaaaattatgaaaattaatttatttatctttaatttttgtaaaaacatt

SEQ ID NO: 23794 - DNA, 916 bp, Heterodera glycines
  misc_feature (897)..(897): n is a, c, g, or t
cttttgatggcttctgatcgatgtgccgtggcactcaccttctggcttggcaatggtgtgaatgtgcagcccagctactacaacagtggcaaagtgtcgcttggcctttcccagttgaaaacgttggcaccgaaagttaaaactgtgcgcattgaggtggagccgttcattcccatttcgttggccaagcaatggatcagtgaggcggccaaaaacggcttttccatcattgtcacttatcataaggcgacagtgttgggctccaacgatgcaagtaagcagaaaaaatgccaaaagcatggaaaatgtccaagaaaatgccgaaaatgatatcgcgggtcgaaaattggatttttcagaaatctcgacctcgcttttgaattgttcggtcatttattagcaagacaaaaacaaaacaaaaagttaaattaaaatttttttaatttagttagattattttttaaatttttaaaattaaaataaaataaaatgaatttttaataaatcatatataaatatttaacctaaaaatcttaaaaataaattattatattatttattattattttaagatgagttgcagcaagccgctaattggtggaagactaattataaatcattagcgcagtccggcaaatttgtgctcaatctgatgaacgagtggggtgaccacacgatcacatcaagtgcctacgcaatcgcggttaacaacgcgttgaaaattgtgcgacaagtgtacagcggaacggtgatcattgacgcgcccggttgagggcaagaagcgcagaccgtcaaaaatgccattttgggtgtgtagtttgaaaccggggatggaatttggtttagaacgggacaagatccatagaatacggaagctaatttaaaaaaataacccanattatggcttttaaaaatt

SEQ ID NO: 23795 - DNA, 1058 bp, Heterodera glycines
tttccatttgaatgcattggcgttttgtttataacgccaattattttttggcgttttatttccttttttacagtccatggtcgggaaccacaatcgaaatcacctggtccattttttttacttttaaatccgaagtcgaacttttcgtaaaattatgtcttttttgcctatatgaattcgccaaccaatttcaataattttcattcaactactaaatgtgttccgcttgaaaatggctctgatagagagaaggattcgaccagtaacaacaatcacaagagaaggaaggataatgttaaaagtgagttgatagacaacgccatcggaagtccgaaatcgaacaaacgggcatttttttctgctgattgtgcactgaacccaacggcattggctgaaatgatgccgagttcgagattaaggtttaaagaaattactaaatgactgcttacccctgataacttccttcaaaaaatgtttaaaatcagaaaaaggcatttgcaataatttcagcatgggaatggccggccgtttgcgtgacatcgtggcgattttccctcaaaatgatttggcttctcctggaaaactgctctttcgggaacaaatgacaaattcggaccaaagggtattttctgccaagggacaagcggatgttccggggatgaacgccaaggaaataagctttgtcgggcgggaagaggcggcgggcgaaggattcgagtacattttggcaattgtggacagacggacgggccgagcgtcggaaatcaaacgaaccgcactgatcaacttccaactgagcaaagaacgcggtgtgtccgataaagaaaagtgggtttttaataggttatgcttgcttttttaaaaattacgaaagattaggagcacaaaaaacgtggattattccgctgattttactttgtcactcgagaaaaaacaagaggacagaaagcgactgacgctcgattttggaagtgtaaaaaagaacaaaatgctcgacgcgcgaattcggcgaagtacgcaaatgtgggggattcgttttgctggtgatttgttttatt

SEQ ID NO: 23796 - DNA, 199 bp, Heterodera glycines
tggagggggaagagaatggagggggaagagaattctttgggacgagaatggagggggaagagaatggagggggacgagaatggagggggaagagaatggagggggaagagaatggagggggaagagaatggagggggaagagaatggagggggaagagaatggagggggaagagaatggagggggaagagaatggaggg

SEQ ID NO: 23797 - DNA, 2080 bp, Heterodera glycines
  misc_feature (1886)..(1886): n is a, c, g, or t
cttgcagcgtggaacagcaagttgtccagtgtgcggaccacatcggaccgttgccttttgccaacgaccgttcaatggcacggctgtcgacaacaaagttgtaactgacaaaccaatggaagcgtttgtcggttggctggtcttccaactaccgttgaaatacgatacatatgcgtacagtcattatggtggacggtttgacatggtcatcacatttcgtgagctttttcgcagaggatttaatccggaaatgcttcgaaaggtaattattctttctttgccacaaatcttttactctctcttatcttttgtacatggttttctctgctttttattctcctctctttctctctgttagcactacactattcgtgtacatcatctcctcttcagtatatacactatttccattttccacgacttttccattttctctgctctcttgcttacagtaatttgtcattgctcacctcactatacagcgctccgccactcttttttatattaaaaaaatgaattattcacagggtaacaaaatgtacgagatgaagattggagcacagaagaagcggaacccaaacatcattttccgtgactccttcaacctgatgccatgtgcgctcggtcagctggtccccgcctacggcttggacgttgaggagaagccattcttcccgcacatggccaatcgtcccgacaactacggacgacagatcttcccgactcccgaggactacctggctcaggggatgatgccagagaaacgacgtcagttcgacaactggtacgaacaacatcggagtgaaccgtttttgctggacgaggctttggcgagctactgcacaaacgacgtggaaatattaatggcagcgttggtggcgtttcggagcgaattcttcagtattacgaggcgggaatgctacgtcgtcggagttgacgaccgagaaaatcatggtggtattgacgtcctaaagcagtgcatgaccatcgccagtgcctgcatgaaacatttccgcaccaatcaccttccggaaaatcacctggccattgtacctgagcgggggtacgacaacgcacaaaatcagtcactgctcgccctccgcttcttcaagtggtatgaggagaagcacaaccttaaactacagacagcacactcggctggcggagaaaagagggtggccaactactcccttgatgcgtgggttgaagcggagaagagagccatagaagtgaacggtaatttcaactccaaaattatttgaatgaaccgaaaaaattgaaggatgcgtttggcatggatgcagcaagtgttttccggaggacaacatgctgttgcccaatgggaagtcggccggtgaagtgcgggagcgggatggaaagcggctggaatttcttcggaagcaacttgggcgtgtggacgtctattgggagtgtgagattgagcgaatgctggcagaggatgaggagatgcggcgtgcttttgcaagctatgtggatgatggaccactggacatccgttccgctttcatgggcggacgcactggcccgctcaagctttttcataaagcgcaagaaggggagagaatttcatatttcgacttcacgtcactctaccccttcataaagtgattttgtcttaaatttttaattttttggcaaattaattgatttagttttaccacgagctacccgatcggtcaccccaaagtgcacgtgtcgaatgaagaagttgaatggaagtgtgcgaccgacaacccctttgacttgtcaattctcaaagtgtgggtggttcctccgcgccgctgtgatgtgccggtgttacccgtcaaagtcaacgaccgactttgtttcccgttatgcctcaaatgcgccaaagactacccganctggtggggttgacgacacctacaattgccgacactccgaccaacaacgcggctgggtcagcacgtgcacgtcactggagctgaacgctgcgctggacgaagggtaccgcgtcaccaaagtgtttcgtgtggtgcagtacgagaagagcgatgaccagttgttccgttcatacatctcccgagtcatggcgcac

SEQ ID NO: 23798 - DNA, 1516 bp, Heterodera glycines
tttttccaacattttgtttatgaaatttatgtcagttcaatatcttttttcttttaaataaaaaacaaaaaaaaaaaggaataacaagatttttgggtatggattaaaaacatgaaattttaatggaaaagcaactcatgaatctgtggtaaattttacagtaaatggaatgcgcccgttttgtcttcaaaaccgtgccacaaaacgcaattcacacacctgtttgccaacacgaattgtgccgacggacacacgcacgttcagtgccatgcgttgaccaccgccgtcgttggccgcgctgtccaccgtcggtgccgtcgttgtccaccaccaattgaacagcgaatggacgcgcaactcgcgcacctccaagtgcagtccgttggccagcaacagctcgccatggcgcaacgcgaaccagccgagcccgtaaatgtgcgcggcgcgcgcgtgtaacagtcgctgcaacaccgccgccacaagacgcccggaatatctgacaaagaggaggggatttggagggattttgccgggacttccggtccaggtcccgttttttcaacaaacgacgggatcccgtcccggtccattttctaagtcccgctccaggtccaggccatttgggccgggattaacgggactaaatttgaccagtaaaactgggtccacctcgtttgggcgccagcccagtttttggactataacttttttctttgtcaaccaaatctaacattgttggtatcattcgaaagccctaaggtgttctctattagcttgcaaaatttcgaaaaatctcgttaaggttcaaaaaagttatggccagaagaattcatacaatcagattttccaacttttttggctcgaacttttttttaaaacttaacgaaattttttgaaaatttgcaggctaatagagcatctgaagggttctcgaatgatatcaacactgttggatttggttgacaaaaaaaaagttatagccaaaaacttgggtccgtacgaaaacgaccccgacccgtgggtttttactagagaccgagatttccaaaagtgccggaccggaccggtctgatattttcagaagcaaccggtttccgggcccggcctctcaaaaaccggtcaaccggaaaaccggtgaaaccggattttcaaattgccgggcccggaaccggtttccggtttggtaaaaatttaaattttcacatgtatttcacccaaaattaccataaatcgtgccagatgtaaaatttcggctctatttcactttagtcgtcaataaatgacctcttcaataataaaatttcaaaaaaataaaaaaattttaaagaattttttgaaaaattttttgtaaagtgcattagtaccggaaaacctagtaagtaattctccataaaaagaaaaaaaatttctttcttagatatttgtggaaaattttttaagattttgaaatttctgtttggaaataaaaaaaatttgcgattttgagcaaatttttcaagaaaattacggattttta

SEQ ID NO: 23799 - DNA, 1514 bp, Heterodera glycines
  misc_feature (27)..(27): n is a, c, g, or t
ttattcgcctggtactgaagtgtacancttttggggtaaaaaaaattagccaaggctacagccttgggcgcccaacgtagggcttaggttttgctggcaaagttgtcggggatagtctgacttaaaatcctaccagcaagagctaagcgatcccggtccaaagaaaaaatttcgtagaagaaaaactgccagcccgagtgacaaatcgcttctcgggactcagtcgtccgcgctgaatttttttctatagttttcccggattctcctcaaaaagttgtaagacccttccaccactttcagggcgctcccggccttcggccgggagattttgttttttgaaacgaaagtccttgtcaatataacgtatatactagcgggtgcgtgaaccgtcggctatttagaagggaaaaagcgcttcgcgctttgggagcttcgctacctaggctgtgaagcgattcaaattgatcgaattggttggagatttttttttgaatttttaaaaaactatcgggttgtgaaaagatttggaatttttaaaaattagcgatttttaggccgcttcgcgtcctcgaacgggcacttcgcgcccgtttctaatttttgttgtgcttttcggccgcttcgcgccgttttttaaattgtgctgagtcggacgggcgcttcgcgcccgttattaaattttgatggactcagacgggcgcttcgcgcccttttttgtggcctttttaggccgatttgcggcctcgaacgggcgcttcgcgcccgtttcagatttttgttgtgcttttcggccgcttcgcggccgttattaaattttgatcgactcagacgggcgcttcacgcccgtttctaatttttgttgttcttttcggccgcttcgcgccgttttttaaattgtgctgagtcggacgggcgcttcgcgcccgttattaaatttagatggactcagacgggcgcttcgcgcccttttttgtggcctttttaggccgatttgcggcctcgaacggccgcttcgcgccgttttttaaattttagaacagatacaaaagtgattagaagaggtacaaaagcgattagaagaggtacaaaagtgaagattagaagtggtacaaaaggattagaagaggttcaacagtgatcagaagaggtacaacagtgattagaagaggtacaacagtgattaaaagacgtcaaaagtgattaaaagaggtacaaaagtgaattaaaaaaggtgcaacagtgattagaagaggtgcaacagtgattagaagaggttcaacagtgattagaagaggtacaaaagtgatttaataaatttttaaaaataaaataaatttccttttattaattaaaaagagtgtttgaaaagtacaaggattgaatatttatttaaattgaaattaatattacaaattctaatttaaaaatacaggagttctttaataaaagtaaataaattattattttaatttaaaagatttttcacaaaaaaataatttaatttaaattaaaat

SEQ ID NO: 23800 - DNA, 2545 bp, Heterodera glycines
aacatcattagactcaaatatacataaaaatttgaattataaaacaatcggagctgatattaaaatgaaacgacactcttggctgacaaacggagaagtcaactcaaacagctgatggaaaataaaccacagaaagtgatcatagaaggaaaccagggctctacaataccaaacgttgctccatatatgggaattcataaaataccaaaaatagaaacagccgtagaacaagagaataagcgttcagctgaataatatgtggtgctttctgattctacgcaaccaaccgtgttttggcgtctgccacattgactcgctgcgctgcccacttttttattttagtttcagaacaatttatccttaaaataaaagcagtattttaaggtgttgaaaggtttactcacttttccacaatatcctcaatgctatcttcgaagaaattaattgcatcatcgctgtcttcagaaagttcttcttgcatttttgaatatttctccttcaactgatcaagttttgcagacctgagttatcgtcacgtgatttttttaacagatgcagtcctcttcattgatgcaacagttgtttagcactccaatagtctgataattttttgtgtctgtatgggacctatatttatgtataaataatgtataacaaccatccataggtacaccgattgaacggggatacatatatgtatatgggcggacaacaagatttccttaacgtgatttccctcaaaatttttaagattctctacatattaaccagtattttaaataaattggattttttctgtttaaaaaaaaattttattatgattccaatcaattattgctgagctcagcaatccattcagttttttctctggccactttggtgacatctgcaagcactcgtcattcaatcgtatggatgtcgtcagcatcttcaccaatagcacgctcgacttgattgtttttggttcgctttttaggcggctcgcttgaagatgcctcttcctcaactccatcatcgttgtttttgtcatccaaaaccttcaccgccaccggtttttccacagatatggatgaaataatccaatcaagcatcgccgtatcattattttccttaaaatatgcgtgttttagctgaaataatttttgcatggaacacaatggactagctaaggtgggataaacacctagcaaaaaaaaaacatgaacccaccttgatgttgactttgacgagcaagggttgatctatttttgactgcaaaatcgattccaacttattgggtgcgttctctgacaggttgtaaaaagcttccacgctggcaatgctcaaaaagttgatggctgcataggaaaatgctgttgtttcctgctcgcattcctcgtcatcacaatcttggagtacaacacggaggtacaaattgcggctgggctttttcgcacggtggacgcacgaaacacaaaagtcttcactgtcgagtttcttacgacatggaatacccttacttctcattgggcaggactaaattggaagcataatgatgtaagagttatattggcggggagatggaaagctgtggaggggaggagaatatgctgagtggagtgaagatgagatagtgtgatagagagaaaagagagacggagggggggggggggtaatgctcgtcgctcattatataaaaaaaatgctggcccatcgattgtgatgaccaccgaacgagtcgttggtcatctccccaaccccattttatttatatatattttgttgttcattttttttattgtaataatattttttttccaatttagcaaaaaaaaatgaatcaagccgtgtacaacagaattgtgtcactcccgtggaggcagctccaaatgttggcaaaaagtcgtggaatcgccgccaatcaaaaggtgggttttatttgaaaagggtgggaaaatcagtttttacactgctgacataaattttcatcgcctttggcaaaattaatcagccgaatttgatgatttagggggggggtaaattttgaaaaattgtggttgtgcgataggggctttgaaaatttgataaattttcaaaatttaaatttttgggggggggcttgagtttgctttgttttttaccaaaattaaacaaaacatttttttttgctttagaaacagattctcatcaaaaaattgactgcaaacttcagcggcacaaatcaacaacacaacaccaacacaaatggacaaaacgatgatggggacggcactgacaatgagcaaagtttcggcgacggcacaaatggacaaagcgatgatggggacggaactgacaatgagcaaaattttggcggcggcggcggcacaaatggacaaagcgatgatggggacggcactgacgatgagcaaagttttggcggcggcggcggtgacaacaatgttgaggaggagcaggaggggggcagcaacaacaacagtcaactgagtttacccgacgggtaataattaaaaaatatatttagaaatgaaaaaaattcttttgaaattaaattttaaattctttg

SEQ ID NO: 23801 - DNA, 2005 bp, Heterodera glycines
  misc_feature (26)..(26): n is a, c, g, or t
tttggatttcatttttttaatctctntgttttatacaataaatttttcaaaataaaattgcatgcaatgtttaaatatatttttatttgaatttagtaaatatatatatatatatttattttatattattaacagggattctttttttatgtaagaaaaatcgcgaaatatgtaaataaaatatgtataaaaaatgctaaaatatgtatgaaatatgtacaaaaaccccaaaatatgtactaaaacatgtaaataaaaattttttaaaggttattttttggaaaaaaaattcttcgtaaaaagtgaaacagaggcataaaatgccataaacatgaccaaaataggcttagaatcaccttttaatatatcaacaattaatttttgatatatcattttttgaaaaaaaaattcgattttttagggatacattttcacaaaaaatttctgtaaattctcaaaaatcctcaaattatgtaaaaaaaaatgaaaatatgtacgaaaaagtccaaaatatgtataaaaatatgtacatatgtaataagtagaaaaatcccaaatatgtaaataaaagtcccaacttttgttcgcaaacacaaaaaaaaaagttttttttctactaattaggctatggagaatccaggaaaaaatatgtattcacataaaaaaagaatccctgattattaaacattctctgtaattctttttgttttattttgctaaataaaatggttaacgtgaagaagggcaccgtcattcgttgtgacccggcaatgcgacagttcctgaagcatttggacgagacacgggctctgggcaggccgttcatcgtcaaggtggttgagagatcgtttttcgtgaaatatttcattctccattttattaaaattttcccattttaatttttttttttttttttgaggcttaattgtattgtaggtgttcaatccagtttctttagccatcaattttttcttcataaaggcccacatttgtaccaagcaaaagctttgtctaaaaatttttttctttaattcaattctgagccattcttgaaaagctttcgttcggttgataccaagaaagctgtcattgaccaaataagaaaaaattggaggcctaaaagtcgaattttgaaaaagggtttgagtttttgtcattttttaatttatcccgttttgacaggaccttgacgagttttgtttgttcgtggagcgtgacattgtgccaatgttggagcagagaatggatgcccttatggatgctttaacacccgacactcaaacataaaacccacaatttttgtttctcatttcctcaaatgtttattgaaaaatttaattcgcaattctgttaattggctaagagttcattctgtgatgctattattatacaaaattttttaaaaaacaaaatttacacattttttcaaaacattttgttgatgaacgacgctaatggcaaattggaggcggcacagaaacaatttgaggcaattttggccagcttttctcccaccgccgatggcaatgaacaatcgcagcagcagaaggagcagtttttgcgatgggttcgccaacggttgcgccgtgaaaatgcgatgccagcaaaagacacactgcagcacagtgacaaacggcatccaacggatttgtcggtgcgcaagcaacttggacgtatcgcaaaacgcctgcgcgaattggtacacatgtcattgtgcctgtagcttccgcttttcccaaatatagttggctttatttgctaaatcattcatttgcatatgcttttatcagctaattagtcttcgatgttgaagaaattatgaaaaagcgtgtccgattatgtcgaggtcattgaaattgaagacacttccattttgacgaattaccgaaaacctgagtccgaattaaagcaaaaattcagttctagaaagttttttaaataatgtaattttcgaatttcaagaagtcaattataaacttgagtatttgaacacatacattttgat

SEQ ID NO: 23802 - DNA, 1241 bp, Heterodera glycines
  misc_feature (33)..(33): n is a, c, g, or t
  misc_feature (1063)..(1063): n is a, c, g, or t
aacgactaaagacatgggtttttggaaaatttnttgacgaaataattttttcactcaaaaaccatgtgctcccccctttggacccgaagcacaaaatcacttttatttttatatctttttttaaagaagtgataaaaataccaaataaaatttatataatagagcaaaaaattgcggatttttgtagtattttacttttacagaatgacttttctgaaccgagttataaaattttatctgaaaatccgaatttttccagaaattctggaataactttttttcttttgaacattataaaaccaaataaatctcataaaattctccttatttttctttatttttaaagctttatttcattaaaattggccaacacaacacattgttatgaattttcaaatattagcccaaaatcccaagggtcaaaaaattgaaaaatattttcgaatttttaaaaaattctaaaatttccaaaacttaaaataaacattatattcgtattcagcacctcaaaataccccagaaaaaaaattttcacccccattttggcccacaaaaaaaaatttgaaaatttctagggggcctagctcgaaaaattttgaaattttccagacttatagtacaccattcgatagcatttaaaatgctctacaaaaatgttctaaggcaatttttggctaaaaccgatccctgacgagttataagcccgggactcaaatgtcccgctcaggccaaaaattttttctatttccgggaaaaaatcgaaattttttcaaaaatatcaccaatcgatagagctcgaaaaactatgttttggaagtggtctccgtttttatgggaaaattcgttaaaaaatcctaaaattcaaaaacccgaaaaccgttttttaggcctagctcgaaaaatattgaaaatttttgaaattttaaaatttggaaaaatcgagcttttcaagctctacaatagtcccgctggcgacccaccgctcagatcaaagcctaatgagttattcgcctggtactgaagtgggaaaaaaaaattaactgagtctccgtgtctgtacagngtccgggatttggtctgatcaaaaaataaaaaatactggattatagaggacacttctgcggagtgccctcacagcggggatttttttattcgggttttagaaaaaaagtaggggccttcaaacgcaagaaaagtgagaaatcggtcccagggactcagtcgtccgcgctgaatttttt

SEQ ID NO: 23803 - DNA, 1193 bp, Heterodera glycines
  misc_feature (28)..(28): n is a, c, g, or t
catatatagtaaaagaaagtcattttancagcgtcaacgcgtgttaatgtttgaattttatattttttcaaaattaatgttgctatttcctcatatgtatgatacactgttctgtagcaaacatttgttattttctgtttgaagaattttttgtaaattattcaatgagtttttgtttttagaaattatgcttattaagtatagaaagttatttactagatcagatttaattataaatgaaattttacattttgttttttaaatttatttaaatacaataaaataaatttttggtttcataaattggttaaaaatggaagaaatgttcacacggtttttattattattattttataacatggctggctcaatcgactaagtgttcgttttattcaaaactttcttaaaacaattattataaacatatgtgtcaataaattatttgtaaaaaatcatagaggcagttgatttttcatacagaacaggagttgtgaaatttaaataaactcaaaatataattactaaaataaataattatattaaaattcgattttgacgaagaagaagctcatacgttcttatcgagatcacttataaaaaagacaaagaaaaaataaaattttagtaagaccataatattatttctatttttaaaaaaatataatgctcctcccccgcaattgacacgaaagttctccacccacgctcacgactaatatttaagtacactcatttttccatattgtctaacttgcacattacattaaaaataaataaacttcttttcttacttaataaaaatttataagaaaaaataattttatgatcttgatcatttgttggtaaaaatttatttgaaataatgaaaaacaccaacgttaatttttcgtgcgttttagaataaaattacagcgaaaaaaataaaagtttttcaagcagttttcaagccatatttgaaaaaagctaaaaagagtaaaattgaacgattcggatgttgtattttccattataggtgaaataagcggatgttaaacggttttttaatcagaaatttcttgacacaaatgcgaaaaaagggaacacctattccatatgagtgaataagaaaaatgataaaagactatcatataaattatagaaacaaaaataatatttagaaaattttatttaaaacgcatttaaaagatcgaaaa

SEQ ID NO: 23804 - DNA, 1552 bp, Heterodera glycines
  misc_feature (720)..(721): n is a, c, g, or t
gtgtctgttcagagttcctttatccgcaaatctcagcccacaaaatttgcactttaattaaaaatataaaagaaattaatttttatttaaaaaacccatttttcaaaaaaaaaattaaataaaagggttggaaaaatgaggggaatatgaaagaatagaaagttccattttttacaatcaactctaaattcgttgttacccgaaaaattacataaattttttggggccgggcatttccaaaaatgaaaaacccaattttcaactcaccacgtggggacggtcgcccgtatgaatacgccgataacggtcaagattacagctatgagcaaatgccttgtcacaaaattcacattgttttttggggaaaaaaaaaatattgattcttttataatttataaaaatcgaattttaaaatttaatttaaaccccatattttaacccacccgaaatggcttctcgcccgtgtggatgagcatatgtctctttaagtttgagtgccagtcaaaactctttgtgcaattagtgcatgaaaagcgtcctttcgtcgccttctttttgttctccgtctcccgcttctcctcctcctcattgtcaaattcatcctcctcctctccctcttcttcttcctcttccatttcatccgttgggccttcaatttccctcaaaagtgcctccattccatcctcctctctctcttctcctcattcctttccccacaannttctctcgttcatcctcttcctcctccttttcttcttcttcctcctcttccccatcattggccaccaaaattggctcctcctctcgcgctcctatctctcctccgcctctgcaattttcttccattccctcctcatccgtccgcttttcctcctccacctctttctcatcgtcgctttttccattccttcgcccaaattttcccgtcaaaattttgtcggcatttcccttgatcagcaaaagcagaagacaaacggcaattccgcacacaaaaaatgccaatttttcatgggtcgctgcgctgacaaatgactgaaaaaaaatatttttttcattttgatcaatcgccaaattcagcgtttctcaggtgccaaaaaattatgtgagtatgagatgcctctggggccaaccgaagatccgccaaaaaaagcaatgctttctaaaatccacctgaatttcgtccgaattgacaattttttccgccgtattaatcgcctgaaaaaatttaaaaattctcatattttttgtcaaaaatttattattcaccagctgcttctgttgttcctccattttgtggtaaattctgtccattttctctgcaaaatttttcgcaaattcatcatcaattgagtgcctttcatttgttcgtagggcaaaaaacgactaaataataaataatatttttttaaatttttaaaatgcaaagaaaattaattttcaattgttgtttttaacggtgcatttgcccatttatcaaattaatgataaaaaatgtaaaaatattttcataaagatattttaaacgaaatctcaaaaaatggcaatgtagaac

SEQ ID NO: 23805 - DNA, 2259 bp, Heterodera glycines
atcaggatcaagagtcaaattattattaatggagaaaaaaaatctggttgatcctggccaaaattattcaggatcaggatttcccagatggactcggaccggatttagaattaaaaatcttctttttcaggactcctaattcatggtaatttttcaaaatataccctgatcaggatcaagagtcaaattattattaatgagaaaaaaaatctggttgatcctggccaaatttattcaggatcaggatttcccagatggactcggaccggatttagaattaaaaatcttctttttcaggactcctaattcatggtaatttttcaaaatataccctgatcaggatcaagagtcaaattattattaatgagaaaaaaaatctggttgatcttggccaaatttattcaggatcaggatttcccagatggactcggaccggatttagaattaaaaatcttctttttcaggactcctaattcatggtaatttttcaaaatataccctgatcaggatcaagagtcaaattattattaatgagaaaaaaaatctggttgatcctggccaaaattattcaggatcaggatttcccagatggactcggaccggatttagaattaaaaatcttctttttcaggactcctaattcatggtaatttttcaaaatataccctgatcaggatcaagagtcaaattattattaatgagaaaaaaaatctggttgatcctggccaaatttattcaggatcaggatttcccagatggactcggaccggatttagaattaaaaatcttctttttcaggactcctaattcatggtaatttttcaaattataccctgatcaggatcaagagtctggaaaatcctgacaggatctgctcctatccaggatctattaaaaagtataaatttcataataattcttcaacattttattttcatcatatttattcataaatcaatttaataaattattcatcattatatttatttattcacatttttagccatgtttcattcaggaccaatttccggctattagcctttatttcatttaaattgcggaagcgataaatgaattccggaggcatttaatcaattcgcctacagattttacattcacatgaaaataataattattttaatttgggattttgaaaaataaaagatgtcataataattagttatagattttcattaagctgacgaaagctttgccttataaaaaagcattgaaattttaattaggcgccataaatataattctaatgaattaactgctttctccaaataattacacctattattacaatgcttcaaatctttttgacaatttcatttctgttgataattggaagtgcaattagcaatggaactgacgaagtgaaaagaggtaaaatttataaatataaaatgtaaatttaatttaatttatttgcaaattaacccaggattttgtccaaatttatacaaaaccatgcttatttattggcaaaaaaatgcattgttttttcattcgattacaaaaaaataattaattaaaaaaagggaaaagatttctaaaagaaaaattttcacaacatttattgtttagtggaaataagtctacgggatttggtggatgatgccatcaattgggcccaccacattggcatggcatggcgagcggacaaaaaatttccgcggtgatttaaataaaaatttttataatttttttggcatttttttttgcagaagtgatacctgcgtttttgtgcctttcactttgtttccgtcacctttcccgcgcaaaatttacaacgaggcgctagaaattcaaaaagttaatttaattttaacaatttattcattaaagtagaaatttttttcaaattttaattgatacacaaaattttgcgctatttaaaaataggtatatttggaattttattaaaacccggcacccttttggaatgataaaaattttttttttataaaataattgtctagtaattaaaatttgttcttgagctttttggctatcttgcacctattttgactaattctgactttctaatcaagacttcaaaaaataaataaaaatagaaaatttgaattttcgatttttgttcgagttagttttcgggttatggattagaaattggtacaagcaaaagccacacattcgtgatcaaggaccctaaaaaccccctgaaaacaagttttcacgagttcttatcacatttgcaaaccacaagaatcccttccctatttatttttaata

SEQ ID NO: 23806 - DNA, 2046 bp, Heterodera glycines
aaatgccggcgggcaacaacggtttttcaactgaatcctaacgggatttttggggttttcaaaacccggattttttttataactttgtttaaagttattggatttgagttcatattggcaagttctaatgataataagggagataatgttgagaaaattttcaagttttttcattgagaattttttgaatcagagcgaaaatcccgactcagaacctaaatcccggttctgggctctagtatattatacccacaaaaaaaattttcttgttcattcagcacgaaagcaagtgtcatcgcacatccaagttttagcaaggaaaaaacaacgggaacaccactccaggatgaaggtggaaaaggagaatgaaatattttaataaaggctttgcgtaatcaatcctgttttatcccgcaccacaatataagccaaaagtcaagaaattacaaattattctttaacgaggattctagaaaatttcatgaaatttttttttgtaaaattaagctttttttgttgaaaaatttgttcaaaaaaattaaaattttttattctcgaaattagtttggattttttaaagaattaactaaaaaatattattttttaaaatttttctgcggacacggtaagcgggagggcgggaaacgagctgcttccggtttaatcaatcacacacaacatttatttaatgctagtcaaaaaaaataaataaaaatctataccgtaatttctcacatttaattttgattggataattttataaaataaataaattgtccgtcccctttcaaggctccccatcagcagcaagatggtcagccgacagactttggcatggctcagcaacaacaacaacaacatcagcagcaacagttggcaccccctccgtccacctctggctccatttcgccaaactccggtggaccgttgcaactcggtgctgctgacccaagctcagtggagtccaaccagtccaacaacgtgttccatcacacgaacatggccattggtagtaacggtaagtaaactagtgacaattcctggagggaggttacacttggcaccccctccacccaaggagtgtaaaatttcttaagaaaaattcgaaaaatttgtctagtggtacccctccccaagcccggaaagttttcgaaggcgtcgtcgtttgggaagagtgatgtatatctcttaaaaagcaactccaaatcccccgcatttgtgttgtaccttaataagaatgacggaattttcattccacttctgtccaaaccgaatcccgaattctgttccgaacccgaggcccggccgactcggtaaattttccgtgatattttttattccgaacttatcactccctatactgtataatctacagttataccgtattcttattcctttactactgtaacatacagtttgtaccgtattcagttttttacaaacccaatttcttaaagccaatgggattgccaacagcggtggtggtggccttctttcaccgccgtctcgttccggcgcaccgccggtggcggtcattgattgcggcattggcacctcatcatcatcctcattatcatcatcatcttcatcatcaatgacaacaacaacatttggtgcagtttctgcttctacagcgggggcaccaacaatgtcaacacatttgttgcttggaatggcaccagcgacaaacattaataacaacaacatcattaataataacaataacaacaatgttgcgccgactgttgcacataataggtgaggcatgaatgggctcaaattggtcactccatatttacacctcggacatttgtgccccggacattagcgccccaaacatttggcctcggacatttgtgccccggacattagcgccccaaacatttggcctcggacatttgtgccccggacatttgcgctccaacatttgcgcctatatccaatgtcgggttcaaccacaagttttttcaatccctggtagcctaaacagcattatatatagataagtgatagaaagtgattgtggtctgataattattctaatgt

SEQ ID NO: 23807 - DNA, 1689 bp, Heterodera glycines
  misc_feature (1651)..(1651): n is a, c, g, or t
tgcctgttcgtccgtcaaatcgcacccaatcgaacaaagcgccgcaatgagccgacaaagcgattttccaaccagggaaaagcctttgcttcggtggtcagcaagggaaagacgctcatcagaaattgcagagagataactcggcacggaatttgagcactagaaacgcaagaaaagtggaaaatgtggcaaataaaagacaatcagagaaagagagaaaagggaaaagagagagaaaagggaaaagagacaatcagagaaagagagaaaagggaaaagagagagaaagggaaaagaggggcaccgtcgtgcgttccgttgagagcgaaaagaagcgcagaaacgccgaggaaagcgccatgtttgacgacggagtccgaagaacggagacgggcacagaaaacggggaaaatctgaagaaataacataaatgaaaagagggagggaaagaaagaaagatagccaaagtttggtaaaattgggtacgcccataggcgaggggaaaatccccggaataaaaaaaaaatataagaaatactgtaatttcttataaaagtttgttaattttcttttcgagttttgttaattaaattgattgaaaatgataggacactcactttttcataagcataatccaagtcaaaagaagcgatccgttgaatggcatccgccgccaatttgcgcaccatttcgtcccaatgaatgcttttcaattcgcacaaatggtccatcatcggacggatgtattcgccgaattgggcaaccgaaaaataaataaatccgctggaaaaaaaagaaaagccacctgaacagccaaatcggtgtagcagtgttttatgcgcgccacctccacaaaatcgaccaatgtcagaacggcgatgccatgcggaaaagaatcattgcggccgacattctcctaaatgggcaatgaaaagggctcaaaaggggggggggcacttggaaagcggcacttgccgcccttcgaacattcacttcgcggtcaaacagcgcaaccgaaagtaaaacaccggccaaagagggcaaatggtcacggagaagttgggcctggaaaaaatatcagagaaaatgtgccaaaaagagaaaaagtaacaatgaaaaaaagtgaggagaaatcggtgcgttatcagaaagattttagcggatggatgtcagcagcgacaaactcagtcggggaaagaagaacaattgtcatcatttaacgcaaataagacaaatcgcagggtgggggagaaccaacggaaatggaggagaaatgcactgagccacgggaagggtaggggaaagcgagaaaagaaacctcataagcgcgggcaaaggcccaacaaatgtaacaagcggcatcacgcacattgaccgcctgcataaagccaagttggaactgctcaaaagtgagggcacggggaaggaggtcgacaatgaccttagagaagtgagaaagtgccaaatggaaacaaagcaaaaacaaccattggaacttggcacggcaaaaggcacccccgacgacagagctcagccaatgccaaacacccgccgtgccacgcgttggcctcgtccgcggcagaatcactgaagcacttggtcaacaccgaagaaacaacttcagcacccatctgaaaagtgaaagaggganattgggggggattggatttgggtttggatttgatgccc

SEQ ID NO: 23808 - DNA, 1549 bp, Heterodera glycines
  misc_feature (1408)..(1408): n is a, c, g, or t
  misc_feature (1421)..(1421): n is a, c, g, or t
  misc_feature (1428)..(1429): n is a, c, g, or t
  misc_feature (1521)..(1521): n is a, c, g, or t
  misc_feature (1525)..(1525): n is a, c, g, or t
aatggaaaagagaacagggaatgatgacgaaaaaaaatctttcaattaaagaaaaaaggataatgttaaagcaatttgatcaaatatatggcaaattaaaaacgaaattaaatgaaaaattggaaggaaaaaggacaaaatgccaaaaaataatagcaacacatttgggcattgatattagcaccatttataaatggaagaaacaattaaaagatggaaaattgattaaaaatcaaaataaagatgagcaaaaaagagaaattgttgaaaaatattttaaaataaaaattaaatttatgcaaaatggaaaacattcacgaaaagaatggaaagaatttagagcaaaaattaaacaaacattttgtgtggattatacgacaattgaaaaatgggccgagaaaattggcatcaatcaaaatatttcaaaaggtgaatttaaagattttaacgtatttttttaaatttacagagagaaaaatgttaacaattgctgaaaaaatggaagtgattaaacaatattatcaaatcaaaaaacaaaatccaaaattgaaagaagatgaaattgccaaaattttaaacattccaaaaaactcattacgcaaatacaaagctgaatttggcattaaaccaaaaaacaaattgttataattaggacgatcattattatccgaagaatatttggaaaatttcagacataaaaaatattcaattttttacaaatgtttttataaataattttttttcggtttatgaaattattaaccttttttcatcgcttataaaaaatatttgataaaaatcgttgattatgctaataacatttttaattggtctagttgaaaaaccaaattaatttttcatatttatttttattttgaaaaatgagtaaatatggcaaaaaaaaagtaaatttttagagaaaaattaattaattaaattcaataaggacaatttttaaaccaaatatttttatcaataaaaaataattaaattttgggaccaattttttagaaaatcttttcattcttaagggagtttttttcaattttattgaatttttgtctgatcattaataataattagaattacccaataatttgaatttcttagtgaattatttatcggtataaatttaaaaatatggaatttttatataaaaagaaataattgatgaaaagttggaaaattaaaaaattggcttgatttcataaataacaaaaacctttaaaagttaaattgggcttcaaaattcaatttaatatgaattttttatcattaatacacttcacgaggttaatattatttcagattttttagattttaagtgaaattttgtaaatttctttgggaattggttttcaaatgagaatgaagatattgaatttttaatttaaaattattagagtanatcaataagtagntaaagtnnttataattttttttaaacggcaaaataaaataacaaaaatgaaataaaattaatgccatgatttctccaacattttgaaataatcatcccgncttnttgtctgttaattatcagctgatt

SEQ ID NO: 23809 - DNA, 1850 bp, Heterodera glycines
  misc_feature (161)..(161): n is a, c, g, or t
  misc_feature (987)..(987): n is a, c, g, or t
atttaaaacttttaaaaaaatgcttattatttaataaatttttgaaaaattcctttgtttacgttataactgtccattcaatgccaatgtttacaatggcgagcaacagcgtttggaacataaaagcaatttttgttggcacgtcgttcacaaccaatccnaaaaatgaataaaaatttgatgccataaatcaagagcacatttattgtgtagaaaacaaaagttggacgaagttgcttcagtgtgcgaatattttccgataactttaatgaataaaattaaattaaatattatatttaaaaattttttttgcttaatttttgtcttaaaatttaaatttaattttaaaaaaaaattcaatatttacagttataaaataatttattttgcaaaatatttaacataaaataatttaactatgatttataaaccaattaattaataatttaaaatgctttataccgatataaataataatttatcttaatttaatattgcgagaaaattgttttacttgaaaacgttctttcaatgtccaaattttgccgctgttatatcgtgttttatttctatggtaattatgacgtaataactaaatttaaaaaatgatttaatttttgaaatataaattattaccacgattgcagcaatttgcaaaacaaataatccgataattgagggtaatgtgaaacgattgtaatcatgcgcagaactgtcttgtgttattaggacaacaaatgagagagataactgaagaatatttaatttttaaatatttttatttataataaaaattaaaaattacagtaatggccagccaactgatgttagcccacactttgtcatactgttcatagtcgcggaagagtacggtagctagtgtacgttcagccagcagaacataagcaagaaagatgcgatatgtgttcgagaaaacgtaaagtgagccaagtatgttggcatacggtggtcttgtaaaaatgtccncagatggcacttggacaaccatcaccgagaaacggcacaattctgactgaaaaaaataataaaaatcttaaatgagaatttattttattaaattttaaatttggctaaataacacattaatgaaaaacttttattatataaaataattttaaaaatgctgataataaaaataaattatttttttatattaaataatttgtaaaaatgatatctcaaagagtttttaccttttcattaaatctttttgtaacttttcgttttttgagtgaacttttgcccatttggctatggtcgtattataggaaaatttaattatgtaatctatgatttttagaatgtcattaaataaattttgtttaaaacatttttaattaaatgataaaaaattctgagacattttttaatttttagaaagtttaacattattatataataaattattgcttggatttttttcttttcttataaaaaaattcaatttttatggtattgatacggaaaatttttcgataacttttattaattatatgcctaattaagttttaattaccataaaactgctgacactttgtgccaacaacacccatttcaaattggtgtgcaacagtccactgttgaacaccataatgcagttgaaaaccgtgatcagcatggacatcagatggacgactagctcgagaatggccaattccaatgagatgctcagcagccaggacggtgtgtccacaattgaagccgaaccataatggacgccatttgaaatattcatttgtaaaaaaaaattagctaaattaagataaataaaaataaatttttatgtatttaaattaaaattagaagcaatgatttgatgcaaattttaa

SEQ ID NO: 23810 - DNA, 1773 bp, Heterodera glycines
  misc_feature (1744)..(1744): n is a, c, g, or t
gactgatcatccggacgagtagcgtgccggcatctgacggttgcgcactgggtagcggcgatcacgtggacttggcatcttggcatccgaccgagatgatcctgtcgatgatcgtcatcaccatttactggggctgttcctcgtcctcatgttcggtgtctgattcaggcctattccttaggtcctgatcaacaatttaaaaatttgcaggggcaatggcagattaaaagcctcattcaaaatgttcagagacttccaaattttccacatttcggcgttccctgagctggttcgcatgatacagattgattgatccgtccgggaattttacaccataaatcacgcctttgcaatcgcaaattaatcccgccctccaattatgggagaggcggtggcgcgcgtacaccctgtcttttatctgaaaagttcgttgtttcgtgccaaaacgtcgattgaagttccgttccattttcgcgtctctttccgagggttgcgaaagcggcggtttcagtaaatccagagtggttcgcggtttgcgaccaaggagcatttccgccggggatttgatgtttgggagcgaatcatttggtgtggtccgataagtgaccagaaacgtttcaatgacgtcctttcctgggactccctccccttttaatttgcgaaaggccctcttaaaggtgtccacaaatcgctccacttgtccgttagacattggattgtatggtgctgaaaataaatgcgaaatcccgtttgccgcagtaaatttagcaaaatcgttgctggcaaattgtgtgccgttatctgacaccaaaatttctggaattccgtgtcgagtaaaaagataacgcaatttatcgacagtggcggcagttgattttgttggcatttcaaagactccgggtactttgaaaatgcgtcgacaacgattaaaaattctttgccgtaaaaggggccgtcatagtcgacattgattcgttgccatggatgttctgcctttggccacgagtgcaaatctgtcttgacaggtgccttggcagcagcttggcacggctggcagttttggacaaattcttcaatttcagagtccaacttcggccaatagacatattgtcgggccaactgcttcatccgcttgatacctggatggcctttgtgcagcggatccatgattttcttctggcagacttttggtatcacaattctgtcgccatacattatgcaccctttaagaatagacaaatcgtcttttcttcggccgagcagttggacaatatccgtttcctgcttcagcaaaacattgttcggccgccataatcggaggcatctgccgcgacaacgatctccaatttagggtcgtaatgtgtcagcagcaaatcggatgccaaaatttctttcaattttgtgaatgccctttgacatttttcattccagtcccactcctcctttttgagcatgtcgtccagtggtgttctcaagaaacgcatcgtttttgacgaactcgttgatagtgatttatcatgccaatgaatgaacggagcgctgaaatgtccttgggcggtggcatctcagtgatcgcatgtattttacatggatcaggacggcggccatttttgtccacaatttgaccaagatactttatttgctctcggaaaaatgaacatttttcaattttcacccgaaacccatacgtttgggattcggtcaaacacttccttcaagtggttgtgaatgttcttctgaattnttgctgacgacaataatgtcatccaaata

SEQ ID NO: 23811 - DNA, 1962 bp, Heterodera glycines
cattcgaaaaccctaagtgtcctctattagcctgcaaccttttcaaaaaatttggctaagtttcaaaaaagttatggccacaaatgtgtgaaaacctggttgtttgtgtacttttagccataacttggctcaaacttgaccaaaattttatgttgaaaattttcatttgatggttttttatataacgccctttttgatggtttttctataacgattcagcaccatttttggagatggaaaaatttgtactaatttaaattgttaggttgggttactaaatcatgtttcgagaaggatttcataattttcagcccatttttgagatattctgttcacttcggacgagtggccatcgagaatatttaagatttttgtctgttccttttagacaacaatttagttcagagttcccaagtatgcttatttcagcattacgtgcttatttttcgatttgaaaatacaaaatttaaattactattttgatataatttttttatgaagcgaatacttgaattaattaattttgaaaaaaatattttttttcattttcttgagtttaaaatgcccaaaatttaatttgattcgaaatgacacgaccgcagataagcgcggatcgatgcacaatcattttccatttataattcacgtgtttcaagaaatttcgtacagtaaacgatgcacaattgagaattttaatttttaccggagaattatattgattcccaccggtgagcttatccgagaaaatgcctttctttttaccatttttataccaattaagtgctaatgagtgtgcctagcgaacaaaagaacgaaaatggagggagagagagagattcaaatgaaacaaatgatttatgtataaataataaaataatcttcatttccaatttgtcagtcttcgtcttcttttgcctcaccaccgcttccactgcttttcgttgtgccaaaaacggcagcaaatatctgttgtacattttgtctcaacagttacataagtatggttgtgctccacctgttgggctgtgagattcgccgctgcaaaaggaagaagcccagcggtaagcagttgctggagggcatttccggtggcggtttcgtcagagaaaggtgggacgagggaagaggatgaagaagaggaaggcccagaggaggaggcggaggagcagacggccaagcagcccgctgaactgtggcattatgtggagaaaaggggtggaggggggggggagggttaattgggaaaagtgcgaggggatggccaatacggtgcacaattcaattttgaaccccccacccccaaataagtgttattttactcagtcgatgttcgagcggctcactttccatcagtcggtccactccctcgccaccatctcccgaactggcgtcctctgcctcctcaaaatgggcgtttaagccttcttcccttgccacttcttctgttccctctctctcttccgttgcgtacacaaccccctggggcatttgataaagaattggcggatgtgtcgtttgtttgttgttggcgtcgtgctttttggcattcgtaaaagcatggaaagggggcggatgacgttgtttttgcgtttggtgaaaattatttgagggaaatttgtgcgtggcggaagaggagagacaaaagggcgaagacgacgagcgttgttggtagtgatgggcgtggggatgcgatgaaaggcgaggagaggcgggagaggaaatggcagaaaggggggaggtcggcggcagagggcggtgagccgaggggaggagggacgagagggggaaagagggggacagcaagtctaaatgagtggggggacactgctaattgatgttaattgggacgaatgaatttgattagttagcacacttggacaatgccaacactcactttgcaaaagcagtgggagcagtgccatcagttggctttggcttacgcccgtctgttgctgctgtgcc

SEQ ID NO: 23812 - DNA, 2118 bp, Heterodera glycines
taactgtaaacaagcaaattgtttttaattagtttcttatgatcattgattcactcacttggatcgacgggccccctctagcgtacttggaatttgtccgctatcatatgccgtaaccgttggtaatagacaatgccgaagaaaatttttacctggagatttgtcaatcaaagagcccattttccttccattctgaaccttcatttctcgtccatcgatccccgaatacatcgtttcattgccgtaataattgtatccggatttggccaggagtttcccgaagtgttcaatggccgtattttgctcacttaattttgaagggttttcaagtgattttttaaaaatcacttgaaaacaaagggcgatgcatcgtaagaagtgccgtgcattgctgcggcctttccggccatactttcgatcatcattccaatggtcatacgggagggaaaactgcagaccattcaaattagtgactcatttaaattcatattcaaaaagaacagcaattacccgtgagggttaaaaataatgtcggggaccattcccgactcggaaaagggcatcgactcggggggccaaaggaatgaattgatgcccttttggccatgacgtgaagcaaatttgtcgccgatgatcggattccgttggattcgccattggattaacacgtgctgatggcatggaaaagggacaaaatgttcaaaatgaaaataggcaaaaatcgctgcacggcgcgaatgaattaccacgtttttgtttttgtggtccgcctcctgcacaattcggaccaacccgcaataagcgggctcactgttcgtgaatttgtgctcgttgaattgtccgctgaccaaatctgaaaattgtcaaaagcattaaacaccccggggacactcaactgaaagtgccgtaatagcagtcgccctgctggtagagacggccttcaatgggcaggccgtccgcaccgatgccgtaattgcgttcgttcggcttccccaaaaagaccatttccgcatttttgctctgaccaaaaccaccggtggagcgatcaaccaaactgatccttgaagcaattttgtttataaaactcaaaaaattcatacctctgcactttaacgacagttccatgtgcaaagccacgctgatacgaagccttaaaacgggtttttgaggttgaacgggacaaaggcaatgcaataaaccagccttgttgatcaccattgcatcttccatgtcgtatcctgaccagacacattgtgtaaaacgccttacccattaacccttcccaactgaccagtgtacgaaataacggccacacacgcatttgtgcctagagggtattcgtccatttcgtatttgtcatgggcctccaatttgagtaaaggtttttgcgcagtttgcaatttgtacattttgttgtccgtacgcgtctgccaagcgtggactgggacctgacaataagcaaaaggggatgtttgtattgaatagcgcccttccacaatcacccccattgtctgttttcccatttgacattgatacacatttcgaggcgattggttgtgatcgggaaaaggaatcaaattgccagcgaatgagaacagagacgagggatgaagctaaaaattgttggacgctcatccaacccatgggcactttctaacttcttggtgcattgttacgcccggttctgcctcttcggggtcaattataatggaaaggtaaacttgttcaaaaattcctaaatgtaattaagttcaaaagggtaagtttaaatcagttaacctatttgctcgatttgatcaaataaaaggttcctaactggtctcatcaatcttccaaggccgctgtaaataaaaaacgcggcgaattgcatttgaatattctcagagtcgggtgaatgtctgataagcgtaagttccgtaaatgctggcacacgatcatcatgagaagcgactttcattgcgcgcaattgacgttcaataaacgcagcttttttgcgagggataaaaccaacaaaatcgccatctaacacaacagggtaaagcttaaaaaaaaatcaaacaatgtatttaatactaaagaaggttaatcacttcgatatgggtttgtattcccttttca

SEQ ID NO: 23813 - DNA, 950 bp, Heterodera glycines
  misc_feature (935)..(936): n is a, c, g, or t
atgttgtgccatagggaaatgccacaagaaacaagaagagatgatgaaaatgccaagaatgttgtgccataaaaaatgccaataaacaagaagagatgatgaaaatgccaagaatgttgtgccataaaaaatgccaataaacaagaagagatgatgaaaatgccaagaatgttgtgccatagggaaatgccacacgaaacaagaagagatgatgaaaatgccaagaatgttgtgccatagggaaatgccacaagaaacaagaagagatgatgaaaatgccaagaatgttgtgccatagggaaatgccacaagaaacaagaagagatgatgaaaatgccaagaatgttgtgccatagggaaatgccacaagaaacaagaagagatgatgaaaatgccaagaatgttgtgccataaaaaatgccaataaacaagaagagatgatgaaaatgccaagaatgttgtgccataaaaaatgccaataaacaagaagagatgatgaaaatgccaagaatgttgtgccataaaaaatgccacaagaaacaagaagagatgatgaattaccccttgcctaaccttaggcccatctgaataataaaaaactcaaattcgagacttggacatttcgtgggctggacattttgtgggtcagcgattttcacgtttacttttgttataaacctcttaataaaagacaaaatcaatgaataggaatgaatttagagtgatcaaattaaataaatttaatttttccaaattttttgtcttccgttttattctgaattgcacgtggggaggggaggaattgggggagttaaaaaaggtcttatgtaaagaaaatcttaaaataaattattaaagggctgactgagtaccgtcaataaactgaaaggttcttgttcatttttccaaccgattgtagcccaaaatttttcggnnatccgaaaattcca

SEQ ID NO: 23814 - DNA, 2151 bp, Heterodera glycines
ttagtttgaaaggaaaatattcatggatccagacaaggccatctcataccatgcaatcagaactcagcaggttgtttgtgccgtcaatttataaccaatcgtaatgtttagacacttccaaactttcattatgaatatcaagtatgtcgtacttttgaaagacgtccaataattgagcttcaagtggttgagtcgcacgatctaattatatgtttaacggatgtacatttgtcaattcatgatgctgtagaaccatttaagtttgtgatttacctttttttaatttggtcctctattttcaggctcttggatgtatgttctaagtacaaatcaatttccgcattttctcattttgtgacagaggtgagcaaagacgattatcaatagtttttgttttttcagagccaaactattcatattgcaatttccgcaagaaagcatttacacattttcaaatatttattgggtgaactttgtgaaattaacgactgtgcaccgattactcttcctgagaatgcccaagccgttgtgtggtatgtgttaaatacactttttttttgttagattttcgtaaattatcctctgtaatatcaattttctaaccttcgtgctccgcataatggttttcctggtcactacttactgttaatacttattggtaatttttaaccaattttaaggtgcggtgtcaacaatttaattctggcatttaaatgcgagttccaattctgggacatggaccatttcctccacagagatgatttgatcgacgaaaaagtaacaaccaatttatttttgtgagttcgtcatttagagcatgagtctcgcaaaaagtccgacaaaagtggaaaccattcggactgagtcaaacgaaattgctccactgattgtcgctatgtcggacctgcaaatagtggccattcgtcgagaaatcagcacagtcgaattttttgagcccaattctggaaagatgattactcattttaacaattgcaaattttcggaccaaatactttcattgagtaagttaaattaaattacattcattttttcaaaacaatagcataccaccatccctacttgatcggaatattaccaaaaaatctgcttgagattcgctctgttaatcctccgatgctaatccaaaagattcccctgctgagagtttcgatgatttgtccaggcggcaggttaccaaattgtaaataaaagcttaattaattctaaccttttttcagcggaattggtcagtgatgaatccttttgctaatgctctgtttattgttagtttacgccgcgagtgaatcccaaatatggaagctttgttccgaaagtcatcttcagaaaaacattcgttttttgattgaagagaaacaattcgaattggcagcacaactcgcggtactgaaacagacatcctcaaaggtatattaaatccgtgaattaaggcatcgccgactcaacggacggcaatcaatcgccaattggctgcaaaacactttttggaaagaaatttttcaaaatgttttgaaatacacaaccgtctaaatacaggtaaaagagtatttgctaattgctgcctaattacttcaagcatttagatgttttgttggtgcttaatctgttcccttttttgatccctgacaaatatgtcgctgtgatttctcggtacgctcaggccgaattgcaattatttgaagtttcctcagagaatataacggaagatgagagaaaacgtgcaactcaagcgcttattcagtttctcgtctcggtaaaaaaaactactcattccaattcagcctccccattcataaaatcgtttagcgaagggcggaatgcatcgccttggtcaatcaacattatttggattataacaatggaaatagcgaacgaattttaagcacaaacgaactaaaaaggcaggaagcttctttggagctgattgacacggtgcttctgaagtgttacataaaagtgagtccttttttcaagcaaagcatcagcttgactttgcaaaatgacacattgaggtaaacccgtccatggtcaaatcgttgctgcgttcgaagaattgctgctgtattgtgtcggaggcggaaaaggacctcaccagaacagaatgtttgaagaattgttgatactttacgagaa

SEQ ID NO: 23815 - DNA, 920 bp, Heterodera glycines
  misc_feature (859)..(859): n is a, c, g, or t
aaataagctttgaaagaagccaaaaaaggaatgaatcgtgtgaaaagcagagaaaaggctgaaggaaaaggtaattgaagtaccataatcgaaattgaactgaaaggatgatgcaattaaaaaaggaaagagtaaaatggtcaaaaaaaaaagtgaataaattttggaatagaaaaccttcgaaaaggtaaagcagcacactttgagaaagttaatgcaaagataaaatgaaaaagaagagtaacgtaagaagtaagcgaaaattttacttttgaaatgaatatgaaattaaaaccggagactgttataaagaaaggaaaagcgaaatttgccattaaagtgaaataacccgagatatgggtgtcaagagaaaatggcatgattgaatgaagcaaatgggagcgttgtcagatgttcaactgatcgacagcgaatgatcatgttcatcaatgtttgaccatcaatgagtgcccgaaggctgatcagaacgacggacccacgaagctgatcagaagtgatgaggcaaaagccaggaggctttttttcgaaggagggagaaatgctgtatccgcagcattcaaatttcatattttgtgcataatgtacattgccctactttctcccgacccaatcccgtcgtaaacttatccatctgttcatccaatcccaagccaatccttccctctcatttaccgtgccatttctatcccattcacctctgttgcatatgccatccatttctcttattccctttatgtttttgccgccatacccctcatcctatccaaagtccatcccctttgtgtcagtatataagtcctcccaatttccccctcgggggctgcgagatgtctgcggntgggtcagtctgtgccatttcttgcctttggcatcctttcccaataaccattgcactgacc

SEQ ID NO: 23816 - DNA, 1478 bp, Heterodera glycines
gggaaaatccttcagaatcttttaaattttgataaatcggcataatgttttacaatttatttaataattgggttttttaatagagtgtcgaaacgaaaatctcaccaaatttttcaaaaaattttgctaaatgtttataaaaaccagaaaaagaacaaatttttttctaaaaaatcacaaaattaataattttttaatgaaaatctgctaaaatatggtcaaatttctcaatttttcctcttttgtggacaaatctgttaacaaatagcattaaaaattgcaaaaatattcccgtccgccgccccccccccttgttccccaaagttttttggaaaaagcgccgcaaaaattcaacttcggtttttcatgcttagaatttcacaaaatcttatttctaaattgatcatggaaaatcaaaaatataaaatttgaacattttaaacgtgttttgaataaattttgtaaaaatgaggctttttgacccaaaatgaggcttttttgcctgccaaatgaggcttttgaaaattttaatctgggaaccctgattatgtgcgttattaaaaaaaaccatcaaaataaaaatttttgcttttaactttgctctaaaaagaccaaatttttatttcttgctatcattcgataaacacaccgtttcaaaaaacgagatgtgtgccaataaatagagagtgcagagaaaaaaacatctctcattttggcgtactatttatttatctctgttattagagaaaaacggaatttacttcgccacatataactttttttctactcatacaatttacaccaaattttgcataacgatagagaaaaattttctgcatcgaatcttctgtttatttttatcgcttaaatgttgttttaaaaagttattcaaaaaagaaattttcaaacgcttatatctttttcctaatcaatccaattgcttagcatttgcttagaaaaagcttctccccatcaagggctttcgaatgatgtcaagattgtacaatatggttggcaaaaacctttaaaaataattcccaaaattcgtaattttttaatattttggacaaaaataaataaaaatattcatgtagcacaacggactcgaacctccaccccttgtccctttaccatcttacaaaaaccacttcgccacacatgcaaatctttttggaactgggaggccaaaattgaaacggtgtgtaaaactaagtatttatgagcctgtaaaatttcaaaaaaaattcattaagtttgaaaaaagttatcgccaaaaatgttcgaaaaccatggttttttgagttcctcgaactataacttttttaaaacttaaggaaattttttgaaattttgcagactgatagagacacttagtgcatcgattgatatcaggaattaaaattttggttgctttggagcaaagttataaataattttttcgacaaaaattttcataatgatgcttatttaaataacgc

SEQ ID NO: 23817 - DNA, 1206 bp, Heterodera glycines
tctgcataaagtttgataaaaattcctttcggaattttcttaggtaaatcattaatataaataagaaacaaaataggtcctagaacagagccctgggggacgccagagcacattttgtattcagaagaaaacgaattttcaacacgaactaaaaaggagcgattggccaaaaaatcagaaatccaattaaggattttacctctaatgccaattttatgaaccttatataaaagtaagctatggggaataacatcaaaagctttacgaaaatcaatataaacacagtcaatattttttccattgtaaataccgtcaaaccaattttcaagagttaaaataagttgggtaacagtagaacgacctttaacaaacccaaattggtgtactgagattaggtcatgttttaaaaggaaactagtaattgccctgacaacaaatttttctaaaattttacacagtgaacatgtgagggcaattggtctatagttggtgggacaacttttatcccttttttaaagagaggaattattatagattttttccaaaaggtcggtaattttccggtatcaaatgagattctgaaaagttcggtaacataaggtgcaaaagaaaggaaacaatgccaccgccgacaaaggtacggccatgcaaatcctggacctttgcgatgttgaagcgcttcctattacacagtaccgaatgggaaaactgggcacccgcccacgtccgatgaagttggttcttccgacccgtgctcatgttcggaaatgtctcctcatggcgcgcaaagagaacctcgggtttttgttgagcagtgagcacagcttaatcacatcacttcgcttcttcagttttaaattcgaattactcccgctcccgcccgggactcccgcaaaatttctgcgggattttaacgggagcgggattttcacgggattcccgatcccggaaaaaaaattgaactcccgatcccgttcccggaaatttttttttaccggactctaatgaatataattgtctggataccgaataattttgtgcaaaaataccaatttatgatttattattttttttacacaaattctaaaaaactttagattttcgcatttatttttgtcattttttatacatccgatttatttacatgtacacatacatatatatgaatgaagatatttgcgaatttcctttataaaattcatttca

SEQ ID NO: 23818 - DNA, 1199 bp, Heterodera glycines
gggggttttaatgcgggaggaaaggcagcagaaatgggattggctccgtaggcattggaaccacgggcgaaaaatgcgctgctttgtgccgatgccgtggacagattggagattcgcgctaaataaagattagcaattccaaaaatcagtaatcaccgcaatttccatgccgtatacgtccgccttgggcggtgccgtttggccggacttgccaccgtattccgctttggtttgcttctgtagtgacgctccatagccgccgtatccgcccactgttgtgcccgaggtggaaaaggcgccacttggaatgggcgcgtgtggctccgttagcggcgcggcatgcactcgcggaaacggcacgtcggatataaagcgcccgaagagccatgcctgcttttgcggaaatgccgaacttactgggtctttatgcctccgattggactgaccccgccgcctttcggctctcttttgcttcgcgtgtgttccgtcctctccttcgactctccgtgccaattcgcttttacgtcttcgccaaaattgccaatttgggaccaaatatcgcgcagacgaacgtggcagaagtcggcctcgaattgcaattccgattgaagcgaaagggaagcggtgagcagcgaagggaccgcgacacaagcgcaaagcatggacaaagtggagaaggaaacgcagagaatggccaaacgacgggcatagcttaacagatttatggcaaaagtggccgaagggaattggaaaagcaaagcattgacaaagcaatgaacaggtcgagagtctcgacccgagaaaagtctcgggaaatcgtcggttctcgaactatacattaaaagacactcgaaaagtgaagttttcaaaaattcccggttaaagaaaccaacgaaaaggggaagaaattccgaaacaaaagattactaattattaattaattaattaattaattttttctttgtcaaaaagggcaaaaaagaatgaagaatacaaaacattatgtaattaaaaggcccactcgatttccttctgcttttcctccctttcgctgttcgatcggtcggccaatttgaaagagtcttcgcttttggctgctgcttttggcaggaaatgcatttccttacgtaagtaatgagtttaaatgtaattcccatgggtttcgattcaatttatacgcaattttcgcctaaatttgc

SEQ ID NO: 23819 - DNA, 1381 bp, Heterodera glycines
  misc_feature (25)..(25): n is a, c, g, or t
  misc_feature (31)..(31): n is a, c, g, or t
  misc_feature (77)..(77): n is a, c, g, or t
aactcgcgaagggaactgcaacaanaatggnacggaaattgaggggtggtaatgaattttttttagttaaattgatntaatgaaaataatgggcatgctttatttgtacccgatgcgggacgggattccgggaattttgttgtacccgttagcagtcctaaactccgagatatttaggaaattgttggattggatcccgcgggatcggaaactttatctcgaaagatttgtgtcccaatccgggaggcgggtcacataaattgtgttttccgggctctacaaaagtttatatttcaaaaaaaattttaaatatattacaagcgctcgaacaataattaatttgtcaccattatttaaaaaacataccttttgaagacagttgacaatgaaattgaatagctgaaaagaaagaaaatgtattcactagtcaatttttattgaatttttcaaaaactcaggaccaaaagttgcaattgaattgaaaaagcaaatcttttaaaaattattggaaggatggaatttggacaatgggacaacttaagtctaaaacaacgcaaaaatccagtttattcggtgcgcaaaaaaataccaaaatactatagtataattgggggatgggttgaaagtaacagaaaatgtcaaaaaaaaaatacaaatgcccaacctaaaaaacccaaatttggcaaaattgcagcaacaaataagataaatttggacacaaataaacctgctctccgctgcccttcatgatcggataagggacaacgaaattattagtggcaattatcggctctttgtctttgccctgcagtgtcagcatgagaatgcgaaggtttttgccgctcagatcgatggcaacgtattttccggtctctgcaaaatggaatttaatttcaaaaattttttttacaatttctgaactatataaaagtaaaaaattgtgcgggagaaccgcccgggcggggaatttcgcggagtcccatttttggaggaatacgaagtacggaggcccagccaaaccgatgataagtaaaatgcgttccccgttcaaggtccatcttcaaactcatgttcccgactttttttaccgcaaaaacccgggcactaattagcatcgacaggcatttttggtaaaatccaacaaaatttggaaaaatagtgaaaatatatgccgcacccgttccatccggaagggctggaagataggaagggagcatcggaatggaagtgcgtccgttggtggtggccccctcctggaggccctgcctcaactccgtctcaatgtcctcgctgattttcaccgaaacgctccttggaaatgatgaacggctttagcatcccaagggccttcaaaagggaatttttcaatgagaaaacttat

SEQ ID NO: 23820 - DNA, 1226 bp, Heterodera glycines
gttttgacccaattcgaaccccaatcccggatttgaataaactcaaaatccatttttcaaaaaattcacattttatacacaaaatcgcttcacaatgtcacgaggatgacccgcacaaccaaaaaatgacacgacgacgactcgtataaccaaaaaatgccctgagtacagataaccgtaaaataccaaaaaaattgttagaacaaacattgaaagcttatttggggcaagaaaacactcgccgaacgaacaccaaacgcgttgacgccatcaagcaatgactgtcacgcgtggcagtccacagattttttcaatcacatatcggaagacttaattaaaatgtatgacttatttttaacaagtttctaccttcagaccaaagacaaatgcctaccttttgagttttcccaagtttgaaattggtgatgtcttgttcttctccagtcttcataacgttcattgttgttgtcgtttgctcacaatgatcagaattttttgcattttcgccgtcattgttgttcagaaatctgtgtttacaacatttatgaagaatttcaattttttcgacccattttgcttagaataatctattatgatatagaaagggaatgtgccgggcccgaataattaaataatgtccttcctgaatttagtgattccccaggattattgtgggtttttcccaattccccattccacttttaattgcccaattccctttaataaattatccgctccttattatttccatatcctcttcttttacttctccattatccaattagtttgatcgatttatttacttaaaattggaaaatggttgcgaattaaatgtgaaaaatggaattgaaattaaatgtgaaaagaaggaattgaaattgaatgtgaaattgatgaaaattaaaatgatctgaattccaaaagtatttgagtgaaaaatggccaaaagaaggatttctgatgagggacggtccgggatgggagtgggatggagaaaccaaaggagagttttgtccgggaaccgaggaaagggacttgggatctcgatgaaagggacggagaaggatttcttctccggagttttgctcgtaattgaccgggggagctaactgatcttccgtttccctacggggaaaaggatcagcgaaatgctgatccttaatccccgccttcttttgttactgtgtgtaagggggggggggggacaggggtactgtacgttacaa

SEQ ID NO: 23821 - DNA, 1629 bp, Heterodera glycines
  misc_feature (50)..(50): n is a, c, g, or t
  misc_feature (74)..(74): n is a, c, g, or t
  misc_feature (111)..(111): n is a, c, g, or t
  misc_feature (1604)..(1604): n is a, c, g, or t
gtatcagtgtcatagaatgtaggcaatgtagatcatttctcttcacacanaaattgttcggtttattttcaatnttctaaaatgaaatattttatttttacaaaatttgcncaataattttggactatttttattcttttttaaatttatttattttttgtaaatttatttaaattcgaaattttttactttcatcatttcagcaaatttatcattgtcccgttcgatggtccatattttcgcttcagtgtctcggatagctttgattagtggcgcttcttcaggattagggaaaaaacgttcaaccatgccaggctgggcgagagcctaataatttattagtgctaagttacgaaatgttaaaagcccttttaatcagtattattggctaatacaaaatatggcataactatagtcaatcccaacacaaaaaaatggcacaacttatattactaatcgattcgtatcgtggatctaagtaagcatgaaaatagatatccatttgcggaaatgagtttaaatttaatattgaactggcttaaaatgaatttttattgtcatttgttgaattattttaagattttctgtttatttaaataattagacagaatgccaaagtcataaaatctcaaaaaaattgccttttgatgatcgaaatcagaacagcgaacggattagcattatttttcatgctttactcctcgagacgaattaattgataaatataatttgtttattttttttatggggggaggtgaccatactgtatcccaaaatagttttatggggatgacctgttggattttctttgaatatgcaagtactgcaataagcgatggtgctttctgaaaaaaaatattaaaataaaatattattgcgaaaatatctaattttttttacgattgctgtggaacgttcaatgatcagtcgagctttcatttgatatgtattttcgttgagcatagtttgctgattaaacacaacagcaacaacaatttgcttgtttaaccgtaatgaaaaatctttgatattaagcgttagcctaaaaattaattaattgttttttcataattacttaattttcatacattttggcacattggaataaacttaatacaaccgaattaattgcatatttatcatgcaatttcttctttatgatccacgattcatagtaatttggcctatttttggcgacaattatcagcacaattgctttagtatcagcaaatttttgcctcaaaattttttgtaaaataattaattaattgatttaataaagacttttaccaagcatagtacaatgcatcgacagtcaatgaaattgtgtcgctttctacatggtttgccatattcaaacccaaatttgaaaggacatttttatgaagctttgttgtaagatcagaaaaggcaaatcctgtggttgaagcaccattgatttcaaccttcattttaaaatattgtaaaaaataaaattatttaaaataataaaaattaatcacctgttttaattgataaagttttgtttcttcattttcatcactgttcttcttacaaaccatataatcctaaatggttttaatattcttgtacgccactaagantttatttctcaattcaaaatagtag

SEQ ID NO: 23822 - DNA, 322 bp, Heterodera glycines
caatcaaaagttacccctggcctgcaaaatttcagccccctccgggcaaaccgtaaggacttataatttttttaacgaaacccaactttattctatatatatataaactagcgtgtggcggcgcagtaattgcacggtgtagacagtatgctttgcacagtaattgctcggtgtagaccgtatacttttggtatatatgggcgggcgctgacatgagcgcttcgcgcaaaggacttcgttgctagtgcatgcgcggcttccataatcgatgcgtgtaccacaacatgcgtggctccccacccttccccccacgcttccccac

SEQ ID NO: 23823 - DNA, 2758 bp, Heterodera glycines
ccgacgacacttatgttaaagcagttccagttcatttgccatttttcttaaaaacataacgccaaataaaataaatttgaaaatagaaacgaaagacataagagaaaaagcgcgccgcgaccgcgatgcgttcgcggaggcgttggcttatttttttattagccatttcttaatttaaaatacattaacaaatgttttagcttatttcattaattttgatgtcaagcttgctatgagctttcaatggccttggcattttgattttcctccatttttcacgtaaaaagctaaaaaaaggtgtcacaataaatgaattcaaatttactgcttttaagcatccaaccaaacctttcaactcgtgacaaacaactaaaagcttggggacgacttgtgctcgattattgccaagcaaatcgtatttacaccactgatttggacgaaatttcaaagtcggatttattcaacaatcgtcgactgaatagtgagtaatttagcattttttaaaattaaagttagcatgcttaaggacatttggatctgtcagggattcgggcagtgttcgactttctcgaacttcaaagtctgtttggccttttgttcgtaataatttctgcccattcactcccttaagaacacgtcgagtggaaggataaggacaagacgcgctgcaacatttattggcgtagaccagaagagtggggccaattgctttacgagtgggcaaattcaattggattgttgaacactgtggtcacattgtacgagttgacccaaggcgaagacgtcgcgaaagaatgtgagttggcaaggcgacgaagaaaaaataaattggaatttggtttttcagctttttacggtttggacaaagacgtgctgttaaaagggctccaacatttggagaaccaaggcaaagctgtgctgattgacattgacggcgaaaagggcggtgtcaaatttctgtgaacaaagctttgtgttcaccgtttctatggccatggaaaagggttcgttccgtccacacttatacaatttcacaaaacaaccttccaggttcgaattttttgcgcaattccgacattgttgaggagggggacaccgtcgttgtttatgttaatgcggctgcacagtacagtgttgtggtgaagcgggggcacactttgcacatgaaatacggcgcactgcgccacgaatttttgatcggaaagcggtgttatctttaggatttacctaattccctgggttgaatctcccccccccccaattttcagttatggcaccgccgtgtccgcctcggccggttatgtgtacgtgttgaggatcaacccgagcatgtggacacggactttgcagaagagcacacagattttgtacacgccggacattggcaccattctgctgctgttggacgtgaagccgggcgcacggatttgtgagaccggcacaggtagaacggaggggggggggaaggcaactcggactgaaacacatggcattttaaggcagcggttctttgtctcacgccattgccaccgcagtggcaccggacggccatttgtattcatttgacatcgatgagaaacgtgccaaaactgttcataatgatctcaaagtaatgcttttaaagagggtggtcgaccaagtttatgaaactataaatttttcaaaaacaagaccaattggcaatgattttttgaaaaattacacttacctattaattttaaaatgaaaaatgagtaaatataacttttaaatttgttgactgaacccagcaaatttagtatcactcgaaagtttttaacagattattagtctactaatgattatgaggattacccaaactaaaaaatttaggtaaataaaaaatacaaaaattcttcccttttttgatcaaacaattgcttttttcgtaacttctctagcactattttcgaattattccaaactaaagctttagaattataccaagtttgttaagttggcttacaatgaaaaaaaaatagtatggctattaataagatggaattgtccgaacggagttgacttcccccactatttctctcttttcagctccacggtttgtcccaaaatgccactgtgctttgccgtgacgtgtcccagcatggctttgccgcaaccgattgtgcggagaaagagtggcgttgtgacggcgttttcctggacttgcccgccccgtggttggccattggccatgcccacaaagtgttgcttcaaaacgggcccgagcgccgtccgtctcggctggtcagcttttcgccatgcattgagcaggtgcagcgggtgtgtgccgagttggagcagcacggctttgtggacattgagacggttgaggtggtgccacgaaaactgaaggtgatgaaaacgcgcgaagggtgtgcatttgacaatgaaaatgcagacgaatccgaaaaacatttcgaaaaaattaccagattatatgcaagcccaagccagaaaaaaaagtttgttgaggagccctgactttttgatcttcgggccaaaagtttttctcgtgttatttacaaatttgagcgctggagagcagaaaatgtagccgttttcaccaagaaaaggattaattttgccattttggatcaaaatttcaaaaaataagttaaactcggggtcaggcagtgtcgataggcaccgcctgtaaaattttgaaattttatgaaagaaaattgatttgcggcgcttttctgtgatgctgttttatttgttcaaacaccaaatgatgcct

SEQ ID NO: 23824 - DNA, 822 bp, Heterodera glycines
  misc_feature (11)..(11): n is a, c, g, or t
  misc_feature (24)..(24): n is a, c, g, or t
tcagaaaaganatttggcaacgcnttgaacaaaaaaaaagaggcaaatgagttgagaaaaaacagaaaaagaaagacgcactttgccacagtgaccaaagtcaacggaatccctgacaattaaaaggacaattaacgcaaatggccaacaaacgacggacaaaccgatcaaacaatagaggacgccgaaaagccgaccttcgaaggtcgacggacagacgaaaccgtagccaatcgaagtgagcattgtggcggtgaagaacagtgaattcttgaagtcccaagtcggaggattctcaatttgggtgcaaatttgagaaggggggggggggaggaaagtgtgataattacttcctcaaagccgtgccgaactgcccgatgggccacgtaaaccgtgtccacataattatgaaacttctcctccgttgctgcccgaatttcggccaccattttattttcattaatttcgtcccatggaatttcctgcaaatttttctgaatttccgtccacaccgcttcagcgtatttttcagagtcagcgccgacacggcggaggtgacgcgcttttgattctgttttttgaaatttgacaattttaaaaatacgaatgtattaagtttaaccaagaaaatggcgttcttccaaaagttggaacattaaagcaccaagaaaaatgtacaagacacaagcgaaggcgagcaaaaggtggtgggagagaaacttggcacggacaaagcgcaaaactcggcttaaaagacatttaatggaagtgatgcactgatcgaagagaggaaagatgatcaatcacggataaaagtgacct

SEQ ID NO: 23825 - DNA, 2107 bp, Heterodera glycines
ttattaattatcaaaacattttttttttacgcaaagcattttctattttttataatttttaatatataatttcgtacttccatctttcaaattttaaataccattaatatattttaaaaaagttcaaattttagttggccttttcattgaaaatgaatgaatgattcgcggagatttcgtggcaaaaaaataaattgctcatttgcttggctgtcggaactttttatgagaatagggccagttgaacaaataacaattttatttaaattattttttaattgcatttattatttttaagggaatttgggatcaattggacaaattaaaatttaaacattaataaatttaaatgtatttattattttatgagtgaggacgagtttgacaaatacaatttaaatacatttgaaatgaattttataatttttatgacagatccctcttttctggcacatattagccgtgcccatccgcgatggttctccaaaatcagtcgcattttccgtgtacgtcgtggccaaacatttgctggaactccagcagaatgggctcaacttgtcaaatgttgttgaacaaatggaatgccgcaaccgttcacgccaaaatgaaagaatatgaaatgatgtgaaaattttcaaataatttgccttgccaattgaattaatgctttttactagtgaagcgaataaagaggacagaaaaaacggacgccaaaaatatccaatacaaagtcaggacaaaatttactgatgggaaaaaattgttataatgttatgtttaataaatgaataaaacattttttttaatttattgatgtttaaatttcaatgtccttttggccatatgttaaagaaattgttccatttttcatttcaattttcgcattggaccaactcaatttttgttgacaacaacccaagaatagcttctctggttaattcagtcaattgttgtttgacctaaaatattatattaattttgtttttttttgctaaaaataattcttaattttctatacattaaaccaataatattgaaaaaacccttataaatttagaaaattgttcttttctaggtcaagaatcggttaatacgtatgttatttattgaaaattaaaaaattctacttaaaattttctaactagggctggacaaaattgtatttcacttatggaaatttgtaacccgtaatctcagagctcaaaacgtcttaatttccacaacacgatccgtaattttcgctcccaaaaaagacccataatttctttaacgcgtaatttggtccagccatgctccaaacaacggatcaattacgttttgcgattccattcggtcaacagccgttaaattgttgtcatcaataaaaacattcatcgtattggcccaaaagcgtaaaatctgttcgatcgaaatgccaaattcagacatttggaactaaaaattcaatttcaaatatataagcgaaaatcagtaataaataaataaattaattgttaattcattacatgtagtgaaaccaattctgaagcacttagtgttcgcaaaaatggtgttggattaggctcatttgcttcaccgagccttaaatttcgtcggacagcgttactaagccaattaacacattttgaagcgacatgcccagtaaaagcactcaatctgaaataataaatgcaatattatttaataataaaaaatccactttataattaatatttaaggttaattacttacaatatattcgaaattttattgtttatagtttcggccaaaaaagtgaaaatgcccataaaacaaaggcgttttccaattgctagatcacgctaaagaagaaatattagcttgcttgatgtagagtttggaggaaaaattttatctataaattaagaaatccctcatttttgaaattgtaattacatttctcagacttacttgaatttttatgcaccggagtttggctttacaaagaaatggtgccaaatttcaaaaaaaagtaccaaaatccatggctaaaattgggcaaactttgcacactcacttttaagtgtacgtccatttttacattgtccattctgacagtgcccaattgttcacaaatgttcgacaaatt

SEQ ID NO: 23826 - DNA, 1481 bp, Heterodera glycines
acttttgttaatttcgccccgtaaaatgatttttgaaaaattagaattttcgactttttggttcgaattcgggtccgggattcaaaattggtcgaaatggatgtcagattcgtgatcagcgaccccgaaggacccgtagaatgaatcaatgaaacaccagaatatatgttattagtacattcacaatacacagatggcacatatttaggcattggtaacaacatcatgatgatggcatttggggtgaaattatatacatacaaatcggatggatttgacgggagatcaatctcatggcaaaattatccgtgatttaattaatagcctctgcaaaaattctcgtcaattccgatcaccacttttcttcatggcgtcgttattgttgttgttgtcgtaccatggctcatgcgtaccacgcgtcacgtcatccagtccctttctatccttgaagaaatgcagacgacattcttttctagcctgggaaaaaatttattaataaaaaacgtccaaatttcgaccttttcgcaattttcatgtttttcatgtataacttttttggtaattgtctaatcgcgaagtgatacatagaattagattcgaaacatgttaagctttcgaatgataccaacaatcttggatttggatgccaaagaaaaaagttatagcgaaaaacataaaaatttttgaaaatctgcccacagataaccgacaagtaccaaaataagtgcagctaagcgggctcgaactccagactcccttttctcttcgtcttcactagcactcagttgtctaaggctcagatggcgtctgttcgacttcacaagggccaacgggaccactgatctttaatggggcagaaagaatgccttttccaatggccaacgggaccactgatcattttagggggcccaccatcgaccttataccataaattatagatgcatttgcgtgataaacaaatttactatcaatcgcagcccgatccgtggatttgttggaaaccaatacgcagtcccataatttgagaaacttcatgatcagattaatcaggtacaaagtcggacacactgtaatttggggctcttataaaaacttctcgttctgccccgatttccgccttaaggattggactgatcatttgcactctctccgtcactttcgcgttgatcaattttctaaattcgcttccaatgcctttcccttcccgtgccatttcctttcattcaccaactgtgggcaatccataatatccaaccacactttgctatttgtacgtattccgttcattctttcgcctctgacgaatttattcctcgctgaagctgcgctataattttgtgaatcccctcacactttccctcccccccctttttcctctccctttctctccgccctcacaattccccccaatatcccgtcggtcgtcgtcgtctgctttgaattcatcccccgcagcgttgtacgccctcatcccccctccc

SEQ ID NO: 23827 - DNA, 1517 bp, Heterodera glycines
cttcatgccgaacttcttctgactccacaatatcatctttttcgggtctttctaggggaattgatgccggtactccttcaatttcatgcagaacttctgattccacaatatcatcatattcctgtctttctgatgaaatttgtgccggtactgcttcaacttcatgccgaacatcttccgtctccaaaatttcggtcgttacatgtccgtcaatttctggcgatgatactgcttcaatttcttgcggaattttttccgtttccacattttcacctctttcatggccttcttccgttgaaatcagctacttccgtcatgagaagaggcaatatttgttcatggccttcacttgacacttcttctggtgcaaatgggcgctcttctccatgcatttgggagaatggtgccattttatcatcggaagattcaacaaaaaaatgcatgtgttcatctccagatggatctgtgacgctctcaaattgtttcactgtcgttacttccccatccgggaataattctgctgatcgaaatggtgatcgggaacgtggcgaatgcattggactcgcttcttcttcaatatcaacagggttggagtcaaccaacagctcttgttccgacgcttcatttttttgctggtcagttggactgcaatttcatcagcggttgttcagcttcatcttcacgctgatcggttgacattggtcgatgatcagacgcaatttccattgacgactgttcagcttcatcttcacactgatcggttgacattcggcggtgatcaggcgcaaattccattgccgactgttcagcttcatcttcacgctgatcgattggcactctttgatgatagccaatttctgttggtgactgttcgacttcttcttcttcggtttctgttccaataagccgcagatcagttagtgcttctgttacaataacatcaaagtctagtggttttaatgcttattcctcttgttcatgaacagctggcaacacttcaacaatatggcttactccttgatcttcttcaattggcgcgtcatgtattactccttgaacttcttcaacttgcacgtcatggcttactccttgaacttcttcaacttgtgcgtcatggcttgctcgttgttcagcttgttgagtctcataccctcttagataatattcatattcatcttctggctcgtcaggggcaggagtgatttagatgatcggcgatgcagaagttatccaacagcggtgtcggtggtgtagagacacatggacagtcgaggatcgaacgtcgttcagcattgaaatgaaagttgtgtgtgcctcagtctccgcatattggacaaacaagttcctagcaatttcaagccaatttctaacattctttgcaaaaagcagcatttccaacgctcccccccaccccaagggcatttcggtgctgttcatttcaaagccactccctctacaccaattgacggtccacgcccataaaacgccccactggggaaaggacctttcggtggaga

SEQ ID NO: 23828 - DNA, 2259 bp, Heterodera glycines
  misc_feature (2111)..(2111): n is a, c, g, or t
  misc_feature (2129)..(2129): n is a, c, g, or t
  misc_feature (2142)..(2142): n is a, c, g, or t
  misc_feature (2161)..(2161): n is a, c, g, or t
agctccaccaaagagaccatcacagagtaccaccaccaggacggcatcgaaaatcaaaaaagagtttcgcccgaaaaaaatggaattaataaatgccactcttgacaaactgtacaacaatccatcttcccccgcggctttttccggtgttactgcactgtggaaagaggcgagaaaaaagataaaacaattaagtaaaaaagaagtgcagaactatttggaaagtcatcgtacctacacgttaatgcgcccccgacgggtgcacttccggagagcaaaaactgttgcagcaggattcatgacagatgtccaagtggatttggccgataaaatcatattctgatagagaacaattaaagatattgaatgatatcaaaatttggttgaatttgagccaagatatgaatttttatgtgttacccattttgttttcgaacccattggcgggtttaagaaacacgcatgggtggcggaatttaagaaaagcgccagcacgcttttatttatatatttcgggatttttctacatattgtatatgtacatatttttatacatattctggattttttagtacatatttcgcaattttttcgtacatatttattttttttacatattttgggaatttttgagaatttataaaaaatttcttgaaaaaaatttttaaaaatttttgaaaatatcccctaaaaaatcggtttttttcccaaaaatcaggtatcttaatttttaaaatactaaaaagtgattctaagcctatttttgtccatattttgagatttttgccattttatatcaatattttgcgatttttggtccatattttatggccatattttgcgattttatatccatatttttgacatacctatttattagtattttttgttgcttttgttttttggaaaaaattggtatcatattttaaaattctaattatccctcatgggggataattagagactgggggattatttttcaacctcctcagataatgggggataattggggaatgggggattaatggatatgggggataaaaagagaatatacggtatatgcctttaacgcagggatgcgatctgtcctgatttatcagatttgtcctgatttggaggtagcgatcaaattttgtcctgatttcttaaataaactcacagaaaatatttggtaacaaatttttaagataccaaaatttgacaataattaaagtttttgtgctttttcgtcaaaccctttttgattactttatttgattgtcacataaatgtgcaatgtgttcagaacaatgcctacagttgcgagcgttccaaatgtcaaggacaagccaataaatggccagcaaggacacgctcgtccttgaaacgagattcaaccgaaattatatttataataatagtttttaattttagtttagtaattcaaattcgcatcgttaaaatctcataaatatcgcaatttaaataataaattgtaatcaaataatattaggaaatttaagcttcttataggaaactaaatcagacaaagaattgaaaaatgacaataacacgcaatttatgtttaaatagtctgttcactaagtaattataatttacattaaaaaaaatcttgtaaattctatttttctatatgaaaactataaatttttgaaaaaaaatgaatatagaaagccaattgagctgagagccaagaattttgtcctccagcagttgttctacttcattgtagtagtggtcaaaacaatgctcacaaacatctaaaaaatttttaagaaaggagtattttaacgaatatttccccaaaatgcatctaaaaaattatatttctttttatttatattttaaattatttattatattctttatatcttgaaaattttgtaaatttttagtttttctataagaaatttccgagttattgaaaatctcaaaaaacaccctaagatacattaaacataaagacgcaataaatatcctgtagtttttttaaatatttttgtataatattttttatttagtatcttatgtatcaaaatgaatagaaaaattaaaaataaagtttttttaaaaataattttttgaaaatgactttgcataaaaagcaatanaaaccacaatattagctntctaataattttncatatacaatgtacattantaatagtataagaaaaattatggggcgtaaaatactcaaaaatttagagctgacaccaaaaagcctgagcttaactcgagactgcgattctcagcatc

SEQ ID NO: 23829 - DNA, 1813 bp, Heterodera glycines
tggtccgatgttcagtgtccgcgcaacgatttaccatgtgatcatttgtttgttgtttattattatttaaatccgaattattgttttaattgtttggtggattttgaaaagtttaatcatttaataggcccaatatttaaatttaattaccggaattgcatcaattagtagggtgtcaaaaaagaaatgcgagaaaatccgcacggattcaaaaagtaatcaaaaatgaaaaaacttggcgtgggtttgaactttgacaagccaacacacccacttttatccactgggccatttgtcaccatgaccatttttattttaatttcctaaatttacatatttatttttccaacagttcaacgcggtgtccgagcgtgtgatgaccagcagcagttgttggccgagtgatgggcggactaatgggcgcgcattgtggaaaaatgggtaggcaaataaaacaattttatagggcgaactaaaaaaattttcaatagtattttttgtcattttacagtgcatctttcgtcgtcctgctgctgctactgcttcaacttctgctgctgctgctcttccattggctggtgccgtcgtcgctgctgctagggaccatcgccacaacaatttgtgtgtgattttggagaaaacgcgcttaaaactggacaccaccgtggaatgtgctgcggaactgtggcgcaccgccgacggcacggcacaggaagtaggacaaaaaaaattttttttaatgaaacgattttaaatttttttttcccgaattttttaaaattaatttctaatatatgaatttatgttataattagacaaaaacgaaattgcttttgatttgaatattgaaaaaagttttgagtgtgaggggttggagtaaaaaaaaaaagatttttgttagtttgtgcgtccttttttattttgttttaaattattgattgtgcaaaaaaacaggaaaaaacaaaattttaaaatatggttttcaaaaaaaatgtgttggctggcatggaaccgaacaccgccgattggggaaaaaaagctttctgtcaacacaacaaaaatttatcaaacaaaaaaaaaaatcaaaatgttttttttttaaaaacaaattcaatctgctggttctcatcttcctccccctcttcctcatccccattctcttccaccgcttctccctcctctctatctggcgccgcgtcgcccccatcagcgtcctcctcctcatcttcgtcctcctcctcctcatcatcgtcttcctcttcctcctcccccaacaaatattcggcgtctccggggtggttttgttcccacagcgaagcgccgaatatgcttaaccaaatttattttaaaaattttaaggtgtcctttggtgaacaactggaatgaacgcgtgatcggagtggtagcaaaaaccaggtgggcattgtttttgaatttcctggattaatccccttccccctcgtctgcttgagttttttttttgctcagcttgtccatttttagcagcaattttcaaaaaattgcccatttcaattattttttaaaattggttttgaggagggagctttaacaaaaatggacataccctctgagctcggcaggtccggcggtcttttctctcaccagcagctcacagagctgaattaggaagcatcattaattagcattaaatttttttttttttgtaattcacccgcaacacatccggccattcggcgtccaactcctcccgggccgttctcatggcccatctctctaaccgccgaacctccaccttaacaaatgacctcttctcctcctccccttcaatctc

SEQ ID NO: 23830 - DNA, 1577 bp, Heterodera glycines
  misc_feature (1434)..(1434): n is a, c, g, or t
  misc_feature (1463)..(1463): n is a, c, g, or t
  misc_feature (1472)..(1472): n is a, c, g, or t
  misc_feature (1509)..(1510): n is a, c, g, or t
  misc_feature (1525)..(1525): n is a, c, g, or t
tctctctttttctttctctcactctctctttctttctctctcactcttccctctctcacatcctttctccctttttcgtaatctcttatctctctcttttaacctcctcaatcactttctctttctctctctttgtctttcttctctctctctcacgctcaaatttctctgtctctgtctctctttttctctctctctctctctgtttttcactctatttttttctctctttcaatcccgctctctcatttcccttctctccctctccctctctttaactctatctctctctctttatttctcgctcaaatttctctgtctctctccctctatttttctttcactctcctttgctctctcaatctcttctctctttctctctttcagtctcgctctctcatttacttctctccctcttcttctcttaatctctctcttttcacactctctaactactttcactcctatccctctctttatctctctctctctatctctttctttttctctcaaattttctgtcttctctctctctatttttctttcactctcttgttctttctcatctcttctctctctcttttcctttctctctctctctctttcctccccttctttttatcacgctctctatcgttcattttccctcatcttttaatttctctctctctctctctccctctctcctttcttacttctctctcactgctttcttctttctcatttttttctctctctctcttgataattagagataatacggtaaacgtttttaattaatcgcgcaaattgtggttgggtgtcataaaattgattggagactaaaattgtagcagaactgcaaataaatcctaacaaatgaaaaaaggttttttaaaatgggagtaaaaattttaaaaaaatttaaaactattaaaaaaatcattaaaattacttttataatattttcgatcaattggaaatcattacaataattgaaaaaacaaaccgataataaaaaaatcggcagcaaacccaacgaactaatcaataaatgaattacttcagagattttaacatttaagtctgattttttgttaaaatgatactaaatcgacaaaagcctttgattgatcgcgaaaattatgattggtcatgtaaaagttgattgaaaataaaacaccaggagaaacgcaaccgcagcctaatataaaatcaattaatgaaaaaaggttttttaaatacataggggattatacatatttcaaaaaatcattttagtgtacacaaataatttttaaaaaatttattgtacacattcaagaccattaaaaatttgctattaaaatgattttgttcaaggaacggaatgaaacgtttgatttgacttctttatttttaacattcggaatattggaataataattcaataataagaaaagagaaatcgaattntacgggtgttgatttcgtaatggtattgnacttttgtntgtacaataataattctctttttcctcttcattctcnnttgttttgcaatgcnttcgcttcgaaaataatccattcaaagtgtgacatacatagtcacacatcaa

SEQ ID NO: 23831 - DNA, 1615 bp, Heterodera glycines
  misc_feature (22)..(22): n is a, c, g, or t
  misc_feature (35)..(35): n is a, c, g, or t
ttggcattttttgatcactatntagttaattattntgggattttttatcactaaaaatcccatctctaattatatgcgaatattttaaataatatttttttaattaaaaaataattttatttttatttttaaaagaattattaatacgtttaatttgatcacttgcacttttcctactttgtcatattacttggccaaggcacaattcgaataggaaaaccaaatatctttaagcgttttcattcgaaatcttcgtatgtatggttgcaaattatataaatttaatgtccattagttgaaaatttcaacgaggcttagaactgacaccgttttttatgcaaatccaaattatgcgctgaattgacacgaaatcccacaaaatcaaaaaaaaaaattacatttatgaagagacatttaaaacttcttcttcggccaataaatatgcatctttaaaaggcataggcactcatttttcagttaaaattttagaatgatatttatgaacccttaggaggcgaaagccacaaattctgacgggacgtatcgtgtgatcgagaagatggacgccaaatcaattgacgaaaaaatgttgaaaaaaatcatagacactgagaagggtaaaatccatgtgttacggcttgaggcgggaggtgagtgggcggaaaaaagcagaatggccatctccaaaaccaagaaatctgagttttttcaaaactcgggaattatcgggttaaatcccaaccggcacggatcaattggcaaaatgcagtcctgggaagaggaaatagacgaatggaaatagggaggaggaaccataaggacattcgttgctcagattttttgtgtctgatattcgctgcataatgaaaatgcaccctttctaagacaaaggtacagagctggccaaatccaaagtgttcaaagaccgttctgtgtgtcatcttctgttgaccatttacaacacaaatatatccaaattagaaagcttattgaattccatggagaaggaacaagggtaagcggaagagaaaatgcaaaattaaaatacaattgaaatttcgttggtgaattattaatttagttataagttgtactcgataaaggagctgaaaaacgaagaagcggacaatgaacaagttgagaaagaagaggaggaaaacgaggaggaagaaggggagaaggaagtaaacgacggactgagggaggaggaggaggcgggacggcactatgcactcagcttaatcggccaacaatgccagaagagttatggcataaaatgaaagatgaaggaaagaaaagctattcgttccttacccatattttctaccttttagcgtttaataaactcattaacaaaaatgcaacaaaaacgaaaaatgcattcctaaataaatatcaaaaatataaatccaaattaaaaaatttttctgggaaattgattaggcctatcagaaaaatgacaaaattctctatcaggaatcaaatctgttaatgaatggtccataaatttgactattttttgcttttcaaaaccgcttttttcggcgcaattttttcaaaaaactaggaacaaagggggtccggcggtgcccataggcgccgcgggaaatttttt

SEQ ID NO: 23832 - DNA, 1149 bp, Heterodera glycines
aaatgaaaaatggttacagtatgacttacagtattgttgttttcatcggtcattagagccaaaaatgattcaacaataaaatgataatttctttaataacaacagatggctagcaaattaaatattttaatttaaaaattgaaaaattgcacccctaaaaagaaaaggtattaatttttcaacaaaaaaaatgatttaaatcatcgcataaaaatagaaaaacgcctaaaatttgaaataaaatttccacatttttttgtgtaaatattttgtcggcatgagcttggcacactagtacatagagccaagaagacagctacttcagcttatttttttgctttttggtccttaatgtaatttaggaatgccatgggatataacaaatgtttgtcacctcataaaagtgcctaattagctagagtaattgtatttaagggcactttttagtaggtaacctaactatctatttattaaattgagtttttaattaatttaacacttttaacactaacaaatacgataaagctataaattcaagaatttcaattatcatgctaacgaaggtccaatgttttaaactgacggaaatggcgagacggaaaacatacattttttataattaagcagtgttaacgaacgaaattttcaaggcttaggataacaaaaatttaaagcaaaaattaaatttactatgattaaattggtagcctagtaaaataatcattgaatatcaagcttctgcgcaatctttgtcgacttaaaaaaaaaaaattctaatgcaaaatgcaaaagccccaattttcataggcgcggacagaaaaatcccgcggtcgcggatcgcgcatcgcggattcaattttcgcggatttaaaaagtcaaaattttccaactttttaaacataccttttttaaaatttccttattataaaaaaataattaaaatcccggtgcatacaaaatttgggaagggattgaatgggggggggggggggtgggtcagtgtccaaatttgcgaaggtgcttttcaaaccggtttttcggcgcgctctttccaaataaatttttgagaatagatggggatgggtccggtgtagccgattggaacctacgggaaatttttcaaaatatatatagatttatctatatatt

SEQ ID NO: 23833 - DNA, 1226 bp, Heterodera glycines
  misc_feature (1092)..(1092): n is a, c, g, or t
  misc_feature (1151)..(1151): n is a, c, g, or t
  misc_feature (1164)..(1164): n is a, c, g, or t
  misc_feature (1195)..(1195): n is a, c, g, or t
aaaaaattttttctaagaaattttacagtccccagggggttggaatatccataaacacatcatagggtaatatctagcaaaaagaaatttttttacacaaaatcctagtccagcagacagatgaagcgacttaataaatcgatatggattgcaaagagttaatttctcaactcacactagctaacacggaatttgccgcgtgtaggcgtaaaatgagccattatgaattacaatgaattacaagcgtatatcttggtccacattgagtgtgtgggcgagattaagtaattttctgaaagagctcaaaagcagctttcgaatggtgtattcaattaattgtttacttgaaaattcacagagatatgtccaaccgaatcttgaaatgaataatggcgtagtattctataaaaaattttttcttaggaattttacagtgcccagggatttgaattatccataaacacatcatagggtaaatatctagcaaaaagaaattttttttacacagaatcctagtccagcagacagatgaagcgacttaataaatcgattatggatttgcaagagttaatttctcaactcacactagctaacacggaatttgccgcgtgtaggcgtaaaatgagccattatgaattacatgaattacaagcgtatatcttggtccacattgagtgtgtgggcgagattaagtaattttctgaaagagctcaaaagcagctttcgaatggtgtattcaattaattgtttacttgaaaattcacagagatatgtccaaccgaatcttgaaatgaataatggcgtagtattctataaaaaaattttttcttaggaattttacagtgcccagggatttgaattatccataaacacatcatagggtaaatatctagcaaaaagaaattttttttacacaaaatcctagtccatcagacagatgaagcgacttaataaatcgattatggatttgcaagagttaatttctcaactcacactagctaacacggaatttgccgagtgtaggcgtaaaatgagccattatgaattacaatgaattacaagcgtatatcttggtccacattgagtgtgtgngcgagattaagtaattttctgaaagagctcaaaagcagtttcgaatggtgtattcattnaatttgttacttngaaattcacagagatatgtccaaccgaatcnttgaatgataatggcgtagtatctataaaaa

SEQ ID NO: 23834 - DNA, 1559 bp, Heterodera glycines
gacaattgcccataatgtttcatttatttcaatttataaaccaatttacaaaaattgcatttttgttcaaagacttttttccactagtgtaaatgaaatgaaagggaattgaatgaagaccgagtggttaaatgaaattgaatgaaagagggaaaaggacgcccatttaaatgatgcatcgattctctgttcctccaaatggacagagaagcagccaaaggaattagcaaaaggcagacagaagagaaagagagagagagagagagagagagagcttttcattttattgagtcttttgcggtcatagaaaagaaaaagtgcagagcaaacgaagaaatgagagaaatgctatacatggtacataagtatgtaacagacagataaaataaaatcgatttttttgaaaatgtaacccggtccagctggtttaaaaatatgtctattggaaaatcattaaaaaatggcctttcctacaaattcctaactcattttttgcccctatttgtttagtgcacattccaaagttgcaacaagaaactgcggaacaatgtgatgtttatgcatcacatttgggcccatgtggcccaacaaaagcccaccgactcggaagaacagtttaccaacatgcaggccgagcaacataacgccaacagcatcatcaccaacggcacgaacaacggcaccgacacggccaccggcgacgagcagctcagcgatgtcagccgacttcacatgtgcccagagtgtctgttggaacagcccacaccgcaccgggcgcacctccattaccaccgtaggctgatgagcaaaatatgaaaattattaaatttaaaaaagcaaaattttctagggaatccgccgaattattgttggcattatttatttggctaagaaataattgataagaaattttgggttataaattgtagatgcttttctgttttgagttccccccctcaaattttcaaatattggcgctgatcacgaatatgacctttgttttacaaatttccgaaactcggacccgactcgaaccaaaagtcgaaagtttaatgccaacttcagaaatttgtactttcgacattttgttcgagttcatggtcggggtcaggggtgggcgaaacttcgagcttcgtgcttcgaaaacttcgcgttttttgggcttcgaacttcgtgcttcgtgaaaatgctcgaaacttcgagaaaaatacacccctaaagattgagtttgaaaaatacacccttaatgattggcttatggtaaatttaaatctcattataactttttgctttgcaatcttcattacattcgtagtccagtgggttatgcttttggatccgttccttatttttcgttagatcagttcccctccaagtttttgttttaatttttcaaaaattaacattttaaatatatgacgtaagtgtagatttttaatatataggcccaaaattcgcaccttttcacccgcctggcgacgcctaccccgcccccaatttttattaaaaaataggctcaaaatcgcaaaatttttacatttttgcttaaatttttaaca

SEQ ID NO: 23835 - DNA, 1215 bp, Heterodera glycines
  misc_feature (29)..(29): n is a, c, g, or t
tgcagtcgtcgatgagcagtgtgatggcngagaacaacggcaactcgtacaacgagtacagcgtggttgatggtcaacagcagacggaagagcaccagcagtagagattgttgtgtttggaaggaaatgaaaattggcggaaaattttcgcattttttggggtaaaaacgattgatatttgtggactacggtaactgtctcgcactgttagtttactgtaactttcttccataaaaatcccaagttggtttcgcttttcttgcataaacagtgggcattttaattgttttggaagaaactttgccttttgacccttaaatgttggcacatttttcccattttaaaattaaatgggtttttgatgttttcaatgttttgttgtttcggcatttatgccgtcactcttttcgagtctctcttctctgtttttattcacataagaattggcaaatgcacccaatccaattgccgccacattttcaacgtgccaccccccgagggcgagggggaggaggagggcatttccgactgatgaacagaagacattgagtgtccccttaaatcggctgcggcattttgcctttaaaaaacaaagaaaattcattttcggcacagaatttgagacgaatttgtgaatttgttgcgaatccaaaaaatctttttcatatttcttgttttaatttatgtatattatttaattaagtgggcattttcaacataattgtgtcattttccatctccattcccagtcccataccccggggggacattgcctttctctctcttcccatgggccattttggcctgaaaagagacggcgaccgctgggcggcgttggctggatttgggtcgtagtatttcccatttctccacccacacacggtctcgattcgaccattgaaagttcgggaatgggtgggtgggagtggaggggggggggggggggatgggtgactcttttctgttattgaaatcgctttctctttattcagtcatttgatgtgaaatttaatgcattgcctttccctccccacaacaagtaccgttgtctgtcatttgatgctccttcccctgctgttgtcatgtacttcttctatgactgtcgggcccttttcccccccgcggggggtccatttgttactgggcgagtcctttgaagacgtgatgagtcattcttgaatgtcaaattaatttttgaattattctccccccccc

SEQ ID NO: 23836 - DNA, 973 bp, Heterodera glycines
  misc_feature (861)..(861): n is a, c, g, or t
  misc_feature (906)..(906): n is a, c, g, or t
  misc_feature (916)..(917): n is a, c, g, or t
  misc_feature (927)..(927): n is a, c, g, or t
atacaaaatcggatttggatattgagttcaggattccattgccagcaaaactgtgattccaatctcgaatcgcgatcccgagtcggcttttccaaaattctgggctttagattttctttggtttgaaaaaaagctaaatatttttggcattttgtctttcagggctaaatttaaattttgatgattcaacttttgtttttttttgttgttgttttttgcttttcgctttgggccttgatgggttttcataaacacaagccatttccaggcattgttttttggccgcttgggtttttttaaaaaatctttgacattatagagcatgttattttctgaaaaatgatggattttggaagtatgactgtcttacggggggaccaaacttagtatttattatctgtactttcattaattggattcaattttcggcgaaccgtttcacataacattcatttgttttttgcttattatttcgcagtttatgtatcaatttttcaattttaagccaatttattcacaaaatacatttttttttgttgccgaaatgagcacggaacgctattccttctctctcaccaccttcaggttttgtttttgaaaaatgcataatcaattctattggtcagattgttcctttataactgaaaatgtagaactcttaatgtaaataatttccgaaatagaaaaaaccgattttcatacggttttggactatggctaaattagctgcttttttcaaacattgtaataatatgcatattaatttttttccctctctcccacagtccctcggggaagttgatgcaaatagagtatgcgttgaatgccgtcaagggcagtgcgccatctgttggcaccccngaggttttttttcattactatactttcacaaaatttcttacctanaatgaaattnntgtttcattnggtttttcaaaatttgtaccacatccactatttttggtcaaaaaag

SEQ ID NO: 23837 - DNA, 1394 bp, Heterodera glycines
ataaaatcatgggcaggcaaaaaaagaaataaagatgaacaaatatggggaaattagtcagtatcacggtgagcagagacgaaggcctcattgtcagatcagcagtattaagcgtaatcataaaaaaattttaaaaaaaagtgaaagcgctgaaaatgccaggaaaacttggtacaaaaaatgcgagtcaaaaaggcaaacatctgaaatttttttaatcattattatattttaaatattgtgggggcaagaggggaggaggtggctgagaattgctgctaattttgagtcgaatttcttaattatgaagtaatttaaaattgttcccaggacgaccacaagtctcgcgcatcccaattaaatatgaaaggaacggggaataggcgaaaaagtggtgtttaaaaaggcatgtgtaaattgaaaattgaatgaattgttattgctttaatttgtacttgaaatttcttagtggggaaaatcttataaaatcggaggagacagttttccgataattaagaccgacattctatgccagaaatgctcccgaagaaaaaaaaacatttttttaaattttaaatagttaaaacgagaaagcatcatctaacatcagtgagcactactctcctttgaaaatttggtttggaaaaaaaggaaattctggaaaattttctgtgtttacgaatgcctatgctttgttggcatttaaaaataaaggaacttggcttttcgatactcaacagtgatgcttagacttattacggtactactcgatactgaacttggccgaagagagttaaaacaaaaaagcactattttttttattaatgacctccctccactcaccctgaaaaattcgttggaaaaaactcgaattttctgtgcgttcactcgagtgactgactctacgcattaaaacatcatttgtcagcaacaacaacaataaatgactgctgttgttttacatacacacggacggaaacatgggctggacaatggcaatgaatgatgatgataatggtggtggatgtgtgtgctctatttgcgcccatctcacaacgccaaattcacacgaccaccttcaaaaagtgtgcacgaaatgagcaagcaataaaagttgagggatttgggggggggggaagacggcaaagtgcgcgccgcgcatttttgaagcgaaaatttgagggttggtcggggagtggagccaatctgtgaggtgatgatggatgtaaaggatgacaaattgcatggagaaggagaggatgaggaagaaagggcatgaagaacatggaaaattgggggggggggggattccaaagccaaatgcacgacatcttcggcattcttaggaatttgtgtggggccatgtccttgaacaccattcccagcccagccat

SEQ ID NO: 23838 - DNA, 2361 bp, Heterodera glycines
  misc_feature (1726)..(1726): n is a, c, g, or t
  misc_feature (1761)..(1761): n is a, c, g, or t
aaatacccgtcaataataaaaaacattctttttaaaaaaatatccagtttgagaatatttttaaaagaaaagaaatattaccgttattgttttaatagtaattttaataatcaaaattgaccaatttggagcagagaagaaaaaattgaaacaaaagtcatttgacgaaatttttggagaaaaagggggagaaaaggaagaagaaaggcgaaatgaactcaaaaaaagagaaataattgcaaaattttataaaataaaagagaaaatcaagcaaaaaagacgaaaatacccaagaaaagaatgggataaaattgaaagaaaaatagctaagaaattggggacaaatcgaacgaaaatttataaatggatcaaagaatttggtcttcaaaaacaaataaagaaaagctataaatcaaaaactgatgaagaaaaaatagaaattatacaaaaattcattggaatggcaaatgaatataagcaaaaaagaaaatattcgccaaaagaatggcaaaaaattcattccgaaatttgcaagaaaattggagttagcctttcagtaattaagaaatggaagaaacaatttggaatgagtaaatttataacggagaaagaaaaaatggagaaaatgaaaatttattgggaaataaaaaaagaaaacccaaaaatgagtgacaaggaaattgcaaaaatgatgaaaattgatagaacgaacatttcaaaatggaagaaactgtttggataaaagaatcattgaagattgaaaggatgattataagaaaaattggataaatttgccgaaaaaattatcagaaaaactatgacaatttctagttttttttctaattttttgtatttgtattaaaaaaattattttaattaccctaaattttgaaatttttcttagtgaaaataagtgaaaacagtcaattcaaggattgggagggtatcattaaaaactgaacaatgttggaactgggctcccagtatgcctaaattttcgattttagaggccctgtaaaactccttggggttttgctagggtgaaaaataataaaaattaaaaaagcataaactaatattcaataacaaataagtttttaaaaaatgaaattgagaagcaaatgtttgggtcaaaataatctcaaaatgttgtataatttgcttaataaaatccaaaatgattagatttcactattaatgggccatttatttatttgtgaaatgatttaaaaaaaaataaattggttttctaattaaaataaactgaaaaacattacaaaactcaactgatcatcaaaaaataaaccaactcatttattcatttaaaaataagtatattttcaatgccttacaaagatttgcattcgaatcagaacaaatttaaaattcatgacatttttatattttcaataaatcaaattttcacataataaaatcaatggaaaaaattttgtttacttttctttatttaaaaaaaacatgccaagccaaatacaatacaatgatttataaaatataagaattaaccagtttttaaaacatgaataattttataagaaaatttatccatttttttcaaaaaatatttttctgttttttgttcctcaaaaatttcttctccaaatacatttcttaatcatggccaactccaatttcttcgaaatttcggcataattttggtgccattcttttcgtgttgcgcctgcaaaggtattggacggggacncaaacaaatgacaggcatttggtgccacatattgnagatcttagtaaaaaaacaaaaatcattttgagatgacaaaaatgaaattattcccgttattctttttaattattattttaattgcaaaaattggatcagaaatgaataaactgcaacaaaaatcatttgaggaaatatttggaggaaaattggaagaaaaaaggcaaataattgaaaaattctataaaataaaagagaaaataaagcaaaaaggaagaaaacacacagcaaaagaatggagtaaaattgaaagaaaaatagtgaaacaattggggacaaatcggaattacattcaaaaatggattaaacaatttgatctacaaaaattcaaattaaaattggagtaagccatggaacaattaaaaaatggaagaaacaatttggcattcgatatatgagaataacggagaaagaaaaaatgaaaatttattggcaaataaaaagagaaaatccgaaaatgagtgacaaagaaattgcaaaaattatgaaaattgatcaatcgagcgttttaaaatggagaaaaaaaattggagaggaaataaacgaaaaatgaaaatagttgtaaaatttaaaaattatggccttttgttgtctacctt

SEQ ID NO: 23839 - DNA, 1415 bp, Heterodera glycines
gcggcgtctgagaacgtcctcctccacgacgggcgggcgagcgacgactcttcgggcctgacttcttcggcgagcgactaggacgaccacgaccagcagacttcgttgacgcggtggagccgtcacgagctttctgctgaaaaaaggggaaatgaatgagtgacgacggagtaggaatgctgtccgaaaacgtcactttggctgccttttccttcgccgctttctgtgccgcaatccgtgccgagcgtcgcagtggtttggtctcgccagcgctggccgcacgtttcttcgtcttgcgactgcgagcacggcgttgtgatgttgttggcgattccgcagacattttgaacgttttgttgttgaacttgttgacggacgatgctgacgatgatgatgatgattggttgacagatggcaaaatatgtgaacgctaaatgaaatgggtgtaaacaattagaagacaaatggatggttgaaataaaatgggaaaaaactggagggaatggtttttgactcgaaaagtggccatatttatacactttttgagtgtgattttcacagaaaaaggaaaattaatgaaaatttaaaaaatcattggcgtaaaaaaacgccaatgcattcaaatggaaaacaaagtgtacctatatatgtttgataaaattcctaatcataggaaatccagttaactaatgccgggcttgaatgccaagacggggttcaaacttacattttttctatcttcgatggactaaacagctttaaataagcgattgaaagtgattttatgtggtagttttatcgtcagcaaatttttgaaaaaataattaatatttcaaacaacataattttgttcctaataactaggcattcaattatatggaaatccatattttttctggactatgggaggcctgaaacgcacgaaaaacatgtttttagcttggtttgaagcttctaggatgggtttccatatccatatttgtccatattttggcatttttatccatattttatgtccatattttggcatttttccaaaaaacctctaataaaacggccaccaaaaatttatttccatattttgcgattttggtccatattttatggccatatttcgcgattttatatccatatttttggactccctaattgatgacatggaaatgtactcattcatataaatgtatttattcggcaatggtaataaatgaccataaaacatgcataaacagggcaaacatattacaattataaaaaatacacatatatatggcatatttaaatagaacaacaaccatttgtgggagaattacattcagcaagacaatgccacagggatatggacatacaatatatacatacatatatagagatacaatttctctttttttaaatgggggttagtgttattatcg

SEQ ID NO: 23840 - DNA, 855 bp, Heterodera glycines
gagacctctctacgccccccccccccgccgccccctccctcccctcaattgaactaccttctcggccataatgattgactgtcctgcttttggaccaaccaactctcgagaaacagttaatgattgcccaaggcatttgagtgatgactcataaaaactgattgggcggggagggcaatagtaagtgattgacaaagatggttaggcagaatttatgttagaaatataaatcattgaaaaagaggacacagccaaaatggaagaatatttgtccgatcactggcgatttgagtctggcaattccaaaataagaattcactgcctttcggtgttggtcaattcaattactaagaatttgatcattttctcatcgtttgatcgcttttcgatggatttaaattcatttgtcgacgattaattgggcaaattctgttgccgatttttgcgcgtttcaaggtccttttttgcgctaagaatggaatgatcgccccgcccgtcttcttttggaaattgctcattgtcagtcggtcgagcgaatgaaattttttcgatcggcgattggcgcattttgccgaaatgtcataaatgaatttgctggacactcggacaaatgagcacaaaaaattgaatgaaaaatatgggagaaggacggacgccgaaacaaaagggtaaacttttaattaaatgaggtttaaatgcgatggaagtcgaaaatgagcagcggacagtttgatagtagggaagtggacaattggacattaacaacggacaattaagcaataagtgtcagaatgaccattttgacacgaacatttgacaattgtcatttgcagaggacaatttgtcacctttctc

SEQ ID NO: 23841 - DNA, 283 bp, Heterodera glycines
ctgaatttttctctatagttttcccggatgctcctcaaaaagttgtaagacccttccactactttcagggcgctcccggccttcggccgggagaaaatggttttagcaacgaaactccttgtcaatataacgtatatattaactagggtgaccagttggctatggtgtgaacagttttgtttctgttgctgtggggaaagcgcttcgcgctcagggacgcggcttcgccgcgtcgctagaaattgatgtaatttagcaattcatcgcagcctcaggacgggcg

SEQ ID NO: 23842 - DNA, 858 bp, Heterodera glycines
tttgtggggaacattcggccgcttcgcggcctcaggacgggcgcttcgcgcccgttttttaattttttgggggacattcggccgcttcgcggcctcaggacgggcgcttcgcgcccgtctttttatttttttggggatattcggccgcttcgcggcctcaggacgggcgctcccacccctcagaatccccaatttttggaagatttttggtgaaaaaaattttcactcaaaaatactggtcacccccctttggacccgaaacacaaaatcacttttatttctataactttttttaaaaaagtgataaaaagctaaattaaaatttataaaataaacaaaaaattgcgtattttttgagtatattatttttataaaatactttttcagaatggagttaggaatttttttttgaaaaatttaattttttaagaaattatggaataacttttttatttgaaagatagaaattccaaacaaatctcataaaattctcctaattttttgctatttttcaaaccttattacactaaatttgatcaaaaacgaagagagttatgaattttcgaaatttcactggatttcccggggcccaaatagtgacgatttttcaaaaatttgtaaccaccttccaaaaagtctgaaacgcaaaataaagcgtatatacttattcagcagctcaaattatgccataaaaatgcattttggctaatttaggtgcaaaaaaatttttcatgaaatgcaaacccatggggtcccccctttggttttgcatttaaaaattcatttttgttttataactttttttaaattcataataaaaacatgagataaagcacattagattgggcttaaaattct

SEQ ID NO: 23843 - DNA, 1729 bp, Heterodera glycines
aaacaaaaaaatcgattttttcaagtgtccgtttggggtactcaaacatttatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttcttttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaatttttttgagccagctagctcggcgctcatttcagtgtaagttagtcctttaccggggagtatccttgcaaagtttggtacgcttctgctcaattagcaaaaaatatgagtgatcgaattttcactaaaaaagttaagcctacattttttggcatatttaaaaagcaattaaaaaatttttaaaattttattcacctccattattgatagaaaaagcatcagagagccttattaacttgtaaataaaatttggtgcgtttcagaaccctttctgaaaaaatatttatgaattaattttgcaaaaaataaataaaaacgaaagactcagattttcgaaaattttttttgagccagctagctcggcgctcatttcagtgtaagttagtcctttaccggggagtatccctgcatagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtggtgggccttcgccccccccctcccacgcccttcagagcacgacaaatatttcaacaaaaattttgaaatcatgtttcccactcccttctcccaggggtattattttgtaaagtctttttttccccaataaacttttcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttcccccaataaacttgtcaaaccccatttttcgcacc

SEQ ID NO: 23844 - DNA, 1396 bp, Heterodera glycines
cggagtcgttgaaagggcaaatcggacaataaaggagcgcttgtacagatattttacaaagaaagacactcttcgatgggtcgacgtaatagacaaaataataacaaacattaacaacagtgtgaataggacattgggggccaaaccgtcttcaattaattttgaaaatgcccgtgcgctctgggaaaaattatataaggagaaggaatttaaaatttcgaaaaagaaaaaatttaaaatcggtgatatcgttcgtattaccaaggaaaagggaaaattttcaaagggatacctcccaaactttaccgaagaattgtttaaaatcgttgttgccaattcgacgacacccgattcatacaggatcgaagatttggaaggaaatttaataaaaggcatattttataaccaggaattagtgaaaacagatggatgatttttacattgtactaccttcgaacacaccgggaccagggaacagtacatcaaaattcacagttcgactccccgagactttggaattgggcacaaattggtcagtagctctctcatcaattatttacccctactcattcaccgcactcggtataaacggtcaagagtttattaaagtatgggaaaacgacagcagtgtccctactcaagtttatttaccggacatgaattttaaaaccgccgggggcctgggaaataaaattaacgaggcattcacacatcattacaaaatcaaaaaacaacgtggaaagagagaagccaaggctgaagataccaaagattcaaaaattgatgtcgcaaagagggccgcagaacgcgccgggagagacgtagaaagacattttaatcagatcaacaatatatcgaattccatccaaacccaactaaacacactacgagaaacaaatcctcaaattttagaagagcctgatataaaaatttggtttgacaaaatggttgagatgggaaccgaaattcaaacatcccgaaatgaacttaaatcttttcaataagaagtagataaagccaaaaacataacattggagcatgtgaaaaagaatgacatgaaagaagcaaagaaatcagccgacgtcgcaaagggaatcgccagacaggcaaagaccaaatatacatcaactctcgaggaatataatgataaatcggaaaagggttttagcgggatggtggttaggcttaacgaggcgctcggtgagcattttaaacgtaaggaaattgaaaataaagaagtttcagaagctgaaaaagggccgcaaaaaagagagagattagccaatgaggatgttcaatttaactacgacagtattgatccaaaatttaatgtctatctttcctctgccgtcacccatatagatttgtcaaaacacctcgcatatgttctggggtt

SEQ ID NO: 23845 - DNA, 1007 bp, Heterodera glycines
ccccgcccaacccccgccctcgcgaaaagccacccccgccccacggggctcgaaccctacttctgacggcttattttacgacttttgttgcgcattttggcatttttcattcatttttaaatgcttccattttggcatttgcccatattaaatgctgatttttggcatttttgcttgccattaaaatccggacccaattttacgacaaatgcgtagctcaatgcaactgacttaatagaaaaatgctttaccgttacactttttttcgcacttttagcccgtttttttatgttacttttttccatgtacgtcaaacgacgttcgtttatcacaaattaacaaagccgtccatgcggacggattaagagaggacggggaaagaaaaagcctatcaaaaagatttttttatgtttaaatggcacatgaaatggagaagcctcatttaatggtctttatatcaatttataaacttcgttttctcaagaaatgccatacagaaatattgtttaatgcgtgatttttcccatatattttcattttaataattttaatattataaattataacacaagttaaggcatgattttggtgccaaaattcgaagatccgttttctatatttaaaaatatcacgaaaaataatggaccaatatgaaaaaacctcattttcttgtcattaaaaagaattgtgtgaaaattgtccatatttttcaatggagcaattagcgtatttgttttatcgatgttgccatatcgtacgttttgaaaatatttgagatttttatcagttttcccgaaatataaaaaatatattttttaattttatttcctttaaaatgattttttttcccgttcaaaataggtgaacatattttgaaattttcagttttattccaatgcaactccacactgctgagctgaatgaaaatgatgaaaatggttggccaaattttcataaaaatatcatttttgaatattttaattaaatgttttatttttttatagtaa

SEQ ID NO: 23846 - DNA, 1557 bp, Heterodera glycines
tcgtgaaaaattataagggcagatttaaacatgttattcttttaaattttcgtaaaaaatagcgaaatatggaaaataactggacaaaatgtgaaaaatggaataaaaaatatggacaaaaaatgtaacttggaagcgcaaagtaagctaaaaaaatgctcatattcaaattatattgtatcagcaacccctttgtattctatttttttatttgcatttacttacgtagtgtgcactgcacaaaattgtccacttctgtccaaatatgctttactgtccaaacgcccccactgtccaggtgtctactgtccaactgtccggtctcgacacaaaatagagacgtttctaaaaattcaggtttagttagataaattttttcatttttttcgtaaaaatggcgaaatatggacgaaaatgtgaaatatgaaaaaatataccctaaaagcggagtaaaataaatttttaaaaaaatcggcttatgcagtttacgggccacaattttaattcacatttagacaaaaggcgttaaaaaatacagagcaattgaccaagaaccaatcaatacattttaaatggaccgtttcgttttattccgaaatttaatttttaaaaatgtagcccattagctgcatgtgacccaaaagtccttagcgaaatattcgtgagtacatcttataggtatgtcagcctttctggctgttttgttgttttcgatttttccaataatgaagaaatatgtgctcgctcataacacaaaaaagacgtaaacaacaaacagaaaagaaaaaaagactgaattatttattttccaaaaggaattcgtttcgataaattgtttacttttaaatgtattagttacagcgcaaaattaatatatagatagtatgaattttgcaggcttatagcccttatgcctatgccaaaatttaatgaaggcttaaaaatttctcgcccaactttttatgatcactcttgaacaacgtatatttctctctaacaaataagctgatcaatgatcaccagcaataaggggggggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaa

SEQ ID NO: 23847 - DNA, 1087 bp, Heterodera glycines
agattagactagaaaaaattgaaaattttgaaatcatgtctcactaggccttctcccaggggtattattttgtaaagtctctttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttcccaataaacttttcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttaagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattaaactaaaaaaaattgaaaatttgaaatcatgttccccccccctctcccaggggtattattttgtaaagtctttttcccaaaaaaacttttcaaaccccatttttccccccgggaaggttttttttattgaattctgaaccgttttgagtaaaaaaaactaaaaaaaattgaaaattttgaaatcatgttcccccccccttctcccaggggtattatttgtaaaattttttttcccccaaaaaatttttcaccccctttttcccccccggggtggtttttttt

SEQ ID NO: 23848 - DNA, 1528 bp, Heterodera glycines
  misc_feature (1447)..(1447): n is a, c, g, or t
  misc_feature (1455)..(1455): n is a, c, g, or t
agcagagatagtcccaggatttggcttcgagggataccgctaattgtaagaacgacgctttttttattctttgttccgctctatttcaaacaaaaagaggcccgaccttaccgataaggccgtcgagataattttactttgttgaaaaaattcaaaaagttattcattggtgcttcagcgacccgtccaaattgcactccgtgttggccaatgtgttgccctcctcgcgctgtctaattgcttttgtgctggccaatgtcgacgcgtgttgggagttaagtccgtttcggctgttccccgcttcacttgttgaacagtttcaaatcacgcacattaagtcggcatttgcaatgccaatttcaaataagtgccacttttcagattcaatccaatcgctgattctttactgacggcagcgatgaaacgcattttccgactgaccgaattaaattgggacgccgagttggccaaacaaattgtcaattgtgcgaatggtttgccctaacctcagcagattctgctcaattctctaacagaattttattggttttgcaggtgacatccgccgggcacttaacactttgcttttttcgttgatcaaaattgacagatcgaaacggattgacgctgaaaattgtctggccaaagagtcattccaacaaaaatcctctttaggtcgaccgaaacaactttctacacaaaaaccgttagaattgttccatttcattggcaaaattctttacgcaaagagaattgaagagaaaagtggtgtcaaaaataaacaaattgagcgatggaaacggacggagcaaaaattgggacaaaaggtgcaattttgccattttagcaatttgaaaaacatttttgagttgtgcgagaaatacggacgaccgatgccccccaaagatgaactgaaccaactgatcgcagcggcaccgatcggagggcaaagtgtcggagggaaatcccatagattggctctaatttaaaatgatcttcagctcattgggtttatttacgagcacgaaccgcgtttttcaccttcactttccgcattgacaaggatcaattcgactattgcctctttggacgtgattaatcgtcaatttggggtggaaaatgaacggatggcggacaaatacgcgatggaagtgagtggcatcgttcgggggagggcaccgtctcggacttcgtgtcatttgggtttctctctgcccgttgtcagattgccgtccgttcttccattttccacaattattctcctgccatcgaaagtgggtgaaaataaagggcggaacctttttctttttttctatagaagcgcacttccgtcgcactttttatcacttggaaaagccccgtttccacgaaatggacgcgcaacggcacgaccagcgaaagcgaatggcggaagggatcggcgcggaccggacggcgcaaatggagnctttgtgnccggggggggggtcttaaaagatgggaaaacatttgtgaagggttgtgccatgtgacgctctgaggtccccgg

SEQ ID NO: 23849 - DNA, 1050 bp, Heterodera glycines
ctattggaaacaaggcatttcgatgtgccaaattctcatgagctgtccaggcacgcaaccatccatcacatccctgtccataattcgcttcctgttcaccagcaattatttggggatgagcaacaacataggaaggaccaatgtaggttaacacaaaatatttgagtaattctaaaatcaggtgaaaaaaaaataataaaaaccctttcatacccaaaatttcaatttcgggagggccaatcaaattgtccatcaaaatgcacaaaaaggtgtacacttcattgattggtacaaaagccagcgattgaagtgatcgaaataaatgtcggtcatccctgttatttttgtaacggttgtacaacccagggagagtttggatgtgtttatgaattgcatttccgaggtgaaaggagcacccttgtaaaattggtctattaaatgattttttattaccggaacctgtaattattgcctggggaaatatttgccggatagcagagagttcggaggcttcaaaatcacacattactcttcccggagaccaattttgaattctgttgcgaatcgactcgaacacacgaatatacccctgcatatgtttggtaggtaaacaagcaaacacacatggaacagcgcatgcatcaaccacgacatgaatggtaaaaagctgcccaaaacccctcggtgcagtctgaaataaccaattaagctttaattttaattcatacgatccttttaaccttaaaagtcccatcaattgctatctcgttacggtaacgatcaagcatttcaattgcactttgtgttgaaaaaactatgattttacgcatttggccaccaatgttgacattttcatttgttatcacatttgcctccaaatgttgaggaatgacccattcaagtggatttatgctgtccagtccttgaaaatagccatttggggaattacatttaggcactcatgtttgggaaacgagaaattttgacgtcccattaaaaattttttacgtgatcactgatcagacactcaaaatcactatgaatatcaaa

SEQ ID NO: 23850 - DNA, 976 bp, Heterodera glycines
ttgtccatttttatcacggggccgatgtgggagataatgtaccggtccagtgattgtgttggatccggcactctttcgattatcccgttcctctcccactcattgaaaattttttggtattcttccaccaaattcaattctctcaatttctttactgtgccacaaagtcttgccctcgcttgttgaaaatttgtcggcaaatcctttactctttcgttccatggtaggccacattcatatcttccttctttgaatgtcaagccctttctgaacgttctcatcacttcttctttgccgttttcctctggattgtcgctcattccaattatgttcagcccgaaaaatgtctttatctgttcttaaatttcttcgtcagcctctcctttgttactggcacattgtaaggcacttatgagtgctccagtgtacgtcacttgcacactcatgtccattgggccctggacttggccatatccacttatcatccgcccgactcgagacgttgacaatgtgaatccacttggcaacttttctgtctcgtctcttattttcaggtcatgtctgacatccattcccaacagaatgtctggttgtcgtggtcgtgatggaagggaaagttttttcttgcttaattccacttaatccttcgaattcagcgttatgatgggcatcgctttcacaatgaattccatttcattgagtgcgcatatatatggatctccgttgactcccagaaatcctacgcggaccacattgctcacgtagcgtttggcttctttctctccgaaacccgtcaaatggcattcttccgtttcaatcaccggaaggcctaattgttttgccacattggcacggatgaatgagcgttcacttccatcatccacaaaaactgatgcgaccatgatttttttcggattgcatggattgaagatggtcacctctgctgtcctcagcagcactctcgaatttccttgca

SEQ ID NO: 23851 - DNA, 1110 bp, Heterodera glycines
atttgaggaggggacttttcgacagtaaagagtaattaagtttctaaattagaggtgtaaaatcgtaaaattttatcgaaaaagcaacaaaattaagccagatcagtattgagataaattatttttaaaatcaaaaattattaccaagaaaataaattagagtgccacgggaccgggacctggtagcggacaactgagtacaattgagtaccaaggtcccggttttgaccgggaccgggactagtctcggttttttcccggttttcccagccaaaaattcacggtttttcaacccgaaaaggtcccggtcccgggtttgcccaaaattcccggtcccgtggcactctaaaataaatagataaattttggagatcaatttttgagaaaatttttcattcttagaggtatatttttgaacacttttggggccgattcttaagagtgttttttctaaaattttcattgtaaaaaatgtaaaaatcgtatccctagtaataatgaattaacaatacattttagtatgttaatttaaaataaatttagtaaaactgacaagcaatataattcattttaactagcgggtgcgtgaaccgtcggatctgggcttgggataaagcgcttcgcgcttcttgagcttcgctacctagattagctctggttgtggagatttggaatttaaaaaaaattatctgggacttttaggccgcttcgcggcctcgaacgggcgcttcgcgcccgttataaaattctccttatttttctctattttaaatgctttattagataaaaattgtacaacattgaagtgagttatgaattttcaaatcatagcccaaaatcccaagggccatcgaaatttttcaaaaataccaccaatcgatagaaatcgaaaaacgatgttttggaagtggtctccgttttcccgggaaaaatcgttaaaaaatcataaaattcaaaaactgaaaaacctacatttaggcctaactcgaaaaattttgaaaattttcgaaattttaaaatttggaaaaatcgagctcatttagttctacaataagtctgctggccaccccccgcttattgttagagcaaagcctaatgagttattcaacg

SEQ ID NO: 23852 - DNA, 1208 bp, Heterodera glycines
  misc_feature (154)..(154): n is a, c, g, or t
  misc_feature (195)..(195): n is a, c, g, or t
  misc_feature (1150)..(1150): n is a, c, g, or t
ccccccccccccccccccccctcttttcatcgtcccccaaccattgacacttttctgtttccctttttctaaatttttctcccccatttttctttctttctttatccccacacccccttttgctgtttctgcattgcactttgtgttacacttngtgttctcttttcccgtcgaccgttcgtccgtttattcctntgccctcctcaaaaagaccaaagtccatttgtggtgatgagtcacgagagcaacatacaaaacgctcccgagaaaaaaaagttcgtgtgcctcgtggcggcgaattttttgccttttatgacgcgaggaaaggccaaatgccctgaggcaatatttgacgcaaacatcaaaggcaatttgaaaagaagcaaaatgccaacccacgagaagagggccaaaaacaaaaaggaactttttgtcgaatgaataacaaatttcgtcacaaaaatttgcccaaattgcgtgaacaaattatgaatcattaaaaaaatgcgcgaaaattcgcttaataattaatttttgcacgtgctgacgtcagtaaaatgttatgcactttttacaaaaagagaggacgaaacggagaaaggaaagaaagatggaacgaaaaatgatcaaagacgaaacgaacaaatggtattttgggaaaggtcatcggcaatgacgaaaattgtgcaacttttgaacaaattgcataaggaatagcaaagagaataaaataaataaaataaaaaaattaatttttattgaaaattatgacgaaaaaccccccgggcttaagcaaaacgcacctccgtccgttctccgatcagtttgggctgttggatcgcggcgagcatctgatcagactcactcagcacccccttgtggatggccgcgtcgaagtcgcgtctgagctttgccaccgactcttcgctgccaaacttggcactgatcggcaccagtcgatgatgagacgtctcggcaaagcacacaatgcgctcaatttcgcgtagagtctgaaagagcaacagataaaggataaatttggatggaaggtgatttattgtttgatcactgccgatcggttggctacgatcagcagtaaaaagcggcactgacttggatgatcagcgccttctctgtactcatctgctcnaactcgggcgatgaaccgccgcccccggcgtgtccgccaccgcccacgggggacgact

SEQ ID NO: 23853 - DNA, 988 bp, Heterodera glycines
cgtaaaaaattttaaatttaaaagtgtaataaaaattcacttcgatgtattttcaatagcatgacccgcaaaatgaagcgttcaatgtcgagttgcgtcagttacacccggccagcaaatatgaaatttacatctctgcatatggtggaaagggcaaggagctgcgcaagtcacgtcatgtgtgcgccactaccaagagtgattaattcgcacattttccaaaaacaattgcgggatttacatattgacatattcatacacgtttttgttgtcgctgttttaaggcttaaatttttattatttttaaccgatctcgtcttaaagttgtttgttgacatcgtttcgaacgttgcataaaagcaaaagttatgcacgtgtttttaatttttggtttaattttgaaaaattgttttttcaattaagttttttgaaagaacaatcgtttctatgcgtctttcagtgcctaatagcacaattagtgctctatttcgtaattaatctttcgagccaaaactcaaatttttggaccgaaatttgtattattatgcattatttaactctggatttggtacgagtatcgattaaatttttaggaactttgatctaattattgcgataaaaaataaataaggctatcaaccatttgcatttaatttgggcaactgccaatggaattatcccaaaaaccggcaatagtcgcccgggcaggaaggagtgcattggcgtacaaatgtccttatttggttaaggacggactatggtagtcctttgactttcaatcagggttcggatagcatatcatacgcgaaaatcttattcaaatgatttgtgttttttgccagaatgaatttctcgatttaagtgatgtgatttatatttattaaattttttttttgcttatatgcattgaagaaggatatcaaaaaagcaatttctgcattttaattcatttaacgtcataaaaaatatttgggggttttggaaaatg

SEQ ID NO: 23854 - DNA, 916 bp, Heterodera glycines
  misc_feature (825)..(825): n is a, c, g, or t
  misc_feature (852)..(852): n is a, c, g, or t
gaagaaggatatcaaaaaaccaatttctgcattaaattcatttaacgtcaataaaaaaatatttggggtttggaaaaatgagttgactgtggatgacctgcgactgcgccgtgttgtgaaaagctttctttcttcctctctttctctctctcactttgtaacatttcgaatttctttttttttgaattttgcgcccacttaaaactagggttgcaaccccgacgtcggggttggaaacatcgggggtcggggttgaccaaatcgttcggggtcgaggtcggggtttttcaatttgtaccttacctacaccatattgtcaaattttttattatttttttctgaaaaaatatttattaatttccagaataataatttatttgtttatattttttagtgaagcgttcctttttttggtttaattacccaagtttgaggtttaattacccaagtttgagattatgtcgaatttgcaacctcccaatcttttaaaaattcatggctcactccagcaaaaattatcagcaaaacgtaccgcggcacacttgacaacatcccctctatcaacaattccaacgaaacgacaacaatttttggacggcgcagcgcaattggacatcgcagcactgctaaccagcactgaagtgtctgaacccgttcgtgcagtcatttgccaactggatgcacttctcaagctcgcggtggacatgcttcatgagacgtcgacccaggacacttgcgcggtactggaggaagaccggagagaacattcggtcgttctgatgggcgtgctggaatcggacagttgcctttcctctacacggcgcncgatttctaaagaacaccaggtattgnacattctcaacgtttggacttgttgagcaatgccgaccaaggtttaccggatgggccaaagaaa

SEQ ID NO: 23855 - DNA, 1828 bp, Heterodera glycines
atccgaagatgataataaagctctccaaatttgtccggttccactttgctccgacgaaattgagctgaaagaattcgagtaaaacaaaatcatccgattgaccatggccgttgcagattcgcaggcgctaagcacaacttcatggccctcacaaatgaattcaaaatcgccatcggagtcgtgatttttggcagtttggtacgccagcagaatccttgcctgaaagacccccccctggacatatttattcacctctaaaatccgtccattggcacaattttttcttactcctttcaatctcgcttgaattgcggcatcttcctcccaaaattcaaccaaatcaacaaacttacgtttgttgtcaagaaaatgttcaaaagtggcaacaactgtccttccgttattgtccaaaatgtggagagttgtctcaatggcgaactcttccatttttatccgatttttaaggaaacaagacgacaatgccgctgcgatgcctttttcagctaaatgaatgtcagttgcggcactgaaggggaattggaacttgggaagggtttcaaattggcctatgagaaatgattttctgatccgaagctttgtcgtgtttggccggcaatatgaagagtccaaactgtccaattgctaagtccggtggtcgatcaatttgaacggttgtggcaaaaatcaatgcgccaatttggagttgctggtgatcgcgtaacgacaattggtgcggatagagccgttgacagacctcaaaaccggggaccgcaaattcaacgtaaaccaaccggttcccttgtttgggatttgttcgaatgtcggaaatgatgctgacgtccttatccgttcgtgacattgtcacttgggcaattgaagtcgcttcggcttcggcgttgatccgttttgaatttgaaatccaatcacggccaacgtttcccaaatttcacttaataaatcattagccacaaagacgaatcccggtctttcgtcttgaccgaaaggaatcacaatgactccgtcctcccaaatttggcaaactaccattttcttaccaccaccgaaattttcctcttcatctgaatcgcgagaatttttctttgaaaattgcccattctcgcctttatccacttcctcattttcaatttcgacttggtcagagtttgacattggatttgggtccatttgggcttccacactcagaactgatgacccgagggccttttcatctccttccacttccatctctccagcattcgccttttcagaagaatcttgaggccctttctcgaccgattcatcatcctgttgggaaatccccaattagcgcccccatggtttcaagcggactcacaattttggcaacaatttctacattcgtttggtcattttcgcccgaatgattgggcaaattcgcctccctctttcaaaactgtcgacccgagggccttttcaatggactccgctgttatgggcacagacttaaattattttcattttttttttgaattttcgttcacctctccggcatttgtgtcttcaagaagacgatcaatcgagtcaggagaaagtgccaacatagcgccgttgtttttgggtgaaagtgccaaaagggattccatctgctgatcaacaagatgagcagtggcagtgcctccggcggctctcgagtccaattcctcatcagaggtcaaatcctcgtactgaatggccgcggccggtggttcgatagacgggggaggagcaggaggaaggtcaggaccaactttgtcctttttcgcctttttatactttttgggcattttgaaatgtttgcttaatttaactt

SEQ ID NO: 23856 - DNA, 2438 bp, Heterodera glycines
  misc_feature (2403)..(2403): n is a, c, g, or t
  misc_feature (2408)..(2408): n is a, c, g, or t
tagaaaaattttttcatttcttagggtctatttttgacattttagtgtcgattcataggggtaatattttttcgaaatttttttaagtcgattcttaggggtatattttttcgaaatttttttgggtcgattcttaggggtgtatttttcgttttttattgcatttttgttaataaattctggacaaaacgccaaaataagggcaaaaacttattttaagggcgaacatccaaaataaggatttttaagtgcgaacatcaaaaataaggatttctaaggtcgaataagggcgtgaaaacgcaaattttcagacaaaaaatgtgtttttcgtgtatttctcgttgagttaaagccgcagaaaaaataagtaaaaacttagaaatcccatccctagtaattagtaattactaattagttgattttaaattcatatctgtcgttttttggaatcgaatgtctccctcaactaacaccgacttagtcacgccaaattatattgctgaaattgttggagttaatgagactgtcgccccacaacagcaattgaatttgctggtggaagatgcgctggactgggcccactgctttggccttgtgttacgtacaacggaccataaagaccggtttgcctgcaataattcagcatgttttactctgcccattcttctctaaacaaattttactttttgagtgtttttcaattttaggagcgatgtttgccaagcggctccatttgcgcttttcccatcgcctttcccgcgtaatctttttgacgaagcaatggcggtccaaaaggtcttaaaacatttataaattgatttaacgcaaatcagcatctttcaggatttgaacttgttgtattttcgtatctcgtgggacttggaatttctgaaggaagcacaccaacacgtgatcccttccgatgcattcactcgaaaaatgctcgaaattttggaggatgtgcacagcggtggtgtcaaacagcatatcactctgctcacacaacgcgcggttaattattagcaattggaggggtaaatcaatttttttgcggttttctactcttattgttaggcatttcaattttgcatgtgtttaccatcacatgtacctacatttattcatccatttatgtttttaaggattacatgtgccatgtaacaacaattgatgaccaaacagagacagcgaggcaacagcaattcgagcttaagcaggttctatctgttgtaaaaatctccgcctttaacaatttgtgttttttttcagattgaggtgaataacatagccgttagtatgggcggattggctcagcgtgcttccgttcttcatcgacgcatgttacaaaaaaccagcaaaacgagagtaattgaaaaaattgactcagttttgcctgaaaatcgaccaattgacacactgactgaaggcattcataacgcttggttggacctgttgttttttcatcagtaaaacaaaaattaataatttggcgttatttgtttaggaaacaatttggcgacccaaatgcaattcttttggttgttgtgggcgaagtgaaccaaaaccaattcgatcaacgatttgtggaatatgaaatggagcaaaaaacgacgggacaaatcaaaattgttcgtctcacacttacgcaatgttcgcaaaagtaaaacaaaaggcaaaaacaaatcggaaatcaactaaactaacaataagcatttttcaaattacaggctgaaacttgacccaaaggagtacactcttcatttggacgcccttaaagtcgcggttgtctatttccgggctggttatgcacctgaggattatccaacccaaacggaatgggaggcgagacggaccatcgaacgatcgacggctattgtattaacccaacgcaacgtttaatcttctttcataaacaacagacattcagaaatgcccatggattggtcttcaagtggcaaacacaaaaaaagtccaacaagttggtggattgttttttgtttgtttttttcgaaatttaaatttcaggttcttgatactcccggtgctgtcgaacgttttttcaagggaccagccgatgaacagaaagtggccgcaattcgtcatgtcttcgcaaaaatgtggggattggatcgtgacgatgctgaaacaaacaaagttatgcaagtgagaatttacactttcagtgtctgttatcagtcagttttcgtcttacaaaggatgccattaccagtccccagcgttatgtgttgaagcctcaacttgagggcggaggcggtaaccattttggggaggaaattgtgagcaaattgcgcactttgactcccgctgaacgggctgctttcattttgatggaaaagatacagccactggtagtaaaggtaggcgtttttgactaattcttgnagagnttaaaaaagcgttattttaaaataaaaaaa

SEQ ID NO: 23857 - DNA, 2595 bp, Heterodera glycines
  misc_feature (842)..(842): n is a, c, g, or t
aaagaattcgtttatgaaggtttgttgttacttcagaacatttaaggccaccaattgcagtgccattcacttcaatcttaatttaaattataaaaaattaaaaaattattagtgtaattaattacctgttttaattcatgaattttagagtcttcattctcgttgtcattcttttcacaaagcatataatccttaatggttttttaaattatctttactaaattttaaacaatttttcatttatttctaaattatttattttttataaatttactgctcgttggaaaagcaaagtgagtggttgtttaatgccatcagaatgaacttgatccattatgtcaaaagctgatgatataatttcgtcatgcccaattaggccttggtaaacttcccgcaaaaattcgtaatcgcgcattattcggaaatacaacaaattaaatgcctaaaaataaagaatactttcgaatctgcattggccattaaattttgattttttcgaacttttttgtattcaaatgcattcaaaaacctcctaaaaatgtgccttatttgaactgcaaccagtgataaattaattgctcgtgtgttttaggtagggcccggatttttatgcaggtttagctcgtttgaaatgcacgaaaaacaaattttttgttcaaaaattttgagttttatcgattttattcgaccttaggaatccttattttgagtgttcacccttaaaataagtttttgcccacattttggcgttttgtcctaagaagcgactcaaaaaaaattagaaaaatatattcctaagaatcgaccctacaattttcaaaaatagacacataagagatganaaattttcataaaattttagtctcccaaatttatttttgctcctctgacatgttgcgacgtgaaaacgatctttttccgtttacaaatcatttttagccgacaatcgtatgtcttttactcccgaaaaaattgaaatgtatctcatttgtaactgcaatcagtgaataattctttttggaaaattgttttgttttccaaaattcagttcttgtaaacaaaaaaatgcattgaattatcaaaaattttaaatatttttttatgaaaaattattaaatcgtttaaaaaatgaagggcttattgaataagttatgttaataattaaaattataataaataaataaatatattactgtttgagcattgtacgcttgatcaaaatatgttccagaaaatggcgacggaaaaagcgtaaatggtgccacttgtaacatagcactaaatgaatgaagcttagttgccctttcacatttcaaaaaaccattggagttagccgagtggaatccaggctttctcctaatcaaattctcgatcccattatttccaatccttagtttttattataactaaatggaaattatttgtcttaatgcgaatttcaaaaatatgactcaatatatttcaaatgttgaaattcagaacaaaatcttacaaaaattttaacaaaaaacccaatctcgagttcgatcaaccttacctttgatcaaaaagtttaatcttaagtcccatattttctgcccatcgtttcacttcatcaattagcttctcagtttgaaatgtgtttaattgtttttctatgtcgcccatataagcatttaccgtatattttccttaagttaagcaatttttgtatgataaaaataaataatttatttaagaaaattgtgttggttttttaacactgattaattaataagccataaggcaaatcacacaaaataaatttacacattgttaacgatattttccgtaacaaattgtgaaatactttattgttacggaaaataataattaaaaataaattaatattatggactttaattaaatttttattcgataatcacctgaacttgacgaactaatgtactttccagcggattcatttttgggaggtgccgagtccaaaaaacgaatacccaaaattaaaatcaaaagaatttgtggaaaaacattttcaatattcatattttctaaaatgttgaataaaggtaggaattttaagtacgaataattttttttttaattcttaaaaacaatctaataaatagggcccggatttttatgtttttacatattttttttgcggcttagttatggcgagagaagcccaaaaatagcattatctccgaacaatttttgatttagagcgacttataaaaacataaaaacacatattttggcgttttgtcacataaaatatgttagcacatattttggagtttggcacatattttgcacatattttggcatttttgagaaaaattgcaataaaaatacaagaaaattgaaaaatacaccccctaaaaatcgacttttttcctaattattaacataattttcaaattaaaaaattttttctcgattgtagaaactaatgaaatctcgaattcattaattcgtcattggatttcgaagttctctgctggaactttcaatttatagaaatgatttatcaaaaaaagacaattttaccccaaacacttcgaaatgtatttgatttgcgttgtatgggctaaaaatgataaagaatgagat

SEQ ID NO: 23858 - DNA, 1024 bp, Heterodera glycines
gaaaagcctacggattggcattggccaaaagcgaatttgaaatggcacttaactcagagacccacaaatacgcaacgtaagcaactgctttacgttttgtgaccagcaaagtgtcggttaatttgtcataaaatcgaatgcattcgtattcttcacaagcgaaagacctttcattacgaatggaggggaaaaggaaaaataaagtcgaacaattggaaagtgataatcagtaagtaatcagaaaagaaattgtgaatgattcaatcaatgaaaaactcaccggacagttcgcatcgttgagagaacctatgcgatgagtgaatgaaaagccagcctttttgggacatccccaattcccatgccatccccaattcaatgggtcccatgccatctccaattcccatgccatccccaattcaatgggtcccatgccatctccaattcccatgccatccccaattcaatgggtcccatgccatccccaattcccatgccatccccaattcaatgggtcccatgccatctccaattcccatgccatccccaattcaatgggtcccatgccatctccaattcccgtgcgatccccaattccatttgctgttccctttcagccgacctcttccgccacatcgttggaataagcaaccgcgtcttgagccttttcactcagaaactaaacagacaaatgtccaaaatttggagtgccttctaacatcgtaataaatgccaaagattttcgaggcgaccaaaatgattggaacgacaataaaagggacgagagaaaggcgccagcagagagtcatcataaaaagcatcgaaccgcccatttggacagtgttacgcagaaagactgaagcgacgacgcacagtttgttgaaaagaaagcacaaacaactgactgttcacgttaagagcgattgtatccgacctaaaggagggacggatactgtagtacggtaggatacggtacgcacattgtggtcgtatccgcggtcagtcgcgaagtaatttcgcctgtaaa

SEQ ID NO: 23859 - DNA, 1068 bp, Heterodera glycines
tcaaaagaagagatagtcattttcttgggatatagataaattaaaaaattctctgtgaaattaaatggcgattgcgcaccgccccttcctatcatgctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgtgaaattaaatggcgattgcgcaccgccctccctctcacgctcgagagcatttgtaacgtataaaatttctcaaaataagagatagtcatttttcttggatataagataaatttaaaaattctctgtgaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgcccttcctatcatgctcgagagcatttgtaacgtataaaatttctcaaaataagagatagtcatttttcttggatataagataaatttaaaaattctctgagaaattaaatggcgattgcgcaccgcacttcctatcatgctcgagagcatttgtaacgtataaaatttctcaaaataagagatagtcatttttcttgggatataagataaatttaaaattctctgagaa

SEQ ID NO: 23860 - DNA, 914 bp, Heterodera glycines
tttgtaaaacaaaagggtcccccctttgtttcaaaaagacccactttccatatagcgccaaatttttttcttttttgaaatttttctgaaaattataataacacttttcggggggtgtttggaggcattgagtacaaatcccatccttttttcgtgaattccggaccccgaatcctaattcgaacatttttctaaaattatttaaaaatttttaaatttctctaaaaacatggttcttagtgttttccgggtcgctgatcacgaacctgacattcattttgaccaataaaaaaaatttcgtgataaatgaaagacatgattgctaaaggatggacttctttttttgaaaattagcatttgaacagcactggcgccggtgccgcgttgacagccgctgccgcactcactgacacttcgacgcccatcggcgcggttgtgtcgcgtggcggtcgtcccgaccttgcaatgaatgtgttggatcgcgtgtgcgcgccaacgcttctcctcgtgggcggcttggacggccaagtgatcggaatgaatgaacgcgcgttgaacgcattggtcaactgcaagcataagaaactgcacattgtgccaggggcaagtaggttttgttccaactaaaaaataggaaacaccggagagctcgtaacgagaatatgcgacatgccgatttttgacaatttttaggccgttgaaattccgattgccaaaatggtcgatgaaaataagaaaaattcggcaattttagtgaaaatttgttaacaaatttcgactaaactttcaaaaaaatttcccctgcggcggtaaaattaaaaatttgactaaaatccacaaaattggtcttttttagctcagattacgtttctcaaaatttcttcggcagcgcctgtcggtcaccgacaaactaa

SEQ ID NO: 23861 - DNA, 1028 bp, Heterodera glycines
gcagcccttcctattataggtagaggcttggattttttttattttttagaaaacacttcaacttagccccctcacagcgaacattttttgattcgggttttagaaaaaaagttacgggcctcgaactgcgagcaaaaacgggaaataagcccctggtactcagttggacaccggaccggaaaatccttatttttcccggatgcgccgtctcaagttacatacctatgccaaatttaagcccggcacctattcccgttcccgagattttggttttagcaacgaaaccccttacctatataaccagggctcccagatctgaggatttatcctcattttgtggctttttgataggtcaatgaggatttttttggaaaatgaggatttgaggatttttgtggctttttgagaaattttgaggatttttgaggcttttggggaaaatccccaaaattttttaaattttgataaattggcataatgtttacaattatttaataatttgggtttttaatagagcatcaaaacgaaaatctcacccaaattttcaaaaaaaatttttctaaattttttataaaaacaagaaaagaaccaattttttcaaaaaaaatacaaaattaataattttttatgaaaatctgttaaaaaaaataaggtcaaaattctcaatttatcccctggcggcgcctgtcggcaccgccagcctttaaaagtcctttattttctataaaatttgctcaaaatcacaaaatttggcatttttgtggacaaatctgttaacaaatcgcattagacgtgttttgaataaattttgtaaaaatgaggctttttgacccaaaatgaggcttttttgcctgccaaatgaggcttttgaaaattttgatctggtagccctgtatataacgtatatataactagcgggtgcatgaaccgttggcattttagctgggaaaaagcgcttcgcgctttgggagcttcgctacctagataagctatgggttgtggagtaattgttggtccagaagatattt

SEQ ID NO: 23862 - DNA, 1737 bp, Heterodera glycines
agccattcctcttcctttaccgatcattacgttactcacccagagttttgcatgtgagaagaaatcaactttttgaacctttatgaatttatgcgaaaaattcccaaccctgtcacttttttccattgcccagtttatttgagaaattttttaagtttcttgttttaattaagaagcaactcttcttttaaagttttattactttatatgattatttcaatgtattttttgtttttatatttttaatgaacattcatatattgtatctatctatctagcatcatttaacatcgctttatccctatttgagaattcggattttaaggcaaatttatttttcagctaacttaggctatcacaaaaaatctgattccctatcagtgataaggaaaattttaagaagaactcagtccattaaacccttttaaacatcgggagtgccaaagtcgacactggatgactcaatgctgcattcatctgtccctcggcgccatttgaacagcccattcagtccccagctaaataattcggcagaataattacaaaattttgacaatttttacttagtgccccaagaattgacgccaagccaatacttgaccagctcgcctttgtccgtgctttcctcgccccatccgattagtttcattgcatgtcctccaatcggttttgtatcgttcttgtgctgataatgattttatgataacatgtattaattttaaatagaattcggaatttaaaccgtttttaacaaaactgttaaattgagaatttttaaatttatttttttttaattgtcatattacttcatatacgctgttggtgcctttgacgacggtatgctaaaaattcaatttcattattaataagattctaaatgcatgataattagggcttatatttatagttgcaaaaactgtaaaatagctaatttttagtttctaaaaaaaccccaaaaggtgctaaaaatggaaaaatagttgctaaaactttcaaattgatgggtgaaaatcgtgaattttatccaaaaccaaaaaaaaaggtgaaatacataagtttttagaaaatttgtcaataaataaataattaaattttagagtgtattttcgtttttattgcatttttgttttaaaatgtgggcaaaacgccaaaataaaaacatgttttccgtttcatatcatagggatgaaaaaactatgaatataagccctaatgataatgcattttttagcattgtttctttttttaaatacctatgctcacgaatctaatttaccgcatcaactgaccagatttttaaacattttattggcaattatacgtataaccattttattccccatatcttaaacccttagattacattttttcattctctcaaaaaaccgtgtcggtattagaccttcccgttcaaaaattatggcaataaaaatttaatggaagtcttcaaattcccaaaatcatatgtgtcaaaaaaacctcgtgaaaaatgacccccacacaaatatccagctggcttacaatggcgttttgactataaaaacggggcggaattaatgacctgggtttttttttgaactatacaattaactgtataataggttgcttttttttgccatttctgtatgtagacctttccttcaattcacataaaatattgtcttaccacataaacattgattcgattgctgctttcaccaatagttgtaaatatcatcatatgcatttacactaatt

SEQ ID NO: 23863 - DNA, 1844 bp, Heterodera glycines
cacatgacgcgttgatctgcgcaataagtgacgacacctctacaccagggttgctgtcgaattttgaaacactcgtagcgacctacgaacagcgagcgggtttcagcaaaaaggcttttgaggtgcgaaatggtgtcattccaattcacttggtccggctgtgtggggctgatcgtgtcccggtatttgttgtactcctcctctccaagtttgccgagaaggagtcgcacttttgaggcctcaggcagagtgcttccgtcgtcctcgatcaattttccgtaccgtttgaaccaactttcaaatgtggtgccgacctccggattgtaattgaatgctgaaagccgagcatcaatagagcttgccaaattggcattgctcaaatttgctggtgcggcgttttgcggtgcggcatttgtgaccatttgttgcagtgcattaagcaattgttgaagctgttgcgcgtccatggtccaattgaagaaaaactgcacacggcagactttaatctcacacggagagaaaagttttgttttttttttgatctgcgaaaattagaaatcaacacgagatttctaattttccaacacgagcaatatcagcacgagataaagcttgaattgttgctttgccggtgatgtgcagttaattgctgactgcgccaaaatttgttatgtccgaagataacaaattaaataagtttatttgccgaagaaaataaaataataaataaatgcagagaatataaattgggaggtcaaaattggtgggcacaatgaacaattgaaatgaggggaatcggagggggaagatgacgaagtggcgttgggtcatacacctaatcaataattacttccttctctaacaattttcatttgtccgacccaatttggaacattctgagtcgtatcaatacattttatcgcaaatttttcatgaataaaaagcaaaacagtgcaacgaatgagcaacttttgtttaggatttgtttagaaaaaaattctttttttcaaaaataaatttcagataccaattttgttatagttggagatgaagaaacttatggctgatcaaaataaacaattgaaaaatgacggatgggggtcgttttggcgcccacgttttggcgcgaagccaaaaattaaaaaaggtaaaaatttgatcaaaaattttacaaaaaaagtgaaaaacttttaccttccaatgggtttttcaaattttcaccctagaattttttttcaaacttcccgattttgactgtgttttatgggtgtagattagagatcaacatgtacctggatccagccctgtatttttcctggatccaggtacaggcacaggccatttttcggcaacctggatttttcctgtacatttattttcctgtacttatgtacagaaaaaataggtacaggccattttttgaaacaggtacaactacggttttttcaaaatgttgatctctagtgtagatcaacatgaaggagtgatatgatcaacttgctgtgaacattttgttggtcaacatgaaaaattgacttatttgttagcaagaattttttcaaatttttctcttcgctatgcttctaaaaatgtcaaaacattttgaatatttttcaactcttaaattttttggtctaaatttcaaaagagttgataaacataaccttcacggtatatttaataaataatagtcactatccctaaatcagaatctggtaaatcattttctcagatttggaccctccatattaaaacatttgataaaccaaaacagatagaaggcctgatctaatatgttcaaaaattgtatttcatttaaatcaagtccgggcttcgcaattgtc

SEQ ID NO: 23864 - DNA, 1063 bp, Heterodera glycines
tgaaatttttaattaccgtgatccgaattttcattaaccattggagaaacataatggactagacactacaccattctattttatgtgttatattaaatttttaggcctcataacttggcccagcggctcagtccctcattcataccggtgcttatttggctctattctcgtttacgcgttcgatcagtgactaagctaaaaatgatgaaattttggtttcttattataattttttcttaatgcaaatatttgctcttttcttgtgtttataaattccctagactttatttaagctttcgattgatattaagaatatatgggtgtgcctcgttccaaggctttgagacccagaaatgattatttaaatttgtcaagcagctaggggaaattggtttctaattaaatcagtaagaaaatattcaaaatttttgtaaatttgaattttaaggtcaagagtgtgagtgttagtcatataaaattgacaaaatacgtagttaaaaactgcccggtcgaataatgattaaaaatgacaaatctgtcgatctacaatatccttgaccattttctttaataattttttgcattttcatttttaaggcatatttattgaccttacggacattttcggacaatatcgggtaaaaataaaaaaatatcgaataatagcaagaaaataaaaaatctaagaaatttataacggacatttttcattagacctaaagaaattttgatcataaaaaattctgatcaaaactttctcagaaccaaccgaataataaagcttgctattattcgatagccctacgtgtcctctattagcctgcaaaatttcaaaaaattttattgagcttaaaaaaagttatggccaaaaatgtgtgaaaacccggtgcctttcgtacttttggccatatctttgctgaacttgaccaaatttattgaaaatttagatgaacttgtagagaaatgttagggctatcgaaagaaccaagaatgcctaaatttggttgaccttgacaaaagttatgagaagttttttgtgaaaatttccatttgatgggttttt

SEQ ID NO: 23865 - DNA, 751 bp, Heterodera glycines
gacactgcggcgtgaagcagggacggacgtggtctcccacctgcacacttcgcactccctcccccaccgattcgacaacccccgcggcctcgtggcccaaaatggagggggaaatgccctcagggtctcttccgctgagagtctgaaatatcggcaaagataattaccacagaataaaacaaaacagcaaactagcacctagtttttatataacgattcagcacctgaattccatccttcaactgcttttttccatcgaccgttccaacattggttttcgaattctgcggggcatctgatgagcaacctcttcgtattgccgaagacacagaagttcatcgtttcagtttatcagcgcgaatgactcgtcaaagttgaagccaagcccaagcatagccagatatttggctttctggttgcttttttgaaacgcttaaattgagttgttcttaatacttgatataaccgtttccagtgaaccggtcgaattaattttaatgtacgtattaagtaagaaaatattaagctataaaaaggcagaatgcaaatagattacaattttttcaaaaagaataagatactttgaaactagagtaaaatcatctccggcatcagaaatctccagagcattgcgcaggcttctatccattgcaggttttcgcagacatcaagaaataaaagaataatccttcttagcgtctcgagtgattccatcgagaccaaaattccggtgatttttttcgttttcatt

SEQ ID NO: 23866 - DNA, 1549 bp, Heterodera glycines
gggctttataaaaaaaagcaacaacaatgaatttgagttaaatgtgctgaatgcagtaagaatattaagtgcaagcaaggcaacacctccaatgcgataaaccaccttaaatcaaaacacaaaacagcgaatatgaggcgaaatatgaagatttgttgaagcataagcgaggttagaaagggacaatcgaaacacccttggtcttaggaagtggcacgttatattaaatgtgcatatgcattggtttttttaaaatttttaagagggtctttcatcattcgacaaaaaagtaattcattggatcgcatgcacccaatcatctttctccgatatcaacaacccgacaacaatcgcactatttatggcaaaccatccgttgcaaaaattgaaggatgtgtcaatttatcgtaaaaaattcttccaatggtctacagaatggtcaaatcaacggtccaaaacgtcggatatttggtctgacacttcaaacgcattcataaagttgtgttttcaatttctttcaatttttttcgtcaaacaatttagtcttacggcacacggaatcagcaaaatatttgtcagaaaatcatttgtactgtctgcggcccacacggaaaacattgtcgtacgcggtgcgttagacagaaatgagctgtaaaaaagcttcttgctaaatgccgccgcattgttgggcactataaacattcaccattggctacaagcattttgaaaagaattcaaaaggatttgggcatctcagttcatacacttttacaggttgtactcccaaatgtacattcaatccaacgcataatttttaataaattaaggacacgccaactcgatggaacgcggcatatcttatgatgcgccgaattgaggagcaacaagaagcattggcacattacgcaattcaaaatcgaaaatttgattttacatttgatggcactgaaagcaatttgatgaataaacttctgaaagttttggatccaatggagcaattaagcagattattctgcctaggaacgtcttcaatttccgttaagtacccgttcacaaaattaacaattcaaaatctggaacaaatggagtttgaaaaccacgacgtaagcgaaatacgggatcaaattgtcgatggattgaagacaaaaatttttggctgtaaagatgaaaggtctaaatagttaacggaattcttagttaatttttttcttagggatcatcaaattgcaatgtttctcgatccgagatttaaagacaaagtttctgactttccggatcttttacggtaaacattgaatacaatcacaacatcacaacaaaattttttgtattactcagacgccaaatttgttcacaactcgaatcattaagggagaaacaattcagtgaggaggtccttccgttgtcaaattctcctatttctaaaaagccgaagggattgcttgatttttttgatcatacgctgtcagcatcgtcagtagtcgagacaaactcacgtaaaaaaaccaattttttttcatttaaattttgagttatagaagagcgaaat

SEQ ID NO: 23867 - DNA, 1583 bp, Heterodera glycines
cattcccattattacattatgaagtgaatgaatgttgtgaccattcttccaaaagccgtgaagaatgacagaaattaaaatcaacaaaggaagaaagagaaaaaggaaagcattggaaaaaacgaaagaaaaatgcaataaaaatgaagggcccaccgcttccaatgcttgcggaatgccaccagcgaaagggtaatcgaacgccgcggcaccaaacggcgcgaaggcacttccccccgtcatcgcttctcccatgccctccgggcagtgctccttcaaaaagtattctttcggatcattgacttctcccccgccccgtacttcggcatccgacatataatctgccggaaaccagccgaagcgaccatccaacttggaaaattccataattacaacgaattaacagagtttagaaccattagattgattgattgacccgcttttcatcatttccttttggcccacctttccaaaaagccattggccgccgatcgaaggcatttccgagtgtggttggtcgatcagctgaatgtaatcccccgcctcgaaactgagaatgttgggctggcgagtgccgtaggaggaaactgcaaccacaaaacgacgccgctaaacgaataattagttaattgctttctccaaccgctgtctctttttttattatgtccctctcatttttttacctttgccccaccgatcacaaagttctcgatcagttttttgacgatggccatttgttgtccactgatcagaatggcaatgttttggcgagtgactattcgcaatgcgttatcgccattctcaagcacaaattcggcaatgtcacaccactcgaagtgatcctggatggtcattttcagctcctcgttgtttacattgggactcgaatggacggagatcagtcggatgccggactcggaaatgcccaaaagctgagcaaaactgacaaaacaaaagaacggagtgactgtttggtcaagcaactgaactcaccgcccacttggtctttcctcaacgacggggaaaaaccggcaaaagtaaagaggccatttgcggacgatgtcgatcagttccaactttacatttgctgggattgtcgcgggtttgtccaaagcatttggcggaacattgaaactgcctgtgggtttttacgtttttttttgaatttgccgcccttttccaatttgacaaacgaagcaattgttgaacagcttcacgctcgtaccgacgaattcgaagctgtcccacctgacgacgacagtcgcggatgatctgaaggaaagcgaacgatcatttggcaacaaagagaatggcctgacctgggcaaaaaccagatcaacctcagaagcatcgtctaacacttcgcccggcacgaacaaatcacggcacagaaccaaactcaaaattaaagtgaaaatgatcaatgttatttagactttattgccctttcctttggctctctctctcttctctctctctcttctctctctatctctgtgtatctcttcctcctctccctccctctctctacctctccctatctctctctcttctctctctcttctctctctctctatctccct

SEQ ID NO: 23868 - DNA, 962 bp, Heterodera glycines
tacccccgatgctaatccttccgcagaccctcttcaaaatttttccattaccgcaagagttgcggaaatggtgaattattctcagaaaaatggctatctctttttaggacaattttctatctcgtacccccgatgctaatccgttccgcagagcctcttcaaaattttttccattaccgcaagagctgcggaaattgtgaattaattctcagaaaaatggctatctctttttaggataattttctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaatttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagttgcggaaattgtgaa

SEQ ID NO: 23869 - DNA, 1509 bp, Heterodera glycines
  misc_feature (1428)..(1428): n is a, c, g, or t
aaaaattcccggtcccgtgcaactctaatttttatcagccggggcccaactctgttcgagtccggccgaaatatgtgtgcaaaaaaatattgaaatccacataaatccgtgtcctagcaattaaaatcgcttaaatcaatattaaaatttgatgaagaaagatcaaacctgaatgctcaggttggttgtaatttgccggttaatttgtttccttcgagttcagtttttgtccaaatttttatgagcaaggccattttgtagccacaaataattattaatgtataagaaattaaattttcaacaaaactaatcccaaacgcaatttgaatgggaaaataatccttaaaaatatttaatattttattttaatttttcaaaaactctcacatttctttcacaatatatcaaaaaatcgctgatattagcatccaaaatttgttccatttgcttcatttcttcttcattaagcaatttaaatatttttataaacaatttcttttttaaaataaaaaattttaaaaggccgagaaaagtgagggcctcaattaaaaatgtttctaaattattattgtcaggaacgacaaaattattaactaaatttgcggtagagttttttgttggcatttactgccgtcatgttatttgctgaggagttttaagcatttgcggcgcatttttcaagtataaaagaattttatcagaaaaattgaccattttttgttcctgaacaccttgaaatgtatttggtttgttattgtgcgggcgaaaaaaaagaaagagcatttttgagacttttattgaatttagttttttttcaaattatttaaataattttatttttattataacattttaacataattttcgatcaattgttttttttacaaatgcttttttcatcaactagccaatattaacaacaacaatatttacatttacgtgaattactcaaaaccaattaattgttcattatttttattccgcacttaattgttagtcaatttgttttggtccactgcttcacatatactgcttgaaaagggtgggataattttcataattaaattcaaagcgccgcccaatattttcaaattaattaaaaattttataaatgattagtagtattaggacagaaatcttggccccccccctgggaagagagatgcgcattcactataggagagaggagagaaacagagaaaaagagtaatttctaaaagaaggaaaaatgattaaattgtaaagggatccccgaccatagttgtaatacaaaaaacccccagcctaatgatattctcgggtatgttttgcgccactgcgcgagtgttcagccgtttttttgcttttgtgtccccagttaatagatatcaacggaaattatcgatttgtaatttcaagaaaaatgatttggaataaacccccctcggntgttttgtccacataattttagtgcgggaaataaatgactatgaaaatgcccgaataatgattttgattattatttttttt

SEQ ID NO: 23870 - DNA, 1084 bp, Heterodera glycines
aatttacctatgtgcttatgatgcttgaattgaactgcgtttagccggtccaaaaatctttgctttacttaggctccatccaatccctattttccggatccaaaaagcaactttccatctggccaattccgtctggccaaatatatttcactctaacttttttcttagttgatagaattctactaaattatgtatcactcttaacaaggtctatgtattagcttacgaaaaattgcaaagaataccaaactcagactttttttttaattttcaagaaataacttttttttacatttttttaatctcttaacttttcatttcaagccttcaaatggcacaccattcttagttttggcacaaataaaacatcttgaatccaagacagaattgaccccctcccctcgccgaaatgggacggaaatgaggtgggtgcaccacccctaatcaaccacttaatcagcagcggagcaataaagtgactgtgctctgcttactccctgctgctgggtccatccgccacccctacgcccctaaggggctgacactatgctatatataattggggggccacgttgtccctgtgccctgctgatcgatcggtctcgatcttccatttgtctcgagcgatgggagggggggggcaaagcaatacacgggcagagggggggggggggatccgctggcgataaatactcctacatacatgtgtacgcgatggcgacgaggcacccaccaatcactaccacacccaatcagccacttttcctaggccaaaagaggctggaattttgatcaagtaatcagagatttagactatttaaagaaacaagtttaattttctgatctaaattatgccagcaattgtccgtttttttttaaccatccataggaagtgaaaaggtatagaagggtttgacttcgttgccccagcctctcttcatctcttcccgtcttgtctcctccaccttccccatcccccgtttaccagcagcaacagccgtcatcttcatcttcgtcgacggaggaacaggacggcgccgcagggcaatgggatgggaagcaggaagaacacaccttcacatcg

SEQ ID NO: 23871 - DNA, 1816 bp, Heterodera glycines
aaaggttttaaaagctctccttaaatatgaaaaatgcattaaaattatttctttgtttaaaacaaatgtaatctgtcattatgaagtggataaaaatcgatgtaaagtgaaaaagcttgaaaatgagccctcaagcacaaaatttcgacttttgaggccctgtaactcttgaagaaagcaaaatgcatccgtaagattaaaaatccacactagaagtcgaccctgctctatcgaatggtatataacacatatgcattttccgacttacagttcgggtggttcccttgtaagtttttttagaaaaattttgttttttcgagaaatttgatttcctgtccattttgccgctcccatcccattttcccagccaaaatgccaatttaaaacttgttaattgttccagcattttgtctgtctcactttgcctgttcctcctcctcctcctccacttcctcctcctcttccctcgtcccccttttcctcttcctttccccgtcgcttttcctccgcttctttttgtcataaattgtccgaatgtgtcgcttctccttcctccgttttggctttgtcttcgtcggtgttgccggcgcctcctccgcctcattttttttgtctgttcgactccttttactcggtgtcgtcgtcagtttgttcgcctaaagggtgagccaaatttgaaagcgtaaaacattgggccaaaaacttagaaaaaaaatcagcagaggcgctaaatttggcggcacctccgtcggaaacggagaagcccgttcccccttccccccgattttttttaaactgaaagctttttggttttttaaaataatgtttgaaatttttattagagttgagcgggaccgggagctgaacacggacaactgagtaccgaagtcccgatttttcccggttttcccagccaaaaattcccgggttttcaacccgaaaaggtcccggtcccgggtttgcccaaaattcccggtcccgctcagctctaatttttattaaaaaggttattttgttttaaaaacttctttgcacttttttttacaaaaaaaaaatttaagttccaaattttataaataatttatttatttatttactttttactttaaaaagacctataagaatttaaaaaaaaataatttgatcttttaaaaattaaaacagttaaagttgcgaaaggaaacaaaccccactcccgagtagaaaaattttttgtcgcttcggaattattttttcttggaaaattttgctgtattttctgctttttcataattttcgtaaaattaaaaaaatccttaagtttagaattttttaaaaataaacagtatatttttttgagaaatttctaaattttttaaatttttcggggaggaaacacgaaacgactcgggcgggaaataaagtgcaccccaaaaatccaccccgcccacctcgtccagccatgccggtcggccctgctccatgaacagccatgtgtcgttggcgaaataccaaaatttgcggcccgccgagtcgacgcacaacggcttggcgtgcaactgttcgtccgagaatttctgcgagaaaatttttccaattttttccggaaaattatttgttttttaccgtgtccaacccgccgtcctcgtgcacacactgcagcaaatagtccagcaaaagtgcagccaaacgcagcacatccgcaacgaacaggttggacagctggggcttgtcctcgtcggcttaaaaaggaataggggggaaagtttggctaaacgaaattcggatgctccgcggggtggaattccccataaatcattcccccccagccccaaaa

SEQ ID NO: 23872 - DNA, 1964 bp, Heterodera glycines
  misc_feature (131)..(131): n is a, c, g, or t
agattttaaaaaatatttataaaattttattcaattatataaaattttttaaaactcattaactttttaagcagaaatttattaaaattattcgagacttcaactttgaattttcatttccataaaatgcncattagtttattccattctttttgtacggtatctgtagactaaaactacagtatacatcaggacgtgggtaaaactacaaacttttcaacagtaatggacatgctgatcccaaaaaatttcggaaatcgggattggctatcagtccaattaataaggacagtttggataaaaatttaaaaattaaattaataaaagtaaaatatattacagtaagaaagcgttgtcaaaaataataaagatattctgctggtttcattaatattattatataattgcctttttaagagagggacgaaagtttctttttagataattcgatatttaatcttatcttttccaaagcaatttaataattttcggcaaaatgatgaccctaaacggggggcaggcataaaatattaatttacaattggtgttccaaattttaaatgagcaaaattctgacctgaagaagaatgatgcaagcgattgaggggaaaacagcgggaaaatattcaaatctttgaaatcgaaaaagccttttaatttagggctttgaagaaaatagtatttttgcataaaattttctattttccttgttggtgcccctccaagacataactcacccaaatttttattggctcaaaatttagttatttttggacaaaatctgttacaaatcgcattaagaattatataaaaaaaattcatggccgcccctaatcttttattttaaagacaattacctaatcgaaaaaaataattattttttggatttttttcaagacccggttttaccgggtacccggacccggttgaaaatcttggacccggacccggcttttctagacccggcaatatccggacctggtttttcccaaatacccggacctgtgtaacctcaattttaattagaatgaattttctagacattttcttgtttcggcatgcgttttttcacgaatgtcaaatttctttattgttttctcttctctctctccccctcctaccttttccctttctctctttttctctctctcctccctctttctctgccattttctctcctcttccctctctcctttatccctcatcatcgctccgcccactttcccctaaagtgcccttcttctccattcgccctcatttggcaaatatcctcctcctccgttttggcgtggcttgctctaccttcccttccttcgtccttcttcattcttcctcatccctttcctctcccaaatgtgcccaaagattattcacctttttgcccatttaaaagttcccattttccctctgtttttagcacatttttcaataatgggacaactgaactcctatttcttctcgccggaagaccattcgtcgtccgtttgtgctcagcccgtgctgatggagaaggaggaggagggtgaaaagtcgatgaacgacctggtgaccgcttcgtccccaacagaagttcgtcctgcttctcctcccgcttcttcctccgtctccgttccgccatgtgagcctccggcaacgcccacttgcgcaacttcgtccccatttaccgcccaacaattggccactccgtcgtcattctctcctcctccggcacccggttcatctccccccccccctacgtcctcctcccttccgtttcgtcattgccaattttccgttcattataccaaattttcctcgaattaatttctcttaccctatttccccatttttagtacctcattctccccaggggggatttcgggttcctaccagggatggcattccgaggccccaaaaatattggaaatcggaattccgtgcaatccctgattcctaccaggggtggagcacggacagaaaaatcg

SEQ ID NO: 23873 - DNA, 246 bp, Heterodera glycines
aaaaaaaaaaaaaaaaaaaatttttttgtggggggggggggggggggtggggggggggccccccaaaccacaaaacaaacaaaaaaaaaaaaaataatctctccccccccccgggggggggggagggggggggggggggggggctaccccccaccccaaaaaaaaaaaaaaaaaaaaaaaaaaaaaaaaaaaaaaaaaaaaaaaaccccccccccccccccccccccccccccccccccccccccc

SEQ ID NO: 23874 - DNA, 1747 bp, Heterodera glycines
ggaaattgatgcccaaggccgcgccaaagtgctgaatattgtagctactaatatgctcaagttacagtaaatgagcaatagtccagagcagttgggcacatggtttttggagagatgccaatcccattcccatctgcactatgttgggtgcgaaaatggtgagaagcttggatccgggacatggaccggtcagccctctttagggcctacaggtgaattgccatttagcgctcaacccaataacgtgccaacacctggactaagggagggaggagggccatgacgtgcaacgttagggcacttccggtttccattgcattatgcgatgtgtcaactccaattattggaggaaaccaagtgcatgtcggctgacgcaaagaccctaacagactaaaacgcgcctaggtagcgaagctcaagaagcgcgcagcgctttcccaagcgccaccctcgcatgcacacacccgctagttttaaatttaaaattgatttttattataaatattttgataatgaagtagtgtattttgaataaatctcttaaaaaatataaatttgtaggtgagtataaaaaatgttcatcagatcctatgtcgcttttcccacgggtgtaaaaaatttcgtttaaaccacagaattttatatgttaattattattttaaatattatttttcattacaattttttgtttttttaatattgtcaaattacaatgtacatacatttagttttctccttttacgatttattatatttttgtaatttgaagtcttaaatttttatattgcatatttgtcagttattgtttaagggttaataattacttataattaattgcgttaatttagtacagaaattataaataataatttttctcacccttattttcgatatttttatttccataatcgattatatgccttttccgttatctatttaatgtatttatttttcttatttatatataatcatttcatatgactcggtgcttaattttagtttctaatgagatttattagttttgataatttttagtggattatttcgcttttttttcttgtcaagtaatacccgttttactcctgagtatgttgagcatgcttttcattaaaaatcaacaaaaataattaatatcttttaaattaatatttttaaaggaaattatttataatatgattatatagcaatttcataacaatttatttaaatattattacaaattcttaatttatgaattaaaaaaattttaacaatataggtctaaatatgaaaattccccatagtcttttgaaagaaacgcgaaattgccgggggcaataaaaggcatgacgataaatggaaagtggatgaaaatggcaaatggcgaaaagtgaatttgggatgtggctccgctgctgacaaattgaaaagtatggcgaaagtggcaaatgatgagaagtaaacacattaaaaaataataatttggtaaatggaacttattgaacttttgtttactgccagcagaaattaaagctttttatatgttgttaaatttttgtataaaacaagaagttgtattaaaatttatctttttaattatatgttttcattaatttaacttaaattgtttttttaatatatatcataatttaaataatttttaaattattcacccaaatttattattgatatttaaaatttatcaataatatttaaagataacgtatcgtttaaaataagcatttatgaaattttcacatgaaacatt

SEQ ID NO: 23875 - DNA, 1250 bp, Heterodera glycines
ttacgaaacgactcagcacgctctattttatttatttttgaattcatgttttcttgttgacctcatgtttttttactattttttataaatgtgtactaatcgtttttcttttatcttggtgaattattttctttgtatttatatcagttttatatatttatttatcaatgcaaatattaaatataaatgttttttcgttttttggtaaataatgaaaatctattatttatttagtgtaataatttaattcgttagtaagagttaatttttatattatttcatatatttatatacaaatcattttattttttttaaatattttctattgaaatttttacaatataatttctatttttatttttcgttcataacttttgttattttctatacaattggtctatttcgtcacattaagtgcacttaaattattacatcattttttgtatttatttgcgtttatttattttatataaaaataagtaaaacatagaatgttctgataataataaaatgacacggaaagcaacattttcaaacctagtgaaatttgcagccataaacttttaatattttttcagttttcagttttcaatttttcatttgtttttttcaaatctgtgcattttcagcaacttttatttttatttgcaaatctaattgtagttttatgatatgaattttaaaatgtaaattaataaattttcaacttttaaaaaaatcccatttttaaatttaaaacaaataatttttattaaaattctataaattaaaattgccaaaataatcaaattgtttcggttttatttttactttcattttatcctattatttttagatttttattgctatatgaaaaaattagtcccgcattaattaaaataaatttcaaagttttgttaattatttatatgtttttgtatttttaatttaattttagtccactattttttctctttaattaataggcacgaaaagggtgaaaaaatcataaaaaaggcacaaaaattaaaaaagtttattatagtgaatgttcaaaataaatttaatttttttgtataaaaaagatttatttatttggaaatttttaataatttttattttttattttctcgctgataagtagagaccgcattttgaggtatatgccttttttttgcttactagtttcgatatactaagcataaataacacatcttccacttgatttgagctttctacgttgacttttaatatgccgtttttggcatttt

SEQ ID NO: 23876 - DNA, 1622 bp, Heterodera glycines
ttattactatttttaaattcggtttaggatcgtgttgaactctttgccaatgcgaatcctacttcacgacctgctgtcgactcggcaaaaagagagatgcggccacgtcgcggcggcttaaccaaacaatcaactcaactgcggacgatccaaatgcgacaaaaagggctcggtctgctagcgggtaaaccgaaaaacgcacgattttcattttcggcatgtttttttagccgtcgtcgttctgtcaaaatggttgatgcactgattgaaatgtacgagcaagacggagcaaacggaggaactgcagaagaaagaagaggaagaatcgggcaaaaattaaaaaatttgtgaaattataaaatcggttgtttttttgtttgttttgttttggtctttttcaattatcgtgctgatcggatgcgtgagattaacaagtgcatgggtggtctgcaaaactttcaggatttgggcaccaatgttgcatcgagaaaaccttgatgtccgtgggtagcgaatggtgttcgcgcgtctgcgcgacaatgtacggcacttgcttgtcaccgaccgcctgcttcttcaccttgcacagtctgtactggccttcacgactttggattcggtggatgacaaattgttgtttgcaaatgatgcgcacctcatttttaaaagacagcacaaaaagtttgaaatggtacaaaaatcagagactgtcaaatgccataaacgaacaaaaaaaaagaatttgggatcctattgtttacagaaacaaaacaaaaaaacatcgtatcaacagaaaaaacaaaaattggagatcgggcaattcctcctattcatcaattgatctgtccagcgaccggcggcggcaccaaaaaaaagttcgagttgggcaccattgtgaatgtgtatgggcccaccaccgatgatgatcaaattgtttggcaaaatttgccctaaatgaaaaaaattatgactttctatgacaaatggactctaccggcgaaacgcaaaaacatttgatgcgctggttggttgagagcatgcgacagacgccctttgagtgatgcgatgttttcacttatcccgatgggataccataacaagtcaccgttgtacataatgcgcacagaaaaattttccattttttataatttgttgcttgaaaaacgttaaaaaaaatcatatttgttaaacatcatagttaaatcattgggttttacagaatctgttcagacccaaccgcgttttttaactcaagaaacccctaccacagggacacctaaacttataattagagagcgaaccggactggacccggtaccggatttttctggacccgaaatccggtccggcgattttttgggattgattggtgtgtgtttgagcttaaatcttgagttccctcagttacaacaattggattaaatagattgaccggcttttggtagaccgaatccgatcgtttttgaaaatgccaatccggtctggtccagcgaatttttgaacggattttccgggcaatcatggagtttactagtccatgattgactgattgaaaataattttatcaggtaaaaaagacaaattaagccccgaacagtttatttgtaattgttttggcggaa

SEQ ID NO: 23877 - DNA, 1763 bp, Heterodera glycines
tttctcgagtaaatgtcaatttctgtggagttgcactactgtagcgatggacagcgacggccaccaaatatttgtcgtccaaaataagtgagaaatccttcggatggagcttcagccttaattttttatttttggtattaagcctagaattagtaaattccaataaaaaattaacaatttcgaaattcaatttcgaaattcaccgaccggttaatggcttcgcgcagaatgaggaaaacgcactttgtttgtccgttcgaaattcgcgccacctcattttggacttggcgcgattcaattaagcgtgtgtcgaaaggagaagagtgaagaaagaggatcaccgcctcgctgttaccgaactcattccttaatataagacatttagattaattaattatttcagaaagtccaataaaaaaatatttttagaaaaatttttataaataaaagaaagttttattagctcctggagatataatcatttgtgccattttcgctgattgactatactatgggcgacacatttaaattatcacattggcaaattctatcaaaataaactgaaaaatggattcgatatccggcaataaatcaaggaacttttcgttttatttcaaccctaccaaaaaatatctatggtagttttatgtgctatatggtcaataaataaattataatctttgcttttaccatgccatgtgcagtgtcttggccaccattgtgtccgtgtgattaggcggaagcgcccgaggcgtaatgtcggcattggccatggaaaggacatgctgatgaagcatagtgacacgggacgaagtgccaaggccgccaattggccggcattaacttccaccagaaaaagtaataataaatgataaagaaaaacgaaattaccttagaatgttagtccaatttacccaatttttgaaaataaaattcaattgttacctgctttaattccaatttcttctcattgttctcttcactttcatgtgtcatataatcctaaaataaattaaatgtttactaaatttatattcaatttaatttaaataattaataaattgaatgtctatttaaatttaaattcaattatttcttaccgctcgttggcaaaacaaaatcagcggctgtttgaatccgtctttataacaattttctatgaagttaacagttcgtcgaaattcctctgttatgttgcagtgcatatccttcagaaagtcaaagtcgcgcattgcgcggaagtacagtaattgcagtgactgaaaagtaaaattgaatacggtttgctatgaaaatcgttttaaaataaggctaaaatttagtaatttcaaagaaaaatttggtaaattttggctggtttcttttattctgcatttataaattaagcttgcgtaaaacgcgttaatgaaacgtttagagctcggcctggaactggatccaggcctggatttttcctgaatccaggtccaggtcatttttcggcaacctggatttttcctggatttttgtccaggaaatccaggtccaatgtgaaaaaaaatccaggtccaggtccaggcaaaacacgaaaaacctggattttcctggacaaaattttagaatttattatttcaagtgaccgatgttttttttaattttcaaaaaaagattaaattaatttaaaaatacattattattattaagtagatatttttagatgtttctaagcaatcacttaattttttcaaactttttttgatttttaagatgagtttcaaaaaatc

SEQ ID NO: 23878 - DNA, 1798 bp, Heterodera glycines
ataattagaaaaattgtttaattaactttagggatttgtaattcttcttttcaacaaaaattttgaaaatttttctccataattatcattttattgcatttaatgtcgattttttaaaatttttataaatgatttttagttttttttagtatcacaattctgaatgattttttgatatattttatttcccaatttggctttgctctgtgtttctgttcgatgactttcaatttcattggtgtcggttggatcagtcggcccaaacactcaaaaaaaacgaacggagagaaataaataaaaaataaaatataaacaaataaaatggaaaaaggcaccgaaaagggagcacaattggaattattacataacataacttatcaatttgatatgaaaaaacttatgtttgcttttgtcgtatatttaaaaattcgaaattccaataaaacattttttggattgactaacaaataaatgggcaaacaaaacattggccatggttttgggggtgaaaatcggttgctgatcggacggatccgcgcaaaaatgaattgttaccatttttaattgtttttcactttcttattttttctctttttaagtgaaaataaattgttatcaaaattaaaatgcgtttacaaatgctccatttgcccgtatttcttctccttttctttccaattttttgttttggagtttggcaaaagttcgaacggcccattgaaatggcagtgccaaattcggtgacaaaaaaaatgattatgaatttaatcaaatgaaaatacatgcgatcaggatggcatatatgaattcgatctgaccgtgaagcattctctaacaatgagcgtgccaacggcgggcgacaaactcagcctgatcgattacctgcctgaaaaagttgtccgaatgaaatttaaagtttgcttattttatttttgaagcaaatttggatgccccgcgggaataatcgcacgtcatttggggacgaccaaattcaaaaattgttgcaatgggacggaatgcatcggcgaattgtgaccatcaacggggaaaggtaataatggggattaatactccgttaatcttgcatttttttctcattatttacgctctgaacatgctcctccctccgtttcagtcccggcccccttttggtcgttccgttcggagctcgcgttgcgatgcgcgtgcgcaaccgcctccgcgccgaagcgttgacgagtgagtgggtgaaaatggtgctaggtcgttttttaagtccgccaagggggaggaaaacaaaaaatgtaagacatataaattgataacttggcttaaattcgattaaattaatagtttcatggtatcattcaatagctttattgttccttatcagaatattaatttataattttttttttaattataaaaaagttatgaatttatatgtcttacatttttttgttttcctacccattgacggaatttaagaaacatgagctaacaaaagcaattagtgaactgcgcggtaatgggccgattgaaccacttttagcattgttttagttcacttacacggaatggacaaacgaaacgcgtggtaaaaagaagaaaaagtggcaaaggaaacggaaaatgccatttgttattacagcatttcgattgagtttatgtaattattgttcaggtggacggacggagtggcctttgtgcaacaatgtccaattcagccccttactgagtgagtattttccattgataaattagccaattaatggcaaaagagtgccattttccattttagcttcgtttaccgtttcat

SEQ ID NO: 23879 - DNA, 1523 bp, Heterodera glycines
  misc_feature (1480)..(1480): n is a, c, g, or t
  misc_feature (1497)..(1497): n is a, c, g, or t
caaactacaacaacgtcctcctgcaccttcctccacgtgaagactactgcccaaaccaaaagaagatggcggacctgcagaaatttgaagactggtacaataacaactatgaacaatgcttcgaccttaaagaaaaattacccgaatactgctgcaatgacgtccaaatccttatccacgctctcgtggaactgcgcagggaattcaaacaacttacacaacggcacggaaaacacggaggaatcgacattatttgccaagccattaccatcgccagcgcctgcgtcaaaaattatgcactcaatcacttgaaaccaaactcactcgccatcgtcccggaaaaaggctacactcctcaacaaaatcaaatcgctctggccatcaaatacctcgactggtactcccatatcaataacgtcaacattcaaacggcacattccctttacggcgaatatgtgtttaagcgtgaaggacagatataccaagtggacggctacataaaaggcacaaatgggaagcgggacaaaattatagaggtgaatgggtgtctgtggcacggctgcgaggagtgttttgaggagatggacgacgaaaagatgtcaaacggaaagacgctgcgggagattagggaaagggaagagaagaaacatgaaatattaagccgttacgtcgacttggaggttatttgggaacacgaaataaatgagaagctgaaaaaggacacagcaatgagggagtttttcgacaactggaaggaccgctcgccaatcaaaatcagagacgcttttcatggaggacggacaggaccaatgaagctactccacacagcaaaaccgggacaaaaaatcagctacaaggacttcaccagcctctacccgtggaccaatttctctacagactatcccctcggccaccctaaaatcatcagtatcccaccaaatgagcagacggtcaactggcgctctccatccgacaacccctacaaaggtctgctcaaagtgctacttctacctccaaacaacaacatcaacgtcactgttatgcccataaaatttgatcaacgcctcctcttccctctctgtgagaagtgcgccaaatacatcacagcaaaatatcccaatggcctcaaagacaacgactattcctgcccacacttcaaccctaacgaccgcgcctttgtatcaacctgcactcatcttgagttaaacgcagcactggaagccggctacacagtccgcaaagtcttccacgtcctccaatacgaccaatggagcgacaatgtcttcaagtcttacgtgagtgaaatgatggccctgaagatccacgcaaccggcttcccgtcatggtgcagcagcgaagaggagaagagtgaatacattgaggagtgctggatgaaatttggaattcatctggagaagagaagatgaaagctgaaccggggaagcggtacatcgccaagctctgcctcaactcactttgnggccgcttctccatgangaatctactttcgaaggcgtaaatca

SEQ ID NO: 23880 - DNA, 1021 bp, Heterodera glycines
aagaaattccagttctgtctcgaagattgacttaattttcggaattttcatcacaaaaaggtcaaattttgccttaaaaagggtaaaaaagtcatgaaaaaagtcacaaaaacgcaaaaaaggcataaaaatcccaaaaagtataaaaaagtcaaaaaaagtcacaaaaaaatgtatgttagaagcttcaaacaaagtgtagaacccctttgaagtcattttaaggtcatttagagtcagcaaaaaaagtcatttgacttaaattcccatccctattcattcctttgttccgagaaaagaagggcaaacaaaaaatcttttcacaaattcaattttatgaatgttattgagaaatttaagtttaatatagtttaatatttatttggttgctaaattagagaatacaattagctaattgctggacaataatcaaaaaatgaactcctcaatcatttcatcccattcagtcactcatcattagggtcgcgatttctagtgatttcactatttgattactcaattgttttgaagaaaggagcacaaaaaacgcattctgctttgaaatcttttcgtttgaacgtcaattttcgtcataaaaaccaaaaatacacccctaagaatcgacatacgatgaaaaatttcttaaaaattcattcgaaaaatttattcatatattttcatgtgagaaattttagattttcaaaaattatttatctcaagacttagcttaattttgttacttttttgaataaattttcttattttacaccccctaaaggctgaaaattttgtcacgatttcgtcactatttggcatttgtcctcactattttagttaactatttcgagatttttcgtaactaaaagtcgcgaacctactcatcaactcatcattcagtgtttgtgtgagccggtcaatccgggcatggaaatcacactgttcgtgccagtctcatttcgttgggagtggtctccttgaattgtacggaataattaattagtgacaaattcacaaaaataat

SEQ ID NO: 23881 - DNA, 1650 bp, Heterodera glycines
  misc_feature (17)..(17): n is a, c, g, or t
  misc_feature (34)..(34): n is a, c, g, or t
  misc_feature (74)..(74): n is a, c, g, or t
gagtcccagagatgaantgctgtgggttgagtcncagtgtctgaatgccagagatttgagttccagtgatgganagcctgagaattgagtcccagagattgaaatgctggtgggttgagtcccagtgtctggaatgccggagatttgagtcaccgagattgaaatgctggtgggttgagtcccagagattgaaatgctggtgggttgagtcccagagattggaatgccaatgaaagttggtgggttgagtcccagtgtttggaatgccggagatttgagtcccagagattgaaatgttggtgggttgagtcccagcgattggaaagcctgagaattgagtctcagagcttgaaatgctggtgggttgagtcccagagattggaatgacattgaaatgctggtgggttgagtcccagtgtctggaatgccggagatttgagtcccagagattggaatgccggagaattgagtcccattattggaatgctggtggcctgattttcagtgatttgaatgtcattgaaagttggtgggttgagtcccagtgtttggaatgctggagatttcattgtttggaatgtcggagaattgagtcccagagattgaaatgctgctgggttgagtcccagtattggaatgctggtggcttgattttcagtgattggaatgtcattgaaagttggtgggttgagtcccagtgtttagaatgccggagatttgagtcccattgtttggaatgccggagatttgagtcccagagattgaaatgcttgtgggttgagtcccagcgattggaaagcctgcgaattgagtctcagagattgaaatgctggtgggttgatttttagtgattggaatgtcattgaaagttggtgggttgagtcccagtgtttggaatgccggagatttcattgtttggaatgccggagaattgagtcccagagattgaaatgctggtgggttgagtccaagtattggaatgctggtggcttgattttcagtgattggaatgtcattgaaagttggtgggttgagtcccagtgtttggaatgccggagatttgagtcccagtgtctggaatgccagagatttgagttccagtgattggaaagcctgagaattgagtcccagagattgaaatgctggtgggttgagtcccagtgtctggaatgccggagatttgagtcaccgagattgaaatgctggtgggttgagtcccagagattgaaatgctggtgggttgagtcccagagattggaatgccaatgaaagttggtgggttgagtcccagtgtttggaattccggagatttgagtcccagagattgaaatgttggtgggttgagtcccagcgattggaaagcctgagaattgagtctcagagcttgaaatgctagtgggttgagtcccagagattggaatgacattgaaatgctggtgggttgagtcccagtgtctggaatgccggagatttgagtcccagagattgaaatgctggtgtgttgagtcccagagattgaaatgctggtgggttgagtctcagagattgaaatgctgctggtgggttgagtcccagagattggaatgccattgaaagttggtgggttgagtccacagtgtctggaatgccggagatttgagtcccagacat

SEQ ID NO: 23882 - DNA, 1544 bp, Heterodera glycines
  misc_feature (1465)..(1465): n is a, c, g, or t
tgaactttcgttgtttctgtggcccatccatctatccatcattgttattctgtttttcccacaattgccaaattattggccaattattaattaattaattaatttatttagcctttccaagaatggaaaacggagtgacaaagtgttgttacagcgccattccgaacaatgatcggacagtagcagaaaatgagcaaggaaatgggcgggaaatgagtagcgacggtgatcaaacgggagcagcaaaaggcatttccatgggcaaagggacggcggcgccgtttcgcgccgctgaacgccgtccgatacgttttgccaattttggaatgggcgccagcctacagtattcgtgccaatttgcacagtgacttggtcaccggactgaccgttggcattatggtagtgccacaaggtccaattgatcatgagcgaaatttatttaaatatcaataattttacatttttaaatttaaaatgtttaaatttaagggatggcttatgccactttggccggcgtcgacccggtttatggcctttattcatgctttttcagtgcattattctacatgttttttggcacttccaggcacatttcaattggtccgtttttggcttttgtattttttaaattaataataattgtaatttatgtttttaaatgactttcggttgaatttattaattgccataatataaacattcgtaattatcggcaatcataatttcttttatcaaaccacttaagatggataattaattaggtggctacttatgaatttactttatattttaaaatttaaaatattaaattttatttccccttaggcacttttgccgttgccagtatgatggtgggcagtgtttgcgcaaaatttttgtcacccaattcaaacaacaacggcacatcggctccggagacgattatcggaaacgatgacatttttttggacgatcaaatcactccgctggtgttgaccagcacattgacattcggggttggctgttttcaggtcactcattcaatttaattaattaataattttaatacatttttataaattttgaattgttcttagttgtttaaaatataattgaataaaaaatattttaaccgataaaaaatgttttgcgttttgtctttttttgttatttattaatttcgtttatattttttgtattaattttaatttttaaatttattttttcctttttttaaatttatttccaaatgttttctccattttctctctattcagctcctttttgccctctttcgcctttcctctttgaccgattatttctccgattcgctcatttccggctttaccaccggcgccgctgtccacgtgctcacttctcagatggacaagctgatcggtgtcaaaatcaatcggtacagcggagttggcatggtcattttggtgagaaattattattttttattttttaactttggccatgattntgggctaatttgctttgtctccgcttgtcagatgtgggcgtgagttggccttggcttctccccgggccacctttttgac

SEQ ID NO: 23883 - DNA, 1164 bp, Heterodera glycines
tttattatgcattttttcatttttgggactttcgtgcattaaatgccttttttgtcattttccttttatggcgtttttttccgaaaaattccattataaaatggaataaaattagggaaaatatacccctaagaaatgacctgactcgaaaaatttcagaaaatacacaattaagttttgaaaaaaaaactttctcaaaattgatcggcaaaatttcactacttttcttgataaaaattttaggtttgaaaattgttcttaatcgaaaaacattataaaatatttaatatcatttaaatgaatgagacaaaaacattttggttaagttttttaggaaccggaggccggcggtgcctataggcgccgccgggaaaattttttgaagcttagagtggatttgttaacagattttcatcaaaaatggccgaattttgcccttttgagcgaattttttaataaaaatgggatttttgggatcctacggtgccggtaggcaccgccggggaaatgttaatgaaattttcaaaatttgcgaaccccccccccctcgctgcgaaccccctcctccacctcttttacacccccccccttcagagcgaaaaaaatgtatgatattaattaatgttaaatctgaagtccattgttcgagcctgggggtgaacctacaccgatttaatccgatgaacttaccccgttttggagcaaaatgaggttaagaaacagcctagctgttttgccgttagagtcatcaaagatgtgaatgcgcagctataaaaagacatttttgattgagaacatttttgttattccattattttttgctcattgacattaatagacgtcgaccaaaatttcaaaaaatatattaacttaacaaattttataagtgtctgatcgcccgaccctttccgacttagtttttgaagtcagcagaaacatcgaccgacaagtggacgcagcgaattgagctcggaatttcgtgcactataaaaattttgaagattcgatcatacaattctcttttttcgattcattcaatatttaaaaatatcattatttttcgtgaaaattgttatttatttatgcgattctggtaaagtattaatgaatttcgtattttgaagccttaagaatgtaattttaagactttttcgctaattttta

SEQ ID NO: 23884 - DNA, 1509 bp, Heterodera glycines
tctaaaaattaaatttataatgaaattaaggcttccacacttcgtaagatgatgacattgaaaaagaaattaaggaatttctcgcgctggaaattgcgaacccagaagcggacccgttggacgaatggaagaaaattgctccccgattttcaatccttgccaaatttgcggaaaaatatctttcagcacctgccaccagtgtcccaagtgaacaaacattcaaagtcgcccgtgatgtttttgattatcgccgttccaaattatcaccagaaactgcagaacagcttatttttctgaacaaatctcttccccagatgaattacaattattgaatcaatttttctgttgattttattaaaattgttaaatttctacatataattgatgaaattttgtgggttttttcccaaattaacatgcgaaaatttaaatttttaccaacccggaaaccggtgccgggcccggcaatttgaaaatccggtttgaccggtttttgagagaccgggcccggaaaccggttgcttctgaaaaagtcagcccggcccggcccggcagatttggaaaatccggtctctactagttattatgtggcgataaattagggattattcaatatttgagcattttacattttatttgccttagggaatttatcataactgttttaagcaaaaaaataagcaaattttataaaatttatttgatttaataaaattacttaccatcacttaaaatacacgaatttgtttctgtgcaagtgaacgttcgctgactatttactatacggcgaaaaaattgtttacatccttaagcaacaaattgtttactcattaattaataattatattttagtgaaatgcttgaaagttcatttttattcttaccattgcaactttgcacattgtaatatttgaacgctgcacctcgtccacaaattaaacatttttttggtgtttttggttgctttttgtaaatccttttttgtttgattggttccgccgcgtccatttcgaaataggatttttcgtgatttaaataaatttcaatttatctaagcatatattatttatctaggttctgataatttctcattcaatctgcactattaacatagagatatataaaatggaaattaataaaaaaaataaaagaaagtgaattcattttttcgtctttcctaaaattatcaacagcattatctgatgctaaattgatttttttacgaaaaatgtgtccttaagctgaatattactatcgaaaataggttagccatattgtgatgctcggtttgcatgatccggaaaattccgggaccattccaggacatttattcggattgtccatataaataccataccagcataaacttgtattggttagggttaataatattttacatcttttattaaaatgatttcccttctacaaatgtcatcatcattttggtggcacttctgctcgaattccgaagctcaaaaattttaatctcaaaagctcggagtccgcaat

SEQ ID NO: 23885 - DNA, 943 bp, Heterodera glycines
agccggcacactcgcggattttggccgctatcttctcacctgaaacaaaatcagccctttatagggaacaaaaaattaaacttgttaatttcgtaaaagtcccccatattttccaataaaataggattttttgctgaattttaggtgaaatataacatatatttttaaatattcataataaaagccttaattttccaggcggcgccttttaagccgaggtgttgctgggagtccccgacttctcactctcactttcgtgtatggattggatgggaatgaggcaatttagtacatttgttcaataaaactaattgttaaacaatgcttctttttaaatttcgtttattcgacctttttatctaatttaaatttatttgtataaaacaagaaatgataactttccaaagaaaaacccgaaccatcgaaacgcaataatatttttcgaatgataccatgatttgttggttggttaacaaaactattaaaaggtctttaaaaatagttattcttttagcactttaagtttaaatattaatgttagaaaaatgggtttttttgatgcaatgacagaaggaagtaggagaaaggggagaaacatacagtgcataagggggggggggtcgaccccgagggcccgaaaaggggggggggcttgcaggggcgtatctagaaacatttttcgggggagggggacccgacctgaagacctttttttttttgctatttaaccataacttttttccactgctggttaaaaactgcactttttcactaaaaatgacccaattttggctttttaaggcaaaaaacttgtaaaaatagtggaaagtggaggtccggcggtgccgataggcgccgccgggaaaaatttttggaactttgagtgctatttgttacgaaatttgcctattaaactttttaattttcgtttggggggagggaa

SEQ ID NO: 23886 - DNA, 1466 bp, Heterodera glycines
aaaatatatatatatatatacataataagtggataagaacatataaaattagaaagaaaattataataatgaaaaaatattttattaattctttttccacaattttccttcgtaaatcgatgttcgtcagtcagcacatccgccaacgaaaatccaactcatcattttgcaaaaaaatttatttatcattttgtaaattattaaaattaaaaaagcataaatcttgcggaaaataaaatgcctacctcataagataaattttgaattttcgaatgaccacaattaatttatttattaaaattacgtccataaagatctgaaaaaatttattcgcaaatgtaaatttgcattaatgacaattaattatgtaattaattgagtgatgagttgtaataaaagcgtttccattttcgcgcatttcccaaaacattcgttttgcttctccgccggtgttcagcagccgcagtcgaagcacaaagggatcggaatgcacggaatgcagcagcagcacggcacacagcgcgggccgctgtccctctccacgtaacgacgttcgtaccttaagcaatttggcagtgcctaattaggcagctaatgagtgcgcttaattggttttaaaaatggacgatttttgtttaaaaaaacaatttgcctcaaattccttcctatccctactgattaatttaatttcaaattgtttaacaattggcacttacaccaccgggggaggcggatttgggtagtattggtaattctaaacaaaatccaattggtttatgccattgcgaaaagtttcgattaattaattgcctggcgttgaggctgttccgtgtacgtgtgctgctgcatgatcaaatgcttcaacaaaataaattttctggaattgtacaaaatgtaaaaagttttcatttgtcagaaaatttatcacaattaaattctttggcttagaaaacacaaaattttcaaatttatctaaacttttcaaaaccgagcctttgaaaattctaaaccgaagccctgtttatgaaatttttttcaattttaagaatttaacatttagacaattcttaaaatctcttaattaatgggctaattaattattacaaatttaatttggcagggaaaaagaaacgaaaaaagaataaatgaaccgttcaaataaaaatgctgaaagagatttgtcggcgctatattaaaagtgggtctttttgaaacaaaaggggggacccttttgttttgcaaaatttttttaagataaaaaaccatgataattttttatccggggttttaaaggtcgctaatcacgaatctgacatgtattttgactaattttaatccctaacccgaactcgaataaaaatcggaattttgaatttttcaaattatgattttttgttcaaattgagattaggaaatcggaattgatcaaaataattgaaggattcgtgatcggggaccccaaaaac

SEQ ID NO: 23887 - DNA, 1004 bp, Heterodera glycines
atcagcccacaaaaagaggtcactaaatttgtattccaaatatcattatcaccctctctcatagccaccacggcacatcgttaagctttagcgttcttcttaaattctctggagctgcgatcagcccgcaaaagaggtcactaaatttgtcttccaaatataattatcaccctctctcatagccaccgcggcacatccttaaactttagcgtgcttcttaaattctctggagctgcgatcagcccacaaaagaggtcactaaatttgtattccaaatatcattatcaccctctctcatagccaccgcggcacatcgttaagctttagcgttcttcttaaattctctggagctgcgatcagcccgcaaaagaggtcactaaatttgtcttccaaatataattatcaccctctctcatagccaccgcggctcatcgttaaactttagcgtgcttcttaaattctctggagctgcgatcagcccacaaaagaggtcactaaatttgtattccaaatataattatcaccctctctcatagccaccgcggcacatcgttaagctttagcgtgcttcttaaattctctggagctgcgatcagcccgcaaaagaggtcactaaatttgtcttccaaatataattatcaccctctctcatagccaccgcggcacatcgttaagctttagcgtgcttcttaaattctctggagctgcgatcagcccacaaaagaggtcactaaatttgtattccaaatataattatcaccctctctcatagccaccgcggcacatcgttaagctttagcgtgcttcttaaattctctggagctgcgatcagcccacaaaagaggtcactaaatttgtattccaaatataattatcaccctctctcatagccaccgcggcacatcgttaagctttagcgtgcttcttaaattctctggagctgcgatcagcccacaaaagacgtcactaaatttgtattccaaatataataatcaccctctctc

SEQ ID NO: 23888 - DNA, 893 bp, Heterodera glycines
ttttacgttggaaaattaccggtttttaccggtaccctttccggtggaaaaagttggtaccggtaccggtaccggtttttgcattaccggtcagtaccggtaccggtttttttacaattaccgattaccgctcaactctactaaaaactgtcaaaataattaatttttagtttctaaaaaaaccccaaaatagttgctaaaaatgggtaaatagttgctaaaaacttccgaatttagggggtgtaaaattacaaatattttattcaaaagtcaacaaatattaatccaaatcattattgaaattcgcattgcaaataagttgcatttcaagatgttcgggagatagacatgagcgattgtcagtcaaaatagatttgtaaattgaaaatgatcgttcaacatcacatgaagtcaagggagcgtatttgtaaagtgaaatcagattgattttctaaaacctctatttgacatgcttgacaaaaaataatttttgaatcagttgtgtaaacatcgttcttataattggaaatccatttcttgaaaagaaatgcgcgagatgaagtttcttttggcattcttaacaataaaaattgtatattaaacgttaaaacaaataatcttaattaattgtgcaattcccggatttattttccgagatttcttcattttatgtaaagaattttcgtttttgttgcatccttgtaaacgaattttgggcaaaacgccaaaatagttgaaaatagtttttttttcaaaaaattatagttttttagttgctaaaaataaaaaaactagaaaatagttgctaataactcgaaaagtagcttaacaacagccgaaaaaaacatgtttttcgtgcatttcaggctatggggagctcaggaaaaaaatag

SEQ ID NO: 23889 - DNA, 824 bp, Heterodera glycines
gtatggtggttacaaatgtgacaattgcatgatcgcgggaaaaggtgtggataatggcaacatggattttcctgactcgtacaagccaacagatgaggaaaagcacggtgggtgagataatgagaggggggcgcgggtgatcaatttgttagaatccgggaagagttaggggatcccatcgggattttatcgggatctaatccggatcccgcggccttttttggagaatggtgggtgagataattaggggtgatcaatttgttagatttgggacgggattggggataccgtctggggattttctcgggatctggtccggatcccgcggcactttttggagacggcaaagcagtgattgtatcccggtcaaccgatcccgtcccggccttttaaatctttctggccctacaattcatacacaaacaaaaaatcattaaaaggcgctgaaactggaaaaacggattcatcgacgaaaaaatttggtgagcaaaagcatggtttagggcttggccaatttgttagagcccggacgtgttagggatcctatcagggttttcccgacatgcgattcgggtaccggcatggtttgtgttaatattggggtgtgataacaaaaaaatcataatgaatttgggctaaaatatgcaaaaaatgtttaaattaaaattttgggacaaaacgttctaacgatgcaataaataggcatgaaaaattaaatttaaaaaaatatccgaaatgtaaaaaattctaaaattttcaaatttatcttacatatttctcaaaaaaccaaaatgcctgaaataagcaaaaatatgcaaataaaa

SEQ ID NO: 23890 - DNA, 1912 bp, Heterodera glycines
  misc_feature (27)..(27): n is a, c, g, or t
  misc_feature (52)..(52): n is a, c, g, or t
  misc_feature (57)..(57): n is a, c, g, or t
gcacatcggaatttggaagtgcaattntatgaacatatactttgctttccanttatnggtcattcacccataattaaaaaggatgctttctctctctctctaccctctttctctaccccctctctctctctctaccctctttctctaccctctctctctctctctaccctctttctctaccctctctctctctctcattagcattaccttcgccgtcaccggctgaattctgtgcatcagttcgtgtgctgctcgctcttcgtgcgtgaattgctgcagtttctctctcagtccctcgtcaacataatttggtgttccttcttcgttttgcgctttcaacacataaaggccggggtcagcgatggccaactgaataaatggccaaaataagtgaacgaaagaaaaaggacgagaaagaggaagagacatttatggaaaggaaaatgatttatttgctttgatttgacccaacattttgcaatttccattttaattggcccattttcgtgtgtttactcacctgtatcaattgtcgggtcggatcgtcgccctcttccaaaggccattgctcaacaaatgttctccgaattgtctccaccatttgcttgtcttcttcgtctcgcataaactgttcgatctgtccgcgctgtgcgagcagcttcaaaagggcaaatggacattaattaatggtgaattcattaattaattgaggcaattctcatcttatccgttaatcacctgcctcactgcttttgaggtgctcaaatcgctaaacaccgtcgatgttttctaaaaagcatactttttacgaatatttagttaatgctctttttgctaattgcataattaattaaaaatgccccgacaatttcccatggaaatgaattccttccgctgttgtccttacaattgcccgcgatcgttcgattctccgccgtgtctcccattcgtcgtccgtccattccggcaaatgcccattcgacgaatagacgagggcaaccgcacgacgatcggacaaacgacgcaaagtgaagtcattctcgtcgagaaacaacctcaagaaaagggggggggggacagttaaacaaaagtcattacagtggtcaatcacttgacaaaggcctcttctgacgtcattcgctcaacttcaatttgtccatcggaaatctgctgaagttcgttttcaattgcgcgctcatcgaatcggaatttgtcctcgggggaaacgatgaaaacgaccaaagcatccgcgtcaccaaatctgagcctgtaattaattatcttttatttttccattgaattttctttatttattcccttaccatccattgaaaagtccccgtgccattgtatttactgcccgattcggcggcacattcgacgcgtccatccccaacttttgcagcatttgccgatgcacttccgctgaccgctgaactcattgccaccgcgttaccaccatagcaaatcgtcattccatgcttgtcgaacgacggagtccattaacgatgaaatgaactagatataaatatattgtagtacatataataatatgcagagccggaaagacggaaagcaaaatgtaagctagaaaaattttgacatactatcccgacaacaagagaataaaatagggacattttttcggaagcctaaaaatcccaaaatacactgaaaatgtgaaaattttcgaaaaacttaaggatttggaaagctattaaatttatacattgaatagagttaaaaaaattagataacttatttacttcatctattttaaaaatcccgccgctgaattaatttgggcactgaacaaaaccatttcgacagaactttgtgcgctaatgcaaaaattaatggttaaaacaaaagtacaccttcgttcccatcaacagcaaggcgaaaaactcaa

SEQ ID NO: 23891 - DNA, 1362 bp, Heterodera glycines
cggatcagcaacagcagcaaccgaaaaagaaagcgcttgctgagttcatcacacagcagacgactggcggtgccaattagcgaccactaccaatcctctaaaaaacctaccagcgctctctcgctcccgcatacctcacaaatcactaccccccctctgtcgatctctcccgtacctctattaaacctgccctatcgcactttcgctctcttcaaacattctttggaaaacaaaacatgaaatctaaaaatcgaatatttttatatggcactatgactataaatgtgtcgtccgatggtgaatatacccagtatgctcggaacaccataccggggcccggaatttagcccagggatcccgagcgcggcatgtacagcaggccttcatccgacgagaacaggcgacgccttcctgacaaactgccggaaggagctatagcaaatttatttaaattttattttaaacatttttcagaacctcaatgacgaaattgtccactgacgaattcgtttgatagtaaaaagttactttaatatttaagcaccatatatattgaatgaaagaattatccgctacttgaaaatacattaaagaaaataagtatgtatatagaatatttaacgtgaaaattaagtcactgacgaaaatattcactgtcgaattcgaccactgacgaaaaaaatggaaaacagtgaaataaataaaaatagttcactgacgaaagttgttgggggcttgagccaaaaagtcggaaattttgggcggttctgtgcgggaaacattgtattccaggacatcgttattaattttcaaggacgtccttagcagggatgtgccggacggaatgccggttccgggaattttgggcggttctgtgcgggaaacattgtatcccaggacatcgttattaattttcaaggacgtccttagcagggatgtgccggacggaatgccggttccggtttgtcggcaattttgggcaattttttagccctcggaatgcatatttttcagccgtcagcagaatgccgatttccgaaatttttaggttcggaattcccaattgccgacattttttgagggcatcggcacatatccctgctggtccttaatgtccacggacaggccaattcagtatcattttaagcaaaacattgttgtttaatttaaaataaacttgaaaaaaaacagagttccatgaagttttaagctgtaaatttgtggcatatttttggcattttgggaaatttaatcattttaagctggaaatttgtggcatatttttggcattttgggaaatttaataattaaatattaaaaaatgcaaacggataaaatcaaaatgttccacgcaaaaataat

SEQ ID NO: 23892 - DNA, 1079 bp, Heterodera glycines
gggaaaaaagacttttcaaaattatacccctggagaagggagtgggaaacatgatttcaaaatttcaaatttttatagtctatctactcaaaacggtcagaaattcaataaaaataccattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaagactttacaaaataatacccctgggagaagggagtgggaaacatgatttcaaaattttcaatgttttctagtctaatctactcaaaacggttcagaattcaataaaaataacat

SEQ ID NO: 23893 - DNA, 1424 bp, Heterodera glycines
tttcccggtttttgctcacattgtccacgtgttctgttcggcaatgtttgctgctgacaaattgcactcggtcggcaaaatggtcggctgcaattcgatgcttcttccggtgccgtcgtcgccgtattcttcggcatagtccaaatttggcaacgtgtccatttttatgaataaatgctaaacaatcgaaaatatcgaatttaaaattaaattttgtgatttaaaaacgctttgtctctttaatttttcttttcgaaataaaattaccttttgattaatgtggaaattttgattttcataaccataaatttttaatgagaacttaattattaaattttgatgtaaaggcattttaataatgatgcaataaaataaaataattaaaatcgaaaatgaatttttaaaaaatatttttaaatttattttaaatagaaatttcgcgcaaatttatgaatttttgaaagaagaaaaacgcgcaaaaacataagtaagcacccgttttgtttctttcattaggagcggccaatggcgcgttaaatttgttggcatttgcgatagaagtgaaatgggaaatgaacatttaattggtttcgcactcaaaagccaatgagataaattttggacaggccgaaactgagagcggagcccacggcacagtgtgccaatgggaggggtaggcgttggcactttgctgtaattgaatcattttatgaagtttgccgggcaacaaagggccattattgttggatgatcgattttgaaaataaaactaaaatataaaaaaataaaaaaaagaaagaattaaatattaaagaaaaaggaaaagcgaaggaaaaaaattgaaaatattagcaaactcaaaaaaaaataaaaattatacagaaagacgaatttattctaattatttaaaagcataaaaattgtattatctatcaaatgaaagaaaattatttaaattttcgcattttcaacattagctcttccttatctttttataaggccaaatttcgtttaatttttcctttcgtttcttgcggagttttgtgccattctttgccactcattttttggcacagcacttcgataacaaatgcacacacatccaaaccattttgcataatcatttggccaaaataaggacattttttaagttgaagtacgaattaaggaccccaaatttggcaccaaaaagtgccaaaataaatggcgaaaaaagcacataaaaaaacgtgacataacgcattttcaagggcctgatgaagatgaattctttcattttaaaatttatttttttattttttgtgtacggtatgacaaatgaatagcaaatgcattttttcaaattgaaaaggcttttcccagaaattcaatcattccttccccttccctattaattaattactgtgccgggagggatttgtcct

SEQ ID NO: 23894 - DNA, 1053 bp, Heterodera glycines
ttctcttaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaatagttatttctgggactttttcagaaatcagaattaattctccaatgtggcccaaattttaggcccccagccacagccccttgcttctccccagttttaagtcttggatttgtcaaataaattcaagacttcaaattaa

SEQ ID NO: 23895 - DNA, 1628 bp, Heterodera glycines
catttattatttttgttataattttcttaaaagttggtcatactttattaaaatatatatgctattagagtatacttgaacctaccgaaataaattaagaatataaattcagtaaaatgcggaaattatttatttaatattaatataaaactttttatttttaaatatttatttaaaaaattttaagtaaaataatgacatcaaaattcattttgtccataataatataataaacttattaaaatgcggaaattatttatacaatattagcatgaaactttttatttttgtaaatacttatttaaaaattttttaaagaaaaccaatgacagcaatttcattttgcaaataatacaaaattttataccaaagaatgctttttgcaaaaaagtgaatattacaaaactcacttaaataataatccaaaatgaaaaagggcccataaaatcacagcttttaattatcccccaaaatccccgtaaaaattcgttttgatttccttcttttgactctcttcttagttttctttgttctctttagtgccaaaccaattatttgtcaaattcgaaatgactttttttcctttttcaaaatcctaaaaatgaaaattttcgatttttcaatttatttttttaaaattacgctttgcattcgttccgcatattcctcttctgtttcgcttacatccgaaaacttacgacattttttgcactttggacatttcgttaataatttgcgcgattccgatgtgtcttcacagcttaattaacaaatttttataaattaattttacgaaatttaaaaaaaaaatttgagtattattatgtttttagggtgcgcgattttgtatattatcaactagtcgtcccggtagagggctgggcaattgatggggtcggctggtaggccacaaacggcgtagatgcatcaggttgttcgagcagcagccgggttggtagggcagcagcagctcaggcgcagacacatgggtggttgttcgtgcagcagcagctgccgataggtgcgatacatagaaattatgccgagcacataaaaacaatctctagttattatctgttatctgtgatcaaattcaaaagttaatcaaaagacaaattttaaaacgcctttatcttttttctaacacgtccaaatgtttaacattttttagaaaaagtttctttttaattttttttggacaaaaaataaataaaaatattcatgttgcacacggactcgaacctcaactctttgtctctttaccatcttacaaaaaccacttagccacacatgcaaatcttattggaactgaaaggtaaaattgaaatggtgtgtatataaggggaggattctttgatttctactattttttgaaccattcgtttttatggatgcatcccaaaacgtcgtcggccgaagcgtcgccggaagactttttggacatacctttgttcattgtcaatcaaataaccacattccttggtgttgttcgaaagttcatgtgtttaattcttagtttgcaaaatttcataaattttccttaagttaaaaaagttatgggcagaatgaaatcaaatctttccaaattttttttgccctagtttttttttgtacattgaataaaactt

SEQ ID NO: 23896 - DNA, 1697 bp, Heterodera glycines
  misc_feature (1616)..(1616): n is a, c, g, or t
  misc_feature (1662)..(1662): n is a, c, g, or t
gtttcagcgcggatggggcccaacacagacggggtgcggggataggtgatatttttcgtggtctctggcgctttttcctgccactaattcgcagagctggagattctgtcacagacgaaacaattcagactggaaaacgctttataaatagggtaatcgatgaaaaacccggtttgaagggaacgatagagacgttggcaactgagagtaaacgtggagcggataatgttttagagaagggcggatttcggcgtcaatttggcacaggagggcgaagaaagcatataaaagctaacaattcctccattctatcacatcaaacgataattggaaaaacaataacaaaaccgttaattcaaagcaaaaagaggcttcgatcagacgcgttcgggctttattaaaaaatgacctttcacaaaattgacgcgagtagcatcgattcgattaccaatgccgttgattttttcagtatacccccgacaaatgttaccgtatcatcgtcaaaggttttcgagattttgccgagtaatccactcaccgacactccttatcattttaaaatacactcgagccaaaactacattgacctgtcaaagtgttaccttttgaccgaatttcgaatgcgaaaattgacacccccaaatggtgaatggggacatttggatgctactgatcaggttgttccaatacaattgattgggcacaccttcatgcgggacctgaaaattgcaataaacggtcgtgaaattttcaattctaattcactgatggcatacaaaacttatctttctcatgaactttcgcaatcacttgaagctaaagtttcgcatttaactgctgctggatacgaccgtgaagatgctagtaatctacaaaacgcaaattccgaagggttcaaaagtagaagacaacggtatttgggaggtcgaacagcacaatacattgcaaaaattgatgccgatcttttcaatgtaccccaatatttgattaatcattgtgaaattgatataacgatacaaccccatgacgacaattttttgttaattgacaccttagaccccctggtcaaccatatagccttgagcttgttggattgaaactctactgtaaaaaagtcagtcttatggatggtttggctcttgagttggcgaaaaaattggaaatgaaaccagcacggtatgctgtacgaaagacaatgatgaaagcattgttcataagcccaggacgctatgaatttaatgcaaacttgttcatggaccaagttccacgccgcgtgacaatgggacttgtcgcaaattcagattatgtggggaacatcaaaagtagcccattcaactttcagcactttaatgtacgggagttaagtgttgtggccaatggtcgctcctatccccaggcaccgtatgacattgactatgaaaattggaaatttgttcgtccctacaatgacacgcaggaggcgcttggttttgccaactctacatatggaaatggaattgattacttttcttttttgcacactcactgtatttatgtgtttaatatgacaaacagcggcgacgatcatggcggtttatttgatctaatcaaaaaaggctgtaaagcagtgaacattnaattcaaaaaacagtacccgatggtggaatacacttattgtgatgngtgaaagcgactctatttacttttttgataaaaac

SEQ ID NO: 23897 - DNA, 2091 bp, Heterodera glycines
  misc_feature (79)..(79): n is a, c, g, or t
tgaaatttatgaataatttcgcatttttctgatcatcaattaatcattctgatcatgcgaaattgaatcggctgaattnaattcatttttgataacaatttgcgttttgatcagttgcattttcatattccattttttcattgtccgatttttgtccaaaaatttcagcaaaaattggccgaagttttccattcttttcacttaatttaactgataaaatttcgtttattgagtaggttaccaataataacacgaaaataattgcagcattctctgaaaattgttgtgttttcttgtgttttttcagttcaattattaatgaataagaatattaaataatatgaagaaaatgcaccgcttaattctctttatttatattattttattatatattttttttattaaattgaagttttaaaatattgttttgttttaataaaaatttgcaaaattgaagttttattaatctgttttaaaaagaacataaaaacacaaattttccattttggaaaaaaccttaacaaaattggttttcgaaaaaaaattcagaacacaattgttcgtaagaaaaaaggagcaaaatgacaaattaatataaaatcaaaaaggtaaatccgtcattaaattacttgtgattgattgaattattttattaaatattcttaaataatatgattttttcgcttttggtctgattttctttcgcacattaaaaaagaataattattaatttttatttttaaaatttttcatagatttttaaaattttcttattagactataatttttttagacataatttttattttacatattttcggcttttcctaaaaatatatattttttgccatttggttatataattattcataaatatctaatgctttcccactgattcatctcatttcatccaatacacaatttacattcacttgaaaattattctaatggaccaaattatttggattaaaaataattccaacccaggaaagcggataaataaacaataatcaaatagtaaaagttatttaaattaaaatttaataattttagcaagcttaaaatttaaagaaaaattccgaaatgtgccagccaacaaaattttttatttctcttttcacctttagcgcctttctgttggccgataatctcgccggtatgaaccaggggtgaaaccggataaatcagatatcgattttataatagctgagcctttcatgcagttggataccaacctggatttcagaactttttcaaaactcttgtgaatcccggatttttgctattttcgcacttaaaattttttttaatgatgcttagaggtcattttaaattgattacagccgacggatataaaattaacatatgaaatatttcaaaaaacaaataatttcagaaggtctcaagtgcaagcagggattcgaaatccgtccattggttgaacaacaattggaaccggacgaatgtgtcgatgttgagcttcctcgattttgtgaagcgtcaatttgcacaacaggtgatcactgatcagaaaggcacagatttttcgtagaaaaaaaatcattaataaattaattaaatattaatggtgaaaacagtgcgaaatgtcaaaaaatgtataaaattaaaaaaatcataaaagttttatttttgaatgtaaacaaaaactttttcttatttttgacattttttcgaaaagtccatgttctccaaaaatttattttataaggtattaaaaacattttattatgctattcgatagatttttggtttttacaaatacacaaatgaggaaaaaaattttcaaattatcaaaaagattttgttttatggaaattaattttctttttcgtgttttataattcaaaactcttaagatgaggcgccaaattttgcgagcattcattggaaatgtgcggaagaacaaaatgccaaagaatgtgccgaaagaatgaaagaaatctatgagaaaaagggtgaattaaaaaatgtttcatgccaatgccattatggcgaagaaggtgaagactttggcaacaaaaggttcacgcttccgccgcctgccgacccgacggacaaaggtagacgaaa

SEQ ID NO: 23898 - DNA, 1769 bp, Heterodera glycines
attgacaacggttctctccgtcggtgaaaagggacaatgtcctccgacatcgtctttttgtcgggccactgagtgcgcagaaatttcatcacctttttgcgtgtgtcgtcctgctcaagcgattcgatcacattctcatttgttaatgggaaattcttcataacagaatttaaggtcccaattgtagcactcgtagaaagtttggccaaaattatgtcgtcttctggcatcggagttttcgcaataagtcgggaaagcacatcggcttggccgaactcaatgtttgttggtactcaatttcaaaatcgtaccccagaagaatgattgcccagcgctgtaaccgattggcggtgcacgctttgattccttttttattgccaaaaatggacaataatggcttgtgatccgtctgtagaagaaaatgccttccaaaaagatatttgtgaaacttctgcacggcatacaccaaagccagtccctctttttcaatttgcgaataattcttttccgctggggacagggaatgtgaagcatgggagactgctttcattgtgccgtcggaatagcggtgagaaatcactgctccgattccatgctctgatgcatctgcggacacgatgatttgttgcgatgggtcgtagtgagccaatagctgatcagattgcagaatctgaatgacctgatcaaaggccttctgacaatcggtggaccaactccagaccacatcttgcttaagcagattgtccaaaggttggcggatgaaacgcatgttcttcacgaactgctgataatggtttatcatccccaaaaacgaacgaagtgtggacaaattggttggcacaggcatcttagcgatcgcctgtattttggctgggtccggccttcttccattcttattaatgatgaagccaaggtacttaatttcccttttgaagaaggagcacttttcaggcttaattcggaacccaaacttggcaattcgcttgaagacctcttgaaggtgcttcttgtgttcttctgatgatcggcttaccacgatcacatcatccagatatgcaactgcgaatgcacaaccagccaacatcgaatccataattgactggaaaatgccgggggcggacttcaccccaaatggcaaacgttggtactgaaaatttcctcgatgagtggcaattgtgcacaactctttagaattttcgtccaactcgacttgtagataagcatcccgaaagtcgatttgcgaaaaaattcggcctccattcaaagtggcgaagatgtcttcaggaagcggcaggggatgctgatgcaaaagcagtgcgctgtttaagccagtcgaaaagtcggcgcagacgagaattgaaccattggcctttttcacaaccacgatgggtgcggcccaatttgtgtgttcaaccggacggatgacattcatcgattgaagtcgctccaattctgcttcaacaacagatttggtgttgaatgggacgggacgcggtcggcagtaaattggagttgcattgggcttcagcgacaaatgtgccttcacctttttgcaatgcccaagtccgtcggcaacaatttcaggaaacatcttttgagatcaccattttctttttgattgcattcaaattcaatgaagaattgactttttgtcgaatgtcgtccaaaagtccgaaagcatccatcatttcaatccccaataaattcatgatccactttttgacacataaaatggtctgttttttcgtggtgtctccaaatttgaactt

SEQ ID NO: 23899 - DNA, 2185 bp, Heterodera glycines
cacaaaatgtccaagccacgaaatgtccaaaagagtggaaacccacgaaatgtccaaaatttataaaaacaaaatgagtctaatttggggtttttaggggtttcggggtcgctgaatacgaatatagcctttatattaccccttgcctaaccttaggcccatccgaataataaaaaactcaatttcgagacttggacatttcgtggcctggacattttgtgggtcagcgcagaaaactgatgctcatacaattgagtcccagaaatttcaattttgcggttcttcctgcggaatttggtcccaactttttttagagctatgctctgccatacaaatatataaattaaaataattgtttttttaataatttaagtacgcgaattccctgtttctagcgaatttcaatgccgtcgaattaacaagatttacttcactctcgagaaaccacttgttgatgcttcttgccatccacaaaaccaattatgcaaattttgagtacaacaaactattggattatgattgatagaaaagagcggaggaggaaaaaggagtgggaaataaacgaatttttagggttttctaatccaagttgattctttaaaaaaataagcaaaacttcaattctttcatttaaataaaacagttgattaatataccgtatttcctttaacacagccccccccccctccctccctgtaataaagccccacttttgaggagcgggttggaaatagagcctccccctttgatgagggaggcttgaaaaaataaagcccccggtggctctatttaggcaatacggtaattattatttatttattcattggttttaatttgtttcatgcaaaaattttcctggggcgaaatttgcgcattcggacggcactcactcactactcaattatgtaacgcacttagtaggaaaattttggactgctgtgttgagagactaattgactcattcattctcgtcctcatcaatcattgaaattattccaaaaacacatccattaaattgtgcatttaatagccaataatttgctgaaacgaaaaatcaatttttatattcattatccttattctcgagtcgagactcgagaccgagacccaaaaacccgagactttctcgagtcgagaccgagacgctctcgaacagcactagtaagtaactccttagggaacggatgaatacataataaaataatataaatgagtttctttgacgtcaaatgcaaacaaataaataataaaacggtccaaatgaatgagtgaatgacctttaacttatgagatgggtgtagcacataagaagaaagtaaataaacattcctaataaaagaaggacatcccattaaaacaaatttcgacctacccaaaatcacagatagtgccaggatttgttggggcttggggggattagggagttgtgcctgctgctgtttcagaaagcgcatgtctaaccccaaaattgtacgggaatatggaaattcgggagtataaccttcaaaaaagtcgggaatacggtaattcgggaccgggttaaatccctggtccagtgtatatatcactgggatcactgggaattaattcgatcgaaccatttttccatttattgcattttattaagaatttttgcccattaggccccccgccctccgtctcggcccaaatgcttaagcattgaaaggacctgctgctgcttgaaaaagcaaatggtggcttcttcagaaaccactcaccaaaaatattctcacaaaatgactttgagtttcgtggccaaaactgaactgagtacacagttaagtagccaaagaacaaacatttgtaaagtgtatataaattaaaaaattttttggagtattaaatggatgggataatctaattactttctaattataaaaaatcattttaaatatttcataatttttcatagatataaataaatattcactctacggcttattttgagataatactgcaatttattttaaatattcactttttcgcttttgaatattttgtatttaattattggaaaattttacactttctcactaagtctttcccaaaaagtgccaattctctttcaaaaaaaacttttgttgcctatggcattcctccatcaaatcattttctttccttctcttttgtctctcatttcggcatcgattcaaaaaaatggcag

SEQ ID NO: 23900 - DNA, 2150 bp, Heterodera glycines
gcataaaaattcccaaaaatctcattctttatcatttttagcccatacaacgcaaatcaaatacatttcgaagtgtttggggtaaaattgtctttttttgataaatcatttctataaattgaaagttccagcagagaacttcgaaatccaatgacgaattaatgaattcgagatttcattagtttctacaatcgaagaaaaaattttttaatttgaaaattatgttaataattaggaaaaaagtcgatttttagggggtgtatttttcaattttcttgtatttttattgcaatttttctcaaaaatgccaaaatatgtgcaaaatatgtgccaaaccccaaaatatgtgctaactagggatgatatttataggcactaaaaaccgccaaaataggtaggctctaggctctaaaaaacccccaaaataggcactaaaaaatggaaaataggcactaaaaatcctcaaatttaggggtgtaaaatgacaaaattttattcaaaaagcaaaaaatattatgccaaatcattattgagattcacattgcaaataagtaacatttcaagattttcgggcgatagacgtgagcgattgtcagtcaaaatagatttgtaaattgaaaatgatcgttcaacatcacatgaagtcaagggagcgtatttgtaaagtgaaatcagattggggggcataccgaaattgattttttgaccagaaagaatttttccaatatcgcaaattgtatcaaaaacctctatttgacatgcttgacaataaattatctttgaatcagttgtgtaaacatcgttcatgtaattggaaacccattttttgaaaagaaatgcgcgggacgaaggttcttttggcatgtttaacactaaaattgaatattatatcactaaagaattctaaacaaatttttaacattaattaatcaattccggattttattatccgagatttctttattctatccaaagattttcgtttatatgccatgtaagttatccacatttgaacaaaacttcaccatcccccccccctccaacttcatgcataatttctttttcattcattttccattcccaataaacacacatcctcttgatcaaaaacataaacaaaatatttatctgatctatgtaattggccaaaaagttttgctccatacctttttactttttcaccccccccccccggcgtatgacacgaaaaggacacatttttactccccccccttctctctcataattttctctaactatctcacattctctttgatttatattctctctgacttttctctcacacatgctgcggcgccctccccttcacaatgcatattaatttcgtccccccccaaatgacacctctcacaaatgcgcgaaattttcccgcaaaaaactacccccacaggcacacccttaattaccacataattaataaacgtttaaaaaaattcacaaaaaaaagttttctcccccacaaatgcgggaaattttcccgcaaaaactaccccctcaggcacccacgctaattaattaccccccccccccataggcatagactcattcccgcactcattaatcacggcggcaccttcaaagaaaccgcaacccatcaatcaccacccgctacccgctacccgccctggtaactaactacttttgctcttttcggtaatactgccgatggaatgaccccatttttgaataaaatttagcttttaaaagtcactgaaaaaataagtttctaatggttttcgaagttctgaacatgattttgttgttaatttcgaccattttcgagccccgaataatgatttgaacaaaaaaggcgaaaaactcaaaatttttgaatttcgcacttttattttaaaattgagtaatactgcgatggtgctccccttctttttttggtagaaatttttttgttttaaaaggcgcgaaaacatggcatctaagggtttggggaaacttgtcccgaaaatacaattaatttgacccgttttggtaagggacacccggacccgaattcgtcaaaattcaaagctatccatggttcattctaaattgataaaacaaagcataaaaggcaatatcttgaacagcggccccaaaaaccccaaaaggcaaaagaaaaaggggtattttaa

SEQ ID NO: 23901 - DNA, 2517 bp, Heterodera glycines
tttcatcaaatatttgtcctccttttcttttgttgcttctttgtctctccttttctgtccttctctcagcaaaatgaatttgaaaagtgagcgaaagtgcagtaaatcgcttctttttccgtcgccgtcgtgcggcggtcggaaattttccggcacattcacaaaattggcgcccttttccgaaccgctcagactgatctgtccaaagtgttgtgcgttttggcccgctttcagttgaaatttctacctgatcgctcaactgagagcgcggaattgcgcccattcggttcaaatgcgaatggaatcggtccgtccgagtcagagggatggcaagaaaattctctgaaaaacaacattcgaattgttgttagcttttactaatggtgtcgagactcgactcgagaaatcagctttctagaagagccttggtcttgtgacagttaaatccgttggattgaacttttcagtcctccgcttgcccttcccccggtgatttgctccccccgcgccctcacccaaaatgaatccaagtgccacgtcgtccggcacgccgagttgggcacagacccattggaaattgcccctttgctgatgggtttcgcccgtggcaatgaatcggcgcagtctgcgaagtgttagcgcggacagacaaatgccagccccgccggtgccgaaccaaaatggactttttcggtgccgaaagggggcgaagagttggggacggtcatcaagttggggcagcacaacgggagctgaggtggaaggtcggcccaggtaaaggtcgtcgagatggggcctaaactgtcggagaaaggcgcgcagattgacgagcagcacaaaactgtcgtcgtcgaaatggcaccaaaaacttaaaatgccaaaacaattcgaaaagggaggcaaaaagtcagcgaactttttgtaatatggtgataggcgattttaaagtgtgatttggcattatgataagcttttttacagtagtaatgtcaacaaaattgaaaaagaaattaaattggtttttcgattctccgaatttttttcattttccaattatttgaaaaatttaaacccatttgtgtgcatagttttgcccatcactttttctgaccgatttgttcgtgcgataaggcacggaagggagggaattcatggaaaaggcagcaattaaccccggggggaaatgagcgaccactgacatgaccaattgaccataattgctgacctcaaaagtaaccttatcttaaatacttaactaatggtcaatggtcctttaattgccccccccggttcgatttagtggggaaggattttaaatgtccgcccaaattactccggcgaccgctgaagcgcaattcgaagttcggctgccattttgcagcacagtgcagcgctaaattaagcattggaggagataagtaattgagggttcactttgtgtgtcccggagggcatttggtcgattggatgagaggggacggagagttcgcatcggagacgaacaaaatctgctgaaataagcgaattgtgtgggaaatcaatcgcattgacttcttatggtaaggcatccggaaaatgggacaaaaataacaatgctttttaaacatgctaatccgtaaatttctcccgctttcccgggttttccctgtcaattcatcgtcaaaatccccgacattttccctctgtccgattggcaacgaaattttcaccgtattttctgcccctttacgcccggccatcgatgcccaagtggccaatgcgtcttcgactcggctccgatggtttgcccttgtcgtttttacggtgatcaaaatggacgggtcggacacagaagatgggctgttgatcggaactggcgatgccttaacagagacatcaaatgcgggagtgaatcagagattcctccaagttaattaattacgccctaatgatgcgcgattattttgctaattaactcaccgatggagaggagaacaacaaccaaaatagagggaaaaagaagacgaactgctgttggaagaagatgccgaaagaggaagaggaggaaaaaggcattgccgaaggaagcggaggaaagagacaattttgggaagggtcagtcacatcgttgccgaaggggcgacgaatggcaaataaaaagggaaaataaatccaaggaaaaggggagaaataacgaaattggcaattatggcctctaaaagtgccgaaatgtaacaacaaaaaagggagggggacggttttatgaccaaaacagacaaaaaatgaacggatgggtgggaaagtgcgaacgaatgaatgcccccgggggagacaaatgaaaatgaatggcgatgatccaaccgaacgaagccaatggacggaagagcctagcggagaagtgaccttgggcaaagtgaacggtgagggaccattggcagaagcaatttccaaaaaacaaaaaatggacaaagaaaaattgtaaaagttgggggcgtaaagggagagaaaaaagaggggagagacgcccctcggggtaat

SEQ ID NO: 23902 - DNA, 1921 bp, Heterodera glycines
aaaaaattcaattttttggttattgttcgagtttgggttagtgcttagaaattggtcaaaatagatgtcagattcgtgatcagcgacatctaaaaccccgtagaataaatttttatgattttctatcacaatttttttttgaaaaacaaaagggccccccctctttactttttgaaaaattcaaaatctgccattctacgatagtgcccaaatttttctgattaatccaatggattcagaaataatgagcacttcgatgctgaagacggcgtaccgcggcatggcaatgtttgagggggaaatggcggaggaaagggcacaagggaacaaagattgcatcattcttacgcttttatgcgggaaaatattggactattttgagcagcagctgaaagaagcgaaaatggacgggaaaaatgaaaaaggggagaaaatggccaaaattggcaaattttggaaattattcacgcgaatttttgaccttttcaagaaaaaaagcgaaatgcacgacaaaaaaggcattctgatcaaattgagccaacttttgcgttatttaaggggccaatttggggagcaaaaagtgtcgaataaatggcaattaattggggaactatttgagcagggatttaccaaattgtacaaggaaaatgaggaattccgaacccattttaagaggaacatcattcaaatgatcggattgttcagagaaatttgtgaaattgcagaagagaacggggaggaattcttttcgaagcaattttggaccttatttggtggaccttttgtaaattaaaaagcataattaattaattaattagttacagtaattagttggagagtctgcgattttaaaagaaaaaacgaaaaatttctcagctggcagaatattggtctgaaaaggcaaagatgcctgttcaaatccgaccagcattcccatagctttccctcatcaaagtgcttccccaactcattaatatttcactcgcaaagacctgagacttttctcgtgttgaaatttgagtccacgacattcggacatcgctagtcgaaaattgctaatgatgactaattaatttattatgaaaatacgacagcgatgcgataaattaacatttgcttaattaagaaaaaatattaaacaaaacgacgaccaatacgccgcagaacgaaataaaatcactacttcttatcgaatgcccaaaaaagaatatcccagtggaaaagctgaaagaaatagacattatacgagcaggaggaggcaattaataattattattcatttcttaataggggaaaggcgaaatgcacggacagtgaaattgatcgcctttttccgaatgatttcacttttttgattacgcctaattaataaagtaattgccataattaccatagtcattttattcagataaactaccacttttgatgacttcactgtacaaagaattattaatgaaatcagttggcaaagatgaaagtcgcggctacaattcaagccaaattcacattttggcaatgcttttgagctacaaaatacaaattgactttatgattggcatagggaaacagtttgaagaaagaactgaaaaatttgaggaccaattggaaaattacatgaacgaatttgttgtcgaaaggccagaatccggcagcgaagaggaggaattatgcgaaatgcacaaattggcacattcgatagctaaaaatggcattttgagggaggaaagtgccaaatggggcaaatttattgagcaatttgtgggcaatgcaacgaaaacgccaactgaacgggtgaaaaatgcaattataataatattaatttaacttagtggccgaatgtttggtcactgtaaaatataaaaaagtaaaaacattgaaaaaatgataatcaaatatcggagaaaagagttaaaaatattat

SEQ ID NO: 23903 - DNA, 1871 bp, Heterodera glycines
attaattttttaaaaatttttaagaatttaaatgtcataaaatttagcagttaatagaaatctaaggagtgagcggtgcggaaaaagagagacggaaaattaggattcaaggcaaataactgatattagaaaaaaaaacaaaattatcatgtttttaaaatgggtggatctgaaattagagctactgggtatatgaaatttccggactcttcgagacccgaaaacccgaaaaattctcaactcgagacttagtactgcgactgctcaatattcttacataattcctttcattcgattaactcaccaaatcctcatcagctgttccgtgctctgttttggcactttctgatagcagccgcgtagcggtgctcgccttacacaacaattaccgctcacaactggccaaaggcactgcagcaaatttgaccggcacaatgccggcaggcagcaatctaattcaacaaaaatataatacgagcattgagtcggtagcgcagaattgggccaacggatgctcaatgtcccactcgagttcatcagggatgggagagaatttgtacatgaccagttcgtcgacaatttcggaaggtttaattgaagtgcccatttttaacaaattaggtcgtaaattccaaggggcagcggcaaaacttttcagtttctgtttgtatgttaattggctattaattgaccataaattcattattttcctgggcctacattaagcatagatattaggttaattgaagaagacaatttgcagctgatgcgctgaaacaagcttgcgacatgtggtgggcggagctgaagcagtacggcttccagtcgagtcttgtgctggacatggatcagttcaacaagggcatcggacattggagccaggcaactgaatgaataatagttgtagctatcaaattaaacttgttctttcagcaagcgtgggccaacactgctcaaattggctgtgccatggcacgctgtccctcctcgacctggaagacatgggttgtgtgcaactacaaggaagcgtaagcaaaatggaattttcttagctttataactaggatagcaatttttagttacgaaaaatatcgaaaatttaatgtaaaatagtgaggaaaaatgccaaaataaaaacaaaataatgaaaaaaagtccgaaatagtgacgaatagtgacaaaaaattttcagccaaaaattgagcaaaaataatttttattttcaatttcccccccccccccccgtttaggcgcgtaaaatgacaaaattttatttttaaaaagtaacaaattaagccaaacttgtattgagaaaaaaaaaattttaaaatcaaaaatttcttgtcaacaaataaattgttgagatgaatttttgaaaatttaaaaataatgggcaaaacgccaaattagttaatttcaaatattttagtgacgaagcgccaaagtagtgacggatagtgagccgaatcaaaaatttcaaatagaaatgcgtttttgagctcctttcttcaaaacaattgagcaaaaaaaaaaaataggcaaaaacctaaaaataaaaagagccgatttaatggttttttgtttgtttgccttttcctttggcttattttctgattattatatatttttttacattaatctaattcattaatctcaacagtggcaactatttgaaccagctcgtctacaaaaaaggaaccgcgtgcagtcagtgttcggattacaatggggcgtcctgcaacagcaccggcggactgtgcgtattgccatgagtgagggatatgcttggaagaatgatttttatttgatttatgaatcgaaaggaagtgaattggcattaattatgaaatcaggcttttcatttgaaatga

SEQ ID NO: 23904 - DNA, 1236 bp, Heterodera glycines
  misc_feature (39)..(39): n is a, c, g, or t
  misc_feature (49)..(49): n is a, c, g, or t
tgcgctcgctcgccccctccatgctcagttcgtactcgnccaccattcncagcgcacagtcagccgcgccccttgcgaagccgaaccgcgcgaaaagcaactcacaaacgctaatgggcggaacagagccaacgaaaagtgtaaaggaacggacggacaaagcgaaagtgaccgaagcaatgtttagccgaattcgcaactgattgtcagtgagaagtgcggcacaagcgcagaaattgcacagccgcaaatgcagcagcaattgttgcccggcaatgtgccggcgacgacgtccgggggagtgccggtggcaccgcaacagccgcaggggcaaacggcgcaaaacggcaccaaaagcggcactggcaaaggcatctgctcaccaaattcaaaagcatcttgctaccaggtgggcaagcatcaaccgactataaacacttgtgaagggactgtttctcccattcacaacttcttttttcgttgcattgtcaggtcagttcactaaccgaggcttctgctcggaaactgtgccgtaagcatccgcaaaagtgcataaggtggggaaggcacaattcgacatttattcattcattcgttcgtttgtcagttacactcgcaatcacattatgcgcacttaccccggcggcatgcgaatcgattcgtccaatttcaatccgcaacaattgctcgaattttggcagtgcggcctccaaatggtggctttaaactaccaaacagccgacgttgcgatggcggtgacttttgcttgacattttggacgaagtaaacacccaaatgcaggtgaacacggccatgttcgagcagttcggcagttgcggctacatgctgaagccgagggccctttgggacgcgtcccatcctttgttcggcaaattcaatcccttttcaaaagtgcgtcttttggggatgccaatgcaaagacaatctccatcgttaaggaactctccttgtgtcctgcactcattctgcagttgaccatcatctccgggcagtacgttcagaacccggccggcccttcccccgccagtccctttttggaaatcgaaatcatcggagtgccggccgactgtgccaaggagaagagcaaaatggttgactgttttaactgtttattctctctccttctctcctttctctctcttctctatctctctctctcctttctctctctctctcctccctctctctctctcctttctctctctctcctctctc

SEQ ID NO: 23905 - DNA, 1402 bp, Heterodera glycines
aaaatggggtttgacaatttattggggaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattgggggaaaaaaagactttacaaaataatacccctgggagaagggagtgggaaacatgatttcaaaattttcaattttttctagtctaatctactcaaaacggctcagaattcaataaaaataacattcacggtgcgaaaaatggggtttgaaaagtttattggggaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattgggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggctcagaattcaataaaaataacattcacggtgcgaaaaatggggtttgacaagtttattggggaaaaaagactttacaaaataatacccctgggagaagggagggggaaacatgatttcaaaattttcaattttttctagtctaatctactcaaaacggttcagaattcaataaaaataacattcacggtgcgaaaaatggggtttgacaagtttattgggggaaaaaaaattttacaaaataatacccccggggggaaagggaaggggaaaaaaggaatttaaaattttttatttttttttttgtttatttctactcaaaaccgggtttaaaattttaaaaaaaaaaaaaattcccccgcggggcaaaagagagggggtgtgaaagagtttttttgggggaaaaaaaaaattttaaaaaaaaaaaacccccgggggagagggagggggggaaaaaaaaaatttaaaaattttttttttttt

SEQ ID NO: 23906 - DNA, 998 bp, Heterodera glycines
atttggacaatttgcttcgtcgcacttcgcctacaattctcaccgatctcaaccaattgacttcaatcaattcctttgatttgttgcccgctgcgtttggtgatggttttgatgggccaaattcaacaatttctgctggccaagcattgtccaaatggttgcactctccgagaaaagatggacaacccaagcgattgcgttgttggcaagggaactttgaatggatcaacaatttcaaggaggtgtggccataatctcgaaaaatcactgatttttgttttcaaattgtttagcattttcttcgtgccaatgccatttcttccgtcagttacgaaattcatttttatgttcatgtgccatcaatggaaatggtgccatttgaattggtgaacgaatggacaaaggaaaagctgacattggccaaagcaaatgaaaatgaattggacaaaagttggataatgaaacgctgcaaaattattggggagaccgcgacggtttattggaaagacggaaattgggacaacaattgcaacaatgtgttcatttggctttttagtggcactaattgcatcgggttagcaattaaaaaaaacatttgatttttatccgaatttgaattttgcgcttaatttaggcctttgtctccgccaccaccagcgagaagacgaagaagcgggacaaagcatcacaaagggcgaaaccaacgcattgaaacgtggcgaaagaagtgccaatttgaggccgagttgaggacggtcaaaactggggaaaatgtccatccaaacgtcgttgcaaatccaactgaaatggaaaaacagtttagttaaataaatgatgaatagggatcggatttttagtgataaaaaatcccaaaataattaactaaatagtgagaaaaaaattccaaaatagtggcaaaaatagtggcgaaaaagttccaaatttaggggtgcaatttttaaataggctgttttttaatttgaaaataatttaaaatt

SEQ ID NO: 23907 - DNA, 1624 bp, Heterodera glycines
ggggggggggggggtggatcagtcggtgtccaatggggggaaggcgccattgacaaggacgacgacgacgggcaatgaatgcccagcaaaacgagcgatgggtccattcatcatccgacagaccacaaatttctccacttccgaggtggtcgcccacccaaaatgtggaagaaaggagacggactggcgcgggaagtaaggacgacgggaaaggagggatttgaattttatcatcataaatggggaagggatcacccgccgaccgacggcgaaagtcgcgccaaatgaattggcgcgaggaatttttggcagaatttatcaaaaagaaaaaaatgggcttaataaattgagaatggacaatcaaagtggagagatcggtttgtgttgtgctgttctgttctgcgggtcaatcactgctcatccgccgttggtcgtctcccgcctcattagcaccgcttttgccattttggcacaacttttctcccatttcatttgacggcattttatgccgttctttgtgttcgacgatgtctttcattcatatcgagcagtacaacctgaacaagtgctttgtgaccatttaaatgtaattagctcgcgactttcgtgggtcaaatggctcagcttttggaatttctatccgaattccggaaaaattcatcattagaccactaattgctgcctaattagtctctttctatccaattcagtgacgtcacctctttgggcaactcccaacgcaatttcttatgtcccctccagggatgcttctgccgacgatgatgcgttgtgctgctgtacagatcttggcggatgagcggagtcagcgctgatcgcgtcagtttgaaatttaaccccaccgtaaaagtatttccaggcccaagagccgacgcgggtctttgagtgaccgaacccatccaaaacggtgctctgaagggactgatcagtgatcagtgaaaagtgctctgatcaatcctaaatgactcactccgtccgttttgctgttgttgttcggcgtctccacaatgacaaaatgcgacgacttttgccgtcttcggctgtgccgtcctcgtcgctgttgcccgttccgtcgcaatgcgacaaaccacggacttcgcgcacttccgtagacgcaagacgagtacaaattgtagtaattgtgcactaaaaactcatatcgttagtctgcacagtttttatctcggtcctccttctctcccccgtctctcattttgtattctctctcatccccctttttctttctcgtctctctcttttttgtattctctctcatccgtcatttcttttccgtctctctctcttttgtattctctctcatccccgtttcctttctcttactcatttcctccatgaacacacagtcggctgagtatcggctggcaggtgcggcatacagctgtcccgaggagtccatgcacagaaagtggcggttggtcactgaccgaatggacaccaggccaaaagcgactgccagaaattcgagcagagctgaacccaaagtgatttgttgtttgggagttaataattcgtttaatgcactctttcatctttgccaatgtccctaaaaaccctcccccttggacccatcccttattaaggtctg

SEQ ID NO: 23908 - DNA, 1241 bp, Heterodera glycines
  misc_feature (1054)..(1054): n is a, c, g, or t
  misc_feature (1063)..(1063): n is a, c, g, or t
  misc_feature (1143)..(1143): n is a, c, g, or t
gcctatcggcaccgccggacccactcccatcccctgttctccaaaattccttggaaaaatgcgccgcaaaaaatttgtttttttagattaaaaatgcactgaatttgctaatttacttcccaaaatagttaaatatgataattggaggcgaaaaatacaaaagttgatgctatattaattgtataaagtgttatacaagcgatttaagtattttttgttaaatgttcttatttttgaccctaaaatcttattttatggcctggatgttcttattttgaaattttttcgatggaagccctgcattagaataaaaaataaataatataaatcacaattttttatttttaaaaatattttttcagagctctaagattattttaatgttttgtagtttgtttaaacagaaaatttttgcataaataaatacccatcaataataaaaatcattctttttaaaaaaatatccaatttgagaatatttttaaagaaatgaaattattaccactattctttttaattgtaattttaattatcaaaattgaccaatttggagcagagaagaaaaaattgaaacaaaagtcatttgacgtaatttttggagaaaaatgggaagaaaaggaagaagaaaggcgaaatgaactcaaaaaaagagaaataattgcaaaattttataaaataaaagagaaaatcaagcaaaaaggaagaaaatattcaagaaaagaatggagtaaaattgaaataaaaataacgaaaaaattggggacaaatcgccaatatatttataaatggattaaagaatttggcctctataaattcaaatcaaaaactgatgaagaaaaaatagaaattatacaaaaattcattggaatggcaaatgaatataagcaaaaaagaaaatattcgccaaaagaatggcaaaaaattcatgccgaaatttgcaagaaaattggagttagcctttcagtaattaagaaatggaagaaacaatttggaatgagtaaatttataacggagaaggaaaaattggaaaaaatgaaaatttactggaaaatanaaagagaanatccgaaatgagtgacaaagaaattggaaaatgatgaaaaatgataagaagagcatttcaagatggaagaaactgttggnataaaaaatcatttgagattgaaaagatgattataagaaaaattggataaatttgccgaaaaattatcagaaaactatgcaattttttagtttttttt

SEQ ID NO: 23909 - DNA, 1946 bp, Heterodera glycines
  misc_feature (1900)..(1900): n is a, c, g, or t
tagaaattttatgaatttagatataattaacattcgcaagtctttttattttcaaaattcaggacaaacagattaatttagttttgtgttttgcgaagacggaaataaaaaggattaaaaagaacaaattgatcagttttagtgaatatttctttatcatcagagagttgccaaatcgaacttgacattggatccaaagttcgcctcaattttgtcatcagagttgcgcaaagaaacgaatgggaacaattggccaacaaaagatggagcaacgaaaaaatcggagaaacctgtgaaaaagttaaaggtttctcaataagtttaaatataaaaaataattaatgtaaaataggcaattaaatagctcatttataagacaataattcaattagtaactgtttgtttaccaacccaaacgttgtccattctttgtgaaaatgatctgtcgagtggccgaattgatgccaattcctacggtatcaccgtaggcatatttggcatttgattccttttgttttccgttaatgaaaatattgccataattgtcatatgcataagtgcccttttcatctccatacagtggttttttctgctgtttgacggcgaatccgaataacaaaacactggaaatttattattaataataataaaaataattaaatttttatattcctaataaatttattcaaaaaataaaaaatctcttactttttcttatttccgattgaaatttcgtagtaaaaaatgtcggacgaattattgaacagcaaaatcggatgtttagcgaaaacagaacacataccatcttttaaggagaatatataatataactaagtaaattatgataaaataccattctcatttctcttataatggacaatgagacttttgtcgccaatgatttcgagtttctcatgacaagcattggcatcccaataattctggcggaaatttaaaagtgcctaaaaataaaaaaacatattaattttcacctttctctgctggatgtgcaatttttcgagaaaaaaataatttttttgggggggggggggggaggattccacacgaaaaaaaataaaaaagttttttcagcgatttgttgaaaattaaaaaaaacttattgttagtaaatcttgaaaattggtcgtaattccatcaaatttttcatttgttttgcatttgtaaataaaaaaccagtaataaaagtaagaaaagagttaatataaaaaatcaaccataaatttgaaaaatagctaaaaaaattgtaatttttttttgaaatttaaaaaaatttaagttataaaaaattacaatcgagtatgctctacatgataaaattggttttaaaaatgatttttgaacaatacccacctcaacggtgccgtcaaattgcgagtcgctaaatggaagttcggcctcgagcaatgcctggggcggcgacacattttggcactgtttctgttgggtttggatttgtgggccggaaatgttggtggtgatgatggaagagaaggacggatgaacaccgccaacatgatgatgatgatgcggattcagggaggaggaggaagaggaggcagcagaagcggaggcacagttttgttgggcccgttggtgatcgaggagcggcggtggaagagcgggcggcggatgggcgagaaggggcggcgattggtggcgccgaagagtgccaccacctccatcagcagcaccggcattggtcccagcagcatggaaagatgatgatggggaatgggtggtgccgatgaccgcggaagagcacgaggagggcatcatggcggaagaagcggcagccacagcacaggcgggagcggatgaggaggacgcaaatgggtggtcgaactgaaattgggtccaaagtcgccctcattttgtgccngcactcaccactttttcacaagccttctcatgctgcaccatcttct

SEQ ID NO: 23910 - DNA, 1510 bp, Heterodera glycines
aatgagtttttattttttataagtaagaactgtcagtcgacatgcgggcgatgatgggcgggggggggggatgaagtgccacaccccccaagagcgctcaaggccaagcatttacttcgccaaaaatggctgcaccataaattcgaccgcaactttattcagttgcccatttgactcatttccaccattttttagtgtttaaattacagaaaaataattttttatttttgaaatgtcatccaattttctcgaaaatgacattgatgaggaaatcatcgatagcagtttcgatttttcccgtccctatggcccaatgcatttcccggattccgacttgaccgccccaatctcgaacgaagcattggcggagtttaggtttttagagggatcattatttttgtatttataagaatgagtagggcatatttatacaaatatctattatttttattttaaccattaaatttacagcgcatggcttagcgaaaaccgggagggtcgaggtggcttgacaccactatctgatcttgtgcggtttgagacctcgaacgcagagactgagacataccccgaccagccgatgccgataccaattcatatgggtaatgtaaaaatggtcttttttaagtaatctgtatatggtagcaattttgatgacaatttcaggaaatcgtgaatggaatgtccagggacctcgcatgaatcagggatatcgcggggattattggcgcgggcagcgtcgaatgccattcccggttggtggtcgtcgtggggggcgtcattggcgcggacaaagtggcaacaatcgatacgcagcccaaaatggtgggtttgaagaaattgtggtatgcaaaattcggtttgtagaaggtgcggaatgcatttttggtgtgcaagtcggtattcagggggtgcaaaatgcctttgtggtatgcaaatgtgagtgtgtagggggtgcagaatgaatttgtggtatgcaaatgtgagtgtgtagggggaggatacggtataatatgtttttgcaaatttataccaaaatagttctaacttttctttattaagcgaactttgaaccaatcggaccaactccgctaaaccaaggtagaaaattccccactccttcaccatacacatatttaaaaacttttagttcgctcacatttatatgggagtaagtaatattttttcaattataaatcaaatgactaatcatatacagtaccagatggcatgagacaactgttcaacccggctcccccacctccggtgttttatgtgtttagagggcccgcccacctactgaatgaccctcgcctgtttgagcgcgttaacgggggtagtgttatttttatgccgcctcaaaacacaaccttaaaaaacatgattttagcgagtcctcaaatgccgatgggtctccaatatgaccgaaatggagttgcgattttcaacccggccgttccaccccccggatacgagaaccttcgccccccgggaacataaatgccaatca

SEQ ID NO: 23911 - DNA, 2010 bp, Heterodera glycines
  misc_feature (1362)..(1362): n is a, c, g, or t
tcattattgccttcattaattattacccttccctttccattctctccccaggactatgtggtggttgagttggaattcgccgccaccttttccccgctcaattggtactgtttcgtcgtcgatgccgcgtcccccgcgctgtttaagcgccgcgtgcgcgcgttggccaaatgctttccgaatgtaattatgggagacgagcgcccgatgaaaagtgacggggagggcatgatggaagcggtgttggactgttttgagcgattggacgcgccacaacgcaaatgggaatatgtcactctgttgcaagtgagtgaatggggcgtaacaaatctaatttttgtaatacggtatatgagcaatgtacggtatacagacaattagcacagggtttcaacgtttacagaagattattgtacattttaatgattttttgacccaaaaacagaaggcattatcaaattaccgacacagaaaactcaattttattaatcattattttgttattttcttaatagaatcacgacacggcaatcaaaacgcgtgttcaaatggcacaaattttcacttggatggacggagcaaacgatgttgaagttgtagtcccaccacatggacgagtagacaaaattacaggaatggactggagttttgaggcattgaatttgttcaaaaatggtacataaattcttaagaatacaatgcttttttaattttcaatttagcctaattaacaatttttgagcaatttttggtcaaatttaggataaaagaaaattttcatttggtagagatgctaaaatttagaaatatctattttctttcaaacagctttatttcgtgggggatgtggattccgtctctggtactctcatttttggggggggggcagatttaaatacatatttaacaacggttctatgggcatagctggcgtttgtgcgcgaaattttcgcgcccaaactacgcaccggggcggttaactactaatgagccattgaaaaaatttcttaaaatgcatctgaccagggattgcactgaattccgattacgaaaattttgataaaaactgtaaattttcggaattttttcattattttggacggattccgatttcccaaaaatttttgggcctcgggcacttggatttccgaaaattttttgacacctcggaattccatccctgatctgcacgtgattctgcctccataataattttgcgaggcttttttgcagttacgcgattttcgttgattttttaaaatccgatatcacaaataggaatgtacctcgtctcttccccactcccttgagcatggtctgatcaagacaagggcgtagccagacccttggcttcgggggggngggggggggggggggggagggcttaagtcaaaaattcgatttttgggggtgtatttctcgtttttcagtcgattttgaggggtgtatttttatttttttgaaatcccgaattctggggtgtattttacaaaatttttcgccgttcgctaaaaaattaatattttttgccattttggtcccaaattttcaaaaatatggtaaattgagggtccggcggtgccgataggcgtcgccgggaaaatttttgagtatttcaatgcaattttgttaagaaaattgcttaaaatttcaaaaaaatttactgaaaatttttacttttttgggtttcgggcggggctttagccccctcaggccccccccctgcctacgcccttggatcaagagccttttcaataccaaattggccaattaaagtcttaaaacctaatctcaataaataaataactaacaaataaatttttttacccttcaattatttacaaaaaaagccactctgaatactgctgttccgtctgctgctgctgtccatggcttttcgccacatttgctgctttcaaaaggctatttcgaaatcagtctgacccgtgccatggtccgcttcattcgaaaggagctgaacctgaccgaacttgtccgacgaatgaatct

SEQ ID NO: 23912 - DNA, 1329 bp, Heterodera glycines
acaaaaaaaatagggagccaggctcgaataatatttataatgtttaattggttgataaaaaaaagttataggccaaaacaatttgggaccgaccgctaatggtcgatccgctaattttctctaccaaaaaaatcacctttttctggtccgggaatatttgggaaattgtataaattaataaaacagtttttttcacaataggaagccgaattcgcttcgctattgttagtgaacaggccagcaatactcctcaattcgctcgtagtcgtcctcccaaaaatgcctttccgattaacaaccgccggcgcagtcgccggtcaaatagcggacgttcttctcgcacttattcaaggtgaaaaccaatttatgttattttatctaattattgttataatatcttttaaaagacacataaaaatataaaactaattgatagtgtcaatgaattcaactctataggtctattcaaaatcccgttaggtctcgttctcctcttgctcgtgatcgccctgctactggtagagccatgtctgttggtggtgctaacaataagaaagcacaaaaggagaaaactactgaagaattggaccgggagttggagcagtacatgcgtgggaataaggtttctgtccctctttgtattttggaaattctcacctcttattttcagcatcctcgcatcaaattggattcttgaactcttttggatctatgaccgtatcgtaagcatcggatgtttcactaaaaactgatctgccgtttatttcatcatattacaaattcaagaacgtatttctatccattatcggttttaaggagtttgattttgttttgtttttcttttgataaatgtatgtgctgtaaacaatttgtttgttcctgaaatgtattaaaacataaaaaataattagattaatttttgtcatctaatatttgaacataaattagggtaggaaatggagcagagtgaaggaatctcggtcggtgagcagcagtcattggatttcacaggtggacaaagtttggcatgaaatgccattgcctttccatttttaaggtgtgcactcaattgggagcgaatgttcttttgccgccccatccgatgatatttctgtccgaataaattctgcggaagctgaacttgccggtgggatgggagatgaggatggtcagtgtcactttgacgaccctctcgagccaatcggtggcagtggagtgacggagtcggacgatggacgcaatgggattggcgagtcaatgttctggactcaatccattacgccagggaaattttacagaagagtatttccagtttatgccttttattaa

SEQ ID NO: 23913 - DNA, 1284 bp, Heterodera glycines
agagacactgtgctgatgaggaacggtctctttcggttaaatttgcacgtttcgcgaagtgcccatttttgcactgtcgcgaaacgccccatttttacaccatttttgcactgtcgcgaagtgcccatttttgcactgtcgcgaagtgcccaattttattgatttttatttttgcacttgtcgcgaaatgacctagcaccattatagtttacttttataaatttatgattaaaatttctaaaaattaatgaagagtaaattaatttattttttcctaatgtccttgtacgacggtttttcttccttgcaggtcttcaaacgacttaccaggaaattgatattatttgaaaagatactataatctattaattaatattcttgtaaaggtcagcttgtacctcgcatgtatcatattttgcttattgtcagttaattcaattttaaaattaaaatcttaccagaggtttttattctctataaaatgaatttttaattttatcattaggttaaaaaaatttctaaaaatatgcaattttttgtttttaattttattcattgaattgattacgtgtaattaatataattaaattgttctataacagttcatcattaattaggtataagtaaatttcattatattaaattattataattattgtactataaatttttcttattttatttttggaatttttagattgttaaaaaatttttatatactttaaaaatatcattttttaatttttatttcactttcggtacttcaattttggtgactaacaaataggcgtttgattctgtatcaattgatttattacttaaaaaaatcaaaaagattggaattgaaggaaaaattttttaaatttttaactaactttttaaaaaatcggagttttaaggttaaaatcggcgaagtattgtcagaaagtttcagcatattttcgggagtgccccagggaagtgtcgtgtcttagggccattactctttttaatttttataaatgatctgccgtcctttattgcaaatgaagcatcatcagttggcataaaaatgtatgtcgatgatgttaaattataaaacaaatcatttagataaagcaattgaggcttttgaaaaatggtcaaaaataaatgggttaaaaattcaactggaaaatgttttgactttatttaagaaaaaataataatgaaaaaagaatatttattaactccaaaatgatttcaaaagtctggaaaatgcacgtggatttgggaataataattgattcaaaacttcctttttca

SEQ ID NO: 23914 - DNA, 1900 bp, Heterodera glycines
atcagtcaaacccaagcaaattgttagcggttgaagttcgttctatcgaggaaaggggccgagtttcggatgatggtcggttgagggttggagaccaactcgtcgaggtcaacgaaacttcgtgtgatatggtaaaaatggcgtcaaatggtttatttactaagtaaaagtcccacttcagatttcttttgcgcgtgttcagcttcgtctccgtgaacttcagtccatcccaaatccatcatttgcattttttcgtcgcatttcgcaaccaaaacattcgcagaaactcacgcaaaggattttgccggtcactacagctttacaaattgggaacacttctcaaattggagaaacaaaaagtgttcatttgaggaaaggttcgtggcattgtgtttaaataacttttcaaatcttttccaatttaggtgaagatgggttcggtttcacttatgcgggacgcgaatctttcgcaaataatcgcaaggaaaacctttactatgtgaagggtttgcgcaaagagtgtggaggaattgccattggcgacagaattttgcaggcatttaaagaaacttttaaagaaatgttttgatctttcagattgatcaaatgtccctgtcagaaaaaagtcagttcgaagtaacggcgttgttgaagagcaaatcggttggggatgtcattgagctgctgatcagtcggaatgttgctgaagagccaaaacaaatgaacgcaaagaatgaaaaagaggacactttggaacatcatcagtcgtccgatttgatttttgacagtttaaatgcacacttttcgggaagcaccgatttggaattgcattgtttggaaattcctctcaatgacacgcccggtgctggcttgggactctcactgaaagcacagcgagttggcgccacggatgcgggccttttcattcgtagtgtgagttaatagtcatgaataaaaggaatacaaatttgattacgatatcccattcttattgttagatcctccacggttccgcagccttcaaagacgggcgcttgcaagtcaacgaccgtttggttggcatcgaaacccaaaatttgcttaactatgaactgaatggggaagctttggaggcatttatgcggaccatttctcagttgcctcaatcgaaacattcactacggtgagataatgctaattttttgatttatttatttttgcattatgtaagactattcgtgctgcgtaaaatgcatcaatcgcgcgattcgaagccattcggtggtggcgcaagacgtggcagtgacagtgatttgagtcagctgtcaaatttcgaccgtgaagcgccttcacggaggtctttaaattaaaaaacgatcgattcatggacgaatccttttcaatcataatcctaattactttggcacatttactctattagttttcctttttttcgtttaggtcgatctctgaaaaacggtcgctggtcacccgcagggacccctctcagctcagaacctatcaaggaattgtccatcaacgccaaatcagcggtaagcaatgagaaaaccttctttttcactctgttacttctcagctcctgcactgtcctcaacggcggttgccaattcgactcgctctcgacgttcactttacgatgaacttcgaagggtccgttccacgcattccgggccaagcgccaaaaaacaacggccaaaaacaatgttttatgtggacgagtcgggcgctgcagtgacatcggaatcgagtctgataccaaactttatcgtcacaaattaatgctttactattaatagcgttttcctcaacttttccaccacacactgtcagtagcgccgtcacaagcgattccattaacaccacaatggcactattaatgcctatgctcacaatctttcgg

SEQ ID NO: 23915 - DNA, 1867 bp, Heterodera glycines
ctcgcgtataatccgtgcttttatactcggtttcattttctcgactcaaaaagccacgaaccattcttttaaggacttcgatccaacaaagttttggatttgcttgtctcatgtctcggctcgagaaaattcccttgtctttgaagtctcggggttttaattgggtcgagagtgtagaacttgagaacagtcttggattgtttgctctatttcgagtctcgtctccaacaacactactagtgttcaatgatcagatcgggacaccactttattcatgctattttgtttccatactgtatcattttatgtgtttaactacggtattgcgttgattgtacatattacacttttgtatttgcataaatggtacaccacattttgatttttgaatttttttatcattcagtattgaattacaatattccttgaattgtgtaacttatgaaattccgctacgaatattaacatatttaaaattttttagttaacaattgctatacttctaggacctttgtacgatttcgagtttctaggttgagtctcggtccgtccgtcctgttctttgtgcggaacagtaaaagaccaagccggggtgggacttgaagccacaccccagtaatccgtgccgtactcttccaattactatgtaggcaaaatttcgtttaatagcactagaagtgaccaaatgatcatagcattgctggaacattcctaagtctgccaaggggggaaaaagtcctaaaattgcttacaataaattttttatttctcttgaatatgatttatccaagtattctcatattctctaccataattttaattttttttaagttttttattgtattttctggtttaggaatcgcttttttcttgacaccagcgggctatcactgtattgaagcgaaatccactggttactgtttttgatttgtatggttgaactacggtattgcgcttttgtgtaagtgtcataccttttttcattctgttttaccgtttaatattacatacattacaatattacatataaaaataattttacagtatgcattgttcggaaatcacaaaaatattcttagaaaatgtattatattcgctttggcgttttttgccgagaaggaatcacattctgaagtcccttttacgaaatgaacatcaaaaaatggaattctgttgacaattaattggtgtttattctaaggcccggatgaactcctaaaatagtaaatttattagtgatcaaacaaaggcctagaaaaagctggtcagaaaatttaaaaaaatcaccaagcccaaacactcctccagctcctacaaaataaacaaagttaaattcatttttaactgttagaatatttatgcttactcgtcggagtccattggtccaattttttttgcggtactttaataactccttaaataaattaaataaatattaatgagcaaaatatatatttttttttattaccgtaattaagcgcttgtcctgaatttttataaaattaaaattgtccgagctgaaatatctgattgcttatttttttaccatatctcatcgtaccatctgatttggttcgtctctcatcctctaaacataaaattaaataattaaagattttagaatttagaatttaatttaaggtcgctatgagattatgaaatgattgattaattgtttcattattgtttggatttccaatcaagtcaaaaatcctcaattttaatgatcaaatgcaggagaaaaatttgggcaccctattaaggattaaaaaaaatcgaatattttaatttgggcaccctattaaggattaaaaaaatcgaatatatagtttgggcaccctattaaggattaaaaaaatcgaatatt

SEQ ID NO: 23916 - DNA, 1830 bp, Heterodera glycines
tgttcgcgccctttgtctgccccaattggacaggccaattcggccgtgtcagtccctttgtaaagctgtcgaacaagtcccaaaacggcacaagacccaaatggttttgaacaccattttaagggttgtgccgaacggatggccaagtacggctttccgtggccttcgatgctcaactgcagccaatttccggtggaccacgacatgtgcataaaacccccgccgatggcccaagcgaccgaaaaaaccaccgaaaaacgcatccgttggcactttttaacttataaattgtgccgaattttaaacggatttttgccaataaattaaaataatcaattactcgtgtacatgtaactaattgttgttatttttggacagaaagcaactgcaaagcgtgttctcaagttgcgactttcgaaaatttgatggacaacttttgccgttcctccgtcggtgggcattcatttccttcccatccttttatttatttaattcgctttaatgcttaattttgccaattctcagcatttgtttctctcaccgctctcttttccgtctctctctttgcccaattatttgccctcccaaatttcagtgttaaaagtgcgtcttcgtcctctgaatgcgtctcacattgaaattttgcgtcgaatgcgcgtcttcaaagatagcgccggcggagttcgaaatcgaagttcagccgtcgcctcgggcgacaggccaacgcaagtgattcggttggcagagatcggagagcgaaggtgccaatgccgacaatgggacacaaacaaacgaaaccagcaattgccaggtggaaaaacaaaaatagcagttggagaaacaattcattttaaaaggcaatttcttattaatggcatccgaagagcgaaggaacggagccgagtttcaggcagcaaagctaatcgtgccatggaaacaggaaaaggtgaagcaattgccaaaattgacttaaatctttgacaccgattcaaaaaatagtcgagaatttagtcaaaatagaaatttattttctaaataaaattttcaaggcgttcaaaacggcaattcggagattcaaaagggtgaactgcaacacattgggacgagaaattcgggaaagtgtgctaagtcaaatgttcagaaagtcatgaggaggcaaagaaagaaagggaatagaataggaggagaacaaaaacacagcagcagagagaagaaaagagcttcaaacacctcacaaagtcaattaaaatttagtaatcaattttaaaatgaattaaaatataaaaataaaattttgcgtcgccaaaattgttccaaagcaaattgtgaatgatggccacccgttaatgcacttgtttaaatgctttcactgtcgtccatttcgataacttccgattgaaatgcgtccgcttgtctctgtaactcggctaatccggtgatttgctccaactcggcaggacattggaagattcggttcaaaaattcaaatccctcagtccggtagaactgtttgacctgagagaatgtaaggataaaatgaagcatttttaaaaattaaatggagaaaaatacaaagacagtaaaccaaacagtaccgtatgcccacacgctgtgcatcggtcgtaccgtcgtacggtgggcatcatcagatgaaagcgtgacataaaaccgcggatttggtgcggagtggcgcccaattgactcgcgttttcgtccacttcggccaaaagggcgggcgcttctgcgcccaattcgtgttgaaggacagaagccaacagttcggtggcaattcctaacaaataaaataatattaaataatgtaattgataa

SEQ ID NO: 23917 - DNA, 1809 bp, Heterodera glycines
ctgctcgagcgctcaccatgggaactgtcgatgagtcacttttacaatcaattgagtttgaacgaataattctggcgccttttcacgtcttccagggcattggaaatgctctgatcaaagagctcgaagcatcgacggaaaacgcggaaattgcgaacgaatttttccggagcatcagggcctggagggaagcgttcaggaaaaaggacatgacggggaactcaataagaaaagttctgattcatgcggaccaattggagaggtgttactcagctgaatggccgcaaatcatttgtcaaaccttgggaaaatttgcaaaaatacaaacttttacaaaagtgcatttttatttgggttttttgaaaatcaaaaataaatttaaggcccagccattgtcgccacgggatttggacgaattggaaacgtcgattgatcaatttcggacatttctcgacgatcagtcacggatgcgcactttgctcgccttaaaaccaaaggtccacttggtgttgaaccattttgtgccgttcgccagacagcacaaatttttggcacttttggacgagcagggtcagggtcataaagccttttgaaatttaagccctaaatttttttaggtgatgaagcattgcattcagtgtggaggcggttggaacagctttggaagacaatgcccgatgaagaacaaatgcgtcaattattggaacatcattttgtgtcaaattggcttctcgacacaggaaaaattgacgaaatgaagcgggtcagtttggcgaaaaatgggttcaaaatgaaatcccatgcttttggaccttgaagaacaacaaggagaaatcggtgaccggcgggagacggacgaagaaagcgatgcagaagaacaattcgatttcgaataaacccagttggatttaaacttttttttctttgattttacagaaaatagctatgaataaaattttaaaaaattctgagcttctttaaaaattgtgttatcacttcacatatatttatttgctttaaaaacctcaaaatacagctacaacatgcattggattcgaacctgagaccccccattttttgaccaactcacagaccactgcgacgaaaaatccaacttaattgtacaaggagcccaaaattgaatcgccgtgtttaccttttaaattttttagtaaattaaatctcggttttttgttcaagtcagggtcgagtttcgaatttggtcaaaatgcatgtcataatcgttttcagcgacctctaaaaccccaaaaatatgttttccttgtaatttatgaatttagaatttttgttcgaattcgggttcgggattcggaattttgaaaaaaaatgtcatattcgtgatcagcgccccaaattaccctagaaatgactttttatttgaaaatttcatgagggtcacaaaaccgaaaagaaccaaatgcaagagccgatctcgagttaataacttcgagtcgcagggggtcaaaatatggaactatgcaaaattaaaaaaataaacaataggagaaaatttttgcaagggcaagtcttttctttttctctcattttgacgcactttttctatctctctaactaacatattgttcaaatccataattaatagttgtaattttttcttttagtgttctgttttttatttattgtaattttttcttttagtgttctgttttttatttattgtttctttatttgctttaaatgaattgaaatttacacacaacataaggcgggacttgaacctagaacccccttttggtgactaactcacagaccactgagacaaaaaat

SEQ ID NO: 23918 - DNA, 2621 bp, Heterodera glycines
  misc_feature (1263)..(1263): n is a, c, g, or t
aattttcaaacagtgggagccttacaattttcagtcgacccattcatttctgatttgccaacttcgtccaattcttttaccgttcaaaatgtgaatatttcgtcgcccaaaggtaagaaaaattgctagtcacgttaaaaacccagcaaatagctttacacactattagttaatttttttgaaaaatggaatggaaaaggatatattacaattattgctcagtgttgaattttggttcgtggcttgcgattgacccaaatggacattaatccgtgatcagaaaatcgaaacccatccgaaaagtctttatttttaactactacttttgttaaaaagggttgtgtgaaaaatttaaaaaatggttattccgaagatagattttcctggaatcaccgtagaaatatttaattttccttttttttttgcgcagtgctaaacagattccgagtgccctctccaacgacagtcggacttgacgaggatgtctctgccccggtgattgcagcggcgacaccctcccccggagagaatgtcctgccgaggccttcgcttccaattccatcgccgccccttcggcctctttccccttctccgcccgcttcaccgccacaacaactgaaaagaaaggacgccgacgtccattcgcccgaagggtcggaaagtcgacgcgcgaaagtggcgcgagtggagtcgccggatgtactcaaattctttttcatcgacgcttatgaggacgccttcagaaatccgggcacgaatttgcctaagttttcgaattatctgtcccttttttacaggcaaagtttatttgtttggtcgggcgaaggaggaacccagcggcactttctcgagttgctgtttggcgctcaaagacatttcacggaaattgtttttcattaaacgggaaaaggtcgcctattcctttgcgttgtgctaattgtcttttcccattaattgtaagattctttcctcgggtattccggcgacggtggaagacttggaaaacgaagtgcgaacggtgttcaagacgaaattcggaattcgcaacatcaaatgcaaaccggaagtaaatgatggacataaaacacatttctcaataatatttgtcgatttgtttagctaattaccaagaaatttatctgcgctgatgaatctgtgcccaaagagtgccaaacgatggaagtttgtgtaaatgtgagcaaacaatttaaatgtgtgcaaaaatccaatgtttggccatttcagtggaaccccgaacgaatntccgtccgacctttctggtgattgctttagtcatgtgatgaacacgacggcaacggcattcgaacgactgatggtcgaatgtgaaatatacggaccatgttggcttagcgtaagaaacgcgggtataaacaaacattcaaattggttagacttattctacaaaagttccgcttctaagttctcgctgagtcgccagtttcgtactgtccattggaatacaatgtcgacatgagcgaaatgaagtcaatctcaatggcactgaactgtgccgatccgctccctccaataagcattatttctgtgaatgttttgacggcattgaacccggaaaccaaagagagtcaagtcggtcgtcccgttttggagtttttttgtttggtcaattttccaccttttcagatcgtaatggtttctctcattgagcacaattgtaacttggaaaagagcaccaatttcgacgcaaaaatgatgctgaacaaacgcttttgtgtggttgcgaagcttaaaaaggggctgaccttaccattcgattggacagccaattgaaggccaatggaaatgacaaattggtgcgcaaagtcggcaacgaaatttcgctgttgaacattttcctcatgaaaatggaggagattaacccggatttgattttggtgtgtttataaaaagaggtgatggacagtatcgtgagaatcgtcttacaattgtcagggtcatgatctgaatgctcagttggtgctgatccaaggggcgattgaacggcacaaattgcaacgttgggaccgacttggtcggctgaagcgcagaaatcacatccaaagagtgggccattccaagtcggcgagttgggatctgaccacgggaagactttgtctggactcaaagtaattaatggactaatgagaggaaatttgaccttgtcagcccttttcagaacagcggcgatggaattggtccgtgcacggagctacggaatggaggaattagtcgcgcgtctgctcaaagttggaaaccgcggcaatctttccattgaccaaatttctgagccctttttgtacgaaagcgggattatgttttaaacagtagttgttactttttagggaaacaaatccaaaaataaaattgattgaattgatcaaatggaattggaacgagaattttttcgcgatgaaaattgtagagcatttgaatgccattcctctttttgtgcaaatcactcaaattgttggcggtgtaatggtgattttgtcttttaaaaattgtttcttattcaaatgcttactgaatttgtttatttcaaattccctttttttagtcccgtaagggtatgggtggacgtgccgagcgcaatgagtatttgc

SEQ ID NO: 23919 - DNA, 1161 bp, Heterodera glycines
agaaaaaccgcgaaatatgtaaataaaatatgtataaaatgctaaaatatgtacgaatatgtacaaaaaacccaaaatatgtaccaaaaatataattaaaaaattttttaatggttattttttggaaaaaaattcctagtaaagggtgaaacatgcacaaaatgccttaaaaattacctaaattggcttagaatcacttttaattattttaaaaattattttaatatctcatttttgaaaaaaatagattttttaagggttatattttcaaaaaaaaaattttaatttttcacaaaaaattttctataaattctctaaaatcctcaaaatatgcaaaaaataaaaatatatacgaaaaattgcgaaatatgtacgaaaaagtccaaaatatgtacatatatgtaatatgaagaaaaatccaaaaaatataaaaatcccaacttttgttcgcaaacacaaaaaagaaaatgttttcctactaattagagcattgagaatccaaaaaaaaacgtatttatatatgtctaccctagtaataaccgcagcgctgcctccagctcgatgtgcgggattgtggtcgagaatcctgcgaaggaaaatataaaattatgggcaagcaaactcgacagttacccctttcggcgtcttcaaagtgcgggcagttgtagtcagcgtccaccagacccttggggtacgtctccgcgcacttcaggcagagtgagaagagggtcctgttgttccaccgcattgggatgaccggaatgtcgtagaggcaatggcgtggaggcacaacgaagcacttgatgattctctccattttcacgccttcgtcgacaatgtgttcaggcgctgtccagtggacgttcttgtccattaggatgacttttggatgaccgacgggggagttggtgaacatgttccttaattattgattattttattttcttttttacctggacgggtacagactgttgaagtctttcactttcatggtttgcccagactctccctccctctccgggatgtgccaatagcatctgaatgggaagaaaattagcataatttggtattgtttccttacccattgacttcgatcgccaagtttttgtcctcgccgatccgcttgagcatgccgtctaggaggaagttgccgtgcttgta

SEQ ID NO: 23920 - DNA, 1489 bp, Heterodera glycines
cggcaatctttggggacgcactcagcactcgggaggtcaaagtaacgtcacaatgttaaaataaacttttcaaaattatcatgaaaaaattctctgtcacacggtaaaaagtaataaatttttgagtgggaactaattatggcttcgtgcaaaatttaatttggtttttgttcgaatttggggttcagattgtcggcatggatttctatgtataatcaccgaccctgaaaaattcctgacttttgttattttatttttttatccaaaaaatacaattttaaaaccatttctggcgattttgaccatcaaagtggaaatcttggtatccttcgaaaactctttccatagtgtaaaatatcaggatggtaattctcaaagagcaggatggtgttagatgtgttaatttaatgacaaaacagcaattgataggcaaaattcaaaataattccggtggcgctaccatcttgttggcaacaggttgtagacagtcagggcaattactttgttaagtagctttttgatcggctttgttatgattgttatttttcattttttgttcataaatttttttccttcaaaaagcgcccttttttatgcaacgacctagtattttttttctgttttggcgtttcgtctctccatttttttttcacttagaaagtcccttttttgcacgacaaattgctcgacttatacgtgcatttcatccgcagtgataaaaatggacaaaaagaaagggacgatggcactgatctgttgacggaaaacgaatgtcggcagaaattgcgtcattttttgctcttctccgaccatttaaatagcaaaaaagttgcggaaacattcgtgaaggaaaaaagcggaaaatttcacattgaagcgattttggcagaagcaaatgttagtcggtgttttctttgaaaaaggcgacaaaaaatgaaaaaaaggagaggaaaaacaattaatgatcaatttttaaacaattttgccttttgaggagcacaacgccgtggactgtcttcaaaaactgatgggctccgctgccgaaactgacttttccccctccatgaaagaactcttttccgccggccaacttctctgcacgcgcttcccaagccccgaaatgttgacgacgatgctcactttgcatttgcgtctttcctcgtactcttttattttcattctctaatttccattcgctgtcagtgccgacccgacactccgtgccaacattgtgcaaattttggctctgttggacagtgccactgacgcagccgcggtgctgcgcaatttgccggacgaccttcgctcgtctgctttggtgtgcagttttcttcgtcgccatgtcgcccaccggacaaataccaaacaatgggaaaaaatgcgtatggaaaaaaacgccgcatttttacaatgcgactgatctgaaaatgcacaggtcgagaatttggtgcccgagaacaaagccgcacagaacgcgagttgggcacgc

SEQ ID NO: 23921 - DNA, 1478 bp, Heterodera glycines
actacaataggcacctatcttttttttctggtagcctacagtacccttttggggggcgtgcgccggaggggacgcgggcggccgtcttcgtcgtcgtcgcggggtcgggggggacgcgggcggcggcgctcgtcgtgtcggtgcccaccttcatttcaaaaatcattttttgcccacagaccattttaaatcgatttaatttttgtataatttcagctttttgtacctgaattaaaaatggatgcgacaaagactggcggtaacaacaaaaaaagtcgtgccataagcagcacagacccagcgaaagccgggggcaagaagcgccggaacatgcacccggttgtggccctccaaaaaattaggaaaacagaaaaaagccccattacaccccacgaaaaaaagaagcaaattttgggtctcgatttcctccttataccgggggtggaggtaatatggaaaatttgctaacccaattcatttgtttttgcatttttagcaaattgttgacatcactccgcagcagcagcaaaatgtcgccgaatttcgtccaatttcaacctggagtgttcagcagcagcagcaatcggacccgcgtgcaatattgaacgtaatttgggaggcggggggctgcccttttgacaggctttaatttgtaagcctatgttcagcagggacatgttgtggttggcgaattcgccatggccggcgacccctcagcacaacagcaacagcagcaaccgaattttcctgcgtcgcgcatttccatttcggttggtttatctgtttccctcaatccattcattcccctactaatttaccccccccccccattttcagtatagtaaaccgtttgagcaacagcagcagacaattatgagccaacaacacgagcaacggcaggccatcatggagaggattcggcgccggctgctctccgagctgtccttaatgtaagcggccaagccgctaccggaagacatcgaacattgcgcagatacaacgcgcatggattgacggacgtcggctggcttctgcttggttggaaggagcaaatgctgataaggtgatcagcatttggacggttccgggggggcataactttcaaattgctttttggtggtcaacagcgaataattttttccgccctttttcagccgattgaccggcgtggtcgcccagtcgtgcgtgatgggcggaccaaacgccaaatttcgaggacggaaattggtgctgtagttcgatcgcgacgcatcacagcttttgtccgtcaaggaatgggagcggaatgatgggcgtcccagcgaattggcacgggcgcaaccgggtgaccgcgtgttgctacaacgactgacacgcaaagcaagggcgcggccgtcacttcgctcgacaacacctttttattttcttgctcatttggacagttttccgtgttgcagatattggcgcacaccggaaatggtaataaaatgccggggggt

SEQ ID NO: 23922 - DNA, 1363 bp, Heterodera glycines
  misc_feature (1174)..(1174): n is a, c, g, or t
tttattattgaaagtatatttactttaggcgatatttttcatattatttttatcttctcactaattgttgtttttatcattatcaatgatattattaaattcataggttgaacataacgaaaatgccaaaattggaaagccggtgataaaatgtgaaccgcaaagtcgctgcttggccaaatcagaagttgacaattatttgggttcacacaatttataatttatattaattttcatttccatggcaacatttcttttttcatttatgtcattttaatcattccaatttttaaattttttgtttgaataaaaattgcaatttttgaaatatattttatttttaggtgttttgcaatttgcttattatcaaaattaaaataaaaaaagattaaactcaaaattaattcaagaagaaattcaaattcaaaataatattttaaattatccaatcattttttataacaaaatgttttaggtctactgaattgaagagatttatgtttttgtaagtagaagaaaattccaggtatcaaagctatgctcactgaatacaaaataaattctatttaatcatcttattccaaaaatattaaaattccatgaaataaatatttattattctttaatttctatgataaaaatgaaattttgtgtcatttgtctcgttttgttccgttagccatttgtccaatttgcctcattttgtccatcaaagagccatttgctcaaacaaaaaatattcactcgcgcaaataaaaaaacagaaaataacacataaaaatgattattttatttatttatactattaaattacttgtaatgaggcaataaaaaatataaaactcgaaatgttagaaaatcggttaaagtaagttttcgtaaaatagttatgctctctgacctaatagtctttttcagccaagttcaatcaaagtatttcagttcagtttatttccatttcttttaaaaatttctattttgagttaaaacgccaaaaatttaaaaaaaattgaaatttttgatagaataaaaagaaggcttcggtttatgaaagtggggtaaaaaggtgggaaaggaaacaaaacaaaaaactatccttttttaaattttattattcttcgtgattaatctttttaaaatgtttcaatatgataaaataaagattttaaactanagttgaccagcagcacttttttgatttatttttgtacaaatataaaactcagatattttttaactggtctattatttaggaacaaatctcttattcccaaaaatattaaaattcccatgaaataatatttattattctttaattctatgataaaaataatatttttgtgtcatttgtcccgttttgttc

SEQ ID NO: 23923 - DNA, 1119 bp, Heterodera glycines
  misc_feature (1105)..(1105): n is a, c, g, or t
tcgcctctctggcattcccctcccatcccttctctttccctctttcttacccccccccccccccccgccatcccttctttctctttttgtcccttttgccgatttggaaagggcaaaaatcgtcggcccaaagaacgaacaacgaaataaatgcattgacaaaaaaatgtcctctggggacgaacgaccgttttcgtttctcaaatttattcgtcgttggccgggcggagaagaaaaacaagaaagagagagagagagaaagagagacaaggaaaagacgcaaaaaaagagaggaaagataagaaaagagggaaagggaagagaagagagaggaaaagaagctattcgtaattcgtgaaatgaagaatggtaagcaataaaagtcacgaaggcgcgagagaaggacacgaacagagagagagaacaaacataaatttcttctctccctttcccctctctctctctcgtcatggggatatgaaaattgaatgtaatgcttatgatgatgataatgatgaatgacatttatgtaatttacatttcgggaacatcaaaacacgtgagcggggagaaaagccgcgcaggatttgggaatagtcagcagcagtcagaaagaacgtcggaagaggaagcaacggtttctccttccctccccttcccattccatctcaaaccaaacaaattcacttgtacaacactttttccttccaccatttgtggcttcgtattaacgcattgaaaggattagcaaagggagagaaaattaggatgaacgaatgcatgaaaatggagaggagagttggaaagtgaagatgcagcagcagttagagcagggtagccagatctgaggcattagcctccattttgtgggtttttgataggtcaatgaggctaaatttgcaaaatgaggctttttgtgttttttttgagaaaaaccgcaaaataaagaattttttaatgaaaatatgctaaaaatatggtcaaaattcttaatttttccccccggcggcgcctatcggcaccgccggaccccgtgtcccccaaaagttttttgggaaaagcgccgcaaaaaagtcaacttcgtttttcatgttcagaatcccanaaaaatgcttattt

SEQ ID NO: 23924 - DNA, 1037 bp, Heterodera glycines
catgggcgacattgacgcgaagaagttggctgatctgtacaccaagaagtcccaccacaacaacttttcggtgatattcctcacccaaaacctgtttgacaaggcgatgagagtgccaaggtccaatgcgcagtacatctttctgatgcgtgcgcccagcgatatgttgagcattcgtaatttggccagccaaatgtttcctcgcgagcaagggtttctgatggacgcgtataagcaggcgtgtgccgatccgtacgggtatctgttggtgaccctacacgcaaacacagacaacctcttacgactgaggacaaacattttcccagacgacgaagaaaagattgtctttgtacccaaaaatggttaagaagcaaatggttggacagcgggtgttggacaactacgagtatctgaagtcccttgggaggacgacatctcacaagaagaggcgtcatttgttgagcagtgcaggttgtgaggagctgctgactctggtggagatttgcttaaacctacttaacggatccttctgtttgacgcggaaacagaaacaaaaattgttgccttttgctaacaccattcgacggttggcacgcgtgagaagtgagcagagtgcgagaaagctgatcttacaacaacaacaaccacagcaggagggaggttcactgtttgcccctttgttggcacctatactgttagaggcagcacgttatctgctacgcaaagatggccaataagctcattcttctgccttttgagcattaccgaggattagttgcagcgagagagggtgtcggcgttgcgaaaggagacgaggatgtggcagggcagacaaatttgggattcgtcaaacgacagctggagaccgcgaagaggaaacggacagcgaatgtcagcgaacgaaatgtattgtacaaccagcagctgaggagatatttgaagctgagaaaggaggtgaaggacaggcccctcaaggtacagctaagcaacggtgcgcaactgctgaataagacggtggagacgggcgtacaggtacg

SEQ ID NO: 23925 - DNA, 1085 bp, Heterodera glycines
ttctgctgccttgcatatcggacaaatgccgtactgttcaggcaaattgactgtgatggcaccggtgccggtggaatttgaaacggccctttgcgacgcgacgtgccgcgaaggggacacgctgaagctgaaggcggtgcttcttggcgagccgatgcccgacgtcacctggttcatcaacggcaagaagttggaagagtctcagaacatcaaaattcacgccgacgccggcacgtacacagtgacaataaaggtactaaggggcagacgaattgtgacagaatgccaacaaacaatttattgtgccaaggacatcaccatcgactactcggggctggtcgtgtgcgaggcgctcaatgagttcggcaaggcgtcgtcgcaggcgacgctgaaggtgctgccgcgcggggagccgccggactttttggaatggctgagtaatgttagggcccgtcccggctcacaggttggaggaggggaagcatgcatatttgaaatattcattttatttttattctctgcctcataggtgcaccacaaagtcgtgtacacgggcgacccgcgtccgtccatcgcttggttcatcaacgggcacgaggtgcgcgactcgagcgaaataagcatccaaacggacagcaacacgtccgcgctggtgatcaacagcttcagcccggacaaacacgtgggagagatcatttgcaaggcggagaatgacgcggggtgagaagcattttgaaatggagggaaaagccattaaatggtaaataatgagttaatgactaatgcataaatgaaaataagtttaaaattaaaattttagtcattttatcaaaatctcacataaaatttaaaagatttctcggaagtgtgaattggaaaatcagaacacttttctttaaaataaataaataaattaattaatatatttttatttagcgaagtttcctgcaccgcaaatatggcagtacgttaatcggccttttaaatgcatttgtttgaggagtaatttttgtaaatttgatcatcagacgtacacatcggacatgttcaccgagtcggaaagcggctcaatggtggaggaccag

SEQ ID NO: 23926 - DNA, 1436 bp, Heterodera glycines
atttatcattcgattcctattttctttttgttctgccttctcttttgactccgatcacttctcagaatatcccaaatttgccattgatcgctaactccgatcagttcctctcattcgtccattatgactttgtctctgatggtcgaattggaacagcaccaccaccagcagcagtacagtcagctgtttggcactgacgacacttcggtgccaacagtcgtctcatccaatggcattttgactcaatcggcgccaatgtttggcaccgccggtgacgccaatcaaacgttgaccaccgatggaatttcaattgcaacaaccgcaacgggcaatgccgatgactgcgccaccggcgattcgtcgtcgtcgaccccctctctgcccgacgacagttgcggcgacgcgcgacgaccgtcggcgatggcaaaacgcgtcgacgacggcccttccgcgccctataaaatgggctatttcggcgcaacatcgtgggcaatttcaaattcacttttgtgggcttttcaagccaagactttccaaaatatttaattgatttcccccccccccccattttcagttatgtcattggcaatatcatcggttccggcattttcatcactccgtccaccgtcgtccgttgcactgattcggtggcactttccctcttagtttgggtggtcggtgctctgatcgcttttctcggttccctctgttacattgagcttggcaccagcataagagaagcgggttgtgactttgcctacatttgctacgtgaaatggtgattaaatgccgggcccatttattcacaataattcatttattttttattcaattattattatttttacatttttcattttattttctattttccctctcttcccccaggcattccattgccttctctttcatgtgggtgtccgttctgatgacttaccccgccacaattgccgtcatcgccgaaacgttcggccaatatttaatggagggccttcgccacttttacgccgtccccgccgaatgggcgcccgtggcacagaaatgttttggcattgcgcttctctgtaggtgctaatttcaaagcaaaccaaaggcatttgccgacaattctcccagggcttatcacttggatgaattttttcgcaattggcaaattcgccgcacgttttcaaattgcggcaacagtggccaaattggtgcgcatttccatttttgggaaatatttattttttattaatttaatttatattaataatttaattgatttccaattcacagctctcttgcgctttaattattgtgatgggcttttatcatttgttcttcaaaggggcggcatttgagcagacaatggaccaaaacacaaagtgagaaaaggaggacagaaaaggaaaaaacagattaattaattataattaagatggaatgttggcgaa

SEQ ID NO: 23927 - DNA, 858 bp, Heterodera glycines
caaaattttgcgattttgagcaaattttgcaagaaaaatagggatttttagggacggccgtgccgataggcgccgccaggaaaatttcacaaattttgaatgaaatttgcgatgaaaaatgagttaactttaattaaatttattatttaatttatttaaaaatatttggcattctgtcttagaaaatttttcaaaaaaatcaataaaatcccgcataatcccgcacaaaaaaacaaatttgcggatcccgctgcgggattggaactcaaatttctttggcgggacgggatcccgcgggattaatcccgcaaatcccgcattttccaaaaaattcgggattgcggaatgggatcccgcaaaatcccgcgcgggatcccgtcccgcgccgggctctatttatcaccacttttcacctgtttgagcaaatttggcattaaaagaaaataattgtgaacatttaggcacggaatatttgaattgaatttgattgaaattagtgagtttaacaaaggcatgccaatactgttcctctcgtccgttttgatgttcttcagaacagaaaagactgattcacaaaaggcattggaatggaaaattgatagaatagcagagactagtgatttgagcaggacaaaattggggtttatgaaaatagccacccatttttgatccacatttttcctattgaaccggtcgccctcgagctccttcagtgtctgtttcaactcagcgatctcagcaaacaaatcattcatttcatcagcggtcgtcccacaaaaatgcctatacgcctttcgaactttttctgatgttggttcagactcgaaaatgacccagtctccgatcacttcatccatc

SEQ ID NO: 23928 - DNA, 1085 bp, Heterodera glycines
attgatttcaacaggagacaattgaaaaaagcaaggttttggcacaattctttttttggcaacactatacaagcaggggaaagtgtcaaacattggccctgcactctgatcaggcccaaggatggaagagaatttcatatttcaccgaaaagaactaaaatgaattgattttttccaaaatttcctaattttggaagcaaatgaggatggcacggggacgggttagcaaaaaaacaatattgaaccgtaaatgcaaaagttaaaaaattttttttttgccaaaagggtggcctttcaaattaatttctagcgaaatttaaaaaagcgttagaaaacacaaaaatatttcgaaaacttttcaagaagggtatttgtttatgcaaagtaggtgccgccggaattttggaattgaggagggcgaaaattataagaaaacaattttgacttcaaaccctaattatttcccggcgatgcctgctggtgcctaccctaaattcctttaaatgttttttcacaacaaaacccataaaaatagaaattttgtggggaaaaattttcttatcaattaaagccaaactttttcttaatttccatcagcgcacttatctgcgccgctgggaatcatcttcaactttaaataaattaaggcgctgatgggaggaataagcggaaaataacgcgccaattcgagtggagagaaatttcattgtcagcgcaagtattgcgggaaataattgagtaattcgaaagaagggtatttttaaaggtcgatgaaatgaatgaaccgttggcattgaaattggtgaaataaaaccgaacggagaaaaaggaagcgatcggagagaatcaaaagtggggaagcggggatttcaaccgagattataaatgaattcgaattttcagcaaaaacaacgccaaattgacgaggcgcccaccgacagtttgggcagagaaacagacgaaggccaaagaaagcgaagcgcaagaaaaacaatgagaaaagtgccacactttctttgttttgccctatttgacggaaagggcataattaaatggaaagctttaataaaccaattatgcaaatg

SEQ ID NO: 23929 - DNA, 2033 bp, Heterodera glycines
tgatgagcggcaccacacctttatttggtggatgatcagctcgttcacttggtggtctttgaggctcgtgatcagtgacaccgtcggcggagtgcctttgtggtgggcgaagcgtttctcattctcaggcgcaattgcgaatccctccaatcggctctcgaaacacacttggcaccaacgcatccaatcattctgaaagaaagggacaatgaccaaagagggcattaccattcaccatggggggcaattggacgtctttgagggggtcatcatcaggcactttgacgcactcaaactcggatctgctctgagagaattcgttgctctgaaaaaaggccaaccgataattactaattaagcatgaaatatttttagaaaaatgcaaatggttaaaatcaaccaacagtttgccacaatacttttcgaaaaagatacgatgttccgggatgggtgccaatttaatatgttcactttaatgtgtccaatttaatgtatccccgggctgtgagttttcacgcacccccaccattgttgaagcattctgagccattcaaacgcaccttcgctacacaccactccttgttcggcccgaacctggaggtgaaggttcgtgagtcatcgcaaatgcccggaagatttgtgagagactttcttaagggagtggcgctgaaccgtttgagcacttcgggagaagcgacggcgacgtcgggcaaaagctcacggccaacgacaacctttgggaaggaataaaaacattataaaaagccaacaaacaagctgacaatgatcgcatttgctaccgacaaataaatttccatgccgcaaaagccgaacaaaaataatacaaaaacggaaacaataataaattcggcaaacctatatcagcaaaaattatagtagttgcaaatcagcaactttttcagcttgttcttgccaaaaaggcctttttgatattttttagaaaaggcggacgctatgagagacaaaacggtacaccgtttgcccaactccgttcctctctctttattcagtgttatacaattcgtacaaaagtcaactcctaatccctccgcccacctgttgcatgtattcttcgacagtcatcgccggcttgttaaggtcaattttgcttctgtcgaactcccccaccgtgtaaaatgcctcttgttccattcgatttttttgatcctttctttgtattttatatttcggtcattaaataatgagaaattcaaggtaataaaagtatccaaaacaaaagaaaaagatgacaaaatccaaacaaaataatgacgttttttattgtcggaacaaatcaaataaatttaaattaaaatgtttttgacgttcggcgctaaacaaataaatcctcctttatcatgtgcagctcaagcagtttccaagctgttgccgggttgaactcctccatgtctcggcatattacctaaacaatcactgcttcgtctccctcttccgttcgccccacccattaattactcacccaaatgtgtctcactcgaaccgctttttcagggtcaccttggacaattttcccctcgctgttcttcaccacatttgtcatgaatacttggaattggatgaccaaagtcggcccttggtcggtcatattccccgtgaccaactaaaactcgacgaaaaggttgaagaagacatccctaaaaagtacctccactttgctaacatcgataatgcgagaatccctcgtgttgaagccaatcttttcgtattctttgatagaatttgcgattaaattgaacgccttttgaagcatgaataaattacaaattgattatgattcaacgaatcactcactttctcgtaacaccaatcacgaaggatttcgaagttcatttggtaagttgattcaagaatgttcgggatcatttctttttcgcaaaaacggagccattccgacttgtcgaattcggggtcgattttggatatttgcgttagcacttccgacacattgtctttggattctgaagtttttaatcattcagcaaataaatata

SEQ ID NO: 23930 - DNA, 2493 bp, Heterodera glycines
tgaaaaaagtcgcacggcggtaaataatttttgtgacaaaatttctcaaaatcctaaaatttttttacctttttatgaaaatctaatattaaaatcacttagtatcatcaaaatttctttggtcggcatctataggccccgacggcaattatcgcactcaaaaatttaaaaaatagacaaaaaataataatgctttgaatccgaaaaatctcagaaaactgtggcgagacaattaagcctcaaaaagttgtttgttttaaaaattggtcaaaaattacttttgtttttagtcgccctaatcaaattttaaaatttcttactttaaaatattttcttgtcattaaattatagcggaggttatgcaggttttatagttttattaaaattgtcgaacgactgatccgtctgctgcccccccccccctccattgtccgcttggaacggcttcgtgtgctcgatttgtgcgacaattatctgaccaaattggtcggtttttgaatactttttttcatttttatttatttgtttttttattagactgctcaaatgatttttttggaaaataaataactgaaaataattcacacatttatgagctttttttagccccgttccaggtcttagccccaaaatggaataaatgcctaaacctatttccattttttgtttaaaataatttcggagggaggaatccgaagactttttttgctcttctggcaaaaaaaaaacgggaatttgtgccgtccaaaaaaaggactaacaataaggactattttttgccattttgtggccaaattttcaaaaaataacgcagaatgaaggcccggcggtgccgatataagccgcctggaaaaaatttttttttttgaaattttaatgtattccgttaagaaattttgtggattgactctcgaaccggcacagcacgacgaatgccgaaggactacgtccacgaattgtacgaaacaacgatcaaccaaacgaacagcaatttggaacttcatccgttgatcttccacgcttggcaactcgacaatgagtctgacgcgacacgcttcccgcacatcaatgaattcatcaactcgtagcagttcaaggacaagctggaacagcacattacagcaaggactgaagctttgggcgcgttgaagggcggaatagaaggattcaccatgcgctggctaaaaggcctgatcgacgaagcaatcacatggtggattcgagtcgcctgcgtttattcgaccttcctcatgctgcgcgacattgtactcccatgcactctggcgtatttgctcaatcctatccgagtgactcttctcagcctcttggagtacgcccgcattcgacattccgacccaccgtttccaaaccactcgggatcgaagagggaatgccgctgcgtgaactgccacgaacccccaaaccaccagcgcgcagggcagagcaccgatccatgtcaccaatcaaattggacatgattgccagaacggctcggtaccaacaaccacgaacacagagccatctcgaccccacagaagactcgccctttgggaggccgagacgaaaagaattctgacggccccatcctttttcgcgccggaatgtcggaatttttattcctatcgccgatcaatgatcggcggaattaagagggaggaggcccttcaccaatcccccgcccgccgcgcgacatgttttcgccgttccatccctctgtccccctttccttcaaattgtcaattgtttttgtgtgttcctcccccgccccgcgcacaaattaatgaccaatttgtcaaaccgcaacttttcgccccccgtccccaacttggcgaatcgactccaaagaacgatgaacccccaaatttcccgttttccgcccattttgttcatctgttcatttttgtcccccgtttttcatttcgtgcccaattttcggcccattttgttctgctcacatttgccactttttatttaactttattgttatttaagcggccaaaaatgtcccccaatttcacaaccaaatttcatttggcaattttgccgtttctctccccgcccctccatttgcctttaactgtgatggccccccaattttgatcattctttgaaccccccgattgttgatctttgatctatggcccggtgccctccatttctgtttctcccggtcccattcattgatttctgtgatttcccatttgccccagtaccgaatgcttcctttctgaaaattttcctgtcccatcccggtccccaattcatttgtgattaatcccccggtgatgacattttatctgtgatcaattttgtgatattttgttcaccatttttaaatttttgtttaattacccaagtttgaggctttttcccggaataaattttgcttaatcaattctcggcatttgatttggccggtcttcgtccctgcctgtccctgactcccgcaccgtggaattcatttgacccgaccccagagcaagtcgggacatt

SEQ ID NO: 23931 - DNA, 1153 bp, Heterodera glycines
  misc_feature (1034)..(1034): n is a, c, g, or t
  misc_feature (1057)..(1057): n is a, c, g, or t
  misc_feature (1064)..(1064): n is a, c, g, or t
aaaagaaattacaaaatggggaaaaatgatgggaatgagacaatggaggaggaaaggtcaaaaagcgggctattatggacgaggggagagacagagataggggggacgagggaaacatacaaaataaataaagtgaggcggacatttgggtaccggcctaacagtttccttcttcttttttgaatactagcggggtcagcgccttcggcgcatcccccgctaggcagtacgattgtgttatagaattatgaatgataaaatcgactggctcggccgcttcgcgccctcgcatcattttcttggcttttctccaatctctgggactcaacccaccagcaattcaatctctgggactcaattctccggcattccaaacactgggacttaacccaccaactttcaattacattccaatcgctgggactcaacccaccagcatttcaatctctgggactcaaatctccggcattccaaacacggactcaacccactaactttcaatgacattccaatctctaggattcaacccatcagcatttcaatcactgggactcaattctcctgcatttcaatcactgggactcaattctcctgcatttcaatcaccggaactcaacctcagcaacggaatacagaactatttaaaaggaatccagaaattgaaatataacccataataaatcaaagcactatggtgtataattattgcccccacctcataaattcaaaaaactgacctgtttaaaactttccacctaaatttgatcccgcaagtggcacgtcaatatcccaattgcatataaatattccactcgaacacaggcaaaacatgagatgtagcatttatattgctttttctatccatcaaaggctttttctttcattttttattactatcataacatgctttttattcaaaacaaatatcaaaaaccaaatcagattcttttcatattataaagcagggaaagtacaaaaaacgtttttaagtaacaaacctttttcatttcagcgaatttatatgcatttttttnaatcaaacattctccattatcgnttacatnaagcaaacaaaagctttcatatcaaaatcacatcatttacaaaaaaaaatttagacaaaaaaatatgataaaccccaattttttcttac

SEQ ID NO: 23932 - DNA, 1230 bp, Heterodera glycines
tataaaaaattacctattttcccataaaaagtccaaaatttccaccccccccccccctcaattttcagtcaatggggcgactcgctgttcgtcgtcctccaaacaatgggcattgttgtcccaatgttgtactttgctgaccgcctgagctccgcccttgtgtttgtgtccagcaccggatggctttaattgttcagttattaagttgtgaaaatgaacagaggggactaacgtcttttttggtgttggtgcatttcgtgaaattaggcaaaaattgcttttaatgacaaatcaattcaaattgggacccaccaatgcaaattaatagtgaaagcaaacttttgactctaaaacaacaatttaaccactgacaatgagcaaacgctcctttggtctgtcgtcggaaaggttcgccgcttaatgtgacacggatgaaaaataggtgtaatatgttgcccccccttccccaagtcttaacaaaaaaattttttctaaatttcttcgagcttggttatttctagtaaaaataaatcaattgaaagattttttatacaacacattgggaatcgggggaacaatacatacaatacattggcaattatatacacacattaggaatcgggggagcaattattttgtttcataagtcggctccttcaatgtttcgtagtataatgcgacgtttcactttttccaacggctggcttctgggccactgtttcttcgccttctccgcatctgtgccacttccggaggccaactttgtctccttctccgggtcaatgccacttccggccgtcatctcccctttcccagcctctgtgcctcctccgaccgtcatcttcttcgccttctccgggtcaatgccacttccggccgccaacttcgtctcctccgggtcaatgccacctccggccgccaacttcgtctccttctcctgatcagtgccacctccgaccgtcatcttcgccttctccgggtcaatgccacttccggccgccaacttcgtctccttctcctgatcagtgccacctccgaccgtcatctcccctttcccagcctctgtgcctcctccggccgtcatcttcttcgccttctccgcatctgtggcacttccggccgccaacttcgtctccttctccgggtcaatgccacttccggccgccaacttcgtctccttctcctgatcagtgccacctccgaccgtcatctcccctttcccagcctctg

SEQ ID NO: 23933 - DNA, 1580 bp, Heterodera glycines
  misc_feature (101)..(101): n is a, c, g, or t
  misc_feature (172)..(173): n is a, c, g, or t
  misc_feature (177)..(177): n is a, c, g, or t
  misc_feature (179)..(179): n is a, c, g, or t
  misc_feature (228)..(228): n is a, c, g, or t
  misc_feature (265)..(265): n is a, c, g, or t
  misc_feature (276)..(276): n is a, c, g, or t
ttttcccccctttctctccagtgtcggtcgttcgtttccttctttctctggtcgctccatcgctttcctctgtttatgtgtaaattctctatttccttatnaatcgcgcacaatgcccctataaatgcatttgtccctttttctttctcagtttgactcacttccgttcgtnnccgntnggaatgtttaaatttcgtccacttttttctgctcattggccacttttcnccctgctgatctctgccattgtaaagtcctttcgccncctttgccctntaaagtccaattttcccctaattagcttccaattgctttactttgccacacattgtgctgaacggcggcacttatgacgagttcaatgcttctgagataaagcattgttgcattgcgtgtgcgcgtgacccgtgttgcattgcgtaaggtccgtctcgcatttggcccaccgaatgattgcgttaaggtacacttacgacaaggaattgggccggtgtttcatgaagtcggccatctccgattcatacaaacactcgggaatgacttccggactgaaggcgaacactcacgcgggacagggcgcactgctgaggaacattcgaattgcgggaggaactgcgtcagctgttgtgcacttgcccaacacggaggactgcatgcagtactgcacaggtgggcagagggtcaaactggggaagagaggggaggggagcgaacggaggggtaattgggtgccaatgccatcgttagttgggcaaagcatttgcattttcaattggttttttcaatgatacattaaatgctaaaatccattccccttatagcctatggcattttctcgtggagtcctttgcctccctcatcaacaacaacaacggcttcgtccaacgtcggtcggtcggcctcgtccattgttccgacttcctctcaacagcaacaacaaggcaagtggccaaatgccaattgggccatccgcgccgtgcgcttttcctacccaaaatggactcttttcaggggaatgctcgtgcatgtcgcgcatctcttccttggagtactctttcggctcgcgctcggccatttttccgcccgtttcgaatctctgacaatgagccaattgcaagcaaatgaatgaagacgaaaattcgagacaaataatcccatccaaatccgtccaaattaggtgtcgccactaatccgtccgatatcccttcaatccgtcactctgtcttaatgatctcatcttttttattttttgaaaaataaaacatccgattatgtacagtagtgttttgttttccaaattaatgtccgtttattcgttcgtttgctgcggttgaagtggcgcagaacggactgcccgaaatgtattggacctaaattttgagtgattaactcatttcgctaaaactatcacaataatagtcttaatcattcattgttttttatgcttttccgtgccgtgttctgctcttttcgcgcattcacctcgtacacattttgcggagggtttgtccaattgacccctaatttgattggtgcgcattaaaggagggaagaagcgattgttggtcatcggagtggtc

SEQ ID NO: 23934 - DNA, 1249 bp, Heterodera glycines
tttttgtgggacaaatccaataaataatttcgaaggattattgttttttattgggtaattaatccagtcaattcccagcaatttcagatcaccacagataagaatattattataattaaattccataatatactcgaataattttttaaaatttggtgttgaacattgaggcggcttatacaatgcaaaaaggtgaatcacttttactagacagagtttaatgtgaattatttcacactgaaattttgtcccagaaaaaacttcaagcataggaatatcagtgcttattagtagggttgtaaattatatggattaacatattttttctgcgcatatgctataaagaaaggggcccaaaaatagcatttctgcgttaaaattttttggtttgctgaaggtttttagtccatataaatccatattttgggggttttcgggaataaatccatatttagccatttttgtgtttttagtccatatttcggccatttttggcaaattttcacaagaaaatgcaagaaaagggaaaaatacaccccctaaagattgattttttggaaattttaaaatttacagcccaaaaaatatgaaaaatttgaattttcgtcgtcattttggcatttttaataaatcttttcatcattttttgcgaacttttcttttttttaaataataatttttttaaaattttggcaaacttgaaaatatttttatacaatggacgacaataaatttttttgcatttttatgttttaaatccattttttgattgtttattgttttttttttaatttctttaagcaaatattgaattcatacaccttttttggaatttttgagggtttaaaacacatattttggcagtttttagtccatattttggtccatatttggctatttttgagctttttagtccatatttcgtgcttttttagtccatattttatgtccatattttgggttttttagtccatataatttacaaccctaatcatcatcatcatcatccatcatgtcttttgtcagccacatacataataaaggcacagcacataagcagaaagaagcaaccacgagcggcgtcgccatttttggtgacccgcgcccaattgggcgggcgaagcacaactccgccacataaatgtacacactcatgcactcaaatttggtgcgcttttaagctgtactccccgcaacgctgggcgaggggttggggcaaaaatatattggcgatcacgacgactctttt

SEQ ID NO: 23935 - DNA, 1928 bp, Heterodera glycines
gatgaaaagtggaagtgcaagtgcaaattcggcaattcctcacaacccatgccatttccatttccccttggtgaaggtgagctgttcagttctgcatgagaccgaacacttcccgagactgaggcccaaaaacacttcacatagttgaggctcaagaattttttcaacaatttgttattcacttaaaaaatttaaaaacaaaaaattactattttattttcaattattaaatataattaccatgctgatgggaacagtggtcattagtacacagaagccaaatggtttttaccaatgagaaaatattaaataaaattaaatttttttttgtcctttttaggtccaaccactgcaaaatccaccatcattcatagtaatgaataaaatcagttttataaatttcctttgtatgcagaatttttaatttgttatgtattttttagtttcattcaatgggacaaaatcaagtaaagaattttcttaattttattttatgaaaattttcatttacttttaaatcagaaaatgggacttcaaaatcaggtaactgtacgtacataaagcagacccgtgcatcagcaggccttacaacgcgttcatagttttggcccgagccaaatgagttcgggccggtcagggctctttagaagcgggcttttgcctaaaatctcgaggctaaaatttcaaaaataaatcaaatcaatcagagccaactattactgtgacccttttctgtacacccattaccgtatagaaaccacgcgaatacgaatcaatcagcaaaaataaacgtggaccattctttttagacagtccaattgtccccagtttcttttcgccgatgactctttttgtttggtcgtttgtttttggtaaattggttttaccttcttttaattctttattttgaattttcagctcattttattgtggtgccgcttttctaggccactcttacggcacagtttggacgaatttgccaaattgacgaacatttttgtgtgtaaagaagaaatataagacagaaaaatgatgaattatttattcctaattaaaattttaattattgtaatttcaaattgcattaatgttcatattttcgaattttgaataaagctcggcaaaaccaataaaatagtttatgaaaaacgccatttgtggttttaggtttggctaatcttgaaggaaagaaagttgcaacattcgctagtctttgagagttttatttatgtaacaatttaataactgtcaaattaacatgaaaattcactgtttaaactcggcaaattgcactcttcgccccattccttcgacattcattccgctcgtttctctttttcccttcaattcttcttaaatcgccttcctttgtcgcttttccaatattttttttaagtctgaaatttcaattttatccagtctaaatatcacggaaaaccgtgaattgagcccgtgaatagtgaccgtgacagaaaaaaccgtgaaattcaggtaaccatgacagtgattccgtgaatcatggcacaaaataagcaaatcagcatgaaaatgaccattttgtggcacttaagcgttcaatcgaagactatccaaattttcttagtacatgactttttgggtattactgatcaccgattcagcacccatcccgatcaaattcggacccctagtccgaattcaaacagtcaaaaactttgggacacaaattcgaaaaaatggctttttaaccggttttctgcggaatgtgcttgaaaaaagctgaaccagcgacgcattggcgtgcagtggctttcacaaagtgaaaaatgtcggctcctccctcctccattctttttttgattcctttttttgtttaaagtgaatatgagtagtgcaacgtttaatcgagctggtcgccctcatttatcgttattggtagtttgtaaaaa

SEQ ID NO: 23936 - DNA, 1564 bp, Heterodera glycines
  misc_feature (14)..(14): n is a, c, g, or t
aagtgagtgaatcncggtaaaagtacggtcggccgactgtcgtagcaggtgggcaccagcttattgttgtacacagttgtgcgaaggtatttcactgttactggaaagccttctgaaagaaaatgaaaaattaaaaaatatataaaatatacaaattttaatttttttaaatttaattatttactaattttttgttaaattttaaaaagtgtaataatttataacagcgctcgatattttgaaaaaagtaatacagattaaataaatgcccactgcttatgtccgattgtccctccacaatgttttgttttccgtcttcacattttgtcgtcacattttttgcgcattgttttgccaccgttccatcaaacgcagcaaaaatcaaaagggtgccgaatattgcaacgaatgtttttgccattcaatttaattcacttttaaattaaaagttttaatttaaaatacttttttttattggaaccaatacaaaatgaacggcggttaaactgttggcattccaaaaaattacaaaatttaattcggcccatttttattttcgttttgtttgggttccgtccgcctccttcgacggaagacaaatcaaatggttttgaattaaaatggcaataaatcactgacaaaaagattgattgatcggtgtctatactcaacttaattatttcaaaaattatttttaattagtgaaatttctctcaaatttcagaattttaacctttcatttgacgaattgttttgtttcaattagcgacgcattttaaattgttttttttccaaactgataaaagttaaatctttttggcgtcagtttaattctttaaaaaaaattcataaattctgaattatttttgtgcaatttgttaatcataaatggacgcaaattccctttatttttaaatttaccacaaattaaagaaagtctttggccataatacgtttataattaaattcatttttaaatttttttacacaatttttacattatttggctttccatgcaaattaagcccaaaatctcgggcttttaaaagaaaatgttgccctaattgaagaagattcgaaactgtttgttttttgttacaaatgactttagtattttttgtaattatttggcaattttttcaattttcttttaatcaatggacaaaatgtgccaagatttgcttcatggccatttttaaacaagtaaaaaatgagaattaatataaaacattatgtgcagtttgttcatgtttttagcagtgatcatcttccgcttcttcttcttcctggaggccaagcggcacaaatggcacatttattggcatttccaaatttgtgatcattttgccctccgtttccaccgaaaatataaaatgaaattcgccctaaattaataaaaattgtttttagatattcgatttttatttttggttttggcgcacagcaaaaatgtcgagcagtgaaatgccgagaatgcgtggtgcgtccggcaaaatcagggtggagttgaagtcgatcttctgctccatctcgcggattgtgtgcgtgccgggccgttgcaaaa

SEQ ID NO: 23937 - DNA, 1722 bp, Heterodera glycines
agccaaaatatgcaagatatgcataaaggcccaaaatatgcaaaaatatgcaaataaaagtcccgatttttatacgcaaacacaaaaaagaaagtgtttttcgtactatttagagcatggagaagccaggaaaaaaaaatgcatttgcatacttttggcagccctattaataaaatgtaattggtaataggaatatttataataaatattttttggttgactggtcagatttacgcatcctattatcattcattaaatggttaattacatggacttttttcgaaaaccctctccatgagattttttgacaaaatgtttcctaatttgtcatgaaagaaacctaagtaaaattcttcttttacaattcaataaacctgataatatttcattggatattaaaatttaattagtaaacaaatccatgcttcatcaatatgaagccattaaaatttttgagatttccattctttcaggaaacacattctaatatgccagctattaagtttatttaattgtaaataatttaaagaaaattattaccaattattggatcaaaaaattcaattgcctacaaatttatatgagtaaattccaaggttgatgatctacagtaaagattagaaaattgaatgcgtaaataaatcaaccagcagaaccgtttttatgattggtcagattgttgccgatctcagaattagcctccacgtatcatattgcattgtgttcttactttttcgtcgagttgaacttcttgtagaattcctcaaaaccgtggtgttcgttgcacatttcacgacttttaatgtcgcagagttcgcaatggcacttccaaacattttcatcttcataatgatcagggtacatgggacgacagccttcgtatgttttatttatcggcgctgggtcacagccccattcggcaaagtgttgggtcccaagtttcactgtaaaaatttggaaatttataattaaaaacttgaaaataataaatataatatagatccaaatgttcctcatcgttaaaacaaatgaatttgtaaaaatctcaaaattaattttggaaaaaattcgatacatcataaaacaagccattttcatagggccacacacctatatcataattatcagggctgtaaaaaatatacacgaaaaatggccaaaatatgcgcaaaaatatacaaataaattcgtgcaatatgcaccaaatatgcataaagtcgcaaaatatgcatattttttttcttatggggtattcaaatcgtaaaatatttgacgaaaaatggcaaaatatgcaaaaatatgcaaataaaagcaaataccaaaaagaagctgtttttcctagtaattagactacgtagaatccaggaaaaatatgcatttgcatatttttgacagccctaataattataatttttgaatatttttgttccttttcacaattctcaattaaataaatcaaataaaacactcattaccaaccatcataacaaaacacaaaataacagccaattgcattgaaaaggcattggtttccagtgagcacaaactgtttagtacttttgcgtccccggagacatgcatgaaacgtaattccttctgcctgaaataatgtatatgtaatataataataatgacaaatgagcattattaaaacataacggaaaataaaaaagacaaaaaaaaggggtaatacggcagcagaattgtggttgttcccaatgg

SEQ ID NO: 23938 - DNA, 618 bp, Heterodera glycines
ttctacatctacaataaatatttttataattttttctaagaattattatatttatcataatttttagaataatgtttgtctttttttaatttaaatcatggctcctgagttagattaatattgtactgtcagaatcagaaataaaaattgagttttatattttggctattcggaattcattgaacaataatttttataaacgacattgattattgatttattttagtgtattttgcatatatgtaaataaatgtaaatttagtaattttaataaaaaattatatttattggatttattatttaccttgtgatacaattgtctacatttttattaatgttaaacaacttttaaattataaaatttatatttgtttttcagtgctcgtaagttattttttatttaaatttttttttgaaaaatcaaagaatttaagttaaactctttaaaaaatattttagttactataaaagcaaggttctatgaatcacatcagggtcggggtcggtttagtacggcaggtttagtacggctgttttagtacggccgttttagtgctagggtcggtttagtacggccggtttagtacgagggtcggtttagtacggcaagctgttttt

SEQ ID NO: 23939 - DNA, 1877 bp, Heterodera glycines
ttgatgacaattaatgctttttttaatgtttttgactttaaggacaagtaaaaattttctaagctttaaggcattaaatttccatcccaaaatcattggtcgaaatgggatttgattaaaaattattaatggaattgggccaaggaaaaagataatgtaaaataattgaagatatttgttagagaaaatataattagtataaaaattaaatttattttatgcttttttagatgataaaaatgattattatttctttggacaaatcctttttctgagctcttcccctttgtcttgaacgtgtgaaatccttgttttttgggtgtgattttatcgagttttatgcctatttttaggccttttagcctaaaaatgagagagagactagccaggattctttaaacaaaaacataataaaaaaactaaccccctagactttaaaaaaaaaactaaagaatttatgatagaaaactcatacataaattaatgtttttaaattatctattttctatgaatgattttttgatgaaattggtagctgaaaataagtgatagacaggttcagaccgaaaaaatattttttttgactaaaagcaaccaataaatttttattgttttactttagttgttttgctcttttttgatttttgccttttccgaataatataaaaataagcaactgaaaaattctttccgatttgatgcaatttctttttcaaggtcaattttctgcaaatttataatttttaaagatgtaaaagggacaattctctttgcaattcccaattttaccaaatttggaaatcacgcgctatttcttccgtaattaaattataattttgaccctataaaaagaatgaagcaaaaatgaaaaaagcggaaatctgtttcattaatctttctaaaatgaatccgacttttctttatattttgcttcttctgctgattattttgctgtttttgagtgctttcaccgaaactcgtccccaatttcactacgccgatccgctaacgatcgcttacagccgcgggacaatttttgaaaatttggtcggatggaagcgatgagaacgaacgagcgaatggaagaagggattgaaagacatttatttataaatagcgaataaaaaataattatgattccatccttagagtaaattacaaataaattaaagtggcagtgataaaaagggtctctctctcactaattaactatttagtaggtgataattagttctatattaaataatgaatttggttattaatttgtttggttagtttcttttaatggctgtgatgacggcgttctgtccattctcttcagtcgtacgcaatttcgatgtccatttcgtacggcctaaaggcaaagaaaattcactgaagtgcatatgtataaagtaaaataaaactgcccgataaaattgtaaattgttttacaattaaaatttcctgggctgaactctccgcctttttcccttttttcaaaggattaattccaaaaatgctttaaactttatgaattgtgtgattaccgttcgtccataattgggctgttctcgtccatcttttgaccattgaaatcgcgcatcttaaaataatgaggggataattggataaatgagtaccaggacatttaataattaacagtgctgccacttttaggcacaaaaaaccgccaaacaggcatttcttaaagtgtattatgtgaaatgtttttgggtcatttcttaggttatatttttcttttttattgcatttttgtaaaggattttttcgaaaacctaaaaaagacgtcaaaaatggcgaaataggcaaaaaagggcattataaaagtcatcgtagacaatccaaaccaggatcaaaatgcgtttttcgtgctt

SEQ ID NO: 23940 - DNA, 1985 bp, Heterodera glycines
attaaatttgactgtcttccgcttccaattgccttcttcaggcgatgttcgtcccgccgcctcccccttcgggcggatgttccgccgtcagtcgtaagcatgtccgcttcgtgtcgccgctgatcggcgactgccgaaagatttctgccgctccgtcgccgtctgtgcccgtccgttggccgcaacgaagtcacttctttcccaatcgttccctcaattcgttgccaaattctccaaagcgtcaaatcgctttttcggctggacgaagggatggcacacattcgacttcgttcgtttcgcgtttgctgaatgcggtgcttctgcgcacttcgcatagtgccgattcgctgctgtttgccgctcctttcccgacgcgttcttcgccctcttccgcttccctttcgctgtgttcctcgcccccctccgcttctccaacggcgtccactacgctttgtccgtgtgaaaaatgttggcatcgccattcgaaagggcgcatcacaaagggcgattctcaagggaccgcagcaaaaagttgggaagcgcattactcaacggcagaggcacctttggttccggcggtgtgccccttctcgacaaaaagccttcaaggccatcattccctttgtgtgctgtccgcccacgggggcggcggtggcaacggccaaagggcgggcgcccaagtggccactctttctatgcccacaacggccattgtcgtttattcccgtggcccctatcgtctgccaccaagccattcgttcccacccccgaccatggctaaacactccccgcaacaccaccacccaaatcaacggcagaacacgctcgaggagttgggcgagttcgacgagagggactttgtcccacgttctgagatgctcagacagaacagagtaagtgcaagctgacaaagtccggtgaagaattgagtggggttgcctttaacttcccccccccccttctcaatgcttttccgttccgttctttcgccgttcaccggaaaaaaggaaagtggaaaatgtgtcagtgaatcagttcttatacaattttgaccttttgtactacaattcttaatgctacagaactttattttcaatacactgtattactgccgcattttcctttagccgttcaatgccaatgcattttacgcaaaataaaagcgtattgcccattttcagatggacattattcatgaattgaactgtcgaattaaaaaaaatgggaagttttttttaataatttccaatgaaacggcattttctttctgtccgcagtgtctctttcacttccaattcgaattttcggataaaaaataatcgttggcattggtgggatgggacggaagggagggcaaccgcggctgagtttgttgtctccgagggagtcctccctctgccgtttgtccccaatataattcacttcccattgccaaattgggtccaattccgtctttctgagctcgggaggatggccaattgggccgctggggggggggggggacgtggcgtggcactgtcatttctcacttttctctctttttctttcttcctttggcctgtttctgctttgaccctcaactttgttaatctgttggttgcatgaaactttcatcaatttgctgccaattttattgttggcatcaaaaaaggacttctcggaagaacattaatcccccgggagattctcatttctccactgcccttacttatattgccggggggggggaggggggcaattgtcggtcggactgcttttcccagtggaattctatccgctggcacaatgcacctaaaccttttgcccaagggcataatggaagcaaaatggtgtgctttgctgggggacggacggccttcacatcgctcgttccgctgcttttgcttttctaatggttttacaggaaaatagggcgaagagagaaacaaaaagatgggaattttaatctttgagaatggaagaatgggcgagagaagggacaaatg

SEQ ID NO: 23941 - DNA, 1413 bp, Heterodera glycines
  misc_feature (53)..(53): n is a, c, g, or t
  misc_feature (59)..(59): n is a, c, g, or t
  misc_feature (66)..(67): n is a, c, g, or t
  misc_feature (74)..(74): n is a, c, g, or t
  misc_feature (79)..(79): n is a, c, g, or t
  misc_feature (85)..(86): n is a, c, g, or t
  misc_feature (108)..(111): n is a, c, g, or t
  misc_feature (120)..(120): n is a, c, g, or t
  misc_feature (128)..(128): n is a, c, g, or t
  misc_feature (131)..(131): n is a, c, g, or t
  misc_feature (139)..(139): n is a, c, g, or t
  misc_feature (142)..(142): n is a, c, g, or t
  misc_feature (150)..(150): n is a, c, g, or t
  misc_feature (152)..(153): n is a, c, g, or t
  misc_feature (163)..(165): n is a, c, g, or t
  misc_feature (169)..(169): n is a, c, g, or t
  misc_feature (172)..(172): n is a, c, g, or t
  misc_feature (181)..(182): n is a, c, g, or t
  misc_feature (188)..(189): n is a, c, g, or t
  misc_feature (193)..(193): n is a, c, g, or t
ggcccccgacattttgccccccgagggctccaaagagcaaccctactttcaantatggnaaatagnnttcttgncttgnaaattnntttgggtggaataagagggatnnnnaaaaatggnaaatattnaanagaaaatnggnatttgttnannattgatatgnnnaatnaanatatttgtnngttttnntggnctaaacttaaaacgatcaaccaaattaagaaagttattacggcccaataaactgagtatggttttactgattgggtcaatgaaatgctggagcaaaatatgtacatttatttcaaccaatgaatgaaaagggcggcccctctcatcgtgccgcatttgtcgtgattatgctttgtacgttgtcatatcggctgatgtccaatgggatggactcgacgctgtcccttctgctgctggtgtcccccctccccctgcctttgtactgctccgtctccttttgctgctctccgtcgcttccgtccccaaaattcacccttttctccgccgctcctttcgccgtttcttcccgtgccattctttcctcctcccctttattttcttgttctgtttttgcccattttgtggtgatgacactcagtgcgtcgcatgaggcgaatgagcggcttaatgcgggcgaagtcgacgacgaaatccttaaaaaggaaaagcaaaatgaaaattccgcgcacgaggtcaatcggcaaattcccttgggctggggggtgaccaaaaaatggcagtgagtaaaaaagtcgtcgcccggggggcttttcccggactttccgtccccctggggatggtcctccctacccgccttaacttgtaacgaattgtaattccctgtctctcttttgtccgccgcgtgtcatctcacctcgacgaactacacgcgtcgtccgcgaaaggaatggccaaaagggcggaggagggcgaacatggccccgtgctgttgccgccgttgcgtgctgtttttttttgctccgtcgccgccgccggacatttttccgccacaacgaaatcggcggcggacggaggaaatgccaaaggatggcccaattggtggcaactttttgacaatttcggcggcgactctttgaaaaactgagggcacattgtgcgtttgtccctccttttctgttgtgccgcccattttcccacttttcttcgcacactgtgccgcattgagcgcacgcgacggaacatcgaattgcccattccgtccaaacttttgccaagcggcgaaaacaatcgctgaccgagcggaggcgagcggacgcactgatcgaccgattcgtttcttgtccgttagaattggcaatcatttagcaattatttgttgactaataatggcacttttcaaggagggggcaacccaatgtttttcccattgatcaaaaatcc

SEQ ID NO: 23942 - DNA, 911 bp, Heterodera glycines
  misc_feature (852)..(852): n is a, c, g, or t
  misc_feature (903)..(903): n is a, c, g, or t
ttgcgaaaaggtcgaaattatggttttttcttaataaaatttttttccgggctagaaaatcatttcgttttttgtaaggctaatagagcatatgaagagctttcgaatgatactaacaatcttggatttggatgccaaagaaaaaagttatagcgaaaaacataaattttttgaaaatctgcccacagataacacacaagtacccaaatttttattcaaataaaattcaaatgaaagaacaagttgactaggtatatgtattccatcaaattttcaatttcgaaaacaatttcttcgcattctcagttgtcactcggataacttcgtccgtggaaacctttcaatttttaaattaatttaaaaaagtaaaaaaaagagtaaattccgacattcttaattctggcgatgaactcggcactgagtttaatgtttttgggttcatttcgctcctcggcaactggcccaagcacgggcgaatcgctctctaaacaaagttgactcaacgggattttctggatcagtgcttcctgaaactttttcaatgttgtttttatatttcttagtgattctttcactgccttttcttttgagagagtaaaggatggaggaatggaaaagaagaagcccttttcgatgcccttttgagcatttttcacattgccactgaaggcgtgcaacagcacattttgcgccccatgcgcggccaaccattcaattacaggcgtaccagccgaacgagaatgcacgtttctaaacaaaaacaaacactcaaatcacaaaaattaccaatactatatttccaaaaatagaaccctcgggggctttgtttttttttcaaccctcctcctagcnaatacggcatttaaatcctgaaaatttcgaaattccgagatacatacaggngcaactgc

SEQ ID NO: 23943 - DNA, 666 bp, Heterodera glycines
agctcggccgagtagccgttcagccacgcctgcacccgcgaagtgtccgagatggactcggagggctaaaagggggaggcattaatgtatgggcatgagacgggatgatcatttaggggtaatcagtataatagccaaaatgagggaactaagagtcggtcttaaaacatttttaataacaaaaaacatagtattcttttaattactgtcacagtaactccccgaagtttacagtaaccctgtttatggttaattaggtccgtgtgtctctttaatggtcagtcattagtttaattcaatgattggttgtacttctaaatttgtcgttctccaaaagtcgctcgagttgaccagtgcctgcgcctctttgttcagcttcaatggttctgcaacagtcttttcgggctgttcgagtccaactgggggcggcactccgtcgacgacagtgcctttattcagaaagttgtcgaccaatgattgaattacctgagtaggaatagttcgaaattttaaatgacaaaatatttaaatatcaaacttattttaatttacagtataatattttttaaaataaaaatctgcgttacgttaatatgtccgaagtgatcagcagcagtttttgttattaattgtccatacgctctctgcttgatcggacctgcttcc

SEQ ID NO: 23944 - DNA, 564 bp, Heterodera glycines
gggatgaatacacctttagggataaaaggtgaaggggggagggcgcggtgggagaagaaggatgacggatggatgaagtggtgaaatgggggagggcggaaaaagcggaggaggagggcatttccatggcggaggagagggagggcaacggatgagtggcggggcggggcgaagggggagagggaatttgacgagcggtgaccagtggggttggattgggcggatcatcgcatgccccccccccccccgaggggtcctcccggaatcgccgttggcgacgcggctgacacttcgccgcactttcaccccaaaaggcaatgaagcggacccatccttcccctgctgatgctgcggctgtctctgctgctgatggagttgtcagctaaacgaacgcccaaatgaccaccgttgggggcgctaattttgtgatccgaaaatgattatgacctttctttctttgagtctttgcagcgactaatgcttttgcattaaggttcaaattaaaaatgacaaagaaccattggtttttaacaacgcaaaaactaacgaaacgaacgaaaaggg

SEQ ID NO: 23945 - DNA, 1176 bp, Heterodera glycines
ttcggtctccccaaaatctgggcgcatcggttcggggggactgccccaaaacaaaaaaatcgattttttcaagtgtccgttggggtactcaaacaatatggggagcaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaatttgcaaaaaata

SEQ ID NO: 23946 - DNA, 1775 bp, Heterodera glycines
  misc_feature (1739)..(1739): n is a, c, g, or t
gaccgttttgacatgtggatgcgtgtctggagcagtaaatcgctgagttccgagaagaactttatgacaaaaagttcttcggaacaatccttggttacggcgaatcaatggagttccaaggccgaggaggcccacatgcccacattgtggcgcaaacagacctggacgcagttccatatgtcattcaggaatacatatgggcgcacattccatctttgcctgataaagatgacgacacccccattgcaaaaatgcatcgcgaaatccgcgaaacaatacatatgcaactgcacagatgcagtgacagttggtgtggtcctagcgacccaatttacgggcggtgcaagaaggggttcccagccccttactcaaaatgtacgattttgcgcccggacaggcccgcaatgtatttccggccttcaccaactgatggtggtgcccaattagaggtaaacggcctgatatacgacaactcacatgtcgtgccgtataatccttatattctgctgcgttaccgagtacaccataatgtactgtttgcatatggtaacaaagcaaatattaaatacgcactcaagtacccttttaaaggcccaggacattgttatgtcgagtgcaaacaagagtccggcaataaaatcggaattgatgagccggctcaatatgccaagatgaacttccgtggtgcaacggaagcatatgccattgttcattcactgccatttgccaaactttcacatcaggttgtcaaacttagcatccatatgcctaatcaacaaccgattgtgtacagggcttttcagctggtgagcaaagctcaacaaatccagcaaggcaaactgccagagacgcaatgttctgcctattggaaacaatggcaaaatgaatggaagcatgatccgaagctcaaggacatgctttttgaaaaagtccctgagcattttatatgggcaaaggacaaatggaacaaaaggaaatataacctaacaaagagaccaccaatcggtcgaattgttcctgtacccccatcggacccggaaaggttcgcgctctattcacttatgcgtcactttcctggagacccagaccatcttaagatggttaatgggttgctttgtacctcattcactgaggctgcaataatgcatggtcttcttgaagacgacaaaatttgggacaaaactctggcggaggcagctctatcgcgctggcctgatcaaatgaggtggctcttcatgagcatcctcgtttatggccagcccagtaatgccgtcgaattatggaacaagtacaaagaccaaatgtactttcctcaaggcattaccacaccggcacaacgccaagcagcagagcttgaagccctagccgacattgattggcggctgcacagctgctttaacttaagctgtgtgcattttagcctgccagacccgccaaactcaattgccaaaaatacaaatgcggcaattaatgagtttttctttggcgatgatgatttgaatttaccgcctggccaaccaaatcctcggcctaagcaaatcactcctccgccactcaacagcgaccaacaaacggtctttgatgctgttgttaaggctattcagtcggacccaagggattcgactgtcccccgccgtttcttcatatacggcgatggtggcacaggaaagacattcctgtttggccaaattattaggcgcttgcgaaaggccccatacacctacaaagtgcttgctacngcatccactgggtgtgcagccattttgctgccatat

SEQ ID NO: 23947 - DNA, 1578 bp, Heterodera glycines
tgtttaacaattttgcagaacttcgactgacctattttaccgaatcggaactctctgaggagtccaattttttgcgtgcgagaattgcggaattggaacgtatcaaacgaacaaaaccatctgcagccaatggtgagttcgattgattcaaaatgaagtaaattataaaatatgattaataaaaatattaaaaataatatattttttatccttcctttggaagtttggagtattttatatatttattttcaactgctgaaccccttgacagggataacaaatgccgacagtttggagaacagtttcgacgaatttgcgcaattggtcgttcaaaatgagaaaaaaccaaaggtttgttggaattcgtttaaaccaattaaaacatttaacggtcacagaactgcccacaaatggatgacaatttgttggagaattcacttgcttcactcaaaaagcaattggacggaaacggtggaaaaatgaaaaaataataacggaataattaatgtcccaattaacaaacagagtccaaggtcaataatcttgaaaatcagctgaaggaattgatgcaaaagcaaacggacacttctgagcagcaagaaatggacaaagcgcaactgttggcaaaaattgacgaggtgggagagatatggggacaccggacaaaagggcgacagaaaaagtcgcgactccgttcatttcttttcataaatgaacaaagaaaaactgacaaacatttagaagaagcatcattcattcaatattgtcaagcgattcgcttgcttttaatgttcttttccgtaaattttttattgaaatggttcaaatatcaaccgttaatttaaagaaaaaaaaattggatattttttttacaaatcgttacacgctggcttttgttcttgtccgtaaatttgttgaagtcgttaaaatatgaacgtcaatttaggcgctcgaagtgcagaaaaatgcccagcaaaagacgatggaatatctgaacaaaacgaatgaaagactgaaggcgacgggtaaagaaaaaaaatgaaaataaataaaaataataaaaatgacaaaatattttagcatattattaccgccattcaaagactgctttggacgaagttcagaagagaatcgccgtaatggaagtcatcgtgggcctgctcatctttctgattttcatttcgccatttgcttattatttttcgttttagccatttaatttatcacttttatggcaatttccttaaatttgctaccttaacaaatcacttttcttttgtctctcttttttatgtaactcattcagctaaaaattgaaaaaaatgaaatagtctctccaagtgttttttaattaaattaatatatcgaaagaattctgagtaatttaaaaaaaaatcgtgaggtctattttaaaaattggtatttttaagaaaaatctgttaacaaatttcaaattttcaaaaaaaattttcctcgcggctcctaacaccaccgacctcatcacccctttgttccccaaaagtttttctgaaaaagagcgcaaaaatggtggtcaaattcgatcttgagacgggttcg

SEQ ID NO: 23948 - DNA, 2408 bp, Heterodera glycines
  misc_feature (1052)..(1053): n is a, c, g, or t
gttggctctcggcttcttcttcgtcgccattgaaatgaacgcgatgccctctgccaaaccaccggacgggcctgccttgctgcttccatcaaccttaaaaagagcataaacaggttttttccttggaaaatccatttttttgatttgagaaccaggatttatttgagattttaaaatttgtaaaaaaaattttttgactaattgccatttttatatttgtcttggaaaaaaagctcaaagaaagtttaaaattatcagatggagaaaaattttcttgtaagttttggaccgaagataaaaaatttttcaggaagagcaacgatgcggggtaaacctatccgggaagggatttataattccccacctgcactgttttcatttttctgtttcagaacttgatttaaaaaagttaaaaagctttttggggcaacagttaaaacaaaccgtggacacgatgttcaagtggaggttggccctatccaaataactattttgttgctcacgcataatttttttggcggcacagcgggcaatgatgatggagtcagttgccagtgtgtccagcgtgccacctccggcagtgatgacaattgagtttcttctcgaattggcgtcgaaggggtctgtttcagccacttcaaagtaagaggcccccagagctgccacttcttgaaaggccgacggtgacgccgaccattggggcgtcgtaaacttttccatcatcgccgtgagccattgactataattggggagtttttcctagtttctagctttttaattttcttcctttccatattaaaggcttgcaaacaatatttttttaaacaagaaacatttttcctctccacattgttctaaatataggcgcgagctggatgttgttggcgctgatggcctgctgctggttttgctgtgtctgggtgcaacctgtttttgtgccattttttttacaattgttctgtatacgagttcagggctgaaacagatttttttctagaaagagagacctcgtactgacgaagccactctctcaagcactttttttgcctgtnntaatatagcaattttagcacatcaaaaccgaatgagaaattgtctgttgacttatgagggtccgattcttcaagcaatcgaagagcagacaaggttttaagcggagcgcacttcattatccattttatttttttcaaaatttcgatttttttcaatctcgtaatgaaatttcgtttgcaagccttttcactcattttttcatatggactacctgtttgtagtgccacggcgtcgaagaaaacgcctcatgaagtgcaggaaatttccgccaagcctacggcgaaggcgtgctgcaaaaacagaagaattttcagattttcccgaaaagttagagataaatcagtattttatatggtaatcaagggtgagaggactacacgaggaaatagggccgtgattatgaagcggggaaatcctccaaattttttaaaggaaaatgggtgtatttaaaaaaaatcttattactgttaacaaaattcgtaatctttttaaaacaataggcagaaaaggaaaaaaaaatttttttgtggttatggttatgtgtttctaattagaatcatgaaaaagtatccattttgtttaatcaattttcacataattaccctccaactggcgaatgcgcgatgtttgcttgaaaggcctccgatggcgaagatctgcgatcttcaatctgttaaaaaaagaaatgaggaagaggaagaaaaagagcggagcaggaagtatatatattttttaattttcggggaggtgaggggggggggattgcggcgggaccggaaaagggaaaaaaaatgtagagggtttcagccaaaaagtgacaaattttgccccttttttgggccaaaatttcaaaaaataatgataccatgagtattggaatttttttattatttgaggggggggggggcggcaccggcgcatttcccactcaccaggtgtacggttcgcatttgttgctggtccttgtcaatcacgacgtcaaagttcaggcccagggtcggcgactcttggagtgctttgctcgagtttgacggcaattctggctgaaaatactttcacaattttaggccattcttttgtgcatttcgcatggttttgttaggccctattcccccctctccccctgatcaacatactcccattttaagtggcggatcgattactaggtaccaaggtttgtgccatcgaatttttatgtccgatttataagaccaaaaactcaataaaaaagcatgtcaattccgtccatttgggtggttacagtcctaaagagggccatttggggtgggcaaacaaaaatataaacaaaagaaatcagtgatcagtcaattcaaaggcaaaaaatatattcaact

SEQ ID NO: 23949 - DNA, 1859 bp, Heterodera glycines
tcaattcttagacatttaaaatgctttcaatccaaaattatatttttgaaagccaataattattacgtacaactctcagtttttttctgttaaagcgcttctgctggtggcacaaacagctgctctccaaacggacccctccgcgtcggacattgattacgaaatcgttttgccggttgcgtcgttgccgtcgctggactcgccccgggggacgacgttaaattggcaggacgaatgggtgcgacgcttttcgccacggcttgttgttgtgcaaaacggcggatggaagcacaggtaaagaatggacaagcaaacaacaaaagtgaagagacctcaattctgatcagtgctgatcaaagtgaccaaaactgtaccaatgaggagagaaaaatggcactatagaatttcgagaaaaaaaagcagcgatttttggtgtcatgacaactcgtacaaaaggcaactcgtaaaattttttagattaggcctagggttcaggcttaggcttaggcctaagctttaggctaagcctagccgtaggcttgcttgggcttaggcttaagctaaggctttattttgtaaaatacgagatcaattatgttaactacttcagaaattaaaatatttaatactaaaggtgattttgcttaactcattcgttgtccctttttaggacattgccccgaaatgacgacgacgcccaccaacggattgtgctgcataaaaagtggtccgccttggagccgtccattcgctttttatgatcgctttttttgatctgaaaatgggcacggatttcggtcgacgcatgaccaacctaaagcttgttttgctttattgcccctgctttacatattgttttgttatttctgctttttggttattggaacctttgcggtgagaccaccacaaaattcacctgccaattttcgtattaccaaaacattcctcaccactcaaatgaaaaattaattatttgatgaataagcccattcccattttatttggagcatagcaacaaattgggtaatttaaaaactcattttattcataaacaacaatcaaaacataaaaaggcagattcaacgaaaattaaaaataaataatttaattattgaagaacactccaaaattggtttggccaaccgttgcttttgtttaccgctttttggccaattttcccgcttttccctattttctgttggtgccattggtgcgcatggccaactgtgccttcagtttgccaatattcgccctgaggctgtcctgttcggctcgcattttggcgttctgttccaccaattgtccaatttcgatcttttcccgttccatttggcgctgcattcggtgccgataacgccgtgccgctactcggttctgttccctctttcggcacagcaattgctcaaagtcaatgccggacgatgcgcaaccgacaaaagcacaattgttcggcatgcaagccgaagagggaggcatcattgagggacggccaatgcaaatcagctaaaggggtgccattggcagtgatcactacttagcatgaatgttgacaattggtgcaaaatctgttattaaatagcacaaaaattcaaaattatgcccggcggcacctatcggcaccgccaaaacaactcccccatattcccaaaaattttttttggaaagagcgcgccgcaaaaagtggtgtgaaaagtaaaaatggtcgtcgccattgtctcaaaatcggaacctttttttggtaaaacagctgttaacaaattacactctagttttcaaatttttccacacgcccgacccccctgttctcctcatattttttaggaaaaaagcgcagcaaaaaaatgcatatgcgatgaaat

SEQ ID NO: 23950 - DNA, 1736 bp, Heterodera glycines
ataactcaacacactctttttggatgacaaaaataaaacgattaattgtacgcccctcccatacaaacaaatcaatcggaccgatgggcttttgcaagtgaatgaaagcataattgtgatgatggagttgaggggatttaaccccggggaaaagcaagaagtgggcgtgttcttctacaaccaggcaattggctaccacgacctcagtgagtggtgacaaaagctcaaacattgtaaaaaaaataattaattattactttaaataatttattagccaaaaagtgtcgacttttgttctttcgtttgaatttaaaaatattttagtatgtaaaaaatcaattaatgaaagtaaattactgtttaaaatcttagttggcaagaatgtgctgaagattatattgaacaaccaaaacatcagcttaagcagcacttatgtgagttttagcttggtatttacttgtaccatattcttactaaatgtgcttaattactttatcaatatgactttagcggtgcttaaaaatgggtttcaaatttatatttccaataaaggctccactttatatgatataagcttgcactaacaatttttaatgtgtactttgcattaatttttgttataattaaatttgagtccgcttttcgacaaggcgctcaaatttgtcatgaatatttatttagccaaaacaatggggcattgatgtacaagaagacaatcgtacaatgcatggagctctaagagcgaataccgtactgaacttcacaattacggtgaaggcgatcagcgattttgagttgattttgagcaggaagggcaaaaaagacgcggaagaaaaagcacttttaaagcatttattcaaacaaattatggtctcggaacaaaaacagcctttgcccgcgtgggccactcaatacgttacggtaagtgttactgtaacaaatcagttgaagttattaagaaaaatttaaaaaatatttaagataacttacaaagggatggcaactccaaaagcgcaagtgttttgtgtgccggaaaatcgttgtaccatgaaaaatggagaaatggcgtacgaatatgtttttaataaagcaaattccaccaattaatagcaattaaattatgttatcgtttttttcattttcattccctaaaattgcacattttgaaatttgaataaaaatgattatactgtaatatatacatgcgggcacttaaagcaaaattggatttcgctgatcggtatttatctgtatgaagaatttgaaaatttttccaaaaaaaaaaatctttctcgagttcttaaaactgaaataacattttttaaaataaaaatctgtaaaaagaatcgtccaaactttttccggcatctatcgaccccattccgaaactcatattctctcatattttgataaataaaattcttataatagtgttatttttagtgaaaaaaatctgttaacaaaatgcgccaatttcttgaaaattcgcgtatggttacatctcgaatttattttttgtctttccacgataaattgattcatttctctggctgagatttacgtcaaatacatggtaatttgggacaaaataattaattatatgatgattagggctcggatttatagttgctaaaatctgccaaaataattagtttttagtttctgaaaaacctccaaaatagttgctaaaaatgggtaaatagttgctaaaaagttccgaatttatgaggtgtaaa

SEQ ID NO: 23951 - DNA, 437 bp, Heterodera glycines
aaaattttaaataaaagacatttcgccaaaaataattattaaatttttcaaatttggggcagtttcactggtgaaatttagtcccgtttttccgacccaaagacagggaccgggggtcccggcggggccccggtcccgtccggtctcacatatatatagggggttttgaggttgctgaacacggttatgacatccattttgatcaaattcgaaccccgaaccctaattatgaagcatgttggtcctcaaaatcgttaaaactatttttaaaccagcagtcagaaaatggtaaaagaacgtcaaatataaaagattgaatttagcttattgcgctaaaaaaccgccgcacactcgactacggcggccagtaggtggggcgagactacgggctatggaagaagtccgcgcgtgatccgcaggcggttgactgattggcg

SEQ ID NO: 23952 - DNA, 1873 bp, Heterodera glycines
acaatactttttcacacttttctttttaattttaattatttgtatttaattaattgatttttgtccactttgaattttcttttattttaattatttatttttttttctccaattttcacttttcgatttgctattgacgaatggccaagcaccgcgttcagtccgcctttgttcagcttcagtacgttcgggttggatgagctcggcacgaacagttggacgggcttcaacccaaaaatggcattggttttgtcttttccgcccgcttttgcccacccttattcggtttctgttctccatttggcactgtgttccgcgttcgatcgccccaaagttcggcttgtaataaatgaactgttgcggttggctgttacagttgtcctgcgcgtactgctccgccgcgtcttcgtcgtccccgcgcgcctcttccgttcgctgccgcgtccaattcccgcgcggcgccgctgctgccttttcgaatgcgcttgcggttgttgtgcttgtcggagttttggtggcggtcgcctgtcgactcacagcacacgcgttcaaagccgggataaaacaaaacttcaacggcacgccgagaccagccgccgcgccccgcgttggctggtccggcgccgctcgccgctgcgctgccgcgtactgcgcgcgttcggccgcaccacgcgccctccgcaccgacgcgggcggtgtctttcgccttttgcgccgggtgcacgacaaactgagcatttggccaacgctttcttttcgcgttttgcgtagatttttaagcggactttttggccatttttttcgaatttttgaattaccactgggctttccggtgcttttgccatttcactgttccgtttcacattttccgcgaggaacacttggccaaaagaggcaaaaagccgcggaaagccatgggaaatccaaaaccaaaaaccactttaaatttggcatttgcttaaaaagataaaaatgaaaacaaattttgccaatgttaaggctttttcacgtgccaatgtgaaaatcgcaaatttaaaaaatgaatttgtgagaaaaagcgacggattcattcaaattaattgaattaaattggtattattagcattttttattgaatccatgatttaaacatcaatttgctttggaaataaaaaacaaatttgagcgcgcaaattcacttaaaattcaacgaaaagatgggaaaaactgcgaaatttgacacccaaaaaccttttggggaaagtgacgggtgaacaaaaagccatttttgctggggggcgggggcgggggaattggtaaaatgtgaacgaattttcaaaaattaagcaaaaatttaagttattatttaaagggaaaataaaactgtaatcttataaattaatagttgcttaattaaacggcacatttttaaatttcgctgttttttcttaggaatttttttccttcggtggaattatggccaaagggaattcgcaggcgaagggccaaacgatggccaagccaacttagtttatggggtctgaaggtgacaattttggcccggggggagggcattcattctctgctggcgacggctgtaactcattaaaaagtgcgccgggggggggggcgagggattgaattggcgtcggcactcagtgaccattttcgcatgtcaaaagccaaacgggcggaaagaaagtgagggaggcaccaaatcgctttatttaattaaatgagttaacaaaaagccgctttaaaacaaaagtcattgttctaaaaaggtaattggcctaaatatgcaagactaataattatctaagtgcaaattggcactttttgcaccttccgacctcccaaattcagggtttttttctgaaatatgttattgcat

SEQ ID NO: 23953 - DNA, 1873 bp, Heterodera glycines
atctgtgtccgtacgattaaaaatatttcatagtttgataaattggaaaggtattattaatttttaaaaatatttcgaattttcattgcttctaccgtatcacttactcttctattgtttttctacagtatctgactgccattctcttctcctggtccctgtgctggctaatgaccgtctttgagctgatccccaaggacagtgtggcacggacggacaaaaatgccacccaaatggccattcaaaatgcgccatgggcgcgcgtcccactcccgggtaaaatttcgaaaaaaaatcgaatactttggaaatttaggccaattcggcactcccaatttcaacattgggcttttcgtcggatttttggtgtccgcccaaacgacgcttttcgaggcggtcggcaatttccacgcggtggcaagtgtttcggaggttttgtttagggatggcacaccaaaatatgcaagaatttaaattgaaaggaacggccacccccgtcgcatgcgatcaatcgcggcataatggccgaagggttgggctgcttcgtctccggattggtcggcgccggcgttggcatcacaacgcatgccgaaaatgttggggtgcgaatttctccacgaaaatttcgtttccgacgctttgaataattttccaatttgcaggtggtcggcatcactcgggtggccagtcgagtcacaatgcttttcggcggaatcacaatgatcgctttcggggtctgttaattgcctcacttttattttaattgctcctaatggccaattaacttttcatcagttgttcatttcgtccatccattagcacattaattggttcaggtggtcaccaaattgggtgccgttctgtccgccattcccgaccctctcgtcggcgtcgttctttccacttccatggccatggtaattaatgtcatgccgttctcatttatcacaaatgtttgggccctttttgcttctgtttcccttaggtcggtggtgtggcaattgccaatgttcagtcggtggacttgaacagcacgcgaaatgtggccattctcggcttctccataatgatgggcatggtcgggcgggaacaattaaattccataagaaactaattgcctgattaaatctcaggtggtgcccgagttttatacccgtaaccctgacgtcatcagcacaggccattccacggtggaccaagtgcttaaagtgtaagtgacaagcgaataatgggaaaatgagttgaaaaaaaacaaaaaattggttaaaactaatttaattaaaaaataagaaatgaatttaaaaatttaattgaataaacttttttaagaattattgtttagtcttttgaatcttccaatgtttgtcggcgctttcactgcttggttttattatattttttaattattttattatattcaattattttattaattatatttttaattttaatttatttatttttgcttttcagcgttttggacaattccgtcggcggtgccacgcgcgcccaacgcggcctccgcgagagaggcgtcgtgtgggagagaccggcggacggaaggggtcggacaatggaaaatccataaaattaaaacagatatttcattattttaattatttgttttttttatattacactaattaatgtacaaatcaaaaaaagattatttaatttatttaaattgaattttagatttaattaatttattttaattatttccaaatatgcttctccctcccttcccttttccattcttttattttccattttcagatgtttacgcttttcccgagcctttgcagcgctttttgtccgcccttccgatcgttcgctctttgccatttcgttcgcgcgaaaagccaaaaaaggg

SEQ ID NO: 23954 - DNA, 1532 bp, Heterodera glycines
  misc_feature (1501)..(1501): n is a, c, g, or t
aattttattccattcttttcttggatattttcttcctttttgctttattttttcttttattttataatatttttcaattatttctcttttttcttccaaattttcattttcttctttttcttccaatttttctccaaatatttcatcaaatgatttttgttgtaattttttattttccgttttaatttgatgaagttcgatcatcaaaaatataattaaaactaataaaaggtggattttcatttttttcataaatttcgaatataaacaagcaattatttttacaaaaatgtaattttatattaaattaatttttataaatgaataaattctccggaaaaaataaaatcgtaatctcaaatcaattcattaagttgatttataatcttttcggcattattaaaaatatttggtaaatatttttccaaaatcagcaccaaatggtaaaaaaagaaaaacaagcgggtgtgtgatttggactgatgcgatttggaattttttttaatttttaataatcattctactgagcattaattttaattaaaaataatttaaaaatattgaaatggtccaggaataatttcaaaatttcaaataatgctgatgtacccattaacaaaaagcaaaaaattaggtgtgtatatcgttgtgatatattttttgcatttcttttaatttctcttttgttgttgcacagcattttgagtaaaatccatttaacaaccttttgctgggtaaattttgaaatttaaatatttttctaagatttgtatcggaatttgttaattgataattagtagtccttcaaaaatttcttttaggtctattaaacgcgataacattttgatcgaaaacgacaaaaaatttgcacacctatgttagccatgagcagaagaatcatcattagtataaacagacggatgacacggcggatgatgctgtctcctgctggggacatctgattgattccatttatttatttttatacaatattattcagttcgagaaacaaaatgccaaatatttcacgattttttttttgcaatttttctcacatattttgccattttattaaatgagttaaactaaataacttaagtcgcttctttttaaccagatgtcaaaatattactaaatttatgtaagcttattcttgctatataaaaaaatattattatttaaatttttaccaaaatttattcaattaaataatattaattatttaaaaaggaaatggaaatcgatccgtccgtttttccgtcacattaattacaaaatgtgtaatttgtttcgtttatgcttcactccaacagcggaagaagcaggtgcctttctttctcccctcttaagacatattaattggccatttaaatgaatcccccccccctcccactttaatttattccataaattatattttaataaaaatttataatgatggaagctaatgaaatcgcctgcgggattgtgggattttggaaatttcgaaaaatttttccanataaattgcgggaggtaatccccaggagatt

SEQ ID NO: 23955 - DNA, 1102 bp, Heterodera glycines
aaatttattaatttttttcgcagaaaccacaaaaacgcacctttgcccattcttctaaaacttttttgatttctaataaaataattaaaattaccttattaaataaagcattagccagagtagtttgaactttttttaaattttgaagtttcaaataaagtataagcttaagcccaagcaatttagcttgagtttaagcggatacatttccatataaatatttccattttttctataatttgagttcattttttaatttttaggatttttaggtactaaaaatcgcgaaatcggtgcctaaatagatgctaaaaacttaaaaatgccaaaatagtggcttaaatagtttttataacaaattttttgtttataagcaaaaatagttgctaaaaaagtcgctctaaatcgaaaattgttcgaaagcattaatttaattaaatttaaaatatttaaatttaaaatttttttaaaaatcataggaaaaatcatatttttgatttttgcacttttttgtgaagcgcctcaaataggaaagagcagacatttttagatttttatcttttgtcgaaaaaataataatagaaaatggcttttttcaaaaaattgaatgtacctgagaaaagtttttgctttaaaagcgcttataagagtttttctattacagctccgaatttgccatttttacaaccatttggctattcaataatgtttctgctgttcctttcccattttttgggtcatcgttttgccgtgaattattttatgcctccgcccctccattaatataagtgacccatccatcggcaacagcacattcattttttttgttcatttttctttactatactaatagtaaattactttttccaataaattataaaaaaaaattaaaattaaattaatttggaattcatataatgttcggcttgtttcatttgatctttatttagacaataaaaaatgtctttttcatccaattcatcagatgacgaatttacaataattgacaagggtaattgaaaacaaagaaattaaaataaattaaaagaatattaaatgattttgagaattaaattaattatttttatagcactaatttgaa

SEQ ID NO: 23956 - DNA, 1614 bp, Heterodera glycines
  misc_feature (174)..(174): n is a, c, g, or t
agtatttctatatgtcatatttccataccacacggtccattgattaaaaaaatgagtgacttagttaaaagtttgatttaaatttggagcacaacccactctggaccacgcatatgacttagtcaattaatcaaaaagttaccaaaatatattaattttaggtttgcaaaaacnccaatccattagggggtgtaaaaaagtaccggtctcgagtctcgaaaaccgtaccgagactgaaacccgagaccaagactcgagaacgagaccaaaaaaaaactcgagacttttctcgagtcgagactcgagaccgagagtctcgaacatcataatcatttgaaagctcaacatgtttagaaacttttcccgattgcttcgcgattaaaagattactaaaaaaagttatgcatgaaaatttaaaaaaatcgaaatttttgaagttttttcagaatattttttcataggctatcaatcttttctttctaaggctaatatagcctgtaaagagctttcgaatgtacaaagattgttaagtttgtttgacaaagaaaaaagttataaggccagaagcacaaatgactttttattcgaagcatgtggcaatatcaataaaaacattcatgaatttaaaagtttatataagcagaaatgacttttttgtcggtgttcgttacctaaaaagtaattataaaaatatttaatactttaattcaatttttgattgaatgttgataaaaataaaataaaattattcttaaaactcgtcattcttaagactgaaaatccgagaaatagtttatcgtttgttgtagaagttgagcgggaccgcaaattttggcaaatccgggaccggcacttgcatggacaaatttattaatttcaaaataattttggatttttttatctattatctttgaattcaattaaattttaatcagctatgctgaatgttttaaaattaaaaatttaatcatacttttcgcaaaagttgataaggttttttttttaaataaaaccaaaatgcttcagacataagatttgcacatcaaaaaatttctttaaaatctatttaattttattttatttagcctaaattaaatgataactatatgtaaaaataaataaaatcttactggattgtagaagtgaaaatttaattaataattgcagcaaattaatgaattttacagtaaaattaattattaaattcaatttaaatataaaattgaaaaatgaataataaattaggattgaaaaaaaaaactttttcaaaagtaagtcatctgcaagaatttcgggaccgtctcaataaataaaaaatttttatcgtctcattaaattcttttgagcaattttcaaataggggagaatatgatgatacatttcctcaatttcagaattgtttttagttcccgtaattacgactttatcggtccagaaaattaacgctgtcatgcttttaccccgcttgaaatttaaaccgcaaaatatttccggttcataaaatgcacgacgattttttcgaaactcgttcagttcaatttcacgtccgaatttaaaggtcgaaacaatattttcaaccgtgtgtccggtgtaagaagcccccggacaccccga

SEQ ID NO: 23957 - DNA, 1101 bp, Heterodera glycines
attcagaaaatggcccctaaaccagtcataaagttcaaccctttcaaaatactggtcctgatcctatataatttctttaaccttaccattctctagaataaactaccacatgaactgaggctttatgccacgataaagaatttcatctaagtaaatatttttgtcggtttgaccccttaagccctcaaaatctatgaaatttgaacaattttgaaaatcgcccgaaatcttatgaaataaaaatattttttaatagcagtcattcacatctgctgaaagagcagattctgttagctatgttatatagttttcgttaaaatagaccattattacttttgtaaattaatgcctgaaaaaatattttcaaaattgcgtgcctgaggctgggacattacttatttgtcaccctgtattggcgaattgacagcacaaaatttaaaaatttactcaatttcaccttaaaaacgccaaaaaaaataattatacggaacatgacttggatacggattacggacttacggattaaaaatccggaaaatccgtatcggcccaaaaaaatatggattacgaactacggatccgtaaaaatccgtatacagatccgccggtccgtacccgctctctattttaaacaatgttgtttttcatttgaagacgcataaaaaaagtgtgcgtctctaccgcccacagaagggacgggacagtggaagcagagaaattagtgaattagggtcggggtcactttggcgcgggccattttggcgccgcgaactttcaagtgttataacttttttcttatccaaccaaataaaataattttgataccattaaataggcctaagtgttctttattagcctgcaaaatattagaaaaaataaattctgtttgacaaaagatatagcgtgcggcgccaaaatggccagaaaaagtcagttttttgaggttttttggccataacttttttgtgtttcaattaaattttttgaaattttgcaggctattagggactatcaagcgctttaaaatgatatcaagcttatttatttgaatgagaaataaaaatgttatagcgtttggcgccaaagtggccggttcccatc

SEQ ID NO: 23958 - DNA, 1605 bp, Heterodera glycines
caaattcagtgcaatttttatctaaaaagtcaatttttatcaaattttttgcggcgcatttttccaaggaactttggagagcgggggtgggcagtgggtacggcggtcccgatagccgccgccggggaaatttttttttaaatttataggtaaaataagaacatttatgccataaatttctaaatttatgaataattttaataaataagaacaaatggaagccctggattaattggacaggtggtgaaaagtggacgaaaacgctggagaaaagcgatggcattgtggtcgatgaaactggaaatggaatgggaaatgttgcctaaatcttacacaatcgctaatttacaatatctcgatgcgtttgaatacactgactttgcgtggcaattgcatttgcggaattggcaatgcttttccacgtaaattggcaatttccattttctttgtgccattcttttcgattttgcttccaattcgaaaagacttcagcgcccatttgcgcgttttgaagtgttcgtccacgtaaaagtcaaatcggtggctgatcagcgcaattccaaggccaagttgagaaggtggcagcaaatcgaagacacaaagccaacaatcgccggagatgaagctgaaaaaaggaaaacaaaatttaaaattcaaaattagcattcattttaatttacattgcttttgccatcttttcctccgcttcttttcggttgtctgacattttggtgaaggtaattattaagacaatttccgacagatgtaaaatagcttagcaaaatgaaaaaaaatatatgtaaaatcagcgattcctattaaataggcccaatttaggtatttgcaaattttgtgataataccgaagtcgttaaaatttgctgtttttagactttctgaatccatgaaaaagtcgtccttatttttgtatataaaggacgtttcttggacagaacaattcatttgtcattttatttattctgtatattcaccaatatccttcctcaaccttctccgattatttcattcattttgtttacgattttaattaattttatttatttcaagtatatcccttccttctgaacgttgtgcaaattgtcaacgcacgtggtcaaccgttgccaatgccaaccgtaccgatgccgaacaatgtggtcgcattcaacggaattttcatcaagtagtgttggagctggaccacaccgtttgcagggcacggcaacaattttgattagtgggactgaaatgtccgattgccaccgacgagattcaggcgtccgtccatccagtctattttttaatgcttgaaaactagttgatgatttgatgatgttgaggcactttgtgcaaaaagggatgccaaccttgtggcattggacgactgagtcccggtggtgacaattagacatttcagtctcaggccaattaatgggtcgaaatcgtttttgttgtcaccatcaaatggcaccattcatcctctatttgtttcccccgttttttcagttacttggactgacaacgacaacggaccaaatcaaagcggtgtgtgcattttttgagcattttaacaatttgttaccaataatttgatttgactttttcc

SEQ ID NO: 23959 - DNA, 2102 bp, Heterodera glycines
  misc_feature (1383)..(1383): n is a, c, g, or t
aatctcacaacgacttcatacactccaaccgcattatacgctatttgttttatttggctaattgtcaaaaaagtgctggaaggtattggaaatcgaaagacagaaaaagtttcgaattatgaatttgaaaaggaatattcgaaaccaggaaatggttttactataatctctcgatcaaaaaaaaaccttggtttgaatccaggttaatctctagaaatatcagtttggaggcaaaaaaaagataaattggcttagaatgaaaattttgtttatttgacattatccgtcaacgtacaactgttaatgtatctgtaaatggtcatcaacatgaaaagacgccgattcaaacacgacccgccccatagtttttactcactgtcaactttaatgaaaagggtaaaatatagggtgctatgacgttagtcaaaaaaccatcaaatgaaaatattttttgatataactttgttcaagagcatctaaatttttaattcttgatataattaaatagcactaagtgtaaattccaaaaagtttcgttaagtttcaagaaagttatgactaaaaatgttcaaaaaaacttggttttttgagcttctcaggtcataactttttttaaacttaaagaattttttaaaaattttgcaggataatagaaaacacttagggctatcgaattataaaatttgatcctttagacgaaattatgaataattttctgtcaaaaattattcatttgatggttttttgactaacacccattttcatggtttttgactaacgtccccagcaccaaatatagtgccgttcgagagtctcaagtctcgaatcaagaaaagtctcggggcaacacaaacaaattgggactttagagtttttagcaaatttgcgggttgctaaatcctacagtaaatctttttaaatggtccacttttactgtagttggaaatatatacaacacaatatgactgtgtatagataagtcgaaggtatttaatttgaaaaaaatttcgttaattttcagaaaagttatggagatagacttttaaaatctccattttttgaatttaatgactattaagtttcctttaaattttctaaatttttaaatttatatattcggatagagaatatgttgaataatcgaaatgataccaaagatgttaaatttggtcgatgtttttgttttcacttttattacctcaaggcgcatttagtaaacttgactaatgttatgtatctgattacatttttacctatcacaacctttgaaactttaagcaacgccaaagcaaacaaacaaaaaaatatataaaaatatttttccgttttttctgtcatttgtgcgtctttttttctctgttctctctctttctgctgcggttnttgtttgattagggcaaacaatgcgcacaataatcaaagtaaataataataatttataataaatggcgagaattcgttggtttgttcgtacctaaaacaaaataaatgcgcatcattttgaatggaaaatgcacttcataatcataataataatcataataaatgacggagagataaatagaccataaaacaagttattattcttacactttgagcggggcggggcgtcggcctaaaacattcattttgagaggccgacgaccgacaaaagcgtaatttatgggtggaaaaataaccaattttttatgaaaatcctctcgaaactttttcaagaatgaaacaaggcaaagaaaagaacaccacgaaccacttgataatatggccaaaaccgaggaaaaaagtttcaaaaagaccaaactttaacattttcagacacactttaatttggcaatgtttgtttaaaatgatggtttaaagattttctttagcgaaagaaaaatataaatttttatatatttttttattttactagtcaccaaaaatttttcgcgaaagcaccttttgaaaaatatttttgaaattctaatgaaaaccttaacttctcgaatgttggcttaccatttttttaaatatataaattggccatcattatcattaattcttatatcaaaaaccattttcacaatatacattttttaaaaattattaaatataaatgt

SEQ ID NO: 23960 - DNA, 1071 bp, Heterodera glycines
  misc_feature (1042)..(1042): n is a, c, g, or t
ttcaataattcaaattaatttaattgattgcttattttaattaatttaatttaaaccgaatttggtgaattaaattgattaatttgaatcaaattttgtaaattatattttttatccataaatcagagccctgatcattagcgatgctcgagggtcacggcttcaagtctcgtctcagatttttgaattaacaatgttcgagaatttcggtttcgaatctctgaatattattataatgaaaaaaaaattaggtttattaatgtttttacaagaaaaaaggttaaaaccaagctgcaaagaataatgaattttttggaagtgacgaaattttagaagaaggaattaataatgatgtcgtctcggatttttgagctatcgctttcatgatcactcggtcccgattcttcgactcattaaaaatatttgattagaacatcactaatgatcaggacgcaatttgtaagattaaattaacacagaatggcacgacctgttcactttgttggcgtatgtttccatcatgaatattcttcccaacagctgaacttttttcaatcaattagctagttaattgaattagtgatactcgagagtctcgcaggaccgtgtccccaattaggaaaatccataatgatgctcgagagtctcgagtctttcggtgccccttagtctctctctcggtcattaatcactaaacaaaggcatggcaccaacatccttggatttcccatccaacgattgttgcgtttaagccgtgcaaagagtcgggagcagcaaataatgtgcgtgtcaagcaaattggcgctattccgtacttttgccagtcaatccaatcttccaactgaaatcggaaaacattttcctgcaaaattatttaaaatctgaaaaagttgaactgagttttcaaaaatccagcaaaaaaaaaactttttttttttgtgccgcaaaatcctcttaaaaacgtgccaatgtaattaacaatgtcttggacaaaatattgtataaatttggaagaaattgttcaaatttgtaaaaaataaanataaattctaattttttttatttagaata

SEQ ID NO: 23961 - DNA, 1327 bp, Heterodera glycines
agatcatttagtgctttttttaatcaaatcgattgaaatttcagtcaaaaatgggaaattattttaatttaatttaaattttaaaggcaattccgagcaacggactcaacctccacttgaacctcagcgccgaccactttttgccggaacgaaacgaagtgggaaaagggaaaaagaaatgttggcattttaaaaccttaaaaataacggcgaaaattaatttgatcattaaaatattaattgtccatttatctctcttttttggctcttctcccattttgccgccttttcagctgcatttcgccagtgagcttctgttcaacggtgcacccgtacgccttcgtgggcacatcagcacgcgcactttgcacggcaaagtgcaggtgattttcgctggggttgtcgggattgggagggagttcgatcggaaatggaatccccgactaatccgcgcattgggcaggttgagttggcaccgcagtcactcattgggcaacggcaacagagtgaacgaattggggaacgaatcgctcagctgaggacagccgcgttgagactttgaacaaagtgaaaaccgacaaaattgtcaatttaatattatgcataaatattttcaatattttctattttttgcatattttttaatggattttgtaatttttgtacatatttggaaaaaacatttggggccgcgaagcacggaaaattcgacttaattgaaacttattttataattgtgagagtttttccttatttaccgctagtcaaataccattctttctgtaattattcattaagctttccaattaaaaatttatgtttatttaattttaaaggaaacgtggacaaattgacttttatcgcttggcatatgaatttgtcatgttaaccgatgcttttatgtagcatcttaaaactaattaaattatttaggtaatttcttaagatataatatttattcttaatcggaattcccaaatcccgggggcgcaggcgggaaaatttataaatttgagaggaatttatggaaaattgtccaaaaataaacaattaactcagttttgagtttatttccaaaaataagaacactcttcgggataagtacttttcaaatttctaagattcagcttctccaaaaggacaatcttagaataattacacttgggactcacactcaattcttaatgttaactattttattttattttagattatataaaatgaataaaaaactagtcagccctcaaaagccaactttgtgccgcgatttgcaaattgaaattggcgagaaaattgtcgacccttgcttagggcattatttgcccat

SEQ ID NO: 23962 - DNA, 1770 bp, Heterodera glycines
  misc_feature (14)..(14): n is a, c, g, or t
aaaattttagtggnccatgaaattcaaaaaaaaaatgcccaccattgccatcatttaaaaaatgccattgctcttacccgccgttcattacggcaccgttggccttcttcggctgtgccatgtcgccgttttgttcaagaaatgaactgcagtgatgctgctgctgctgctgaagatgatgtttgtaaggagatgaagccattagggcagggaaaaatgaatttttatataaaattacgatttctgactgaaattttaaaaaatttcattgaaaatatgctttcaagacagaaaataatggtggaaaataatgggctattttcacgggttggccaccaaattgagttggcgtggaatgaatgtgccatcgccggcagcagcagaagataggaggaggaggaggcaaaaatgaaggaaatgatgccgaaaaagatggcaaaaaaaacgaattcattgttttcgagggcattttggtgggataaaaaaaataacagcaaatttggaatttaaaattcaaatatttgtttttgaaacatgttttttgggtgcttaatgatattcccgagctgattagagccttgaccgattgattgaaaggccgggatcagattataaatacataaatatttaacaaaattttggtaggtctgaagttcttaaggtttagaaatttaaatccgactgaatatcccgaaattcggaaaaacctgggaacaagacggacccggattttcgaaatagatgcagacaggatgtgccaaacaaaaagccctgattaacaggacgccgggcactattgtatttttcaaaaatataacgacccgaaaccggattaggactttaataaaatttgaggattggaaatctgttcgttggctgatcacagtaatcccaactgagtgatcggaattctgttcatccatgctcaaatcacaaaattaaaaaaaaggtcggctcagagagtgtcttctcaaattacgtcggttgccgagcaatttttttttgaaattgaaaccgtttgatagcctgaggcattgtaattgaaatttcaacattgcctcaaggggaaatttttgaaattccaaatttaaaaatgtgtctcctttgaaatggcttcttcgcagtcccgctcggcgtggggcacagatattttttgtgccattctttccgcagaattggcccgaagaattgtgtcattgtgacatgccatgccacacattgggttgttgtgttgttttgtgtcagtgtgtcccattgaaatggccttaattaactgtgtgccaatatcggcgaattttttttatcgcttcgggcgcaaacgaaacagaaaaaaaagacagtaaaaaggcatcgcttgagggcatcaatttgctcatgcgaaacaaatttgattgaatgaaagtgaatgaatgccagcagaagcaccactcaattgaggaagaatgaatttgttaaaaaatggcacaaaaattaaaattaatcatttgggattctttagttttttgtgtaaaataaattaattaatgggtcaatattatttaaatatatgatttttattttgcttaaaaaattcaaaaaattctaaatatttagaacaaaaattcgttaaaattttttgaatgtttcagggtttttccaaagaaataatccaggaattttattaccaaatttttgaatattcatttgacagtaattaattatgaattaaatttcaaatttggcaatgatgttattgaagatatcacaatgaaattttttagcacttttatt

SEQ ID NO: 23963 - DNA, 1833 bp, Heterodera glycines
aattaatgtaatttaaattcacttaaaaattatttttcaattttaaataaaaaatttaaccgaacagactccgatgtgtcgactcgcagaattggcccgcgcaaaccatgtaaaaatgcagcaaatgtgcaagataattcaataaataatatgtattttgtacttctttgagggggggggggtgatttgggatttgtctgactttttaaatattatttaaaaaattattttctaaaatatttcttaaaattaaccccccacactcgaaatttttaaaggaaaattttcattttgtctttaaaattttcgatttttcgtttttttccttcaatacctctctcaccaatctttccaaaaaaatttacgttaaatctgccccacccccttgctgcagcttaagcatgagtatgtgctgttggacgaaagtgggccggcccattgcaagcagttcgttgtcaaattggtgctgaggccgggcctcgagttcgacggcagcggcccgtccagcaaaaaggcacagcagtcggccgcccaggcggcgcttgaccgctggtgccagctgccgttgcgccaaccgccgcctgtgccgacggcatccgcgccgccgctgccgctgccaccgtttggcacggcggtgccgtcgtcggttatgtcgcaacagcagcaccagcaacaacaatatcatcttcaaaagcggcacctccggggcggtgccattggtggtagcgcagccgctgtgaggcacaacagcaccagacggggtgacaaaaacaaaaattgctttttcgttttggttttaaggaaatttcatgaactgttttgagccaaaaaaatttttgccgtactattttttttaattattcgattgccattacgcttctctgttttcctcgaaaattttcaaaaaaaaaaattgattatttttgaaaaaagatatggacaaaatatttttgttttagtcgtggcttttttgaaaacatcataaattttcttgatttttgcttgataattgtgaatacattggcattttgtttttggctttttagatgacaccaaaaatcccgtttgtttgctgaacaatgtggcggcccagctgggcatcaatctccattaccgggaggaaagcttttcccctttcaacgacaatttctccaaatcgctacaacagtaaattcaattttttttttgtttgttaatattaaatatttaaattaattaattaatataatcacacaaaattcacgaatgtgccccttggggcattaaaattgaatttgaaaaatattattatatatattcttaattatcttttgttaatgcctaattattcctatcaaaatgcttcagtccctcctttctcacttatttgttgccacaagcgttgtgcccggccgctgcgatacaaagtgtcaatgggtcattagcggcaccgcttttcgctaattttccacaccaacaacagcagcagcaaaacacatcggggtaacaaactttttttttgtttaacgtatttctttgatgatggccaatgcaaagcgcttatcgacagagccattattatgcgcataactaaccgttttttatcatgaactatagatatattttacacgtccgctatgttattccaatactataataccgtgtttactgaattagagccccgggggctctatttttcaaccccctcgaaaggcgggctctaattcagtaaatacggtatatctatgttcacatgttttgtttttattcgctcacatatattttttctctttttccttgttttcatgagtatgcataacaattatattatatttccatgtttatttgtgtttt

SEQ ID NO: 23964 - DNA, 1846 bp, Heterodera glycines
  misc_feature (1784)..(1784): n is a, c, g, or t
aaaaccagggttgcgatgatggtgatatgattacgggaagcaggtgtgatgaggaacgtgattgttatcgtggcgaatactgtggcgatttggtaatttttgtaaacgctataaacccttaatatggctctgttttcgttaacgatcgcgctcttccgaaaatttcttaaaaaacttaaaatttctaagaatttcaataccaaattttgcgctacataaaaagtggcggccattcaatttttttacatttaattattcatgctttttattaaatttttgtttttacagtttccttaaaaccactcttttcctgttatttttattatcaccatattattcgaacaggtgccacaattcatattcgattactcttaatagaccccctttttgtgccatattaaattgcaaaatttctgtggaattttttttagcaaaaatccatcttaggtttatgaaattaaaaatatttgaatggctgcaactttttaagtagtgccgaaattttattatacaatacattttttagaaactttgttgtcttccacgtcgagctgcacaacctgatgaaccatcacaaccagttcggcctcaaccatcaccaggccaaaggactcgtgaacccagcgctgctggtctcaaaaaatagcgaaaatttccaaaaaaaattcctcaaaattttcacagcctactgttacaatgggcaacaatcctctgtgagatgcgactttcaaagcgattgcctggaaacacaaagttgtataaatgggttgtgctgtgttcggtcgggcagtgaatggaaaagtgagaaaaacgaaaaaaaaaaaatttggaaaattttttgaaaattttttttgaggcgcctgtggtggtgccatggcggtgtccaactgttttcaagatcgtagttgccatgacagtcttgtgtgcacttcatcggattactgttgcgaatgcccatatggacaaacaaccgggcaaatgcacacatgtaagcttttcgtttgcaaaaaaaaattaaaaaaattattttaaacaaattaataaatcccaaaagtccaatttcaatcattaatttttctttataaaaaacccatgttaattttattcaaattttttttcgctttattacccaacatatttatataagtagaaaaatatctctcattttaggaataattaattaatttatttatttagttaaattattcatttattcccacacaaattcttatgtagaaaatattcttaattttcaagaaattattttatttaatataaattttttcatttttttttcacaattttctcaagggttgtcctccaaatttttcctgctcgtccaatggcttttgttgtcctcgctgcacaactggtgaacaaccgttcggctcctgcttcaacacgcgttgcgcgcccgggtacacatgcgttgccggcaacatttgttgcccgaatgaagcgagatcgcgactttgaacttattttacattttattttgttaattttagcaatatgttattaaattaaatgtgccatcaaaaattttccaaaaaatatttagggaaaatttggtattaatttatagaaatttcttgtgagaatccaaaaaaatttttgaaaatgtacccgtaaaaattttttttttttgaaaataatagatattaaaaattagtcaaaatttgctcattttacggacaaatctacaaattttcaatcaaattttgaaaattttctccggcatcgcttttaaagatcttcgatttgaaaaatcttgaaccgaaaantaatttatcttacaccatcttcacatttcactttgcctttaactttttatttttcgacctgc

SEQ ID NO: 23965 - DNA, 757 bp, Heterodera glycines
tatattacttttatataaaaatatccccatcagcatttcgtggtatgattttcggcaccacaaaacgggaagcgagttcgatgtgacaattccacggagacgggaaaaaggatttacatcgagatcggtcagcttttactccctttcttttttattgtgatggcattgtatctttttgattagttgttgtcgatgaaccaatccgtcgtggcaatcgccgatttgaggacactgactgtgccgcgtacactgtccatctgtttccgcccattcacttcatcaacacattgccaatgccagtccaaatttcggtgcccgtccattgcgaattggcaggcggtgacgggctggacattgtgaatttggtcgctggattcccactcattttcacggtaagtgaaatttaatttaattacggcatgtgctaatttgaacccatttgtttcccttgcaggttaatgtcggtactgaagtgtacgagttgcattacatagtgccaagcgttaaaaatccactggaaaccgttcgaatggagggcaaaacgaacaccaatttagaattggttgggcatgcacctttaaagttattcattaaattgaactgaattaagtgccttggtctgaattggagcaccgaattcttacgcacgaatttgatgctttacgcgccctattggatggtcaacgagacgggcaaacaactcgcctattatgtgagacatggcaaacaaaaattgcaattcatttagttttaaatt

SEQ ID NO: 23966 - DNA, 1693 bp, Heterodera glycines
  misc_feature (9)..(11): n is a, c, g, or t
  misc_feature (31)..(32): n is a, c, g, or t
  misc_feature (61)..(61): n is a, c, g, or t
acattttgnnntataaattcagaaatcttgnnttaatgattaataaatgtgattacatatntaaatgcaagtaccaattatgtgggatttttttaggtaatttaacgaattaaattttatttatttagactgaataatagttctgcttaaagaattatttttattaaataaaaaattaagtatagtataagatttatatattttttaaattattcctgcaacttgtttcgtcgataaatgcgaaaatttcaaaaatccataataattggaaaatttttcaaaaaataactatttatttgcttttttaatagtcgaacataagtcaaataaatttaaccaatttttttcgaaataacagatttttaaagaaagaaaaatcaaaaattcaaagaaatgattttttaatattcttttaaattgatgaataattattttcataaccgaattaattaattattaaaatttatttttcagaaaaatttttaattcagtcaagacgtaattgattagcttttttgagttttttgataaataaaacattaaaaaatgaatagacgaaataaaaaatttatttgaaataataattcttttatgtaatgtaaaattttaaataaataaaaaaggccccttctgccatattcgtcttccacttaaaatttttacagtttttgtgtttaataaaatgaccttataatatacatttttcatttttagtgtgattcttaatatttatggggagggtaaatttggtaaaaatttcagctcggttgggacatgggaagtatgataaatgaaaaaatctttagtggccttataatttctttacagactgtacgcgcagctcgactttgaaaacttgatagggtatggccacttaagagtttcagaaattttgtatcagtacaatttttggagagtccggaaccgggatcccggcaagagatggtttttgaaaataccataaaaggtttagcaaaatttagaaaaataaaaatatttagaaacgactaaaatttaatttactttagtttaatcgcttacctttcgtgtgtaaataattaattcattaattaatgtttttggtttttttcttgaaaaattccaagattatcccggtccaggaagaaaaattcccaaatcccggtcacggctattgaaatttcggaaaaccacggtcttggttttcgttcccgtggactctaccacagttcaatcagtcgctttttcatttgaacccttgcaacaaaacaagcaaagggtactatttcccttgcaaaagagtcaaaaatctcttcctcataattaagtttgttaattgagttcaattgggtcattattattcagattttttaaaaactgaaagggccactggaaaataaaaattcgttttataaattcacaaaaataccaaattaaaattacaaatgcatgcgatgcaaaaatgcagtcatattgtaaaatccagtcccaatcgtattgtacaattttgttcaaaataattattattcaattcaattaatcgatgccaaagatattttaataataaaaatgaaaaatcaatcataagattttttatgacgcattgggccgatcatttgagaaattcacattttaatatatgaaaaaagctaataaatgaagcaaaggttctattagtgaaaaagaaaattggaaatattaaattctccaattt

SEQ ID NO: 23967 - DNA, 296 bp, Heterodera glycines
tctaagagtcaataaatatgctttttaaaaattgaataattttaattctttgatcagtgtgtaagttaaataatccagtgtaaaacaacaatcccataatttttagtcttttccaatttagtcaatgcccccgctttaaaaaaatccaatgaaaaatgccaatttattatgcttaatgcaattatttgaagattccatagtaatttttaaaaatgagtaagtgaaatgttgtgctctttttggcaattagcagcagtagaattaggcattttgttgttgggcatttccgttgagct

SEQ ID NO: 23968 - DNA, 1616 bp, Heterodera glycines
  misc_feature (1548)..(1548): n is a, c, g, or t
  misc_feature (1600)..(1600): n is a, c, g, or t
tggtactctcatgtcatcaacgtcaacatccaaacggctcactcccgctacggtgaatatgtgttcaagcgcgaaggtcaggtatatcaagtggacagctacatcaaaggcacaaatgggaagcgggacaaaataatagaggtgaatgggtgtctgtggcacggttgcgaggagtgtttttgtaatattgacgaagaaactaaaatgccgaacggaaagacgctgcgggagattagggaaatggaagagaagaaacatgaaattttgagccgctacgtcgagttggaggttgtttgggagcacgagatcaaccagaagctgaagaagaacaagcagatgagggagttttttgataactggaaggaccgctcgccaatcaaaatcagagacgcgtttcatggaggaagaacaggaccaatgaagctactccacacagcgaaaccaggccaaaaaatcagctacaaggacttcaccagcctctacgcgtttaccaactttacgaccgactatcccctcggccaccctaaaatcatcagtattccaccaaatgagcagacggtcaactggcgctctccatccgacaacccctacaaaggccttctcaaagtgctgattctacctccaaacaacaacatcaaagtcactgttatgcccataaaatttgatcaacgtttcctattcccgctctgtgaaaagtgtgccaaacacatcaccgcaaaatatcccaatggcctcaaagacaacgactactcatgcccgcacttcaaccctaacgaagcgccttcgtgtccacttgcacccatcttgagttaaacgcagcattggaggccggctacacagtccgcaaagtcttccacgtcctccaatacgaccaatgaagtcggagcctggaaagcggtacattgccaaactttgcctcaactcactctggcgccgtttctccatgcggaacctccgctccaaagcaataatcaacaacgacccttgtgttctccgacaatacaccgacgacaagaaaattgacattatggacattgagctgatggatgaggacaaaattaatgctcacctacaagccgaaagaggagtttgtcgacgcaaataagtactcaaatgttgtcatctccctcttcactacatcaatggcgcgtctatacctttacgaaatgctcaaaagagtggccgacacccccggatgtgaaattctctactttgacacggacagcatcatctaccttcatcccgaggacaacggcccactcccgacagaaaagggacacctcggttagctgacggacgaaaaaccggaccacaacattttgtaattcatcaatgctggctgcaaaaactacgggctgaagttggaacgtaatggcaatggggaaattaagtacgacttgaaaataagagggataacgttagccgaacaaacagtgcaaacgatccattatgacagtgttaaagaccaaattttgcgttatgatcacgatgacctcgcggaccgcatcattgtaacttatccccattttattcgtcccaaccttatcnaaggcaaactgtatacccaatctctaactaagcattaccaacctatattaancaaaggtattattaat

SEQ ID NO: 23969 - DNA, 1911 bp, Heterodera glycines
ttcttttcaaaatgactttttattattcatttttaaaggtcatttttttactctctaaaaagcaaaacaccgaccaacaatatttttgcctctctgtgaagaaaacggtgctcattaatagaggggtgtaggctatatttgtaaaattgggatacgcaacagcagcccctcggggtttatccgcccatgggcaacgaatggaaaacaccccaaggattagcactcattaattgtacattcataaggcggcatcgctcttgatcgacagattttggggagatggggatgaatgcgaaatagaagctaattgacccccggggcacaaagggagacaatgggagagggattaggacggggattaactgcggaatggacataggacagagagagagagagaaagacagacatattgtgccgatggaaaaagccgaagagacggatcagcggacggaagcggcgcggcaaaaaagggaggagaaaaaggccaggaatactctgctaattgtaaccagtaattaagtcgaatttcggacattaattttaatttgccattgtttcagttttatttcgattcccaaattcagcttctgctgatttgctaattaactttcctccggtcccttacctgctgctgttccctcctccccaatggccaatgaccatgacccgggcaaaataagtcaaaaggacagccgaaagagctgattgacctcaatgatgggctgggctcagagtttattcatcagcagagggatggggcgaaatttgagcacatttgcgttaattaaggataaatttgggaaggcgggaagggaagggacgaacgacacaaaaggggggaaggggaagttcaggatgggaacacaacaggggggatagagcagaagttcaggatggacactccaagggatgggaggaaattaaggatgggaacacagccctgagaatagagcagctgaagtcgaagaaaagcgcacccccccccccccccccgccggcggcaggaattacccgagtaacttaatccgccggttaactcacccccagctacgggttttaactcctactaaatgaatgttacagggttctcgctgggcttacccgcagctacaggttaaattatctttgtaactttattttggaatttttataattttgaatgaatggctaccctggcccaacccagggtaggcaagttcgaaaaagcaattggatggaggaaaagagtactgtacccaccttgctgcatttggtgctgtggcaagaatactgtagacgacaaccgtacgacaataattctactgtacttttaaaatgacaaaaacaaatggaaaagggcgagaaaatggaaatttttgaggaaaacaaatttagtttctgctaattttcggtgcacggaattctgcgctttgacaggaagttgacttttaagaaaggtgggctgtggcactctccgcccataattcacttttcataattctcaccacgcccccccccccccagaaaaattttggtattaccgtaaccggaacagaaggcgagtgctatttgtactcctccaaatttgacaaacaaaagagaacaaaaggcgggccccccaaatccatccaaagcattcacctggatgcattttgggcatgtattagtgggaagcaaatggcaaaaatggattcgtcacgcttgacggactgttcccggggaggaggccaaccgcgggcgggactaaaccatgttcacaaattgccctttccattagaattaggacggctcggaccggacggagcgccgtgggcgctttctcagggtaaattgaagaatactagtacctcaccaaattcgacgaatgataccaataaaatattgatcagtcgattcctcttgatttctaattggaatctatttctgagggca

SEQ ID NO: 23970 - DNA, 1632 bp, Heterodera glycines
  misc_feature (23)..(23): n is a, c, g, or t
ttattttttattaataaattaancattttggaagaatcaatttctttaagagttagaatgttgattattatttactaaaatatcccataaggatagttataaataaatcatcaagataaattttggaaaatttcttgatcaagaattaaatgatataatgggattttctaaatgacgcctgaaaaatttgaatttttactgatttgttaaatagttattaaaatttcgtattaattaaaatcaattaaagagtttaaagaaatctgaaaaatgttccattccactgaagttaatattttaagcttgtttaatttatttaaataatttatttatttttaatgataaataaatttgtaaaaaagaactaaaaaatagcattttagaaaattttaaccgtaaacttaggtagttcaaaaataaaactttataaaaatgctctgcaataaaaaaaattaaaaaatgaaacaaaatgcggtccgcgacgcaatttcacggaatcttgaatgtggtcttggtcaaacgcatgatactaaataaataaattcagtttataaaatactatcattttctataaacctaactaaattcaaagataaatgtaatattaaaaatattaaaaaagtttttttaaaattaaaaaattgcaaaaacttattatctataattaaacataaattataatatagtatttaaaatatgataaaacttttttgaaacttttaaatatttgatgcaggcactaaaattaataatatatttaaatatgaaactttaaaattaataaaataacttgtaacaaatataaaaatataataacaatgaacgatctaaaacaaattaacaacagaaagcaacagcgaacaaggtttcataaaggatggaggatcacgagaaaaataaatatgtaaatttatataaaaaaaattaaagaatgacaacgacagcgccattcccgactacgcaaaactgcttattaagcagttgcactcgctgttggccaccgcttcgtctctagttcaatctcaagtgacggcgaatgacgcgattgaggaagaccgcagacagcgaaccgttgtcatcaccaatgtgccggagttccaatccgggaaagcgtcggagcgtggggaggcggacagagcactggtcaatttgattttggacacagtggacctcgatcaaacgccagtggtgttccgtgtcggcatgcgaacgcccaacagagcgagaccgctcaaaatggaatttcccacgcgacatgcggctcggcatgtgctcagaatgaagggcaaagctttggcgttgaatgctctacatggtgcgcgcatcagggaaagcatgaccaaggagcaattggccgaacgccggaaattaattgagcagtgcgcacagaaaagaaaagaagacgcgggagattggattatctacgcgaatcaggtcatcctgcgcagtgacattgacacaattcgtaaaaatttttaaattttcatgtcaaatcaccaaaaaatcatataaatttttacaaaaaaagtttttgctttttccggttggtagaaaatttttataaaaaaataaacaattttaatttcttacaaacagttaaaggggatgttaattatttaaaaggtctaagct

SEQ ID NO: 23971 - DNA, 1004 bp, Heterodera glycines
  misc_feature (902)..(902): n is a, c, g, or t
  misc_feature (922)..(922): n is a, c, g, or t
aagttacaatttgggtgtcattcctttgtatatcttcagtatagtctccattcatactatatttatacatttaaaactatcatactgtatttacttttatggtttacgcggtgttatattctttaaaagttaattcttgcaatgatgcaaaacaatttatcataggaaaattgaaaataatcaaatgaaaaaaagaaaggaaataatttaaaaaaaacatttgttaaagaaaaaggcacaaaaagatgtaaaaaagatgaaaaatatcgaaacaaaagcttaagacaggacagtgtaaatatgcaaaataaatgcttcaattagtgttttttgttccacaaatgattttcatgtcgtttttattttaaaaattagcatttgaccaatcattaagcattagccaatttgggccccgccccgttcctttttttgtgtcccccgtccctggccagcattcattctgttcgggagagggattggcttagccaatcccccaatctctctccctcctcccactaattatcccgagaccgaactgggagtcccttccccatcccacatttactcatcatttactcatcaaatatatttgtattgtgcgcacattactgaaataaagagcatattcaaatgccgccgctgggatttttggggagggacccgtcgcctatttcacatttataatgaaattaactaattgaagcaaatcaaatcaccactaattatagtgaaacgaatcgactaaaacattgtttggttgacttgtgccgaatcacaaacaaagcacgcaatgtttaatcagcttgacaaaataaatgagaaagccaatcgcacttaagacaaacgtatacatatggtaaatgtaatttggcattgccgaattcatatgatatttcacttgngtggcaattgcacagcctanaattgtgccagaggtaataaacccactaatggcaccagtgcatgttttgccgtcatcatcggcacgttttcgtcgtcttatg

SEQ ID NO: 23972 - DNA, 1782 bp, Heterodera glycines
ggggctttattcccgtcttgcggtaatttcttaaccactgttaaaataagtaaaccatggttaagaaattaaacccgcgatttctcgtcttcccttttttaaccatggttaacgcttaaccacggttttttaaccgcggttatggggcagcttaaccgcggttaacgcctctaaaccacgtattttcattttttggtattctcgttttcccttagttaaccgcggtttaatttttcccttgtaattttaaccacaagtcgtagcagggttaagcccttggttaagagaaaaattaaataatattctaataaaaatggtctaaaaaatttaaaaactgtcaaaactattaaaggaagttaaaaaacataattatctttttataaccagcatttagaaattttttaaattttttgcatcagcgtcgaattgaattctttttgacttcttttcaagtaaaaaacattttttacgaccgtaaacttacatacaaccgacctaaaaattttcaaaatatattcccactaaaatggaattttcaaaaaaatttccccgaatattaattctttctttaaaaaaactttattttattttttacttttattcttttcatgagaacttttttttgaaaacgaattttcgtctaaatagaaagaaaaaaatagtaaataaaaaaaattatttacgatttttgatacctattatttgctgagtaattagcctagatatatattttttaaattttaatcaatgaaaattaattctcacgaattttagaataaaaatttattttttgtatttatttatttaataaattcagtgcttaaccgtggtttacttaaccgtggttcttaaccacggttaaagacgagaatacatattttggttaaaaataaaccgcggttaattaaaccacgattaaggcgttaaccgcgataacctaaccgggaaggaataaggccccctgttcggccataaattattttatgcgccatgaacagatcaagcagatttcgtctatcttgaaatgttggcagttggaggttggtgaaatatttttgacatttttcaatatttgtttgaatagatggattccaaatgttaaaaaatgccaaaatatgtgctaaataggtgctgaagccgaaataagtgcaaacgaaggaaattcatttgacgtttcatggcaaaattttgcaatgaataaaaattcagaaaaaagtcattgccaaaaaatgggggaaactaaaataaaaattaaccaaaatgatgaagaaaatgtagcgaacaaactcgcctcccatcgcggggttcgtcaactcgacgattcgtcaactcattccaaaaattacttcaaaaagcattttccattgcttttcatggcgatgaacaatttttaacactcatttagagcgattcgaatccctaacctcgaagtcgcataaaaccacgatcgcgtaacacaattactttttttaatatttaatatctgttgctgccttatgaaaaattgaaaaagttccaaatgcgttagaatatttattaaaaaagaaattttataattactttaaaacaaatgcattggaaggaaattaatgaagtttatgcaaaatttaattgttacaaaattctcccaataattaacaaactaatattaaataataaatcaaattatataatgatcagtcatatggataaatttgcaaagtcctagaaggcatctcaaattctgttattggttccctaggaagatcacctcttaactgcttcagaataatatgcaacata

SEQ ID NO: 23973 - DNA, 1138 bp, Heterodera glycines
acgacggggtgagcgcctctttttctgttggcttaaataaacaaaaattcgaaattttggggaaaatgaattttaaaatcatctgtcgggaatttggggggggcagtggcgagacagccgggcaaaagccgggaaaagccgacgaaaattggaggaaccaaccgctggacaaattattatcatttttttgttgttttgtaaataataaataataaaattattaaatgaaccaacaaatgtgaatggtttttctactctgaatagaagcttcgagaaattttttttctttgaatggaaatttatttaaatattttaaatttaggctatttaaatgatttatttattttataaaaaattataaaagaccaagaattttttagtagggtaaaaaattttcgaaaaaattttaattgaaattttaattggatttatttgctttattattgaatttttaaaaatccgacaagaaatcaaattagttaagaaattcaatgtttgtgcaagaaatttcgaaaatggcgtaaaccctcttataaatcaaaaattaaaaaaaaaattgtttgtaaatttttgaatttttttgttagtttctacaaaaaatggggtggcctaatgggtaaaagattttctccctaaatgataaatttcataccaattcaaaactgataagaaaataataatcaccataaaaatatggttattgtttgacgaacaattaaatgattttctatgactcatcgctttttttgcgcaaaaatttcgcgcaaattcccatgaaaaaacaacaaaaaacaaagaagaaaacatttgttcattttttgccttaaaacgctccaaaattagcacacacaaacattcgccattcgccccgggggcaattcgaaaggaatttttgggtggcaaaaaggtgagacgttttgtggcgggggaggggggaagaaaatgtgggggggggggtgaaaaagcatttttgtcgtcgtcaagagtggtcgagaatgtgtttggtttggcgcccggcgccccgggcacaaaaaggggccgggccgaggcgacacatcgccattatataacaccagcggcgacggtggcttcggcaggcggctcccgcccccgccccccgggggaacggccccttcca

SEQ ID NO: 23974 - DNA, 1763 bp, Heterodera glycines
aacgtttagaaggattgtatagcctgaacttggctgcgaccaaagcggccgggccgatttggcacacttcattccatcccccccccattccgttcattttttccttctctttcccaaacttttgaccaacatatcacttaaacgttggtgcacatttttttgatcaaaaatgagataagcagaaaaaattgtgtgtgattttaaattgaatgctgaagaaaaagtggctaagatccaccaaaaatggcgtttattaggcagagattaaatgcttattttctaaataaaataaaaatttcaaatttttcacaaattacgcaggctttctcaagagttgatttaatattcaatcaggaaaagcaaacttagaaatgtggataattgactccatcactctcataaatgccctggatttcgatattgtgaatattttcgtgaatgtaattttaaactttttaggcttttttgtgataaattttccaaaaattgcgaaaattttcgtaaaaacaaaaaccaaatcttacaaattaattatctccaattttaattttaattatcattaaaaaatgtcagtttgcctctggctctggcagcgtctaacggcatcatcggatcttatctcgtgaattttcatttttcacatattttgcctaaaagtccctttaaattatgacttactagttaaaatatgttaaaaaattaaaaaataataattttttccggctacacctatcggcaccactgctccccaattttcttaaattacaaaattaaacctataaattagggctgggactctgatttttggctgggaaaatcggggtggtagttgttcaaatctgttggagttataagttctcaatttttgccttatgtaaacaactagtctgaatgaatttttcaaataaaaattatagatcttatttgtcttgtaagaaagccaatatgaaattaaaattgccaaaatgaatttgaacaatgaaaatgttgcattaccttcatcaaaagcattgtttttccatttggttttaacgcaaatcttttcgccaaataaaacttacgaccagtcaaataaattgtatcggtcaatcggtaggcaattagcactgatcaccagtggttcgaattggctgttcatctctcctctgctctctctgatcattcttcgttttcctcgttttgctttggcacttctcatggcaccgacccgaaatccttgggccgagggcacacagtcaggctgcaattttttttcacacagatgcccaagtcgatgcgacagttcagcacgcacccattgtcgttggactaattggtgtagcattcttggaaacaacttttgaatagcttgtagcagtccgtgcaacacttcttttgctcctccctttaaaaatgcaattataatgaaaattaacaaattttatgttaaaaatattcaaaaatttgcactaaaacgggctaattttggctttttgtttacattggcactttttttattccggtcccgctaaaatgggcattaaaaattcttatctttattcagaaagagccaaatttcaaaatttcgtccttggttgtaagccctctaaatatgttctaaaaagtttaaagaaggggtggcaaaaatgctcaaaattatttttttcttttatattaaaaaagattattttttgaaatttataggccaatagaaagactaatgatatcgaagccataccaattgaatttaattttgggttgttttggttaaagttatatctctt

SEQ ID NO: 23975 - DNA, 1611 bp, Heterodera glycines
ccgtctgccctgggttggtcgaaaatacacttaaaaggaatgttaatgaccctccgtcggccctgcgttggtcaaaatgcacttaaaaggaatgttaatgaccctccgtagactttggctactcaataggctttgggtctcagaactgaaatatcccgtgggcactgggagtgaaatggctaaacttaaaaaataactctggggctcaaatggcggcactgtaaaaataactctggggctcaaatggctgcgctgtaaaaataaatctggggctcaaatggcatacgcgagcgtttaaatggcccacacgcgggcgctcaggtggcatgcgtcccttcccttccctataaggcatgacagctgacgcccatcctctgcctccctttccttctctaatacgatttggccttgagttttatccttcagatgttttttcaattatttacctcttctgggattggatatatttattataggtgttttttaaaggtttaaatttggtactgaaacgtccctttccattgggactgaaatggcggggctgaaaattaacgacgaaaatctacatgggtaactacttttttagaaaggatttgtcagtgaataattattttatccttatttttttcattaatatcaaataactgtttgatattttcatgaaattttgtgcgaaaattgttaaaaattttgcaaaataaaaagaatttgacatgccatttttgcgattttctattgctaaatctctctcaaagcattccaatggaaaaaattggcatcgaaagactttatcttctttttcctattataaatgaattgtttttgagatttaaaaaaatataatgtctgatcaaatctgccaatatttgaacatttcaatatctaatactgtacaaaaaaatttggcaacacaattcgtcttttggatcaaaatttgtcatttttcgaatgaatttttagtccaatgcatcatcagtttattgtagcaattagagaccggcgcgggacgggatcccgcgcgggattttgcgggataccagtccgcaatcccgcatgcgggattaatcccgcgggatcccgttccgcaaagaattttgagtccatcattttaatgcatcccgccagcccctaaaaatttatttttcaaaacttcaggtattttttgatttttggatttgaaatttaattaaatttttttcgaattttccaaaatttatgaaccaaagttctgtttattaatttttaatgatattttgacactacaaaagacaaaattcgcattcgcataatttctcttttcatttaaatttcgaaaaatgctactgtttgtttaactggtgtgttaaatgttaaggtttgaagctggcaatttttatgaaccaaatgttttaaaattttatgaaatatggcgcaaagcagacaaaaaattcaaacaatctaacaatttgaatgctaaataaatatttggtcaaactctttaaatcaaattttccatataaaaaggtcttttcagaaaaaaacataaattattcaacatctcttaatagtgcagtttatctaatattaattaaattaattatggctttgcttgggcctgtttagaataataat

SEQ ID NO: 23976 - DNA, 1780 bp, Heterodera glycines
ggggacctctagagtctcaaaattttcgagctaggcctaaaaaacgtttttttggtttttgcattttaagaatttttaacgaattttcccagaaaaacgaagaccacttccaaaacatagtttttcgagctctatcgactggtatttttttcggaaaaatttcgattttttcccggaaatagaaaaaatttttggcctgagcgggacatttgagtcccgggcccataactcgtcaggagttggttttagcgaaaaattgtcttagaacatttttgtagagaattttaaatgctatcgaatggtgtactacatgatataaaattttcaaaaattttcgagctaggccccctagaaattttcgaaatttttttttgggttgaaaaagtgggtgaaaaattattttgtggggtattttgaggtgctgagcacgaatatgatgcttattttttgtttcggaaattttagaattttttaaaaattcgaaaatattttgcaattttttggccctcagaaatttggtcgaatattcgaaaattcatatctagcctaagggttgaccaattttacaggaataaagccttaaaaatagagaaaaatcaggagaattttatgggtttaatttggattttctagcataaatattaaaaaagttattccagaaattctggaaaaattcgaatttccagaaaaaaattcagaactcggttctgaaaagctatttgagaaaagtaaaatactacaaaaatccgcaatttttttctctataatataaattttattttacatttttatcacatttttaaaaaaagatataaaaataaaagtgattttgtgcttcgggtccaaaggggggtgaccaggatttttgagttgaaaaattttttcaccaaaaattttccaaaaacatgtctttaggggttatttgggccgctgatcacgaatacgtgatcagattttacttttgacatcgttaagacctcagaatccctgtgtgattggggattctgagacatcatttgaggggggggggggcaagttcgaatccggacggtgtaacattatttttctgtgcatttttacgttatttacaatgattttaattaatctgaagatttgttgtagattattttaaaaaattttttacattaaagaatttaattatttattttttgaattttctaatctcttttgcacctcttctaatcacttttgtacctcttttatcacttttgtacctcttctaatcacttttgtacctcttctaatcaccattgtacctcttctaatcacttttgtacctcttctaatcacttttgtacctcttttaatcacttttgtacctctttaaatcactgttgtacctctttaaatcacatttgtatctcttcatcaaatttgtacctcttttaatctctgttgtacctcttctaatcactgttacacctcttctaatcacttttgtacctcttctaatcacttttgtaccttttcaccaaaaatcttccaaaaacatgtctttaggggttatttgggccgctgatcatgaatacgtaatcagtttttacttttgacatcgttaagacctcagaatccctgtgtgattggggattctgggacatgttctgagggggggggggcaggttcgaatccggacggtgtaacattatttttctgtgcatttttacgttatttacaatgattttaattaatctgaagatttgttgtagattattttaaaaaattttttacattaaagaatttaattatttattttttgaat

SEQ ID NO: 23977 - DNA, 2252 bp, Heterodera glycines
  misc_feature (2229)..(2229): n is a, c, g, or t
tataattaaggcatattacaaaaatctttttaataaatgtttttataaaaattattaatttttaaacttaatgataaattacttttttgaatttaactgtttatagaattttttttaatcatttaatccataattttttgtcttagaaataaaacattgcgggtattagccattttatttatcataattttttatttttatcctaaaaattagagtgccacgggaccgggccgggaattcccggtcatccgaggtcccggtcccggtcccgggttttgaaaagctcaggtcccggtccccggtcccgggttttgaaaagctcaggtcccggtcccggtcccgggttttgaaaagctcaggtcccggtcccggtcccggtagggcaaccgggaaccgggaaaaacaagcactggtaagaatggggtctgagtgaaaaattagtgaagaaaattggagtcaaagggaaaaataaaaaataataattaatatattcaaataaaaaattagtaatgaaaaaagccaaaaaaaaattttaattatcagtagtaaagtgattttttagtgatttaactcttttttaaattaaattgaatgaacgaaatgtggaatgaaataaaaggaaattttaatacaaaatttcaattgttattaaatcaaaaatgtaatattatgtaccttgcctgtttagataagacaattaaaaagatgagcattttgaactattttaatgtgcagagtaaattcatttaaattatatacattcgttttaaataaatggatttgattaaatttaaaaatataaaaatttaaaaaaatttcaaaaccaggacaaatagtctcccaggtagtgtttgtatattaaaatagaacataaacaaagatggacaaaatgaaaatgattgattaataaaattttaaaaaagtttattaatacctgaagaatttaattttaataacaaaaatattataaataatcccaaacaaaaataacaatgatagtaatgtcaaaaacaaaaagtgacaaacgataacaacatggtaaatctggacctcaacataaaaatattgcaattaaattaaatgataagcaaataaaaattcaaatttataaaaagtagatttagcaattgaataacattacggcctaatatgcacaaaaaacgagttttcaacttggtttgaagcttctagcttgaactttttggtgctttttttttgccttttttgcaattttgatgccttatgttttattcgtttaagtaaattaaaaattctagcattttttattgtgttttgttcatatcttgttaaataatgtttattgatttttaataataatctttttatctatcatcattcattatttattaatgttcttatgccatttttacaattttagctttttttacaatatatttttattcaaactttgtcactaaaatatatgcgaataaataggaatttgaaataattaacattaaataatttatcaaaaaatttacaacaatttacaaaaactaaaatcaaattatttattctttattttaaaattcatttaatattattatatttcatttaaatttaataaatgaaatttttaagattactaattattattattatggtaaaatataataaaagaatttattatttaaataaactttttaataatccacaattattagtttttatttaatatttcctttaattttttaaatttatatatattaatattaatcatgaaattgcaacatgaactatttttttttaatttcatgtgctcgttcatagtttttgcattcttcaagatgccacattataatataattttttttctctaattactaataattaatttaaaattaataattattaacaataataggaaaatataaatttttagaataaattcagaaaatttatttatattttctttttctaaaatataatataattttaatttataatatgattataggggcgtattttataacccctgacatatttttggtagattttgtgaaaaaaaatttccactcaaaaatcctggtcacacctctttggtcccgaatccaaaagtcatttttatttttttacaattctcaaaaagtgataaaaatataaaataaaataattatgatagagcaaaaaattgcggatttttgtagtattttagtatttttattattttaagcgatataatttaaactttcttttatatgtcgcganttaattgctgaatagttaatatt

SEQ ID NO: 23978 - DNA, 1604 bp, Heterodera glycines
aataattattttttatttggtctatttcaaaacattagatacatccgtgggggggtggccggtaacgacctgccgttgcgtggcattcgatcaccactccgtcttggcggaaggttcaaaggtgggaccacttggggtccgatcaatgctagtggtggcgactgcaacggcagagaaccaaatggtccttgaaattgcatgattgggctgaaatatgataactagttctccttagttattcgaaaaatagattattatcaccgcgaatctgttgcagcgtccaatcgcgaatgttggttccaaacgaatctgatcgttttcttgatcggatgtcaataaaacttctctcccttcatattggtcaggcaagccacattcgatgactttcgtggcccgtggttccaacaccgttttgtagatcacggtgagcgaatcgattttattttggttcactttttcaaaatcaattacagtgtcgctgatggcatcgtacatcttaaagcccaattcattaagcgcattcgtgccaaaaagaaggtcaaatccaatcgacggtttggcgatatgcatcgcgactttgacctcgctcgaattctcatgccgttttatcggcagacaaataactcctaaacattccaaaggattgccattcgcatcggaaatgcgattttccgctttcaaaacactcaaattccgaacgtccaattttttgtcccttatcaaattgtagaggaactttgcctcaattacagaaatttgtgcgcctccgtcgagcattgtcttcgtcttcgttccaaaaacttcaaccaaaactgccattacttttccgacttttgaaaaattcgaatttttgtcttccgtcgcgcatttccttatttcgtcaaaaaaatcttccaggtcctgcttcaattcaccaacaatgaaattgttttgatgaacttgttcctcttgcagaactaagcaattttgcttcaaataattcttttgctggtagtgccgatttggtgggttttcgttgggctcaggcatttgctgccgattataacccatttgttgtttgccttgttgattaattgtcgtagaagagttagttcgctcaattgcgcgaaaaatttttccttggggacaatctctggccaaatgtcctgggctgttacagttgaagcaactccaacttcggtttgattgggttccaaatttttgcatttgctggccccgttcctcaaaattgcttcttgagggcccattattcgtctgggaaaaatgttgcggtgtgttcgttctccaagtcctttctctgttgtccggcctcgaaaatcgttgtgttgccttttgcgtagattcagcacgcgcggcaagtgacacgaagtggtccagggtcatgcctggcgttctcacaagctcgaggtataacgcgagctcaggattgcccatcgctctaaccagaaacttaatggcgtattcgttgctcaaatgctgtggcaaaccgttgtaagctctctgtaccaagcctgaaatacggttcgccaactcgtcaatgctttcgtttggtccccgtctcacgccttgcatcagatcatcaaacgcatttcaaatgcgtgcgt

SEQ ID NO: 23979 - DNA, 2096 bp, Heterodera glycines
tttgttcgagattgagaaaatttgtttctctgtggttcgtctaattcgacccacttcgttcccttcctctactaaatccttgctgctgttgagagcttgatcgttctttatatctaacctgacggttattcacgttattaggataggaaggtacccatgaattaatatttgatgaacgatcaccattatttgtccaagaagcattcgcaggtgcctgatttaaagcatggaccgcgaatttgagaggatcagaaatattggattcattagtattggttaaaagaagctctaattcctgagcttgagagaaaactgcctcaaagtcttggtttttagtgacaccagtaagcctaatcagaaatgttaaattaggtttaaccctttccaaaaattcatctttaagtcgggattgaatttgagtttcatcctgacccgcacagacagaagagacaagtggtgaaagtctagaaagaaattcccgaactgtttcggaatcgcgttgtttacacgtgactaatgcacgttttgacatttccttacgctcgggagagtccaatttttccctaatggcatccaaagctttgtccaccgtatcctttttattgttcggtaatttgtcaaaaattttccgaattgacccttcgagcgaaaatttaagtctacccaatttttctttttcagtccaagttgttccagcatattctatgaggtcccggaatttttgggcccaattatcaaaagcggttaggttctcatccctgcaagccggaagctgactagcaaatgggtctatagtagtgagaacattaagaatttcttcgtcctcttcgggttcgaagacagttcgccttaccatggtgcaattcccttgtagtgatgtcctgttatcattggtgtctgaccattcaagtgtatccactttatcaaccaattgatctaacctagtcgtaattgtgtccatgtttgcattcatatcagctgttgtttggttaatggcatcagtattttgagtcgccctcctattaattacccttaaactgcggttggtagcatcctcaagacgtattacaccttggtgaaccttatcaataagtgagattggggcattagaatttggaggagcgcttatattttggaataaatttctttcaacaattgcaatagttacttggtcttccattctatccagagaatagttcacaaatgacataatttcagtgtattagacttctactatttggcttagattaattagatgaatgagttaaatgagcactcaaaaaaaaaacaaaccaaaaacttttcttatagtcttacgactaatcagtgggaatgagatagatttgcgcagtggtgagtaatacgggaaaggaagcgtgcaatttaggctgcgcggatacttatgtatgaaagttttttggctgtgtgcagtagaagtagtagctgggaaattgttttgcgattagaaagcgcttggaaatgaaaatgatttgtggctggagagacggaatgctttatgcgggttgtaataaattttttacgccccattttcccatcgcgataatatcggccgcggcttagaaatcatcaacattaagtgactgtaatgagcaaagttcatatggaaatgctgctataataatacagtaactttggatacttaattcggaattgaaaatgagtatgtgaataaacgatatttgaagtgaattgaaaaaaaaaaaattagagatcgaatttcagcgaaaaatcgaagagggaaaaaaaaattatgaatttgacttactgcaagggcaatgccattggcatgtgggacacactccgaatgcggggcatgcgttcatgttcgattcggccatttcggcgatgttcagtgcctaaataataactatttcaaattggtcaaacataaaaccgtcgccaaatgcacacaaaaaaatgtgtataattaacgaaaacttgagaagaatggttttttcttaaccacttgttaatttgtaacatgcgtggtacatagcgttagacactttaattgttgaccctatttctgagaatatagtgtgaaaaagtcgaagaatcagtaatatcagcccaaa

SEQ ID NO: 23980 - DNA, 1216 bp, Heterodera glycines
aaaaaaaaaaaatcgatttttttcaaggggccgttgggggtcctccgacaattatggggagcaaacatcccccgcaaaattaaattacaggctatagggaagctattcccgaaggattcggtctcccccataaatctgggcgcatcggttcggggggactcccccgaaaacaaaaaaaatcgattttttcaagggtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatctattttttcaagtgtccgtttggggtactcaaacatttatggggagcaaaaatccaacgcaaaattaaagtacaggctatagggaagctattccggaaggattcggtctccccataaatctgggcgcatcggttcggggggactgccccgaaaacaaaaaaatcgattttttcaagggtccgtttggggtactcaaacaattatggggagcaaaaatccaacgcagaattaaagtacaggctatagggaagctattcccgaaggattcggtctccccataaatctgggcgcatcggttcggggggactgccccgaaaaaaaaaaatcgattttttcaagggtccgtttggggtactcaaacaattatggggagcaaaaa

SEQ ID NO: 23981 - DNA, 1314 bp, Heterodera glycines
  misc_feature (20)..(20): n is a, c, g, or t
aactttattccactaaattntgaccaaaaacgaagagagttatgaattttcaaaatttcactggattttccggggctcaaattttgacgatttttcaaaaaattttaaacacttaccaaaaagtctgaaactaaaaataaagtatattttcgagttcagcaccttaaattaggccataaaaatgcattttggctaatttaggagcaaaaaaatttttcatgaaatgcaaaaccatggggtcccccctttggttttgagtttcaaaatcacaattaattttataactttttttaaactcgtgataaaaacatgagataaagcacattagattgggcttaaaattctctacaaaaaagctcttagacgattttttgataaaatcaactcctgacgagttattgagccagaactgaaattgaggcctagcaaccaaaattttctatttccaaaaaaattttaaaaaatttttctgaaaatgacaccaatcgatagagcatcaaaaacggttgcttgaaagtggtctccgttttccccggaaaaatctgtaaaaaatactaaaattcaaaaacctcaaaagtgatgagggggcctagctcgaaaatttctgaaaatttcagaaatttaaaaaattgacaagatagagctcgccgagctgtacaaaaagttcagcggcgccaacacgctcagcgcaacacccagcgagttattttggaaaaaccgaaaaatggaaaaattggaaaaaaatttttgcgaatttttgcaggccagggctttgatcctagggcctcgcccaagaagaaaaaaatttcccaaacattccaacttagggccctctcagcagacgtttttggctccggcttccctgaaaaaagttttggcccaaaaactgcatgcatttttccccaaaaagccatttcagcgccgctggcgctcagttggcctccggaacggaatgcctatagttttcctggatgcgcctcaaaaagttgcttaagcaatgccacactcgcgagcccctcccgccagcggttcccgagattttagttttagcaatgaaactcactgttgttctaaagtatataaactagcgtgtgggaattgacgggggcggcgtaggccgttaggttttggatgaagagaaaatggacatgctcatttgttattttaaacagacaaacattaattgcattagtgtgaagttttaaagcgctatcgcgctatgggacgcggcttcgccgcgtcgctagaaagtgatgtaatttagcaattcatcgcagcctcaggacgggcgctcgcgcccgtttttaatttttt

SEQ ID NO: 23982 - DNA, 1569 bp, Heterodera glycines
  misc_feature (22)..(23): n is a, c, g, or t
  misc_feature (71)..(72): n is a, c, g, or t
  misc_feature (89)..(90): n is a, c, g, or t
  misc_feature (115)..(115): n is a, c, g, or t
  misc_feature (142)..(142): n is a, c, g, or t
  misc_feature (1083)..(1083): n is a, c, g, or t
  misc_feature (1219)..(1219): n is a, c, g, or t
attttttagcgcaaatcacacnnaaaagcgaaatttcgcttttttgcttattttgacataatttattattnntaagaaaattaatttannttcaatattctcgagaaattttgcngaaaaaatgatttttgaaaatttttcngggttttgggctcaaaaaggctaatttagctgctgggggccgttctaatagaggtttttttgaaaaatgccaaaatatggacataaaatatggaccaaaatgccaaaatatggaaaaatatggaaatatggacataaatcgcgaaatatggaaaaatatggatatagaaatccttcctagaagcttcaaaccaagctaaaaacatgtttttcgtgcgtttcaggcctcccacagtccaggaaaaaaatatggatttccatgtaattctattccctagtcatgagagaccccatgtaaagaaagaaagacagacagacagaaaaagccaaaaggggtggactccagtcagggatggcacggtccgatttacaacatttttcggtcggaattacgatttagaattttcaaaaaaatttgggccctcggaatatgaacaaaatttagtaataaaatccaaaaaattcatatttgaatttattttaagccagatttttgttagatgaagtaaacaatttgctaggatttgttagacgtcagaaaatgcttaaaatatcacccaataaagaatgtttaaaatctgtttgcttttgcaagactaataatctcatagcaatggggccgaaagttcgtcatcattttttttcacattctcatcccattcgacagtatagccagacaaatgcgggcatatgggactagtgaattcataattgtgagacatgaatgcattgattttcttcctcaaaattgccacagtgtcctctcttttcacccaaatattgtatgtgtccttattcatttctgccaatttgttatctttttaactgtttgctccgataaataatccacatggatttcaaattcatccaatgccaagaaaattattgttttttttcaaagtagttagtccacggtacccgtcgccgtcgaggtgtgaaatntcacaccctcgacccggggccgggttttcacacctcgacggtccccggttttttgccttttttaccgcaaaaacccaagggtattggctgttttttcgcgcattttctgggggaggggaggggggggggtcatctncgacgtccctggttttcacaccttaaacggtccccgcttttttaccgcaaaaacccaagggtattggctgtttgtttttcgcgcatttttttgttatactgtaaatttttatttttatttaaaataaatttttttattcttcattgcttttcttctcatccttttccctttgcactcgagccgatgggcggccaagggaagagaagaaagggacagagtgttctcgttgtctctgcctttctctcttcccttctccgcacttcctctccaagttgtgtactatctctccacccccgaatattaatatgcatatcgtttccaacggaatcgcaaaatgtggacgaaaggag

SEQ ID NO: 23983 - DNA, 951 bp, Heterodera glycines
ttattaatcaaaaacaacgttggaaattattaattgaatattcatttaatttaaaattaaattaatttttttacaaattcaaaaaataaataatgaaattctttaattaaaaaaataaataaatttaaataatttataaaaaatatttagaattaataaaacatgtaaaagtaatcaaaaaatgcacagaaaaataatgtacaccgatcggattcgaacttcccccccccaaaaaatgatgcctcagaatccccaatcacacagggattctgagggcttaacgatgtcaaaagtaaaatctgatcacgtattcgtgatcagcggcccaaataacccctaatgacatgtttttggatgattttgggtgaaaaaatttttccactcaaaaatactggtcacccccctttggtcccgaatgcaaaaatcacttttatttttataataattcttaaaaaagtgataaaaatatgaattaaaatttatttaatagagcaaaaaattgcggatttttgtagtattttacttttccctaatgacttttcagaaccgaggtataaatttttttctgaaaaatcgaaaatttgcagaaattctggaataactttttttgtttttgtggtataaatttcaaataaatctcataaaattctcccgattttttgctatttttaaagcattaattcacttaaattgaccagtcctccattgagttatgaattttcaaatttaacccaaatttccaaggaccaaaaaaattaataatatttttgaatttttaaaaaattccaaaaaatctgaaacgaaaaacaaacatcatatttgtgctcaggaccccaaataccccagaaatatatttttcaccctcttttttcacccaaaaaaaaaatcccgaaaattctagggggcctagctcgaaaatttttgaaattttcaaacatgtagtacaccatt

SEQ ID NO: 23984 - DNA, 2097 bp, Heterodera glycines
cgaaatagttaactaaaatagtgaataaaaatgccaaaatagtgacaaaaagtccgaaatagtgacgaatattttcagccaaaaattaagcaaaaataatttttattcactgattgcattgcaaatgagtagggctgggatttttaagggcaaaaaaacaaaataggtacataaaaaaataatttttaaaattaaaattcttgccacgaaaatacctttttgagaaatttttttttcatttcataggagtatattttgaaaaattttagctcgattcttaggggtgtattttttgaaaaaatttttaggtcgattcttaggggtgtattttttgaaaaaatttttaggtcgattcttaggggtgcattttttggttttattgcatttttgttaaagaattttccaaaaaatgtcgaaatagtgaaaaaatagtgacaaaactccaaaatagtgaattttcactattttagtgacaaaatcccaaaatagtgatttctagtgaccgataatgacatcagaatcgaaaatttttaacgcagaaatgcgttttttgagctcctttcttcaaaacaattaggcaaaaaaagtttttcactaaaagttgcggccctaattattataaaaataattaattttcttaaggcgtcgctggagaaaataatatgatttttggtccaaaaattttttttcggacattttttgtgccaaattttcaaaaagtcaaaacaaattattaaaatgttcagcagaatgcgtgccattggtggtgtcctcccccgtcgtgccgtcgacgaattccgtcggttgggcccaacaatttgcggacggcacactgaaccggcggttggcacaaattatggtggccaaacggaccaacgtttgcctggcggtcgactgcacacactgtgaccaaattttggaggcaaaaaaaaaactattttaatggcattaaaaataatggaaaatggcaaaaaaaaaaaaataataattttggtaagtcacgaccataaatccagttttaattttcaatctatttttttggtgaaaaatatacaaaaaaattaagtgttttttaaatcgacgttcaaaaacaagcacctttaaaacagacaaatgaatatccaaatttgaggcaggtatatctaaaaaaatttgaaaaattctcgccaatctccccgattcattgcaaattattattattattttttacaaataataatacactgatatgtcatgcatggttcatttttcagattgtttccgccgtcaaagaccatgtctgtgccgtgaaattgcaccacgacattgtggtggactttggcgctgaatttgtggccaaattgcacaaaatggccgatgagcaccaatttctgattgtggaggatcggttggtaaaacatctaaacaaatattaccgggaaaaccatgacaaattcttaccaagaaaaaaaaagtaccattttcccccgaaaaccctggcaaaatattatccccgataatttttttttatagaaaatttgcggacaccggcaaaacgatggaaatgcaattggccggcggtcggttgccggcggtggcggattgggccgacctcgtcaccgcgcacgccctgcccggcatggcgtccattttggcactgaaaccggtacattaaattgctgtaaaaaataaaattcttgccaattttgcgatgtctctcacccaaattttttcattggcaaaatttgtgcccatcgggaaaatttttagattttttttttgaaaaattccgaaaaaatagccgattgccccgaaattgccaatgggtgtcgacagattgtcgcctgtccgtcccgccgtctgtccggccttttgctgattgcccaactcagcaccgacggggcgctgacggacggcgcttacgcggccaaatgtgcgcggattgggcgcgaatgtggggactaaattggtggccggattcatctgtcagcagcggtgcagcggagagagcaacgacgcaacagaacagcaacaatttttgcattggacacccggtgagacgaggggggaggggtggaaattttgaaaaacaaatttgactagggataattttgaaaa

SEQ ID NO: 23985 - DNA, 1642 bp, Heterodera glycines
ctaaaaacccaaaaattaatcaattggtctttttttaccaatttctgttaacaaatcgcattaaaaaatacaaaatttttcccggcggcgcctatcggcaccgccggccctccttgttccccaaaagtcttgagaaaaacgtgccgcgaaaaaagcggtgttgaaagcaaaaaaacttggtcaccctcgatatacatatacttctgaacaattctaatgctaaaaaacaggcacttgcgcgaaaactgaataaaaattttgtatttgaaaaattttgtccaaaaatttttacgttggaaaattaccggtttttaccggtccggtaccggtggaaaaagttggtaccggtaccggtaccggtttttgcattaccggtcagtaccggtaccggtttttgcattaccggtcagtaccggtaccggtttttttgcaattaccgattaccgctcaactctactttaaattaaagtttttccataaaagtttttattcgttacctattgtaagcagggatgggcgtaattacggattcggtttatggattatgggttgcggatttttgcgatttcatgtaacttttaacattaaagaaaaatttagaaaatgcagcattttgttttaagtgctaaaaagttgcattaaatcgaatttttttatctttttaatctgcagattcatttcttcatatacagcaaaaaaattttatcataaagtgacaaaatttgaggctttttgaatttcgttttctaaattaaccaccggtcctgtaaatatttttttttcaaaaaataaataagacgggccctgctggggcagacagtttgtcgtaaaaataccaatttattattttggatacgaataaactaatgttatgtgaattgttaaaaattcttgaaacttttgtcaaaatttcaccatctttcttttttcggctttgattagaaaactcgacggcataataaaaatttgaaactcagacttatgaacagattttcacacatggcacacgatacctgggagacttgaaattttgggacccgatattagggaccaaatgttgtactgatcagaagaaataatacaaaattttattgaataaaaagtatattattattgtcaatagaaaaatttaaatttaaaagaaatttaatattttgaatcgataagcaatatgataacttaaaatacttaaagaatttaaatttcgaagcaataataaaaagaaggaagaaagatgttatacaagggaagaatgctattaatttacataaagaaacgaaaagaaataatttaataaaataaatattgtttaaaaatactaaaaataaataaatattaaaaatcttaattatgcacaaataaaaaataattttattatattcattatgcaaaaaaaatataattaaaaaaaaccttcaactttgatgagaaaatgctaaagaacagagaccatgaaattataccgaaaaatgaattataatttaaaagttcaatttctttaattttttataaatcagcaatatggattaaacaattttgtctttttatctattaagagaaagttatttaaaaggtatcgagttatgcgccctccccaaagaaattgtgttccccgcatgttggatttgccgagaaaatcagt

SEQ ID NO: 23986 - DNA, 1043 bp, Heterodera glycines
  misc_feature (10)..(10): n is a, c, g, or t
aaaaaacctnttccgcaaaaaccttttggttcacttaattgttcacatcctgttgagcaactgcccgtacacagatccacatcccaagaacattcttgcaatgtgccgattgggagcaataaaagcagcaaagccaacagaagaaattgtttggacatttttagtaaaatattttttttgatcgaccaacagcgattggaattaaatggaatggaaaagtgtttgatggaaaattaaaaatttttggaaaaaaatgaaaatttaaaaatttaattttgttatttcggactttgttatacctgaaaaaattaaaaaattttctcaaagttttgatcggaaaaatgccaaatttggtttggaaaattaaaagaaataaagttttgcttttttaggatttcggatgaaatgctccctcccaaaatataggatttaaggctccgtatttaaaatttcattcaattccccaatagttagaaaggcctaggttttttaataaaagaaattaaaaataataattatttatttatttctttttctccgcttaaatacaagacgaattttcatatttttaattgaaaaatgatgaataagcaattttatttttaatttaaattgaacaatgaaggaaacgaaaatttctataggcatttgcattttccagtcaaaaattttaattaaaaattaacgaataacaaaaatggtttttacttaaataaataaataaaaaagtgcaaaatgggcaaagaaggaaaagtgaaaaaataataattttcagcaaaagaaaaaattcatttttaattaaattttattagatattttatttttaaaattataccaataaaaaacaaaaattttcttttaaaatatttaatttaatagtgattaccataattaaaaataataattttcagcaaaagaaaaaattcatttttaattaaattttattagatattttatttttaaaattataccaataaaaaacaaaaattttcttttaaaatatttaatttaatagtgattaccataattaatttaaacaataa

SEQ ID NO: 23987 - DNA, 1267 bp, Heterodera glycines
ctcaccaacatagtttgacataaatccattacctttcccactttgcaacttaattggcttacccatccttaatcggtctcattttgtttttcgctaatgatcaatgatcattttatcactgtctgaccaatcacttaactgatcactcacattttgacattttgttgcatccttcaatttccatttgccaaatgccacaacactcaatcatcaaatcattaccagtgccatccctccccacacccaaaaaaatgccacaaacaataaagcatcgcctgcgtcgtgcactgctcggcccatgttttgccgtcgttctcccaccaccaccaccaccaccaccgaatgctgttggtgccaaatttgtgccacctcctgtgccgctgatgtgcacttgcgacaccgttgtcgcaattgcgttggccccctcccggctgtcgtcgcgcatgttggccggcaaagatacaccggcgttgccacgccgtgcactcagcacgctggtccgtgccactgtctacgactacgagctgggcaaacgccgcaaactgtccgcctcaatgcgaaccgagtaaacaatgatggcggcacaatgccttttatacccataagggggggggggcttttcctttttttgacggcttttcctcatcacccttcagtgtcccctccactagagccttcatttgcaattgtggatttgcattatgggatctgattagactttttgatcattatttagggacatttgatcggaatagctgtttttcgtaacctaaaatttccaaatttcaaaaaaaccttcagttcattagctggcagaagactttgatcactctataattatgtattaattggtcattggtattcgagtaatttttatttgaactttactgagaagaccatttctgatcagtactgaacagatcaacgctgtccctatttgttctgatcaaagatgattaattagtaaggaattgaagcaaattaattacccctctggcccaatgcaagcacactttttatgggctacaaattttggcataatatgcctggtccttcctcctcccatgtccatagtcttggccgtcgttgttcccccgccggcgctatcgtcggcggccccggctgtgtccattcggcacaaaatcgtcacgccatggccatgtgccatcggcttggcccatcaatgctcggcatcggcatgggcaccatgatccttgaacggcaaatagaggttttcctctatcccgtacccttacaattggcataa

SEQ ID NO: 23988 - DNA, 1792 bp, Heterodera glycines
cctttgtttgtgtgtgtgtgtgtgtgtgtgttgtttgtcgtctggctggctggctggtggtggctgtactggaaaattattcccacccaattttcgccctaatcgaatcacgccgacgccacgccagtagcacagtccgccgttttgcactcacttaaaaatttccatccattcccatttttctaaaaatgaaatatgtacataaaaatcaattttaaatggtttgtcatgcattttgacattattttttgtgggatttttgaatcgaaaatattgtcatatggtttataaaaaaaaattttcagcaattttttttaaaattggattaaattttggccaaaatttactaaatttttaagggttttttttttgttttaattttgaaaaagtgagaggaaattagtcgggaaattaggtgaccaaaaataaaaacattgacaaaattgattaaatttgtaccttatgttttttgaaccaaaaaatcaaactttgttgaaccaaaattatataaaaatatataaatttttaataataatttgttcggaagaaatcattctgcgaaattttcttactcgcaacatttaattcactatcataaaatttcatttccctttatcaaatttctaattgaattcttgaccttttctccctctctccgctctcatttcccgttttaattaatgcactaaaattaactggccaagaaattgataagcgtacagataataaaataaattaatgatcgtcgtcgggttcatttttctcattttttgctttttttttgtattgaaatgttcacacaaaattgcgatttcataagtgaacgttttttatatgtgctgtgctgttgtgcactctgatcagagtgccggctgcgttacacaaaaaaagtgatcaattaaattaattgactaatttaattttcctatcgccgaaattcttcgcttacatttttaaaataaatattcaatttaaatacatatttttattttaaatttactttttttcgtatgtcgtcattattcattttcactgaattttggtgtaggaatttggacgtagcgatcagtcatcaatcacatcatttatcataattccttttaccgcactaataaccccataaaacacttcgattttgtgtgagaaaagtgcaaaatttggcatattttttccctaattcgtaattatgaacaaaaatttgaaccggaacagaatcagtacttatcaaggacagtgcccaggactctggaataaaattcattctttcgttatcccgaatcgaataggcttacaaattttcgctaattttaatttaatttatatttattttttaggttttaaaatattttttggcttattgctgttcatcgtcggcattttccagcaaatttttggagcccaaatggcaatgctcaacgggtgctgggacgttagtcaaaaaccatcaaaatgggcgttagtcaaaaaaacatcaaatgaataatttttgacagaaaattattcataatttcgtctaaaatggatcaaattttgtaatattgatatttttcgataatcctaagtgttttctattatcctgcaaattttttaaaaaattctttaagtttaaaaaaagttatgacctgagaagctcaaaaaaaccaagtttttttgaacatttttagtcataactttcttgaaacttaacgaaattttttgaaattttgtaggctaatagaaaacccttaggcctatcgaatgatatcaagaattaaaaatttagatgcttttgagcaaattatatcaaaaaaat

SEQ ID NO: 23989 - DNA, 1688 bp, Heterodera glycines
caaaaacttgaaattgtacaaaaattcattaaaatgaaaaatgaaataaaacaacaaaatagaaaatattcattaaaagaatggcaccaaaattatgatggaatttgtaagaaaattggagttggctatggaactatttgcagatggaagaatcaatttggcattagctgtaaacgaataacggagaaagaaaaaactggaaaaaatgaaaatttattggaaaataaaaatgaaaagccaaaaagaatgatgaaaatattgtaaaaaaccttggatttttagaaagaaattgttgaattttttccgttgataaaaattaccatttattttctttaatttattaatttatacgcaaagcttaagaatatacaaaacaaaaacaatggaaaaaattcaaataaatagccaaaaaattgggggacaaatcgaccagatagattgaagttcgaactagagctgagcgggaccgggaccggggcgggaaatcccagttttttcaggtcccggtcccggtttttggaaaaattgaaatcccggtcccggttttgccagtcccggttccggcgggactaaataagcactggtaagaatggggggtctgtgtgagaaaagagaaggcaattggtggagattgagaaatttttgagaaaaaaattaaattttttatttcttttaaattatttgtttaatattcttatgtggtgtagtgactaaaccttctgaccttaattaattttcgctatggtttaattacccaacagaacagaaaatattttaaatttctttacattatttcaattgaaatttaattaataaaaaatatttcaacttaaaaattattatttttgaaaaaacagcgacacaaaaagaggcattaaagaattgaaaagactattaaaatttctgatttcggttgtggaaacccacaggtgttcaaagcattcaaatattcaagtttctattattttcgtgaacagcaacatttttcggcgctaaaatttcatttttggccattttacaccaattttctgatataatgaaatttcataaatctctttaatttttctaaaatctctttacattgtgaatttattttatttttattgaaaatatgtttattattttcgaatgagctccagtagaaactaataaaattttatttaatcattaatttaccaattggcaattattttgtcattaagataaaattattattattattctttgaaattaaacaggatttccttattttattaagtaaaataatgatttattcagttttttaatcagaaaaaaatcatttaaatgcctcgaaaaatgaattgccatttaattgaagaaaaataaaataaaatcatttcgagacgacaaaaatgaaattatttccgctacttttattaattatattatttttaattgtcaaaattggagcagaaaagaaaaagttacaacaaaagtcatttggcgaaatatttggagaaaaatggcaagaaaaagaagaagaaaaacgaaatgagcagaaaaaaagagaaataattgaaaaatattataaaataaaagaaaaaataaaggaaaaaggaagaaaatactcaaaaaaagaatggggaaaaattgacagaaaaatagcgaagaaattagggacaaatcgaaattacattcaaaaatggatcaaagaattggggcttaat

SEQ ID NO: 23990 - DNA, 983 bp, Heterodera glycines
  misc_feature (939)..(939): n is a, c, g, or t
cgaaaaaggcataaaataatgggaaaaggcagtaacaacaacttttttggataaaaatttttttaaattaacaaaaagctgtcaatctttctttatgcattgacaaatcaataaatataaaaatattttcgttcgttttcattttagaaaatttcttttttggtcatcgccgagttatatacagaattagatttagaagcagagtgaaattccaatttcattgacatttataaaaaaattcagggcaatttaagggcatgcccttagaaaattcccatttaaaaaaaaaactatgaaataagtaaaagttttgtaccgttggcattggcaccaccgccttccgccacgttgccattggcacctcttccgtctcccgctaggttggcattggccccgttcgcattgttgccgccttcgcccccctccacgttggcattggcacctcctccgtctcccgccaggttggcattggccccgttggcattggcaccaccgccaccgcccaccacatttcctccattggcaccaccgccaccaccatcacccgccacatttgcattggcaccaccgcccgccacatttgcattggcaccaccgccaccgcccgccacatttgcattggcaccaccgccaccgcccggcacgtttgcattggcacctcctccgtctcccgccaggttggcattggccccgttggcattggcaccaccgcccaccacatttcctccattggcaccaccgccaccaccatcgcccgccacatttgcattggcaccaccgccagcgccaccgcccgccacatttgcattggcaccaccgccaccgcccgccacatttgcattggcaccaccgcccgccacatttgcattggcattggcaccgcctcccgtcctattcttttttggaattttttttggcatgtaaagtttatttaaattntctaaaatttgatcaaaaatatccatctctaaaattagtaaaaa

SEQ ID NO: 23991 - DNA, 1240 bp, Heterodera glycines
ggtctacattcaattcgcagtgtttcgcccagccatcgattaacgttcatttccaactcattttgtctattgtttgcttcagtgtccgccattatccaacagtgacgtggaagaagattagaaatatacaagaaaaatttcaacgcaaaaatacattttatttagtgataatcgcaatcggtgacaatttttattaaaatataagcgttttctttaaacaaattttcattggtctttattctttacgtaaactcgtgcccaaaccaaatgctgattgaaatgcttggctccaacgctgaaaagtttttggtttttcttttttttgaaaaaaattcgaaccgcgaacgtggtgaaaccatccgcggggaatgaacaaacattcaccggcctccacaacagaatcgtagcattggacatttgcaaaatcagggaactgctccaagtcaagacattccacatcgacctaaaatgcggaataaatcataaacgaaaagatttaattttcctaacaaataaaggaatttgcaatataattttttaaatagagcaaaataagcacttggctggtattctgtctcatcaaatcgtcgtacaaataaagtcctttccgattttggggagaaatcagacgaacaaattttcggcctcgaatttgacagaacaaattatgccgtgggtcagtgtgcaacggcgaaactaaaaacacttcagagattatttggaagagaaggtccttcgtttgcgacatggttcgaagaaatagtaaaaaatagcaggtttaattggtccgtcaatgaatggattttggtaaatatcgttaatttagtaacccagacagagtcaacacttactattagtagcaaaaaatttttgtttgtcagattttggaaatctaagtttcaaactttggtgacaacaaagactaaaattgacaaatgccacagaaattaaagcaaccctgaatttggtataaaaaattattcgctgactcacctgttccagcgggtccaataaaagcattgatagtcaattcgtggtccggttcgaaccttgccccatcgccaatctcttccccgaccggttggtcaccaaacacacaataatcaggcacaggcacatccgcgagcagttcgggaatttggtcgagcagtcggtgctgggccatgtagccggactgggacggctaaacgatttaaaaaattcttaaaaaattttgttaaaacttttttagggaaagggg

SEQ ID NO: 23992 - DNA, 996 bp, Heterodera glycines
  misc_feature (8)..(8): n is a, c, g, or t
  misc_feature (783)..(784): n is a, c, g, or t
  misc_feature (884)..(884): n is a, c, g, or t
  misc_feature (911)..(911): n is a, c, g, or t
  misc_feature (929)..(929): n is a, c, g, or t
ccctatcntgttaaaaaaatagattcaaattataaaaatttcgtgatttaaataaaaatgaaaaatagttaatcgcagtaccggttagtatcgggcctggtttttccaaaattaccggtcccgaccttctctaatttaaagcgactaaatttatttgccaaattttctttggtggtttatatttatttgataaaaatagcagtttttgtttggatatttaaatatgtcatacctctttctagcatttcagatagtttatagcaactgtgtttttactttttattgaattttttgacttatcaaactatttaagttattaagaacatttttaatttgtccttgcacgctgattgaccgtcatgaaataatagcagattctttttcttttttggtgtttgatttttatttttatttgatttttaattttttagttcatagtttgtttatgtttaataaatcgattttaatttattttccaatttaaaataatgtagatctggaatggctctttcaagagtgaactgtagaggcatgacatttttggaaacttttttttgtctatttgggtctaattcaatatgaacttaaatacaataaggttgatcacaattaaatgccgtagctaggacattttggttatttaaaaactaattatatatgtaaagacaaaatgattttaattaaattttttacattgaattgactacgatcgtttctcctataattaattatattcataaaagctgtgccatttaacaagcagcaatttttaattttatttannaggtgttttttattaaataatattaattttggtattttttaaaaacgttaaatgctttttaagtaagatttttctgagcctttaccaatatttttctaanttattttttattgttgtctttctattntgtatttacatttgattntatgatcttttatttgggtatttaaaaacaaaatacatattgaaaaaatttattagaatttttaaat

SEQ ID NO: 23993 - DNA, 987 bp, Heterodera glycines
ataattattagtacaaataaaaaatttgaatattgcttaatctcatgtttgattgaaatatgtaaaatttttaaaagttttaatctttcacttgtttaaatatattttttctgaattaaatacccaaatgtttatgattaatcattttgacagattaatattttgtttttaatttacctataatttttgtaattgtcatttaattagttttcttaattgtatatgtataagacttttaaatgattcatcagcattatgttacaatataaaacagaataataattatccgggtgctattaacagaaagcctcctattctctttttgaagaaagtattatatggcacaaaatttatctgaataattatttattaaaaaaatatgtgtatttatttatctctaataatttaaatatattaattttagcacggttcggcatatttcgttatggttttttagatgtgtttatattgcatttttcgataaattatattattgtttaggtataaaattaaaaaactgcgtctatgacggagtaatattattaaatcatattatttttctaggaatataaatattcgtttctttaattgtaagaatagttttctaactgtttaaaaaagttcagaacaatattgaacagatatttttctttaaaataatgactttaagttaattaatttgttcgtatttgaattagatttatatattttactagtgcacacgtccctaccaaggtcgccactttcgaaatcggcctggcttattgaaatatttaaatttttataaatatttattttgtagttaataatttgaaatatttgttattgttattgacgaatccttttcctgttgcaaatttcctctatcattttattttttaaattcaatttttctgtaaataaaacttgcacaaaaataattaagatcagaaacgcttcgatcgcttcgtgtaatttattttattttatttctttttggactctaga

SEQ ID NO: 23994 - DNA, 636 bp, Heterodera glycines
ttattaaggtgaacttttttccttttatatattaaattcttttatgaaaatattcgaagcgccttctagtaagttaggtgtggtgaaacacataaatatattgttcgaaagattctgataagaagtatttggcgaaaatatgaagggaatctaaagcgaagcttttttttaaatcgaaataatacacgcatttcaaaaaacgatagatggaccaataaatagagagtgcagagaaatatgcatctctcatttgcataaatttttgaaattcgttatttttaagataaaaattgaaacgctgtgataaatagaatgtgccaaaatgagagggtacagagatttatatttttctgaatatatttattaatttctaataaaattcaacaccataaatgggggggggggaattcgtattggttgggacaaactgtgaaattttttacgaaatgggatttcactttttttataggatatcgtctttttcaatttcatacccattgacctcatttcgtcattaccaaatgtaaattgtcttctttcacttctacccatttgacctctcgtatttccacctcaagtgtaagcggcagcaatgcccttttggttatttttatttttgaataaataaataagtca

SEQ ID NO: 23995 - DNA, 1798 bp, Heterodera glycines
tcctgaatagcttttcagaaggcagctacgaatttttttctgaaaaatcgaaaatttccagaaattctggaataacttttttcttttttgtgataaaaaactcaaataaatcccataaaattctccttatttttctctatttttaaagctttattatagttaaattgatgaaaccatcaccgagttatgaattttccaatattagcccaaattccaaggaccaaaaaaattaaaaatattttcgaatttttaaaaaattccaaaaattctgaaacgtaaaataaacatcatattcgtgctcagcacctcaaaatactccagaaaaatatttttcactccccttttggccccaaaaaaattttggcaacaattccaaaaatggaattacaatccataacgctgggagtgaagttgttaaagtacgtgctccaacatctcaaactcaaaccaacacagacaacgatttggactgacagcttgtgttccgttgaacgaattaaggagcataagaaatgcgatcgatttttttcaaatcgattagcaaaaatacgtggacagtttgaagtcaaacatttggtcagtgcagataatcccgcggacgtggcatcacgcggcacaacaccaagagagttgagcagaaatttgttatggaagcatgacccaaaatggttatcagaagaaaaggccctgtggccaaaaccagcaaaggtttatcacccagatgaagagaagctcaggggaagtgcggaagatgaagaagtgaaaacagccgcagtcatgaatgaggtgcctttccaaccaaccattgatgtgaaccggtactccagctggaaaaaggccaaaaccgtgggtgcctatgtcttacgctggatacattcggtggcaaaaaacggatacaatggaaatttgttgccaattctgagcaaaatgggcccaaaaaagcacgggaaccaagacaagggcgtactgtcagtgcccgaattatgtgcatccgaacatttgctgatatgggaagcacaacaacaatttccaacggaggaaaaaacaaaggaaaatcttcgtgtgttcaaagacaaagaaatctggagatgccgaggacgcattggagaagcaacagtaaaggaggaaacgaaattcccgatcttcttgcctcctgaagcaagggccacaaaactcattgtgctggaagcacattggaaaatgaaacatccaagtcacagtactctgttggggtacataagggaaaagcactggatacccaaaggaagaaggttcatcagaaacacgatattgtctgagcgacacggatgtttgaattgccgcaaagagaggcttaaaccatatgcctatccacaaatgccaaacttgcccagtgaacgagttgcgatgataaggccatttgagaagacgggcgttgactattttggcccattaacaataaaaggcggagttaaagtctacatcgcactttatacctgtctcgtaatacgagcggttcatttggaagtggccgatgattgtacggcaacagaatttttgaggacctttcgaaggttcagctcacgccgcggcctcccaagccttatgtggtcagataatggcaccaattttattgctggagcagagtgcataaaagaggaatggagaagagaaatactggtggaaaccagccactcaggagtgagttggaaattcaacggaccacgagcaccctggcaaggtggcgcatgggaaagactggtgggcatcaccagaagtgcgttacgaagaacagtgggaaaaagcctaatgaaaggca

SEQ ID NO: 23996 - DNA, 1252 bp, Heterodera glycines
  misc_feature (1215)..(1215): n is a, c, g, or t
atactacaaaaatccgcaatttttttctctataatataaattttatttggcaattttatctcttttttgagagatgttacaaaaataaaagtgtttttaagattcgggaccaaaggggggtgaccaggatttttgagtggaaaaattttttcacccaaaatcatccaaaaacatgtcattagggctattttatgacgctgatcacgaatacgtgatcagattttacttttgacatagtcaagacctcagaatccctgtgtgattggggattctgaggcatcattttgaggggggagggggcaggttcggatccggacggtgtaacattatttttctgtgcatttttacgttattttcaatgattttaattaatttaaaatatttagttgagttaataaataaaaaattatatttaattttttttgataaataaattttataagtttaaattaattatttttttaattgatagaatttcatgtatttttttaattaaatttgttaaaaaatattttcattttaatttaatgaatcactgttgcacctcttctaatcactgttgtacccctaaaaaacgggcgcgaagcgcccgtctggcccaaacaaatttaaaaaacgatcaaacgggcgcgaagcgcccgtctggccccaactaaatttgaaaaacgggcgcgaagcgcccgtctagacctaactaaatttaaaaaacgggcgcgaagcgcccgtctggccccaacaaaatttgaaaaacggtcgcgaagcgcccgcccaagcccaacaaaatttgaaaaacgggcgtgaagcgcccgtctggccccaactaaatttaaaaaacgggcgcgaagcgcccgtctagacctaactaaatttaaaaaacgggcgcgaagcgcccgtctgtccccaacaaaatttgaaaaacgggcgtgaatcgcccgtctggccccaactaaatttaaaaaacaggcgcgaagcgcccgtctggcccaaacaaatttaaaaaaacgggcgcgaagcgcccgtctggcccaataaaatttaaaaacggtcgcgaagccgcccgtccaaggccaaaaattgaaaaacgggcgcgaagcgcccgtctagacccaactaaatttgaaaaacgggcgcgaagcgcccgtccgagcccaacaaaatttgaaaaacggacgcgaagcgcccgactggccacaacaaaatttgaaaaacggccgngaaccccccgtctggccccaactaaatttaaaaaacg

SEQ ID NO: 23997 - DNA, 1232 bp, Heterodera glycines
attaacagctaaaataattttcgtatattttcacaatttattcaaaaagccaaaaagtccggaaccaattttaaaaactaaaatagtgcacaaaaggggagccgccgcacggcggggcttaaaagcattgtacagcataattaaaaccgaaaataattttcgtatatttttcacaatttatttcaaaaagccaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtactgcataattaaaagctaaaataattttcgtatatttttcacaatttatttcaaaaagccaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtactgcataattaaaagctaaaataattttcgtatatttttcacaatttatttcaaaaagccaaaaagtccggaaccaattttaaaaactaaaatagtgcacaaaaggggagccgccgcacggcggggcttaaaagcattgtacagcataattaaaaccgaaaataatttttcgtatatttttcacaatttatttcaaaagacaaaaaaaaatgattcaattttgaaacgaaatagtgcacaaaagggagggatggttagacgaaaagaggaatttttagaaaagagcgcaccccatctgatatttccattttccgtttcacaactggccaaaggcgactgtgctcattgacacgtaattggccaataaagtacttggactttccacagtaaaatgtggtacaaaatttttggaactgtcccgcctcacggcggggctaaaagcattgtacagcataataaaagctaaaatattttcgtaattttttc

SEQ ID NO: 23998 - DNA, 1252 bp, Heterodera glycines
ctccatcgacagtcttaatgaaatgtttaacaatgagtcaatgccatgaataattgcataataataacgcaggcaatggcacctcttcttccgcttcggtggaaagccgtgcctttttcggaggtggcggatgcttttcctccccattcccatcatcgctctcttcgtcctcttcttcttctcctccctcgtctttttcccttccgttttcatccgtctcttttagaattaacaaaaattttcgtttcattttttctgttaaaaataattattaatcgaagttgttaaaaaaataatatatattttgtaaaaactaaataaaacccaaatgttataagtgatatcaaaatatttttaaataaataaatggaaagtgccaatgtcttcaaaaggaatgcgccatcggttggttggtcattgttctgccgctccgtccgcgattggattcgcatggattgtgacgcttcgaattcgttgctccaccaccgggcgatacctcgcgtccactttggtgttctctaactcttcaagctcatcaaatccgtcaatgaccctgaagacaaacggaacagttggtcaacagaaaaccaatttcttaataattatagaaaatttgacacgactgacttgccgaacagagtgtgctttaggtccaatgtcggctgcttttcgtaagtgatgaaaaattgggaacgatttgtgttcggtccgttgctcgccattccgatcattcctcgggcatcgtactgtggtaaaaaaattaattatttggtggcaaaatgccaaccaactttgaggtcctcatgcaattcgtcttcaaacggtgcgtcccaaatgctttgtccgccggtgccgcgatttgtcgggtcgccagtctggacaataaacgttttgatattgcggtggaaaatgcaattgtcgtaataaccggaagcgcaatgggccaagaagttctgaaaaaacatttaaaatggatgagtgaattgtgcattcccccgcactcacttcgcaagacttgggacaacgttcacaaaacaattccaactttatgtcgcccaccgttgtgtgcaaagtgacggccatcccaaaaattacaaggaaaaaaagatgagtccaaactgctattttcaaaaacaaattatgatttagaaaataacaaccgaattaaaatgctaatattgtataatcttctgtctgctgtgttttcatttatgaaatgtggaaaaacaatcaaacatttgagttcacattt

SEQ ID NO: 23999 - DNA, 1102 bp, Heterodera glycines
cctcggactttgaattgtaaaagtaaattgtttggattttggattcgggatacaattctccatccccatttggctaattgtgtgtgcggtaattgcttcttctcgccaattcaccgccgaagcctttccgtgtgttacgacgtggcgctcctgctaaaagaaggtgagatcaacggcaaatttcgacttttgacagtgcgggaaggagcaacgaaaacagggaaacaaatccctagagtgctgaattgtaaaacggagaaacaaatctctaaatttacgacgtggaaagaaagcgccgaattcgtaaaattgggaaacaaatccctaaaagaaaaacgagaaatttgtgatcaccgaattttgaaaagagggaaacaaatccctttcttcatctcgccgaattcgctggatttgttgaaattgtaaaacgtggaaaacgaatcttgaaagcggaggaaaagctgacaactaagtcaaaagctttgaattgaaaacgggaaaacaaattctcatttgctaatggtgccggttatgcgaagtccgccattaacgcgacaaagagcgttaaacctcggcatacaattgcgaaacgagggcataggagttgcgcaagaacagcagcgagttcagaaacagcactccgacgtcggaaatgctcctttgagcgaaaacgaaaatcgccaaagccgcgtttcatcggtttcatctgttttaggaccagacacaatccaccggcgacttttgcaaatcccaaatccacggaacgatatggacgcgcaacaaaatcgaaacgatttggacgaagatgctcttttggatgaccatggtgactcaatttttggtaacgaaaatccccatgaacaaaatttgggtggagaaaatgttcgaaatgcagttagtgctatgagaagcattgaccaggggagagtgcgcgttgatattgtggatgattttgggtttcacccgggcatgacttccaccccaaacgtggtcgcaaattatcagcgtggtgaaccgaggtttatgctccatcaaccaccgggagtccaccaaaacaaattgatgctggaggaacagcattttcgttttggcgcacggccta

SEQ ID NO: 24000 - DNA, 1125 bp, Heterodera glycines
  misc_feature (8)..(8): n is a, c, g, or t
ctcccctnttggcacattcactcacttgtcacgtaactgctcagtgttgggatgccaaagttacgggcagccgtttgaaacaacggcaccgctatggtgccaagttttgttttggcgccaatccgatgggcaagtgccatgggacacggatcataaagttcggcaaggacgacgtcaaagtgttctgcttgaagacggcggagcagttcaacatcatttacgagttcgaaaagtggtggaatgaaaaattaaatcactaattaatcaattagtatttccactaattacctcggcaaatttcgcatagaattttaccaaattgttcgtttaatttctgtaatttttgtttaattacaaatttttccattttttttcatatgatcacaaaccgtttggaagagaaaagtgttgaaacttttgccgtaaaatggctctttgaggtcgtccaatttgttgatgtctaatttgcccatttgaacaaaatttggcaaaaaattgtgtaaattggtcacattaaacacttccttgggcaatgcctcggcccttttgttcatcaaaacgcgaaaaaggtgctaaattttgtgaaatttctgggaaattgttcacaattagatcatttttcccttcaaaaattatttatttcgcaaaaaattctaattaaaatatatttattgaaatttttgaatatttaatttcagccataaaaaacaaaaagacaaaataggcattatttacggttttccccaaaatatgtcaattatatgcacaattaatgcttgccaataaaatttttcatttcctaaattatatagtccaatttttaattatcgatatgatttaccacgtcatggcctgccccgaccaaagtgtccgcaattgagcccataaattgcatgtgactccatccaattgtgggcgaataaacaaggattttaagacgctttttggctaagcttttttgaggcgtttcttccaatggatttgttgaagccaaaaatgtaatttgacaaattaaaattaatgcacaaaaatttgtcagaagctttggcattttttcaaaaaaaaatatccaatttagtacaaattcgtataatttaattttttgaatttcatgagtattttttt

SEQ ID NO: 24001 - DNA, 1457 bp, Heterodera glycines
  misc_feature (1441)..(1441): n is a, c, g, or t
aaactcaaatttttctcgatttttggcggcatatttttaaaaaaattcaaaaaaagtacatacatccccctaaagatcttttaaaaatatagaatatcaaaattttatttacatttcggtgccatttatcttgaaaacatttaattgctaccagtggcacttttatttgaggaattcatttcggcgattattttagggaccttttatttttgtttttgtctttcttttttccaaaaatgcttttatgggatatcagtttcattttttgttttagcattaaacaaattccctgtttaaaaggccattttgttttcacggtggtcagaaattccatgttaaatccccttcaaaaaatggttaatttatgggtttttaggctattaaaaatgaaaaaaataataattttaaattaaaatattttttattaattaaattcaattaaaataatggtaaagaaaatataaaaaaattttccgttccatcggggaattgaaccgaagagaccaataatgaaagtaataaagtttagccacttgaccacttatgtatatgaacaaatactataaatgaaaataaataatttaatttatttttatcaaaaatttctgatccctcaccaattcccttctcttttctcacccagacccccattcttaccagtgcttatttagtcccgccgggaccgggactggcaaaaccgggaccgggatttctgtttttccaaaaaccgggatcgggaccgggacctgaaaaacccgggatttcccgccccggtcccggtcccgctcaactctagtattagacaattgtaatttatcattggaaatccggattttcacatgaaaaatacggtgctggtgcatttcctaaaaaccgccacccatgcgcgtttcgtaaatccgccagcgcgtttcgtaaaaccgccagcgtgtttcgtaaatccgccaatgggttctaaacaaaaaatatgtaacaaataaaaattcataacttggcccaagttgagccaaattaatatttcatggtatcttttaatagctatgggtgtattctttagaatataatattacaaaatttttatcttaagtataaaaaagttataaatcattgaacattccaggttttttgcaatggtcaagcatatataattttataaacacaatgttttaaatctataaaatgcaattgagccaaattaatttatatattcgatagctctaagaattctctatttacctttaaaatttcataaaatttaatgaatttcaaaaaagttctgtacaaaaaattcaatgatttataactttttttatacttaatataaaaattttgtaatattatattctgaaagaatacacccaaaaaaggctatttcaaagggaagaaattccatttttaaatatatacagaaatacgatgttaatccctttgaaataccganatttagttttgaaaac

SEQ ID NO: 24002 - DNA, 1762 bp, Heterodera glycines
ctaaatttacagtagaaaagtaccgtagtcccgtcgatactttttttgccaccattagcacagaaaaaagagataaacaaattaatcaaataattcaggctgaacatttgtccgtttttgaccaattttccctttgccttggcatcttcctttcctgccagtggatttttcgtcttctttgtcaacgctcttcccacgtgctgcggaattgcgggccgccctgcttgaactcggcgttatgctgctcctttttgcccaaaaggctttcctcctcctcttcctcctcctcctttctgtgccgcttcttttcctgcttctccgccttctgctgctgcttcttcttcgtcttgcccacttgctctccttctttgcctgcttctcctcctttctttttctccgcttccttttcgcccttctgtgatttcaatttttgagttaattaatgcttctcttctgccgctgttcgcttacttcctccatcattctttgttttggcttttcctttgccgctttctttgtcggcttttccgtcgtctcttctgtgtccgctgcgagtgttgtctccgtcccctgcggctcattctctctgatcgctttccgttctttcgctttttttgtctttggctctgtttaattgtttcttttttgggttttcatggcttgcgcaaaattaacgcgacaacgcacctttaaaggaccgtttctttcttccgcccacccaaagggatgccaattgctgcggtgttgccaatggaggagaagccgccaaagaattcattatgtttgtctcgggcgctgcagcaggcgactgaattgccgtggcgccgttcaaaggttgggaagcgtcgagaggaggcgattctttcggtggagagccttccaaaacaggagaagcgacttgcaatgcgccaaggtcgctttgggctttcgaaatggaaggcaattgcaaaggcgagaaaggcataggaggggcggcgatgacttggggaagaagcggagaatcgccgtaagggaagccatcgtacgtcgacgggcggtgtcccttgccatgcgccggtgggtaacggtggcgtttgccaccaaagcgcccgccatacccgtggcgcttgtacgtcttaaaattggcgttacgcttcaaattctttggaactgttgtgattcatgctcactggctcttcttcactgctgtaactttcgctttcgtcgtatccccgttttttgagcacgtggaaattggaaccgacagaaacaaacacaaaatgccctaacagcaaaatgaaaccgaccaaaggggcaggaagcatttttagctaaaaccaagtgaattaaaatggccaaggtgcctaatcagcccttatttattgaggccatggcagtcgaaaaggccctttttgctgttcgatggttcatcgagctgttcattctgttggaggtggatgagggtgaaagatttgtgtatcacaaaatgacaaatgtcagcataatatttagtgattggatgggttgagtcagccacacctttgatcacctgaattcagtgactaatcccaattgaatttaaagaccaaagcgtaaattgtttttaatgataaaaacgtgtttccagggattttcggagccgctgttcatgaatatgaactctatttgacgaatttccgaacccctaacccgaaattccaacattttattttttacaaaaaacggttttaaatgtaccaaagtgcgtgctccatgattctccgatgtgatgctcatattatat

SEQ ID NO: 24003 - DNA, 1978 bp, Heterodera glycines
cacgcgaaaacggccctcacgcgaaaatggccacgcgaaaacggccacgcgaaaacgtcctggcccgctcaacaagcccgttcattgttaaaaatatcttaaaacccacctaaaatattcaaaatttgatacaatatgtataacaattttttgggaaaattgcttaatatgaatataaaaatctataaaaaaaaattcccacaggccctaaaaaccctttttctttttaaaaaattgagtcaaattcacaaaattttgtctttttttgataaaatatattaacaaagtatgtacgaattttcaaactttcctcggcgacgcttatcaacattgccggaaccctcaccccttattccccaaaattttttaaattttattttcagaattctacaaattttgaaaaaatcccggttcaggcgggcgcccggtcaaaattttgtaggtgctggtcaattatccaaacctggtcccggtactttaaaattccgggctcaattaataataattgtagaaggaaaaatgcaaaaatttttaccattacaaaaaatcttattcttttaactaatttaattcgattttaagttgaaaatgaatccaattgtttcacaaattctaaatgaatcttatggactaaaacacccagtaacaaaaaagaatatgaccatcaatgaggcaatcgcaaatggactgttcgccccgagactcgaaaatttatcaacctaaacaccggccaggagatggatgctttcgactctgagtttttaccatccggccattattcaccatttcgtaaaattgggcgcactaggagtgaacacgatggacttggccgttgccttggaatgtaagttggcgagaaattaaaattgcacgagacaattttgtcatcaaatgagaattttaccaattaaaaatggcttatttttgacgcaattttaaatttgttgccattttaaccaataatgttcaatgttttcctgtgttttgttaagcattccgttttcattatctcttatacacttatttacataaaatttcaaactctctccattaagtttttcttgacgaaattcacggagtctttctgctgcttgaatacgaaatgtcgttaccagaggcactcaaatacggatatctcaaaattccaatgaaacccgagacattttcactcactttgagtgactgcatcgagaagaaatggatcaatgaacagacgggccagttcatttcccgtcccggcgaaaccatcagccatgcaatgcattccgacactgactggccaccgccaattctgaaccgcaatgtgcgcgaatgcttcgactcggtcaccaacgcgtggttgaccattccggaggcagtgaaccgtggcattttgaatgcagaaacgggcattttcactgacctaagaagtggcggacagatgtcgttggcagcagcgcatcagcggagactcatccaaaaaccgctgactttgagtgaagccgtggagaggaatgtttggagcgaaggcggaggcggacgttttcaaaatggcggcacccatcatactctgctacaggcgagggctgggtcttatattcattaaaaatcctctatttaaataatattgctgaaagaatgtcgaaacactgtccaaaacatgggaaaaggtccaaaacaaagcaaattattaggaaaaagaaaaaaatttgcagtatgcattttgcaggccattaattgcgggtctctcgagatggatgttcggcacattttgttgggcggggaaatgctttcaataagagaagcgttggagaaaggaatgttgttgccgcatggaataatcgtctcgggaaatgcatttggccacaatttggagcacatgaatttacgcatggcttacgaaagaggcattttgcggggtcgcgttcgctacgcgattttcgatctcagaggtttcaagcaggaagaaaatctgtctctgttgagcttcaacgacgca

SEQ ID NO: 24004 - DNA, 1333 bp, Heterodera glycines
tgaaaacggaaggccgaactaaaaatctcaaaattaatcatttttacggttctaggtaacgattcagatgcattgatgccatattgtgctcctcacgcacagataattggcctataaatgtcggactgatcagtgtctgcttttattcaattcctgagattatgaatggaatttaatgaaaatgtttttattcgtattgaaaatatttcaacattccatctcgttttgacctcttcgttctttgccattttgctgtaacgctcgagcagctcgattctttctgtaatcccttaagaaatattcttccggtggcgtttctcgtgttcctcaccatcgcgtaaatgttcatgctgattgcctttcgggtgatccttcaagtactggtcttgatccagctttgcatcaaccgtcgtcttttttaggagtttctcgtctgaaatgggaaatttgatcagtaaaaatggtaatctttgttttccaaattgttcactctccgtgtaatctttttacctctttgtttttaaattaattcccatttattatttgtcttacgaatgcatcgtaatgcttgcacggtgaattggcccgacagtctgtgccgtcctcgcgaaaccaatggccaattttggtcagatgcgaacactcaacgacgttagtgatctttttgcctgaatatacctaaacgttgttatctcatttgttgagcatccactatcccgtttacaatacttcaaatgttgtgcttggcaccaaagcaattcatcatactgttcgcggcgtcctacaacggccctccgcattcataaatgtgtttctgtagcagcactgaaatgccactaaaagcatggaatattgatgctttttgcttgatgcacgatcctaaaggtaaatacaaaacgagatgggctgctgaaataaatcatgtcacagcaaattttaggtttttcattccatttattttaattttgcatttcgttacctaccgtaccttcaacggcaaagttattgaacacaaaatggaatagcagaagtgtggttacaattggtagcgtcttcacggaaaagtgaggcgaaaattggacgccaactcataaagtaataccaatttataaatgattggccacggaaacgattcaaaataattgaggaacaatgaagatgacgtgacaatgataccataaaaaggacataaaaatatattgcatcaaaaaattggtttggatgtaaagaaaacacagcaaataaattaatgtgcacaaaaggatgaggtgcgccgtgaatcacggtcacggttaccgtgaatttcacgggatttttcactcacggtcacggt

SEQ ID NO: 24005 - DNA, 1961 bp, Heterodera glycines
ttgtcggactttggtcgccaatttatgggacggaatgaaagaaggggccaataccaaagatgcgacggaggacgaagatggcattggccgttggaaacgaagccgaaaaggcagggaaggaatggcaaaaataaaatgagaaaaaactgaaaatgaaattaagcgatgctttccgggttggattccgttcttcctcctttaattgagagtttgactaaaaattagcgactaatatttgacccgacaatgaatggagtggccaaagtggggggggggacggacgggtcgcactcggcgagtgggaggacacgcgcgtcaattgttggacgtgtcactggacggaccgcagaatgaccacccgtccgtcgcccactcactctttcccgcgtcgtaacccaaccgacgcccaattcattcattcattcgtttattgctgctcttcgcccccacttcacttcacttatcactcgtcccatccgccgattgttcttttccccattatttggctttgattacacccaaattcccatttacataagatttactgttctttttttcattgtatgagcgaaatgaaaggaactgccaaaatggacaaaagatgaattggacagtctcaggaaggaactcctctcctttggactttttctgtggctcaaatcagtttttttctgtcagccgttaaatgcgaagcaaagaatgaatgttttgtttattgttcgctttttacaattgcgcattatttcctcttctgctgatggtctatttttgcatgtcaattcataagaggctttctttgtcttctgctgattatgatgaaaagaatggagggatccatccattgattaaccttcaacccccgaacaatggcataattcgaagaacaaataaacaaaggcggcaaaaacagacaaagtgtacagaaattaaatatgtataggtatgtgtcatcatggaaagacaaaacagccttaaacaattccgacaattaagccatttgtgaaactttgaatttttttcattaaaatatatttttttaatttgcaaataaagtaaatttaaaaaatgaatttgaataaattctgcgccgtcgttgaaatttttaaactaaaaagagaaaaaatcttcttgctttgctgagaattttttgtacataggtatgtgctaaactcccaattttttctttaaaaattggcacaaatcacaaaaattaacaattttgcacaatttattaacaaattgccactcaattttcaataatgcattttcacggctatccattcttagttaaaagtttggagcatttccggtggggatttcgccttaaccgcttaacccatcctttaatacaaaattaggtaatcaagtttttgtaatttaattgttctctttatttaaaccattacataactctcacatttacatgcagtgtttcttttcttacaatatcaggccatttcattccgtcatcactttgcttctcttttcccggtgatcgatgcactgctcttctattatggttttcaaaaaactaataaatacacgacccattcctattctcttcgtttttcatcgtcaaaatttgctccatctcacttttaaatcacaaagtcggagtatggccacatttggagatggccaaaaaggaagcaaagactttctcaaaattggtcaagttcgtattccaatccatgagagtgaacggcctgaatttgtccctgcgggtttcggtgaggaatttttttgataaggtaaatgttggatggtttttgccaccagcaaatggcgttccgcatttgtgtattgttttttcagttggccctgcgcatctcccaccggcattggtccaatctttgaaatggatgatgcagaaacagtccttgggactaggacattttcctcatcggcatgccggggttcctccattccggaattgtgcaccaatttatggtgggaatgcc

SEQ ID NO: 24006 - DNA, 2007 bp, Heterodera glycines
tccaaaaaaaaaaacgtttttttaatgccaaaaaattcgtcgcctggcgctaaaaatcgcaaaaatttggcagtttttagtgcaaatctgttaacaaattgcactcgaattttcaaaaattttccccagcggcgcctaccggcaccgccggcctccgattccctaaaattttttggaaaaagcgcgccgccaaaaaaatgaagttttgttatgcaaaaaaaaaaggtcgtcgccggagaaaattttggaccttcgtatgagaaaatcggtcccgagacaccccccccccccctgtcccaatcgtccgtcgtatggcccttgggctgagacaccccttgtgaatgtatgaccgtgagggcccaactaacgtagaccacaaaaaaagtatgcagtaagttatatggggaccctgcatgccgccgaccccttgtacatacatttacggttttaaccttttaattattatggcgaaaaaaataaattttagaaaaagcacatttggaatttaaaattaaaaatgagaagctaagaatgtaacaataaaagcaactttaaacttttatcaaatttctttatttcttttttgctaacacttttgtttattaaagaatttttttgttgtttttagggcaaagtgccaaacgttttttcaaaaaattttctcagtgacgaaacgatcagtgacgaaatgatcggccaccatttgaacaatattcatctaattttttctctaaaatagattttgtcacaattaaaacatttttaatttttttcatcccttctaaatcttaattcataaattttaaatctgcttttattaattctggttggctatattccaaactagctaattctctcaaaatgaaatgtgaatcttaatgcctgaataaaattattttttttaatagttttaatcttaccgctaaaatgggcatatgcatacgtatcgtattttccaaaattattatataaaccgaaattaaatttttttataaatgaaaactcgatgaaaaaaaataagtaaattaagcataaccatctcggtgatatgattatttatcagatattagtaaataaaggtaaacatattttaaaaagaaattccttatcatttattataaatatacaaaaattgcaatttataacatctttttaaaatttataaattatttaaatttgtttaaaatttatattatatttgttaatagccattaaattatattctaaaaataaagagctaattttaaaccataattaaaaaagactataagaaacgcaaaaatatataaaagtaaaggatgtacatattaaaacaaatatcacatatgataaataaatatgttagccatgctagcaataggctgaccatttattaaactccgactatattagtaaacaaatcaaaatagataaataaacataaatatacaataatttttgtgacctgaatgataattttttataattgtcttaaatagcctaaattagttccgcaacaataaaactagattgaatgtggtgttttggacttgtatatgaaagaagtagcagcatttgaataaaacaaagtggtttaatatattaaaattcaatgttttaaataaaaaataaataaaagcaacccaaaaatttggacacataactatttaaaaaattaatgaaaataaaggctataacaatacaaaaatctaaaaaatgatataataatactcaaatttaaaatgaatatattaatcaatttatttttgcacatctccatatttaagaaaaatttaatgaaactaaaaatgaatacgacaattgcattagaatttttggtaagaattcatttatttctaataaatttaaagaatcaacccaaaaaaatttaaaataaaggatttcgaataaggtatgagccgcgtttggtaacaaagaagtaatcagaacaattcaaatattttataacagcacattgccaaacttgaaaattaaaaatgaaaaaattaaataataagcaaatgtagg

SEQ ID NO: 24007 - DNA, 886 bp, Heterodera glycines
tcccccggaggggcaggtcccttggccggttaaccacaattcccccggaggggcaggtccttgtccgatgaaccacaatcccccggaggggcaggtccttgcccggtgaaccacaatcccccggaggggcaggtccttggccggtgaaccacaatcccccggaggggcaggtccttggccggtgaaccacaatcccccggaggggcaggtccttggccggtgaaccacaatcccccggaggggcaggtccttggccggtgaaccacaatcccccggaggggcaggtccttggccggtgaaccacaatcccccggaggggcaggtccttggccggtgaaccacaatcccccggaggggcaggtccttggccggtgaaccacaatcccccggaggggcaggtccttggccggtgaaccacaatcccccggaggggcaggtccttggccggtgaaccacaatcccccggaggggcaggtccttggccggtgaaccacaatcccccggaggggcaggtccttggccggtgaaccacaatcccccggaggggcaggtccttggccggtgaaccacaatcccccggaggggcaggtccttggccggtgaaccacaatcccccggaggggcaggtccttggccggtgaaccacaatcccccggaggggcaggtccttggccggtgaaccacaatcccccggaggggcaggtccttggccggtgaaccacaatcccccggaggggcaggtccttggccggtgaaccacaatcccccggaggggcaggtccttggccggcgaaccacaatcccccggaggggcaggtccttggccggtgaaccacaatcccccggaggggcaggtccttggccggagaaccacaatcccccggag

SEQ ID NO: 24008 - DNA, 1770 bp, Heterodera glycines
aaaaaacattagtggtttgttctgtgactttcgtgtgagatctaatgtgtgtcatgcttttgaaaaaacattagtggtttgttctgtgactttcgtgtgagacactaatgtgtgtcatgcttttgaaaaaacattagtggtttgttctgtgactttagtgtgagacactaatgtgtgtcatgcttttgaaaaaacattagtggtttgttctgtgactttagtgtgagacattaatgtgtgtcatgcttttgaaaaaacattagtggtttgttctgtgactttagtgtgagacattaatgtgtgtcatgcttttgaaaaaacattagtggtttgttctgtgactttcgtgtgagacactaatgtgtgtcatgcttttgaaaaaacattagtggtttgttctgtgattttagtgtgagacactaatgtgtgtcatgcttttgaaaaaacattagtggtttgtttgtgactttagtgtgagacactaatgtgtgtcatgcttttgaaaaaacattagtggtttgttctgtgactttcgtgtgagacactaatgtgtgtcatgcttttgaaaaaacattagtggtttgttctgtgactttcgtgtgagacactaatgtgtgtcatgttgtgccataaggaaatgccacaagaaataagaaaagacgaggaaaagataagaacaagaagagatgatgaaaatgccaagaatgttgtgccataagcaaatgtcaacaaacaagaagagatgatgtgataagaaatgttgtggcataaaaaatgccacaagaaaatagaagagacaatgaaatgccacaagaaaatagaagagacaatgaaagtaaatgcaggagaattgagtcccagtgattgaaatgctggtgggttcagtcctggtgattggaatgcagtcccagtgattggaatgttggtggattgagtcccagtgattgaaatgctggtagttcagtcctggtcattcgaatgctggtgggttgagtgccagtgattgaaatgcaggagggttgagtcccagtgattggaatgctggtgggttgagtcccagtgattgaaatgctggtgggttgagtcccggcgattggagaaaaagccaagaaaaggatgcgaggccgcgaagcggccgagccagtcgattttatcattcaacaatcgtactacctagcgggggatgcgccgaaggtgctctccccgtgtagggagtaaatacatggaatgttttttttttatacaatatggcaaactggttattaggccatgagttcgagagtccgatttgaacagtatctcagagactcttaaccgattgcttttgaagggatcatcccgactcgacccgtccaatttgaatattgcagattctagaaatttcatattgaaaaatttttaatttttcatttatttttcttacttgtactcctctgcattttttgaaagtattcacagcatgatcgctcaaatattcccagattgaaggatcaaatttcaaaccatatttgccctctcttctgtattcttgtactcttgcgtctcttcgttgattaggccataagcatacccactcttggtccccataagatggacaaacttttctaattggtctattctatgggaaaaacagtttctttttcaccatcattattaattcatgatttgtttgatgcaatagacctgctgtggttttaccaaaagtctgaaatgtatatgatttcattaatgaaggccgagagacttggatttctcagccgttttcctttt

SEQ ID NO: 24009 - DNA, 1818 bp, Heterodera glycines
ttcggtgatgtttcgtgcatttctcttcagcattttcgggtctggttgaattttggtccaacaaaatgcaatttattgaaagggtaaaactcactccgctctcgggttccttcatcacattttgttgctttcgatagatgtcgaaaatgtaattgttgcgccgctcaacgtcctgccatctcttaaacattttttttgttcaaaatgccattgtcaaattgagggggcggaaagtggactcagttctcgacaatattaataatgtcaacaagtagcatgtttcggctggccagttatttttaatttgctcaaaatctcggcttttagatgaaattgccattgtccaattcgactcccgacatgccttgaatgccctccactgatgtatggaaaaggcacgcgaatgattcaccaacggtcgacaacactttttggcatttgcgcaatacatttttgctagttttattacattaaaaacaaatttttaaaattattttggaataaagcacaaacagaaatgaaagaagcaaaatggttctaggtagaaaagacctttgcgctttcactcacataaaacgtggaaaataatttaccaaacgaaaacaaatgataaaatcacttggaacaaaaacaacaacggccgcgggagcagtacaatacatttacaataaaatatgaaacaatttcaattctttttcataatttgaatgacgtcctcatggtgcagcttgtgatggatgccgacgcgttgtggtgcgtttgtgaatttggtgctcgtcccccacacaatggcatagcgaaattgggcggccaaagtgcggtgcagcgcatggcacgcgtgctcaacctgggcacacagaaagaaagtttacgggcacttttgcatgatttacttgccacgatgtatagagttttagatgttgtttaaaataaataaattaaattggagcctttcagttttcaaaaaagaaaattgtaaattcgtggggtgcaattaatcattcagtaaatttacctctattgacaaaaaaagtaccaacaaaaagaaaactttagaagaataaaacatttcattgatatcaaatcattgaaaaaatcttttttttctgagaatttctttttattatcatttgtgggcgaaggggaacgccctgtcccaaaattctcgggggttaactcaataattaagtaaaacattaatacaaataaaagactgtaccgtggaattaccgcgcagaattatgccatcttcaggcccttaaaatttggatggtttagtaaaatttaagaaaaacataatttaccaaggtctggcgcattgccgggctttttggtgtatattcggagcaaagcgagatattcccaaagctggaaacaaatgaacagaagattaaaaattgtaaataattgcaaattgagaagttatgaaaaaagtaaggatcagttgccctttaatgccgaatataaaatccatgtttagcactttcagtctccaaaaagttggcagaaaattacactccgatggcagtttgcacacaccttctccaacatgtagtccaggttcaggctcagctcgcaactgatcacaatgctgtgcggcagccgggcgagtcgttccatctcctcaaggctgatctggtcaattttgttgtatatgtgtaggcaggggatgtacacccggttgccctggatcacgtcgatcagttcatcaatgctaaaaaacggagaatttctaataagaagccataaaaaatagcatgggaatgaatttccgaggtcccggtgatcataaaaaaatttttcagacaaatagaaaaa

SEQ ID NO: 24010 - DNA, 1860 bp, Heterodera glycines
  misc_feature (1853)..(1854): n is a, c, g, or t
ataaaatactattcttaactgcaaatttgaccaaagattcgtttattttacaagctgttaacatatttcatttcactcaaacgttttaatttttcccggcggtgaatatcggcaccgccagaccccccccccccccaatgttccaaaaagttcgttggaaaaaccgcagcacaaaaaaccaatttaaaagcaaaaaatttaagagtgttaatttattatcaaatagaaaaattctcattaagcattgaatcttttggaattttaaaataatagacagtttaacgaaaattgttgaatttattttaaaaaattctagaaattttgggactcagaaaattccaagtttttaccggtatctttgaaaagattgacactttttaaaaccaataaattcagaaaattcccaatacattcagaaaattcaatttttttaaatttttttgtaatattgtctattaaatttaaaaaatactctatcatttacatagagaaaattttaaactgtttaaattattatattttcacataaaaataattaaagtacccggtttcccgtcccactctatctattcccgtttcccgttccccaaactggctgggaactaataacaagataaaaataagctaaataaatttaataaggaaattgattttatttaatgtcagattaaactacctcagtttatgtttacataaatacaatttattctagcttctctatgctcgatatattatgatgagtcataaatcccgctctgtgtgatttgctcattttgaattcaacattttaatagctttagtactgtgattgttttctattcagttattcgtaaattctttttcttatgttgtttatttcatatagattaattttaatgtcaaagctaaatctatttttaattaatttttggttgaatttttttcaaattaaatcaaacaaataataaattcaatattggtaaataatttatttaagttctaacaataagcatgaataaaaaaataattaaatcaattaatggtaagcactctatttcataaatagcatttgttgaaaaaatataatttgaatataaaaaaattttatgtgcataaacgcgatatttggccaaaagtataaattaatgaggagaaaactgtttgctaaggaaatctaaatacaaattaccctatgttgtcccaaatgtttaccgtgacaaaaaggcgggagattaacaaaaattgtattcttttccttcgctgaattaaatggtgcacatgtcttttatttctatgcttatttaggggggaaagaaatttttaattttttttaatttaccatggtttaaaaaattataaaaataatttatagcgaaaattgtctaattctcaaaatattaaatttttacttaatactctatatcattataagaagctttcataatgttttttgaatttcctaaattgatttcgttatacgtattattattatacatatttttaaattttttattattttttaatattttttcataaaagtttagctcgttcgcgttaatctatttgtatttatttagcatataatatgttaacttgaatatttattatataaaattatcaaaaatttaattcactttattaattgatcatatgattagaagaagctgttgacagtttcaatttttatttcactgttaaacaactattttttatttctcttaatgaatgaataagcgttttttttattgattatacattttgcttaatgtaatataatctataagagcataattattggggttttgtactcttgaatcccttaaagtatatcattgtaattaaaaatttatattagttttttgcagacctgcagnngcatgc

SEQ ID NO: 24011 - DNA, 1954 bp, Heterodera glycines
  misc_feature (1929)..(1929): n is a, c, g, or t
aaaatggtaattaccgtttcaaagtccacttccgaatcctttaaggcggccggatgcgaagaaaatgggctaaaagtgtcctcaacatgggccatctgctgatgaaaggactaaaatggcaaaggaattggaagtaatttaagcaattaaatattttgaaattaaaaatattatttttattatttttacattttaaaggaccaccaaagaaaaaagtgctgccacagtttttcagcagaagtacaataatagtgattttgtgcgtcttccgcctttttaaagcccacactcaaccaccggttgttctgcccctttgctcgtcggccttatcattgcccaaattttaaaagtttggccaaatgtgtcatgccatggccattttgttcatgtgcatggattaaaaattgacaatttgcaaattatctgtcaattttagttttatgtacaaataaaataaattttaattccaaaaatgattcaaggccgaattttaaagcacaaaatacgctcttgagtaggggatatcctggaaattgtgctcatctcatggaaaactgagattgtatttgttttattgcgttttttttgtcttaggttaaagcaattagcaaaaatcagcaaatggtaattagtcacaattaaattttcaatgatttttacaaattatagtaataaataaataaaatattattattaacatggaaaataaacattaacagttatttatttgagatggtatcgacttttctgtctgtccttcacttcgtaatgaatgacaaacatttttatgtgcatttttccatttccccgccgatgactccttttatggagatgatccaattttatcgcccgaattgtcgtccataaataattttattgcgaaaaaaaaaaccaaataaaaattctttgcgataacaaaagacaaaattaggcaaatgcaaaggctaaataagagttttggcaatgtaagaaggacatcagacagcagaggctgagcattcggacgaatggaagcccaaaaagtgatgcccataaaaatttagcctttgtttgccacgcgaaatgaattttttatttttccggacttttcgtcaataaacacaaaaataatggacttttcaacagtaaacataaaaacaagttttattagtaaaattattaaattttttgccagtttttctaaatttcttttaaatttaaatattaatgtgtgttgttaaatcattattactagggatacaattattagggttttacctattttttcccgagatccccagcggtccgaaacgcacgaaaatcatgttgtttttttgtggttgttaagatacttttcaagttattagcacctatttttaggttttggagaagaaagaatcttttgttttaaaaattcggtatttcaacaattatttgacttaattttgttgatttttggataaattttatgattttacactcactaaatttgaaacttaattattctttactgtcgaaaagtccccgcctaaaatttataaatttctgtgaaatgtcctttgctgtcgaaaagtccggcgcccccggccggaccttcctttttgttccaaaattctaattgtcaataatttggcatttattggggagaggggggcaccttaaagaaatactcattaatttgtaattgtgacctcgaaattttttggatgtcaggtttcccagaaatcgaattctattgacccaaaaataccggaattacattgcccgccaatgcaagaatttcaaaaaaatatatcccaattttttaatgaaatattaaataaaggggaaacgggactttcgtcccgttagccaaaaagtgactaagtgtacactggtaatctcgagctagagttataaaaggctacattgatggaggttttagttcccaagaaagtttcgaaccggctntttacatcaccttgatcagatcaat

SEQ ID NO: 24012 - DNA, 1698 bp, Heterodera glycines
  misc_feature (42)..(43): n is a, c, g, or t
  misc_feature (50)..(51): n is a, c, g, or t
  misc_feature (87)..(87): n is a, c, g, or t
  misc_feature (90)..(90): n is a, c, g, or t
  misc_feature (99)..(99): n is a, c, g, or t
  misc_feature (103)..(103): n is a, c, g, or t
  misc_feature (114)..(114): n is a, c, g, or t
  misc_feature (1608)..(1608): n is a, c, g, or t
  misc_feature (1635)..(1636): n is a, c, g, or t
  misc_feature (1639)..(1640): n is a, c, g, or t
  misc_feature (1647)..(1647): n is a, c, g, or t
  misc_feature (1649)..(1650): n is a, c, g, or t
acgccgagtttgagatgcagcggcagtttgatgaagcgacannctgcaanngaagaatttcaggctgcggatgagagacaaaacgcncancagaatgancagnagcaggacaangaggaggaaaatgtacagaatgctgcgcagcagcagcaatttgagagaactgtacgactccagttgcgcgagtcgcagcgcttttacggcggttcgccttcgtcagtgttagtgccaccggttcaattattttgggagactgaatgtgtaatatgcaccacttcaaggccccatttctatagcaaggagtgcgggcatatttatttatgcagtgagtgtgctgtcactgcggtgatcaacaaggttcgacgctgcatgttatgccgcgctagtgttagtggcatttatccttttgtccgttgagtacctttatggaagtaagaaaatgttaacatttcacattttcagcttaaatttgtcttacttccataaaaaggtgttatttgaaagttggaaaataataaaaaaatgaattttaggatatacaaaatttcaaattttgtcctctattttttacaattatttctcaaatgattctaattttggtaatattcgagctttcaaataatagaagtgtttgattgtatgcgcggcattgagtattggaactaaaatcatgatgaattcgttttcttgaataaccgtattaatccttttctgtttgttcgtcacttttttttcaatgatttaactgatgtatgtctttaataattcattatactctcaactcatctcatatgataatcaaccaacagttcgacaatttttccgtgctttttgttaatgcaatcaactccagcatatatttgtgtttgacgaaaataaagtgtaaatcaaattgacagtgaaagttgatggtcatttttaaaattaaatgtaaaaaaatggtgaatagagacagaaagagagagtgagagacagaaaaagaaataagcccaaagccagcgctgaaaagcaccgacctcaccaaagtgggtgaacagagagagaatgagagagagaaagcccaaagccagcgctgaaaagcaccggcctcacataagtgggtgggcagagaaagagagagagagtgaagcccaaagacagcgctgaaaagcaccggcctcacaaaagtgggtgggcagagaaagagagagagaaagcccaaagccagcgctgaaaagcaccggcctcaccaaagtggatgggcagagagagaatgagagagagaagcccaaagacagcgctgaaaagcaccggcctcaccaaagtggatgggcaagaaattttaaaatttgtcgagaaaattcgtatgaaaggaaatgatgaaagggagaaaaaagcggaaaatttaaaaccatacaaattgaaaatgaattaataaaaagaaaatttaaaaaaaaaacaaagaataaaagttgtaaaataggacaggaggaaatttttcaacaaatgaatttaaatgaataagtacattgggaattggaggcgtaatatgcccctagtaaaagatgaataaaatatgtgtgtgtgtgggagaaattgtgaccagaatttccttgagctcaaactaantcaaatctaaaaggaatatggggtgcnncgnnttggatngnnattaactttaacgttttaaaaatgtatagctcattttatgtctttatt

SEQ ID NO: 24013 - DNA, 891 bp, Heterodera glycines
  misc_feature (883)..(883): n is a, c, g, or t
tgagtagagctcgacctggacctggatccaggcctggatttttcctggatccaggtccaggccatttttcggcaacctggattttcctggatttttgtccaggaaatccaggtccaggtcaaatgtgaaaaaaaatccaggtccaggcatttttcaaaatgtcgagctctacttttgagttttccaatgtttttccttcattttcaaaatatttctacccacagatttcggtttttccataaacaaacgtaaaattttcactcacaattttacgaattttcaaaattggttattttaatgtggttaaatactggtacaccccacaaatgtggttattgctgttttatttttgtgcagatgccccactccgcgttgcccccgttgcccaagaatcggctgagccgttcgttcagcaccgcctccgtgctgttgacctgcctgaacgcgcactgtcaacgcgtggcgcaaccgtccaacaatttcctgtgcgacgcgtgctttgcggctcagaagcgcgagctgacgcggacactgatcggcggcagcggcgccgccaacgccgcgctggccgccgcttcgtccgccgctaacatatccgccgccaccaccggcagcggaggaggaggaggcggcaacaacaaaggcaccgccatcatcctcattagggctaatgatgatgatgataatgagcaaaagcgaagtggtggcagaaagaacaacgccaccaaaaatgagagtagtatcagcaccagcaattcccatcgttcgcattgtgatatttccaccatttgttaattaattgcctaattagtagaagacaaatgcagcagggatgggggagagctcgaaagcacttttggcattcgtgtttctttacaaatgnggttgggt

SEQ ID NO: 24014 - DNA, 2120 bp, Heterodera glycines
aaagtgaaaagagactgacagagaaagagagcagagaaacattatggagaggaagtgaaagaaaaaatgaaaatgagatacacagaggaatagaaaaataaaatgaaagtgaaagaaagaaaagagaaagagacagacagagggaaagcagagaaagaatgaaatgaatgggtaaaagagacaaagagaaaaagagaaaatggaaaaattaaaagggaaagaaagaggaaaaagagcaattaaaagaatggagagaaagagaaaactttgggggaaagaatcaatgataaatagaggtgctcaattataaattatatgaatataaaatcacgaaacatggccataaaattacaaaaaaaaattggacagaattttttcaaattgatgataaattctcaacctttcttaaaattcgttaaatgaagctaaaaataaactaaaaaatatgccaagctaaaacatgttttcgtgcgctacaggcctacagtccatgaaaaaaatatgaatgaaaattggacaccgccggaatttgtcaaaggaaaattggacaccaaatccctattaaaaaagtaaataaatccagcaattaggtgaaaaataaatttgtgtagggtaaatggatgagtgaagtacggtacttagggtagatcagcaggcatcccatagtgattggtcaaaatgtgccaaaattgaacaaaaattggaactttatgaatgctaatgatgactttcttctgctgatgataaaaataattttaaaaatcttaattttcattttatttacgcttataaacaacttatgtatgtatgtgcagataaacaaaaagatatttttggccaatccaaaatttttgtttatttatttatttttgtatccaatagtgtccaattttccattaatgtccatccaattttctagtgtaaattttcggtgtccaatttaccgggagcctggcctagggagtgatttttttttgaaaatctaaaaatttcagaaaaaaaaaactaaaatttacttttatgaaaaatttttgaattcgatttttaataattgaattatttggaaattctctttaaaggattttttttatttaaaaaaatcaatctgaattggtcaaaattctgaaatgtacaccaaataattaatgcattgccaaattaatttttttttttttgaaaattcccgtcaaaatttcaaagttcttcattctcttcttcatcaacatttcaattatatttaaacaaaatttgctgttttattatgacgattgattgggacggttttgaagagaattgtgaaaaaaaaacattcggattatgggaagagattcagcgtgaacgaaacgacggacgaaacaatttttctcttcatcatgctccatattttgtttttgtttttgatcattttctttgatcaattcatcgctttcgctgctgcaagaacagcgtggccgtggcaacgtgccggcgtggcctcgacggcatcggcacaacagacgcatgggcagactgggccgcccgtttcctgaacatcggcttcagcatgtccaccagctttttgcatatatccctgaaaaagttgtgctagttagctggctttaatgccattaaatcagcgaggggaacagcaggaggatgggacactgatctcgacaatctcgaatacccggtgtactagaacccaccgcccctcacatggagataggagggcctttttcggtactcccgaacccatgcagttgcgcgctcggcaccatttccaaccgggtcaccgacgccgaatatccttcctatcagagacagcttcgctccctatagtacgattggcttttttggcattttcccatgccctgacttttcggcactttcttggcagaataatccccgaaaatctttggcaatcgtgcccgaaatgtgcaaaatttcccatcccatgcgttatggtgcgcattttcgtgtcgtgcacacctggcatgtttgttctccggaatgaagccttgctgttggagttgtggcaaaatttcgcagaaattgaacaccgcgtgcagttcctgcttgctcagcctggcctcctccgaaagcctcatcatcatcatcatcgttatggttgttgttcattt

SEQ ID NO: 24015 - DNA, 1889 bp, Heterodera glycines
ttaattttctcataaaattgcaatttttgcttgttttactttttggttaaagccaaacggttggtgctttttgcgattattttgcggcaaaaatacgcccggattgagcgcaaaaacgcgaaaagtgccgctgaagtcatcgtcaattttgaaccaattgatgcggcctattttgagctgttgcgtgacattcgccgcgagacggagcgatgggtgccacggcagcgggagattaagcggctttatcgcgtgtgccgaaatttgaaccgggcggaacgggtcgaaattggaaaattggtcgacgcatttttgcgcggacaaagtgtcgacaattatttggaaagccaaacaacaaaaagggacaaaaagcgaggagcaaaagcaccgtgaaaagcggggacggcacggatttctatcattatttattttttaaaaaaatttaaatgcaacttttattttttcttatttaataagaaaaagcggtagaatttaaaagttgcaaatgatttttatgtgcaagcaatttattggagctgataaatgctgttgaaaaggtgcaaataataattattctattaaataatttaatttcctttaatctttcgttgtgttgtaaaatttatttattcaccttaaataactttttgagaaaaatatatttgttataacttttttaaaatcacaaaaaataaaattatggttgcgcattatttagaatctaacgaaacttttttacgaaacttttactatctaacggtaccaagcatgttagtaagctaatgagttgagaaaagttatacgaatctttatcgaaaaactacatgagatggcttttagctgttttgtttagcatttatttatttggaaaaataataaaagtcattaatatgaaaaatttatgaaacaattataatttatttaatttatattttcatatttatgtatgatttccggtgacaaaggcaattattgctaatacataattaaaagtcaaaaaaatctttgaaaaagctgctctcaaaagagaatatctgtgacgttttctccgcaaatccacggcaacaattttgcaaaaaaaaattaaaaataaattatttgaagatattgaaaaattggaaatcatcagtgcgttattatgaagtattttaagagatttgtaactttcaattaaatattaaatgttgcattgtcggaggatttcggagcttatgggggcacgaattaaataaaatgaacgaaaaatattaaatttattaaatttttgaaagaaaattacaatttaaaatatacagaagataaatagaaatagaaaagaaggctatgattatggtggttatggttactgtacaagtcaccacacgcaaatggcagtcggaataattatggaatttgaaatgaaatagaacggatacggtggtggtgaattgtcagtcaactacagtatggagggctctggctgacaatgatgagggtggtacggtaaagccattttgtggttggtattatgattataataatgataaataataatacacgttttgcccgtcgggtgaacctgagatgcttccgggaaaatgcttctcgcgccgtcgccacagaagaggaaaagcgatggcacagaaagagagagagagagaggagaagcaaattgcccgtccagtgaatggttaagtggtaagaaaattatgcaaaaaataaatttaaaaaaatgtgttaaaaaaatgtaaaataggcaaatttaatttctctattttttattttcaaaattttttggtaaaattaatgttaaaatttgcctgagaaaagttaacaaatgacctaaaataaaacaaaattgcgatttgcatcccagtgatcaacgaataattgaccctatgaccttgatacaa

SEQ ID NO: 24016 - DNA, 1995 bp, Heterodera glycines
tttcttgtaaattgaaaaaatatttttcagtttatcaacatttttacgtgccaaaaataataaattttgaatttggtataaaactatgattctgatttacaacctttgccagtgcttttattttcttcataatttatatgattgccacgaatccttatgcccttgcctaactttttgaacaaattttctttaacttttcctcgcgatacctacagaaattgatttttcattataaaacaaaaataataattacctgttgcctcatgaaaccatgcccaacaaagtccaggttataaaactgcgcttcgtcctcacaatcagtaaaatcatgatagggttcacctgcggtagaaattaatattttatgtaatatccgaataagaaacgtataatcgcatctgcaattaggttgccatttactctctagtactagtatttctaaaatttgcattggtttttttcattttccgacggagctcgacttttgtgttcccaaaaattttaaaaagggccgtaaaaattgttgtgaaaaacaaaatataaggttcgtctttgtctcttatttgggttgggactcggcggttccgttccgaggcctccgaaaatcttttttttttgcaatattacaccatacctttgttgatttgcaactgcaaaagttgacgtctcctggtcactgatttgtattctttgttatttatcctttggcgcatttggtgtaagaaaaatgaggcaaaattctgtccaggtcttttcaggaggtcgcacacaaattgggccctttcgatgttaaaagtcggcggaatggtccaactgtaattgaattcggagagggacgccagcgaagggtccgagggaattacatgggacaaatgggcgaagaagcgatttgggtaattaaggctttgctctgtcgaaatgacgcgaagacgatagatataacgcctaaaattggaaaattatgatttatattaatgagacagatgccaaaaaagcatttgtttataccaaaatgagacaaagggaaacgaataaattacagacctataggaaacatgaaaacacgggtgaaatcccattgcgacggggtcaacgtgaagcaattcgatcgcattcgtaaatccattattgcgaatttggtctgaagttaattttaaccaataattggcagttttagaaaatataaatccgacctccaaagctgccaacttaaaaattaccaatttgtgaggatttttccaagaaacataggctcattttgaaaattaggcctggctaaaacctcacagttggcagcctgtggtcataactccgtctaatgtcctgatattccttaataaataccattaaaacatagaaggaattctgtcctggccaattctgactgactgaaccagtcgcaagcgacgggcaatccgatgagaatcggcgatcgaatggcgtgcactttcgcatccgttcttaaattaaaacaataacattaattaacaatgaatgaaacattctttgattacctgcttatagcgaacgttttgatttggtccgaattctctgtagcaaataatttttgaagacacgattcgaccacctgcatgacacttggcccgttgcgagagtcagaaccctttgccatggctgggaattttgaaccatcataacgaaaccaaaaaagaaattttcgaaaactgctggcgatagtagattcaatttttgatgtcatttctgagaaagtttaagtcggcgtaatattagaaagtgaattcaattctggaaaattcacatgcatttataatcctggattcttctcgaagaaatagagaagcacaatagtaccatttagaacgcggcgacactttaataaaagttacgagtcaatgacaaactcggtacttgtgcagtttacgcggtaatagtgcagtttgtccccccccccatttttcgaaaaaaataaaaagtttaaaatttatgatgatttttttgggcccaggtcgtttt

SEQ ID NO: 24017 - DNA, 2099 bp, Heterodera glycines
aaaacaaaatgcgcgtctaacatttgcaaatgaaagttggataaaaataatccgtcaaatttgattttttatgattgattggggggtagggctaaaacgcccggcaaaatgtcatcatttgcaaaatatattctcctctgttgcgtgcgttccttccattcccaatgcactgccattccctttttctgctcgctttttgtcaatgatttttcgtctcccattggcatattgtccaacccctcgggcccatttgcaacaatttaaggcaaacaaaattcaaaagttgtttggataaaatgtgattttcgttagaatttttggttttccgcttttctcattatataaaaataaagtttccaacgcaattaattcttctgctatttgtgtgacatcattccgaactcgtccaaattgtgctaattgctgccaaaaatgaaccgacggtaattaaattaaaagtcacaaattcgtcatttatttaactaacaataaactgttttccataatttcagttggatttgcaacgacgtttggatggacattttcccctcttttgaccgtcctcaactcggcctcaaattggcacttctttcgccacgtttcaatgcgttggtggacaaacatttcgatggcaaaagcgaattgacaatttggagaacgatcggaattcacaagggcaaaggaccagaaccgaagctgtctgtacaaattggtgacaaatttgtgccatttccattgcccgaccgtccgttgaccagcaaaatccgttttaagcatcttcggattgagtaattaaaaatcagagagctatgacaataaaagcattctttatttttgttcgtgaaatttggccaattttttctgaaaacattcgccacttgggctttaacgatggtgatcatttggacaatttgcgtcgtcaaatttcgccaacaattctcactgatctgaatcagttgaattcaatctattcctttgatcggttgccctctgcgtttggtgatggttttgatgggccaatttctgctggccaagcattgtccaaatggttgcactctccgagaaaagatggacaacccaagcgattgcgttgctataattacaacgaacaagcgaacactgattggatcaacaatttcaaggaggtgtggtccggggggggggggggggtggacaaaacgtagcccgcaaatttttattttaattaaaaaaattatttaaaatttagttacctagcctaaatcaaaaaaaaatagataaattcgaaaaaaattattaagaaaattcaaggaaatgtaaaaaagtcgtttttttatttttctggaaattcagaaaattagtttttatacgagacggcgacgttttaggggcgtacccggtctgtggatggcattctgagttattttctgaaacccgaccccaaaaaagttataaatcgaaaatttctgaaaaattccgaattttatcaaaaatttcggaaatcggaattcagtgccatccctggtgtggccataattcgacaaatcactgattgttgttttccaatcaaattgtttagcattttcttcgtgccaatgccatttcttccgtcagttaccaaattcatttttctgttcctgcgccgtcaatgccaatggtgccgtttgaattggtgaacgaatggacaaaggaaaagctgacattggccaaaacaaatgaatgggacatcgattggataatgaaacgatgcaaaattattggggagaccgcggcggtttattgggaagacggaaattgggacaacaattgtaataatgtgtccattcgtctttttatttgttccaattgcattgggtgagcaattaaaaaaggcatttaattttgtttaaataattaaaatttcgcttaatttaggccattgtctccgccaccgaaagaagaagacgaagcaggacaaagcagcgaaaaaggggcgtcgtctgctgacaaaatgagtgacggacaaaagaacaaaaacagtgatcagccgcagaagaaatgaattaattaagaatgatcgatcgatcataattcatccgtgatcaaatgcattttatgaagaaaaacctctcaattgctaa

SEQ ID NO: 24018 - DNA, 1888 bp, Heterodera glycines
atttcccaccaaatttttagacggttttggcgaaatacctcctaatttttcattttattctgtgcttttggtgtagatgatggtgatgccaccggtttttctttttttgaattttcatttaattttaccaaaattttctttgcattttcttcgcccacaacgaattccaagttcggttggaaagagtttttatttaaaaggacagctaaaaattaaaatttatgtaaaattaagggacggatttataatttttttaaacaaaaatgccctccaaccaatcggtctttaaatttcaaaaatgcataaaaaattaatttcatcagatttgtctcattagtgataaaaatatttgatcacggcttataatttagcatttaatttaattcgaatatgaaatttggttttgtcatttatattttcgccgcaagtattttatttggcatttttttgtaaaaatttatttttaaatatttcgggcttttttcattaatttaaatcaacattgccctaataaatgtgtaaaatttgcaccgtttttcatgcgatcggcaaatgccggctcttctctgatcagtgttccaattatgtcccaatgcagtgatcgcttccacttttcgtacgcccgtcgcttttccatgtcaatcgttttcgcatttcccttctccattatctgtgcccataattcgtcctccaacactttcgtcgtgtccttctccaggcactgcttcaacttgtctaataatcctgtcaccacttctcccaattggcgcacctttctctcgtcctcttcccaaattttgtcgtaaaagccctcaaaaagttctattcgcgtctcccaacttttttcgatgcgtttggtggcgattgaacgccgccgcgtcagtcccaacttttcctccacccatcggacaaaaatgatcacatcggcgagcaaaaggtgtacaattgggtcgtcctcatcccttttcaaattggcgccaaacaaaattctgtcataatgcgacagaagcactttgttgtccgagaaaactaaacaaaaaattggtcgttcattagtagagaccggatttttaggtgctaaaaatcctgaaataggtactaaaataggtgccaaaaaagtgcaaaataggtgctaaaaacgcccaaaatgcaaaaatagttgcgaaaataggtgttaaaaattggaaaaatccagtgtctttatgcactaaaattccaaaagtgactaattttttaatcaatttcgctcgcacaattgcaactggtcaagaaaataaataaataaattttggagacgaattttcggaaaatttttcctttcttagggttatatttactgaaattttggttaatttttaggggtatattttctcagaaatttttgggatagattcataggggtgtatttttcgtttttattgcatttttgctataaaatttctgaaaaaggccaaaataggttgctaaaattcgaaagtgccaaaataggtgctaacccccccccccccccattttaggcttttaggtgctaaaaagtcgctctaaatcaaaaattgttcagagaaaatgtgtttttcgtgcttctctcatcaagtactaaccgcaaaaaaaataggtaaaaacttaaaaatccggtctctattcattagcaattcataaatcaaaaggcatttcttgattaattactagggcttcgttttttcggcaaatgccgaaaattttgcgcactttgcactttatacgctcagataagcatgaaaaacgcattttccgcttggtttagggtataaaatttaattatttttcattgcacatgataaaatttttaaatgcccttgaatttaatggaatttcccttgtgtccttggaaactggcatacccgtcctt

SEQ ID NO: 24019 - DNA, 1911 bp, Heterodera glycines
  misc_feature (1896)..(1896): n is a, c, g, or t
tacttactcacccaccccaaaccaataaagccaaattcccgcctgtcgcgtcgctcggctcgggaaaggggggggggcatctggcactccgcaaaacccaaaatctgccacctggtgccctatcaacgcatgacaacaccaccaactagagcccaagcgggatcgggatcccggcttttttgaaaaaaggcgggcattggggcgccgaaaccggtattcaatcccagtaatcctatcccggcctgattccgatcccgactttttcaaaattccgggctctaaccttcagcacattgctcttcggccctccgccccctttcggcggccctttcgtttcgcgcggcgtcgtcgaccggcgctgttggcgctggcggtggttgcgcagcagcgacgcggccgacgccaatttcgtcgcagcgggcggcagcgactcggaaaaggaattggcgttattgttgtcgttgctgctggtgtcgttctctgtggaggaggaagtaaaataattgccaaaatgtaaatttttcattaaaaacggaatttttaaaattttttttgaacaattagacaaattctgacaaaaacccaacgacattttgcaggtggcgctgtaaggttttgaaaatttgaaggaaatcaatgaaattttggccatcgaacaaagagtatgggctgggtccacttggttatggctatttttttctttaatttattcaacggagatggataaaaggcaaaaaagaccgtaaaaccaaaaaaggcgtttttgtttgcccaaaaataaaaaaacgcttgttttcactcgacggccaattgagtaccgaaattatttggctggtcctggccgacaacgccttgctgctgctcaacaccgtcgttgtggtgctgctgctgatcagtggccggcaaaagcaacgcattgttttgggcggtgacggcggacgatgcgccatgctatttttttcaaattaattcggaggtccgataaattggcattaaatttttaatttattgcattttgaaagagggatttaggcaaatttaactcaaaaattctttgctaaaataaacaaataaaagcatcgatttcattcacttgctgctgctgttccttcctttgtttgtcgcgctgatttttcactgcgcctccgccgcttcgattacgcgccatttttagggtttaagaatttagaaaattttaaaaaatatggtcaatctcctttaaaaaagcattaaggaaatgagatgtaaaataaatatgacagacaaaaccgattgaaattttcaaaaaatcaggagactgtataaaagtagaaaaagaaattcaaataaataacattatgccaaaaatagatttaaatgaatccgacaggcatttatacagtgtcagttgaacttggttaattacctaattaggaaataatataggacaaatgacaccatgctggaggaaaaaaaggctaatttccgcaaaaacaacatttttgtcccagctctatccacgtctcagcagttccattcatcaatctccgttcaacttttcagcaatattccggggctctaatctctaataattagcaattattagcagccttttatgataagtaagtgcctgctgcgcctctgattggcactaaacacttttgtatctctctgagaaatttcgaattatggtgaagaaggtgaagatggaaggaacacgtgctgcacacacattttgtttgtgtgtacccgcccgatcgctaatcactactaatcactaatcaggtgagcgaccgccgtccgacgacccatttcttttttttttgcgttttgcccttacataatgaaaaacaatgagtaagaggggaatatcgaatacataatcttcgtctctctttcgtggcatttcacccgaantatttgtggggacct

SEQ ID NO: 24020 - DNA, 1752 bp, Heterodera glycines
agtaagcatttgcctttttgctctacgagaggtttccgtcctctctgagcttgccttaggacacctgcgttacgctttgacagatgtaccgccccagtcaaactccccgcctgacactgtcatcggcgcgggtcgccgggccaccgggtggcccgacttaacaccaaaatggacaccctttcgggcgcactcccgttttaccgattaagtaaggaatcgatgaaagtagtggtatttcactggcgccttgcggctcccacttatgctacacctctcatgattcttcacaaagtcagactagagtcaagctcaacagggtcttctttccccgctaaatttgccaagcccgttcccttggctgtggtttcgctagatagtagatagggacagtgggaatctcgttgatccattcgtgcgcgtcggtagttagccgacgaggcatttggctaccttaagagagtcatagttactcccgccgtttacccgcgcttaatcaagtttccttggcttaacattcagagcactgggcagaaatcagacacggtcaacgtccacaaggaccatccgtctcctctgttttaattagacagtcggattccccgagttcgtgccagttctaaactggtcgttcagcgccaaccgaagtgcataccctgacgagcatacacgcagctgaagcgctccacaagcagctctcaccactagtccacgcaccatccccgaaagaacagcacacagccacgggcaaaagccgcctgtttcacgcaacagcccggctgacccgacctttagagccaattcttttcccgaagttacgaatctaatttgccgacttcccttacctacattattctatcgactagaggctgttcaccttggagacctgctgcggatatcggtacgatcaggcaggagatcaaatagctccctcgcatttcaagggccgtgtggagcgcacgagacacacaggaaccgcggtgcttacgggcgcacatccctatctcaggctgagccacttccaggcacgcacaccctaaaccagaaaagagaactctggctcggactccacacgacgtctgcgagttcatttgcgttaccgcgcaaaacagctcttgcgaaccgtcatttccctagcctggcgtgggaatgttaacccacttccctttcggcaaccggatggaccaactgcgcaagcacagaaaagtcgtcatccgtagtgtgttacggcgttagccggtgccttaggatcggctgacccacattcaactgctgttcacgtggaacccttctccacttcagtcttcaaggatctcacttgaatatttgctactaccaccaagatctgcactggtggaagctccggccgggcccacgcccaaagccttcaacgcaaccaccacgaccctcctacacgtcatggccagactacgcgacaagcacgtgtacaagccaatgacggtggagtataggtggcccgctccagcgccatccattttcagggctagttgattcggcaggtgagttgttacacactccttagcggattccgacttccatggccaccgtcctgctgtctatatcaaccaacaccttttatggggtctaatgagcgggaactttggcaccttaaatccacgtttggttcatcccacatcgccagttctgcttaccaaaaatggcccacttggagctcaaacattcaacgcctgggtacagagtcaagcaaccctggcttcatacccatttagagtt

SEQ ID NO: 24021 - DNA, 2640 bp, Heterodera glycines
acctcttttgagtttttaatagagaggcgccagaaatgaacatttttaaaaaatttaaataaattacaaaaaatgcgtttccaaaaaacggacattcattagcacactttgtcaacaaaatgatgccaaacctgaaggtggcgccgcaatcggaggccaatttcgcgctgctccgactccaaaaggtcgagccgttcagtaaaattgagaaacaaactgaaaaagaaaaacaaaatttcgaaaaaaaaagtttccaaactcccccgaggccatgtacaaatgggaaaaaagagtaataaaaattaagaaatatgatttttggaaaataaattcgaaaaattttggacgtgtgccgcccattcactcaacaaaatttcctttgaaagtttcgcttaattcggttacacccaaaacagcattaaaattaagaaaataatgtgttcaattttattaggaacattaattctgctgtttgaataattgacgatttttcaaaaatttacagttataaaatgctatttagactatcagggattgaaaaaaatcagtttgaacccgattttagacacaggcgcaaatgtctgggcacgttaatttttgaaaatcctccccagcgacgccttccgaaacagcataatcttttttttaaaatccgcccataaaatttaaagaagtttaattttgcaaaatgcattggatacagttttaggggcgatgaaaaaaataagtcctcggaatccgctttttgaatatttttttctgttcaaaggcctgctggaaaacgaaattcagtatacgaaaaattttgggaaattgctaaaaaagatcggaataaataaatttaacggcccaaaattatgagaaaaatgcgaatttaggcctcgcttgcgatttttcatgcgaaaaaactcggttacaaattgtccaattttaagggactccgttacacataggcaaaaatgtaagggaaaatattttatttgaaaaaagtacggaatggctgcaaattttaccaattttttctcattgtgatacactaccaaaaaaaacaaacaaccaaattctgagaaaacggttaaaattggaaaaacggtttcttcggcttggcccggccaaaaaaataaaatagaatttaaaaatttgaataaaatacccgtcgttgaacgggtggtcgtacatgagcacgtcctccgcccccgttgctgtcgattggtgccggggctgtccttgctggtgcccggcggcaatgccatcatcgaagacggccatttcataagccaaaaaatataataataataataatctactttaaaaaatttaaataaaaaaatgctagacaaaattagaagaattttaaaaaacaactgatcagagatggcgcgggaattccgacccgaattttgggctaaatttcaaaacaattcagatttttttttaattaaaaaaaacatttcgccaattaaaaatgttaaaaaatggatgaaaatctgttaaaggcgtgccttaattttggagttgcattggaccgagaattttagaaatacccggaccgggactgccgggacaggaaagccgtggcgggacttggattctcaacaggggaccgggaccaatcgggaatttaaaaaataaataaataatattcaaaaaaatctaaaaattttggtggaaggaggacgacggcggtgccgatgggcgccgccgaagaaaatttgaaattttgttgtgattattaacagatcttaccaaaatggtcaatttgcaatatatttgatcttgtgtgcgaattaattaaagctattttttaattaatcctaatgactagggctgcaaaaaatatggatataaaatcgcgaaatatgctcataaatatgggccaaaacaaattgcgaaatatggacataaaatgccgaaaatatggacataaatttgtgcaaattgagggtataatttttcaaactttcttcaaattcgctaaatataaagtaaaactttcaaaaatggctaaatactatattaaaactcattttagttgaaaaagacgatacagcttaaaatttactcattttacacggcgagtcaattttgggctccaagtacaattaagttggatttttcgtcttagtggtctgtgagttagtcaccaaaaggggggtctcaggttcgattcccagtgcatgctatagctgtattttgaggtttttaaaccaaataaataagtgtgaaatggtaacacaattttaaagaagcttaggatttttttaaattttattcatagctattttcctgtaaaattaaagaataaaagtttaaatccaactgtgtttattcaaaatcgaattgttcttcttctccattgctatcttcgtccgtctcccgctggtctccaatttctccttgttgttcttcacggtcctgaggcatgggaattttatttgaaaccaaatttcaccaaactgacccgcttcatttcgtcgatttttcctgtgtcgagaagccaatttgacacaaaattgtgttccaacaattttcgcatttgttcttcatcgggcattgtcttccaaagctgttccaaccgcatccataccgaatgcaatgcttcatcacctaaaaaattcaaggcttaaattcaaaatgctt

SEQ ID NO: 24022 - DNA, 1673 bp, Heterodera glycines
aaatatttctgaatgtcacagatcccttcccatttgatgacctgcaaaacgcaatccataaagaattggacaaacagccagcgcaagggatcaccgacactttgaatgtttgggtaacatttactttcattttctttttgggatgaggcaaaatcgccgcctaattcttttttatataaaattggacatttttgtagaaattagacagttttttataatttcatggaaaattctttcccactatttttttttttgaatttttatgataagttgccaattttttcaaaaaaatttcccaaaaattgatgaaaaaatttatcaatattattttattaagatttttaggtttgaaaattaaaaaaaaaattcaaaaaatcgctgaaaatttcccgaaaaattttttttaaagaaaattttcttatataaactttctaagatttttttcttaaaaaatttctaaattagcaaatttaaaaaaaaatttctttggggaaccgagctgggggtgaactgatacaggggggggggagggaaatgaagtggaccccattttttatatacaccaatcgcaaaaaaaacacttacatcgcattactccaactttctccaggacaacaccattgagaagttctattctggccaaatttgatttggcagcgacttttaagaagaaaagaagcatcggttcgctcatctttacacactttctattccttaactttaccacacaaatacaaatattatttttttcttgcgcattttttcttttatttgcttaagtattttcttgtaaaattagatatattcactgctacaaaatatgtatgtgtaaaatgaaaagtataaatggttttttgggtacgatctgttgctgaatttacggtttggaaattttagtcggatgggactcgaagttagcctaaatgttgttaatttgtttgacgggcgcttcgaaaaccgcagaactctttcacgatctcatccggttattccaaatggagaactgacaccgaaccaaccggactgggacactagtctgcccgttatagtctgagccaagtttagagcatcataactttttttcatcaacagcttctaaacatatagggctttagaatgatgccaaatttataaaatttggcccgctgagaaaaaagttatgatactttaaacttggctcagactgtaacggccagactatagtgtccccaccccgaaccaacagttcgcatggtccatcattttttcagggcgacactaataaaaagggtacttttccgttttggggccaaagtttcagtttttttttaaatcaacagctggcgagttgatttgtaatattcttcattcccatagcatagtgaaaatccgtggtgcagacccattcgaagggtgatgcgacatttgcggcgctgacatttgcggcgctgacacttgcggcgcagacagttgcggcgctcattcaaagcgacacttgcggcgcagacatttgcggcgtgacacttgcggcgccgacacttgcggcgacgacacttgcggcgccgacacttccggcgcccagtcaaaaggacacttgcggcgccgacacttgcggcagcccagtcaaaaggacatttgcggcggcgcaaaattcaaagagcccaaaaatatttcaacaatttatttccattaaa

SEQ ID NO: 24023 - DNA, 902 bp, Heterodera glycines
agaagtcggaattttatgtcagagattttacgccctccttgcgaattgcataccaagatagaaaaatttttatacatttgatttttggcattttgatttgctacctaatttcaaataatttcgccacttttgtcggtcgggatcggtttagtacgggccgttttagtacgagcgcaagtttttggctataacttttttctttgccaaccaaattcaacaatcttggtatcattcgataaccctaagtgtcctctattagcgcaaaatttcgaaaaattttgttaaggttcaaaaaagttatggccagaaaaattcaaaaaaccagattatccaacttttttggctcaaactttttttaagcttaacaaaatttttcgaaattttgcaggctaatagagcatccgaaggatatcaagaaagttggattttgaataacaaataaaaaagggggtaaacccaactcatccaaacccaactcaccatgcccaactcatccatacccaactcatccatatacccaactcatccatgcccaactcatccatagcacgatacgagtcgtcgccgtggcatttaatgccacgactaagaccgtacaaccaaaaaatactacgactaagaccgtacaaccaaaaaatgccacgaccgagaccgcataatcagaaatgtccacggccaagaccggcataatcaaaaatgtccacggtcaagaccggcataatcaaaaatgccacgactgagaccgcatatcaaaaatgtccacggtcaagaccacataagcagaaaatgccatgccacgacgatgactcgcagcgttatggatgagttgggtctatggatgagttgggtatggatgagttgggtttggatgagttgggtatggatgagttgggggtgactcg

SEQ ID NO: 24024 - DNA, 961 bp, Heterodera glycines
  misc_feature (912)..(912): n is a, c, g, or t
tcttggacagaattttgagaataattaatgttctgtctttcaagtagcgccggttccggcgtataaaattagtttcttttttcaaaatttaattttattactattaataatttttttttgttccaatagctttgcatcggcccacccttcccgaaccggacccttaacaaaaaacggagtatttttcgggtgccaaacggattatcgattacgtgttggtctatgaagagaaggaaatgacgaacagcaactacaacaacaattgcgctgacaacaacggcttttcaaaaaatccaagaaaatttcaagggaaaattgaaaaatttttcagcaattgtttctctgctctgtctgagtgcccatttcttagccggtcttcacgcgttggaacggctctgacaactttccatggatgccaatgccatcggcggaggggcgaaagacaacgcaaagggcggagagacggcagacgccgaggcaaatttgttttaaaacttaaatttaattgtttattttttgtttcttcagctccctctgcgcagtgcttccctcgaaaaattggatctttcatccaatgccttgcgcagagtgccgaccgaattggtggcccattaattgcatcccctcaaaattttgagttcggcggcgatttcaatcgaacggatggaaccgaaattaatggccaatttcagtgcattgaaacaggcaaaattaggtaatggaagttgaatggacaaaccaattatgtaatttggccattttcagttggactttttccaaaatttcctccgtttttgccctttggaattttcgatggactcgacgaattgcaagctctgctcggattggcctcccttcaatgggtcaatgtcagtaaaaatgtaatgtgaaaagagaatggaaccaaattanatctaaatgaaaattcagttggaatggtgcccaattcttggccgaagct

SEQ ID NO: 24025 - DNA, 1823 bp, Heterodera glycines
tattaagttaaagtattttaaaaatatacgtccctagttgattcatgggcccggtggtaccgacaggctccaccggaaaaatatccaactttttaatgcgatttattcaaaattttgatcaagattactatttttaaggcattaaaaaaaaatccaaaatggcttcaagccttcttttgagaatttagccccattgcttcacaaaaaccacaaaatgaggataaagcctcacatttgggatgaaagagaaatattatgaatttaattttcttaagtataaaaagacagtacttagtgaaattattaagtcaaactaagttcaattttggtttgattaagtcaaagttaatacgcgaatcttgagtaaaaaaaaatgatgtggtaatcacttctcgatcagttttgttttttctactcaagtttaatttcgttcacatggttcgagtttcgcaaaaattttttattgaactgagaaaaattttatcggaatattttactgtcaaatgtttggcataaaaaggcagagactctctgaaaactgtgttacaaatgtcacgaattaacaattaatttccttcatttacatgctttaatagtcatggcctcgacctgcaaaatcaatttctcactccgtccgtaattaacttttccaatgattaatggaaatcaacttaaattggagtgatggattaaattacggaaaattcataccgtaatccaaactatctgcatttatcgtgattactgtatattttttaaattcttcatttttcaattccaatattatttatttatttatcaatattttcgataatttagtattgaattaacataattatttttttgcatcctttattttattcattataatggacgataaatgattcattagcaaaatcagagccgatttttgccggatgggtttttgatagaagcggaaagtgttagcgatgacaaatgtaaaaactgtgcaaatccactgatggaaaagagataaaaaagcgaatgaataaatttaatttataaaaataaaaacgaacaaaaataatattcattaatagaaaatgtactaaatgaaatgaacaaaaagagaataaaattgaaagtgtaaaagaggaacgattaaagagtgttaatgaacccaaattagagggcaaatggacgaaattccattgcggtaaaatgccaaaaaaaagaattccctctccgctgccgtttcgtccgcttctctcttttccgttgcttgctgaagtgccactgggacaaacatcaaaaatttgcagaaaaaacacgcacggaactcccgcaaaaaacttcactccaacccaaatttaatttttaaaaatgaaattatggaaataatttttaaaaacaaattcataataagaaggaaaagaaaagagtgtcatatgaataaaaaaaattttctttaaatttgaaaaatacttccttcctttaaaaaactatattaaattttgtatgaatttttgaaaatgaaaaattcatgtctttgttttttaaatcgggtttatttataaccgcttgaccgctgggacaaaaattgccgaacatttcgaattatttaataaaatttaatttttttttataaatcgctccgtatttgttcagccgattcgttccccatggcgcttgtttggcaaaaaaaacaacaactaatcatctttaaagcacggaaatacaaaaaaaaaagttctgaatttttaaaaaaatcggtcatttgtcgaaacaattctttgagcaaattccttcaccatttttcgatttatattcaagatggaaaaattgtaaaaaaaggtcaaaga

SEQ ID NO: 24026 - DNA, 1922 bp, Heterodera glycines
  misc_feature (34)..(34): n is a, c, g, or t
  misc_feature (1904)..(1905): n is a, c, g, or t
ataaattatttaatttaatttaatttaaaaatantttaaaccttcactatgttttggaatattaatagaaatatttttaatgatatgcatagtatcaaagtctatagcatttctttttataggcattttgtacatttatttaaatattattgtaaatatgcatttatttacatacgagcgatgtgagcacgcgttccacgccggcaatttcagtccgattttgttggccgccagcaatggtaccgttattattattattgcctaaattatgtgaaaaaaatatataatttaatgtatgtgtgaatgtataattgtgagtaaatattaattaattaatcaactgcgaattaaaattaattaatgactggaattaattggaggcggaaggcactcaaagtcgcacgaatcgcctccaggcaaagattgtgcgccaaaataggagggtgtggggggcagtgccaacaattttggcatcaaattgctattgcttattgttgtggtggtgaacgtgttgttaagccgtgcgttgttcaccgacgacacaatgttactctgaaaaacaatttttcagttattttttttttaattttgcaaaaccataattttttttttaaatcctcatattttgtacaaattattaaattttaattttttacattaaatttttttgtcttagaaaatgcgcggattatttattttataaacaaaaaattggtataaaatattatgaaattttataaattgttaggccttatatgaaggaaataaggtattcttgggaaaaccttttgaaaaagattttcggaatacaactttcaggataattaaacatatggaaccgtgtaattaatatccctgtaacatatggcgaatttaattagttagttatgtgggattaaaattacttaaaaataggtcaaaaaaaattatggaaaagttgaaattccacaaactacttccaaaatgaggggtaaaatttgtccaaaaaaaaaagctgaaaaatgaaaaattcattttcattaatttaaaaaaagaaaaaattatctatttaaaaatgaacgggcctttagtcttcggcgggcattaaatcggcgaatgttctcaatggtgtcgcccaagtgcactcgcggggccacactcttcttgaaccaatcgtgccgaagacactgtgacagacagcaaattgttattaaatttatattattataattagtatttaattaaaaataaattaacatttgtgagaaaatgcactttttaatttgaaaaataatttaaaataaaaaataaaattggaattttgtaatttgaaaaaccatgtgtttattatttattacgactaattagtggccaaattaaagaataaataataaaaaatgaatttaataattttccattgaaaaaattgtgaccaaaaaggaaaaattattaaaaataaaataaaattgaataaaaatatttaaatttttttttataaaatttgccttttctggcgttgtgcgtttgtttgtgtccacacacaaaagttggcgcaacaaatctttggccgtgtcactgatcgaagcccaaattgggccggacatctgaacatttttttaaaatgagttttaaaaatggaaaatattatttttaaaaataatttgaaaacaaacaaaaaaaaatggaaaaaaaaatttcaaaataattcatttagtgaaaaatatttaaaaaagcgatattaaatttaaaaaattaagaaaattcaagtattaaaaatatgaatataaaaatgaaataaaattaattttagttgaataaaaaataaataatgtttaaataaaattcaattttatggtgccacaaacgcacggagtaatgaccacccgaaatttgttgaaaaacatcgaagaggtttgcccacaaanntggctatttgcccacag

SEQ ID NO: 24027 - DNA, 1010 bp, Heterodera glycines
tagtccggttaatgtttcggaaaatgccactggaccggagtcttgttaagacaggactttttgtacggagtcctaaagagtccgactctgaaatcctgcagataaatgtgcgggtcataatctgtgactatttcacaaagttggcatctcataattgagcccctccccctttttctagaaaaatattttttaatttggcttgcttatctgtctaactttttgtaaagtttaaaaaatcgaattctatattttaaagcgtagattagagcaggaaaattcatgtgttattatagtcagagagaataccgaataaacgtcaataaattcagaggaagagaaatttgtcaaatgaatagaattcttgaaattcatatattatttaattttaaaacaaatgagttctaaataagaattaagttggattatcgtccttaattacgctaatgatcgattgaaaaaatgaccaaaaattaaaatgccataaatgagatcggcatcgccgcgccataaaaaaacctatttattcataaaaaattttggctcaaatcgaaaaaatttatcattttttggacaaaatctgttaacagacacatccaaattttcaaatgttttcccggcggcgcctatcggcaccgccggacctctttctcctaaaagtctttagaaaaagagcgccgcgaaaaaaagatgatttgacaaacaaaaaaaaagctaatgtgatcagaaattttttgggcatttgcatttttaattaattctatacaaaaatatttatgataaaaagaaataaaaaagcacataaaattattattatgaataataaaaaaaaatttaagctaaaacaatataaaattttttgattatatggtataaggcaaaaattgaaaaaccccgaccccgaccccgaacgatttggcaaccccgacccgaaccccgacgcttctaaccccgacaaccccgaaccccgaattttccaaccccgacgtcggaggtgcaaacctattatattt

SEQ ID NO: 24028 - DNA, 1302 bp, Heterodera glycines
  misc_feature (25)..(26): n is a, c, g, or t
  misc_feature (50)..(50): n is a, c, g, or t
  misc_feature (80)..(80): n is a, c, g, or t
  misc_feature (1208)..(1208): n is a, c, g, or t
  misc_feature (1214)..(1214): n is a, c, g, or t
  misc_feature (1216)..(1217): n is a, c, g, or t
gccaattccgagccccgcatcgacnnatatttcaaaaaaattattcttancaaaatcatgaaagcgtattcgaaatggtnttcagggtagctgatcatgatccggggcaattctggaaaactcacacatttattgacattttttccaattttttggcaactattttggcatttttctgcatatccatccctatcattgtaatatgttgctttatgaaaccaaaatactttacaaaacataaaaaaaatataaaatttaagcaccaagaaaattttgtgccctccaagactctcttctcatcctgctgatttccttcttttcacttttcaatccatctcgaaatgtttacgctattcacatgtaaaatcaattgccaaggtgacgttgtcctcgtctttgttgtacaaccctttgcttgggtccattaattccttaatttgccattacaatattaaaatgtaaattaactaattaatttccactcaccacaaatgaaatgaaattgttcccccaagacttcgattcattgttaaaaactgtttcatcgagttctttcttaaaatcctccacaccgttcttttgcgagacaattcgaagtgttcccgaacatttgcggctccaatttccatcttaaagcaaattaaataataatcaaatttatattttaacgcatttcctttaaaaaatcacttttaattttatgttaaaaattactgcttacataagttttttcaataattaattacaccaattttatagacaaaataattatatttctattatataatttgataagcaaaccttttttagaagcatcgcacaaaagataaaagcccaaccatttctcagtgctttcatttttcttttcaatttctgccaatattttccatggcattccctttatgtacacagtttcacttttacgttcactccaaacgatttctcgtgcaaattccgatagtttttcaatttccatcgaaagtgtgccgttggatttgtttggatcggaaataattttctcagtttttggctcatccacaatgacatcaatggccaatgtgactttgtcctcatctttgtcgtaaaatcctttgcccggatccaacaattccttaattttgatgattttatttggagatgcaaaaatttgacaaatattgtaattaattttttaacatgaaaatcagcaatgtttccgattataactntaattntnnaatcattatgtaatataaaatcatggtgagccaaagtacaaaagtgtcaatgatagaaacattttaattattattagttttaatt

SEQ ID NO: 24029 - DNA, 1224 bp, Heterodera glycines
  misc_feature (73)..(73): n is a, c, g, or t
  misc_feature (195)..(195): n is a, c, g, or t
  misc_feature (1114)..(1115): n is a, c, g, or t
  misc_feature (1123)..(1126): n is a, c, g, or t
  misc_feature (1132)..(1132): n is a, c, g, or t
  misc_feature (1150)..(1150): n is a, c, g, or t
  misc_feature (1160)..(1160): n is a, c, g, or t
  misc_feature (1162)..(1163): n is a, c, g, or t
ttttcaaaatagtaaagtttttaaaaacgctaaaaagccaaaaaattttgtggcctagcaatttttgccccanaaatggttcattttggtaataaattttgaattaaaattgaattagtgaacgattttgtcgttggggcggtcaggaataagaaagagcaattttttttcttctaaaaattgcatataattctntcttatccctgttgacgggggactgcctttttcatgttttctattattaatttttgtcattttttcagttctccgacaagaacactcagtccgttgcgcaactgttccacgatttcctcgccttctacgccttccagtttgacatgtacaccgatgttgcacagattcgcacttccaagtcgtacagcaaagcgatgcgaaagcgcgacctcggctgcggcgacgaccaacgctttcgcctgtgcgtggaggacccgttcgacctggagcataacctcacgtcgggcgtgcgcgaagacagtcagtggaggggaaggaagacagacactcattcatttatttgtggccgaatcatatacggaaaaatggcataggcgcagacccaggcccatactagtgggaattcccccccccccacacctcaaaaatggaaaattaaaatgaattttcaagaaaaatgtacattttttggcgacaaacggctataaattcctgctttttctccccggtgataatttttaaataacgagaaaaatttttaccagaagagcagtaaaaaaatatatattcgggttcttgacatacgattttaccttcttaactatttcaaaaaatatatgggtacaaaaaaagttccaagacaggcaattttagtgttttggaggataaaattgttgttgctgatgtcccgtatttttcactcgatttttggtagaatttaaaaaaatcgagggaaattaatttacatttaatctgtccctcaattaagcattgcatttcatcatcaaatgcttccgttccactgtccgtggaattgcacgctttgatgaggagaattttgctgcgaaacatgacgagggagagaatggcgacggctccaccaagccaaaaacaacgccaaaaattgaaaaatcatttnnatcttatnnnnattttnttttgcttttaaagtttnacccaaaatntnntacaaattattaaccattgttggaaaaaatcgaaccttttcagcaaaattacttttttaat

SEQ ID NO: 24030 - DNA, 1101 bp, Heterodera glycines
ttcctttctttttgcctcctcctcttttctctcctttctccttcgttttcctcttctccttctcttttctcttccttttctctctttgcctttttcccacatttctcttccttcccctcattcactttttgctcccttcgtctgccatcatcacagtccctttgccactttcagcaaacaaattcaatcagattatgatgccattgccgtaactgacgacccttcaaagagtagtggccgcttcatttggtggtgcgacggacagagaaataaatgccattgtttttagttttcttacagatttgcccttcgtttcttccccttttttcattttccttcccaatttgccgatggataacaacactttctcattgttgccctcgtcagcggttggtcctcccgcccccgtccaacttcccaacattcaacgttccactgccgaatgggtctgttcgcttgttgcctcggtcgtccccttccctctcgtagattcccaaatatcgtcccctggctgtccctccccccgggcttttccctccccccgggcttttccctcccccagggttgtctgtccccttgccctcgtcccatctttctcaccccccccccccctcttcctcaggtggaaatactcatttactcgctgtgccttctcgtcggtggtcccctcaatttgctctcttttcgcaaattgctcaccacccaattgtcgcggggcttttcatcccgcagcagcttcaacagcagtcagatcactctgctcaagttgcatttgaacatcgctgatttgatcacaatgtgcctattggccaattgccacccccttcaccagtcacttttcaattcaggttcatctacacactctcgcagatcatttggatgatcagttatcaggtgttgtgtcccccgaggcttgacattcatctcctttggcactttcagtggtattccggggatttactgtgccgtctctgcaagttcttccacacgttcggcttttacctgaactctttcatcgtcgcttgctttgccatggatcgctttttgggcactcgtaatttgaagtctttcattgcctttgctttggcatttcgctgacca

SEQ ID NO: 24031 - DNA, 117 bp, Heterodera glycines
aaaaaaaaaaaaaaaaaaaaaaagagaaaaaaaaaaaaaaaaaaaaaaaaaaaaaaaaaacaaaaaaaaaaaaaaaaaaaaaaaaaaaaaaaaaaaaaaaaaaaaaaaaaaaaaaaa

SEQ ID NO: 24032 - DNA, 1030 bp, Heterodera glycines
  misc_feature (51)..(51): n is a, c, g, or t
  misc_feature (57)..(57): n is a, c, g, or t
tttttttggctagggatatcctataacttatccctcacacacacccgccgncactcncggcttacattacgctgagccaagacaccaccgccgccgccgccgtccacattttgcaaaactccatccacaggtgtgccatgagacgccgacctttctccacccctcaattaaattttatgattattttgataaattggcataatctttgacaatcatttaatttgaatttggtttttaatagagtatcaaacggaaagctcacgcaaatttagccagaaaattacaattttttcgaaaatccacaaatatgaattttttttaaatgaaaatctgctaaaaatatggtcaaaattcttaatttttcccccggcggcgcctatcggcaccgccggaccgtgcgccccaaaagttttttgggaaaagcgccgcaaaaaaatcaacttcgtttttcatgttcagaatcccaaaaaatgcttatttctaacaaaaaaaatgctaaaattgatcatggacaatcaaaaatataacatttgaacattttaaacgtgttttgaataaatttgtaaaaatgaggcttttcgacccaaaatgaggcttttttgcctgccaaatgaggcttttgaaaattttaatctggcaaccctgagtatacacagcggcccaattttgggctctcagtgcaaataggtttattatttatttagtaatcagaacgccaaaactttgcaaaataaaaatgatcacaattttaattggtgcaaattgtaattgctgcccgacaattgcaggctgaacagcgagtcggggagcggagcttggtgccctcaaaatcagatcaacgccacctcacacgaatggatccaagtggaattgggcgaggaatacgtgatcaccggggttggcattctgatcaatcgaacagaatcaatggaattaatgaattgttttaattaaggtacgcacccaaggcaggtgggacaaaggacgaggcaaagaatacgcgcagggatatatggtggaatattggaga

SEQ ID NO: 24033 - DNA, 1831 bp, Heterodera glycines
cacacatttatcccttaatcattttattttaagcggattcgcaattgaatttggcatggcaattacagtgttatgcgcaagtaaaataggcattccaatttcgatcacgcattgtctggtgatcaaatcacccccccccccccccatccgcaattgttgatgccctatcttgcccagatcggcagtgttatgttcgtcggtctgatcaaatcgggcaaaggggtcgactggcgcgtgctgctcaacgtggccctgtcctggctgctcactttgccattgtccgctgtattctccgctctcataatgttggcacttaaaatggcatttctgtgaaaaatggaaatgcctttgctttgcacttttggcacttcgcaactttggaaaaagattttcgtcctaataatttgttattttgtttttaattgtttacccatgtgaatgttgttatctcttttgtatttttaattgatttttaatatcgaaattaaataaacatatttttcgaactttttgatgacaaaaatttatttgaacattaagcatttgcactttctggcatttaaattagggtagtgcgggaccgggactgggccgagccgggattcccgatccccgataggacaaccgggaactataattttaatgatcgcatttattattttttattgttattattaaattcacttacaaacataccaagaaaactttgctaatttaatatttgtttttccaattaccaattaaataaatggcaataaaattagtcgagaatttgtctcgaccaatttaaagaattttaagaaaataccaaacaaatgggcattctttcttttaaaacatttttcgttctttttacaacatcacttttcctttttaatttatattcacataacattttgaactttctcacaaaatgattgttccttttatagtaattgcctaaatttcatgagaatgaaaagcacggcaaacacaaaatcaaattcattttgaagcattttctctcaccgttttattttcgcctttccgtttttctttttaattattcattttcatttatttgttccaattaagttaattggtgaaatgagctccaaatggcactgtggaaactgcttgctttaacaaaatattctgtacatttcatttataagtcataaaaaaccaaaatggcacaaaatgatgacggcacaaatggcacaattttgtcgaataaatcggccccaaattcgatggatttcgcgtcgttgacttccgaaaatgagtcgctgcttaatgtgttggtcggttgtgctatgatggcactttcctcactttgtttggctgccaattcgctggtcgttaaggttttctgtgcgctttcaaagtcaatttaaatttaaacattttattgtttccttttttagaccattgttatggacaaaaatttgcggcgccaaaacagttacaaatttatgttggcactttgtctcgtcgactgttctcaatcggtcgtacattttatcaccggatttttcacaattgatcagagcaatttcgaccagtttctttccgaagtgattatcgtttacattataattgttttttctacgattccttaaattgaggcgctcggagtcatcgcaacgccaagttacgtgttctacgcaattgtcacaattgtcttggccatccatcgtttgacggtgatcagctcgtccgtgtacttggaagagcttctgttttccacgattggcgttaaagtgaaatagcagaaaataattaattatatatttaataaattttgaagggagctctaattatgcctttttaattaccccattggctttag

SEQ ID NO: 24034 - DNA, 951 bp, Heterodera glycines
aaacaatttcatctacgttttttttatttacaaaatattgacaaagcctaattcgtttttatggatttgtaaaaaaatcaaatacaacaacatttaaatggctaagcccaacatttagatcgcataggtaatcataatcacatcaatcaatcaaccatcgattcatttcttctgctctttctgatcgccactcgcccccgggaaaccgtcgagaagactgaaaagaaaaacaaaaataagcatttggatttttaaaattgttaatcaatcacccatcgccgatgagaaaaatgttaattcgattccatcgtttgtccaattccttaatcatctgctctctcttatcatcgggcgcaattggacaacgaatgagggaaaaacaacttaaatcttcttctacatcttctttgtacatttccaatttctctccagtcatttcgttggtcagtttaaatggcacaacggcagaaagcgaagacggcggcggaaagtaaacagtaatgtcgaagtaaacaggagaagaagcattggaaaatgcctaaaaagataaaacattaaaataacaaattaaattggacatcaattaaataccgctttgatttgttccacggctgccaaccattgctgctccaccgctgaatcctcaatgcatattgtcagctccttcatcaaattgtcaggacgaggcaagaacagccatttggtaattgcttggccatccgacgcattggcactgtcatcaggcggaaattcggggtaaatggggccatagaaagtgacagagatgagagattgacaatcgtttagcattgacggggccaattggcgaatttgacgacggttgaagtcgtccaaagacatctcacggatggtgtccttgagcattggccaaatgttgagcagaaggaactccgaaacccgaacattttcagtctcaacttccaattttgt

SEQ ID NO: 24035 - DNA, 2756 bp, Heterodera glycines
  misc_feature (1260)..(1260): n is a, c, g, or t
  misc_feature (2680)..(2680): n is a, c, g, or t
  misc_feature (2686)..(2686): n is a, c, g, or t
cggaaatggtaatgacagaaatcaagcccaaagtcaccaattaatgcagaaggacgagggcgaagaggaggaggaggaaaaagaaaaaggcggtggaagcgaagcagaaggggaggaaggaggggacgactgctcattcgaaaagggatacgtggccatttcgctgtactatttggacggaccgatgagcacggtcaatctgaaggcccaagtcaatcggaagagcaaaaacaaagcgagattaatgagtcccaaattggcacaggtgcgaattgccggggagaggcgcaatttggacgacaaacaaacgctgctcgaagaaagtgggcgatgttggcgatttacccattcgaaagtgtgcagggaacgctttgtcggtgttccgagggcacgaatgcgaactgtccttcaaagaccgggcacatctgacggagtacatccgccacaaaatcgggctgcccattcgcctctctctgctgctcgaaatggacgcgcaactcttccggacggacacttatctgaacgtcctttcgcccaccccttatcattcctttttgacagcaaattaccgggcccgaattggcagcaaagtttggaggaaacgatcaaacagaaagtgagtgagagagtgaaggctggtgagaggaaaagtagccaaggtacagggcgagaagtgcctcggatggccattctttggtggccggccacaaaaagttggacttggagacggtgttcatccatgtaatggggcaggagaatggccaaatgcggaggtgcagcgcatcgggccaacgaaatgccgaccccctcactgacgatggcattggaaaggaatcgggaaggactgagagtagagaaaagtcgacggacatcgaacatggcaaaagcactgtcgaagcaccccctctgaatgattcggctgaatttctgacgaattgccgacagaacaaacagtcgaatcgcccaccaactccttcttctgctggtgcgatcccaccaggcccttctgatttgttcaaaaaactattggtcgcttgctgtgatagctgcgagcgaagggcttcgctaatcacagttaggagaaacgccgaaattgagggagatttaatttggcaaattgaaagatggtcacaaaagcgaatgatgaggagggagaaacaaaaagagaggaaggggaaacggaagaggaggacagagagacggaagaggagaacaccttcgaatgcgacgaggaagccaaaacggaagtgcacgacactntggcaaatatgtgagagaaatgccggtggcatttttatgggcaaaaagcgaagcaatggcactcactgaccgatcagatcagtcaccaaattgaggtacttcaacacagttgtgttgcccgaaatggaatacgtggaggacttcgttgactttctgatcgacgccgaactcagtgatttgcccgtgctgaaaagagcctgcgaaagatacctttgcggagaattggactcggtcagtgagcagaagcaaagcaaatgaccaccggtcgaccaaagctcaattaaccaaatgaaaaatgcccccaggaaatttcctcccctcaagtcgaatttcagaaaaaggagctgatgacttcccttattctcgactttttcttcattgcgatggttttttcggttgttgaatttgtcaaaattgtttaaaatacatattttttcctctttatcttcccgttatgaaatcgatgactttgaccgaattgtgtgaccgatacgccgaattggaaattgtggacaaactgttggaacaagaggagtacaggtaaaaacagaaacaaatgaatgccaaatatgtaaaaaacaaaaaaagaaatgtggacaagcgaattcgccaaatatgcggcgaacggaatttgcacgatttggtggacgaatgcaaacgatttcgggagcaatgcacgagagtgaaaaaagtggagctaaacaaagaaaaagcgagcgaaaaagggggcgaaggagaagcggaagcgaaaaggcagcaaaaagacaaagggaatttgggcaaaaacaacgataaaagcggctcaaatgaaatggaaaatcagcagcagaaaaatggagggaatggcagcacaaattgtaagaattgaaagtcggccaattccatccgtacattcactcattgtccttcgtctgttcgttctgtttgttgccctgtgacaagagataaaatgtgcaaagaaaaacaaataaataaataaacatttaattaaagttgtgggtcactggacgagtaaagggcacctcatgcctaatgaaaaactaccttagaaaaatgtttttgtttgtaaatttttatggggggatgggtgggcgtttaacggacaaatacatcttaaaaaaatctatttttactaataaaaatgggaagcgataattgggatttattgcgcgtggacaatcataattcattccctatgacgttacggtaataatactgtatctcttgtctctcttctccccccccctctctcccttttcctctctctctctttctccctctctctctctctttctctccctctttctctctctcattctgctgttttttctttgtgttttccgttgtttccttttctttaagtgctttttcatgatgtagtgacttgtctttttttcctctttagcgtctgttccaattntcattntctctcttttttaatctatcgaaaattcgattattttattttttttacgtctgatcatttcacatttttt

SEQ ID NO: 24036 - DNA, 1433 bp, Heterodera glycines
  misc_feature (21)..(21): n is a, c, g, or t
attcaaatcattctaataacntctggtttaaattttgtcaatttaaacgaaggcttaaaacgtttgaacgcgttgaaattgttgtaattcccggggggggggggtgagacagttcagttcaacatcagctgctctctctttaaagcggcttgccatcattagttcggttccatctctttcagatcaacacactttccgccctcccatgcggtgccgcgtccgtccgcctcaatgacgcgttccgctgatgcgtccgtcatctccggcgtgccgtcggttgaggcgccgcatcgcatttcgctgtactcgcgcgaaccgcgacgcattggactgccgaccgcctccacagcaacgacaccgacaacccggaaatcaacatcaccgacggcgagctgaacaacgagcgcaagcggaaacagccgaaggcccgcacttctccaacggcagccgtcactgccgtcatcagcgcacacgaaaatgtgagaaaaggcagaaagagagagagagagagagagaaggggaagagagagagagagaaggggaagaggcagaaattcaaatttactttcaaaaatccaggaaaattaattttatttcctctcaatttatttttcgaaattttgcaggctaataaaggatacatagggctatcgaattacaccaacaatgttggtagacaaataaaaaaagttatagccaaaaacttgtgctcgtacgaaaacgaccctggcccctactttatcattcctttttgcttttctttctctgtctttctcttctttctttctttctctcctgactctctctcttttctctcatctctctctttcttactctctcttccaccaccctctctttctcttctcccggtcggggaccggtaaattggacaccagaaaattggacaccaagcggaaaactggacaccgccggaatttggataccaaaggaaaattggacaccggaaaactggacaccatcctaaaataaacccaggaattgagttgaaaaacaaatttgggtagggtaaatggattaataattaaggcacttagaagtagatcaggcattcaacaagcaagattattgatcaatgtgccaaaaaaatgcaagaaaaagggcaatgattggtcaatgtgctaaaattgcataaaagatgggaatcctatccaaaagaaaacttttttctttgtggatgttatggttgttttcttttgctgaagttttatgtaataaaaacattatttatttccgttttattacgcttataaaaacataagtatgtgcagactaaataaaatcttttggccaacccaaattttttgttttatttatttatttttatacgatagtgtccaattttccggtgtccaaatttccattagtgtccaatcttctagtgtccacttttcggtatccaatttaccgggagc

SEQ ID NO: 24037 - DNA, 1022 bp, Heterodera glycines
ctgtcctttgccttcttcacgctgtccctccttcacgttctgcttctctctactctccacagaggccaagtcccgcctctttctttttgcatgtcacactgccccccccccccccccttctttcaatccctttcattttgcgcctatttctggccattttcccatttcgtttgtttcggtaaacaaaaaaaaaattcgggaaaagcttctcctccctttctgtgcgctgtttaagcaaatacctgaaatacttttacgagtagtcctgaagttccaatttatctttgaaattattctaatggttttctttttccataaaatattctcttctgcctcccccctccccctcatttccttctccgtctcgcgcgcgctctctgtctctcccttttctctcctcgttctctctatctctctctctctcttttctctcctcgctctctctctcatcccctctttttccccttcctaattaattttactcactttctctccacacctttccattaatctccctttgtttttccactttgcgtgttgattcagcgatttttccgcatccattccactgcccttttaaattattgggataatttcaataataatcatataataatcgtataatagtaattcatcattatttctaaatcattcctaaaatttcttcctctcctcccttttttccttttgcttaatctttctttggccactaacaattgctatttgattattcctcctcctcagctgctccccccgacctttggtcatttcgcttttttcgctgccctttttccctgcaaaaaattacactttttggtgagaaaaaggccaatgagcgaacggatgaacgaatgaatgtttatttctctttttttgttgtccctcttctgccttatttttactttatcagctgtcaccaattttcagtccaaagtccaatccgaaagacaaattgcaaaacgaacaaaaaaacgagcacagaactccatttgatacccaaaaaaggaatttgaatttaacta

SEQ ID NO: 24038 - DNA, 1877 bp, Heterodera glycines
  misc_feature (6)..(6): n is a, c, g, or t
ttattntggatatctatatctaagcggattcatagaaccattcgacacactactattcaagtgtctaatattctcaaaaacatttatatgtctcgcatcaaatttcatgaacaaatcccttaattcctcaggaaaatcctgttcgggaatttcagggacaaaaactttaccatagtggcagcaatccttgaatgaattaccgcgtccaatcactttctcttcaacaaaatgcaatgcatcacaaaattcacatcgcatattcatttggctaagtctatgttcattagcattctcatgagatcctgctgcgtaaacattaactacaccttgtctaattactctatgtctaattctatcttgttctaagcgcaactgtcgctcaaaaacagatgcacttgctattgcaacacaatttctatttctcatttgttctaaacgaatttgtctttgtactacagattcatctgctattgcaacacaatttctatttctcatttgttctaaacgcatccgtctttgtgctacagattcatctgctattgcattacaatttctatttctcatctgttctaagcgcacatttctggattcttgtgacttattatgccatctaatcctatctctctctcttttctttcgcaaattctcaagtctcctatcttcaaattgactgtcagtcatacgggatgaccccgcaacctcagcatccaaattcattgatccctgactgggaccaccatccacaaatctttgtctcttagcatagttatgctcttcaaacacatcataattcctaatatttctttcattttcttgatctaaaatctcaacacattcttcaacttcatcaaaatctaaatcataaacataatcataatctcgaacataatctaaatcgtttattgaagccataataataaataactgaaaattaattatttaaaataaaacaaaaagttgtaggtattgaaatgaaaatcaaatgaagaattcataacattaaatttattatttatttaaagtttttacgatttacgatcagtttatcactaacaaatccatgatttttttgaagagatccaatggtaagcccagtgcacacttcattgcttaataattatattggtctaatttttaacatattgcaaataaatttcataatcaagtcatagaacaaactctaatgtttatcaaaaaaatgacacacattattgtttcacactaaagtcacagaacaaacactattgttttatcaaagacataagacacattattgtgtcacactaaaatcacagaacaaaccaccaatgttttatcaaaaggcataagacacattattgtgtcacactaaattcatagaacaaacactaatgtttatcaaaaacatgacacacattattgggtcacactaaagtcacagaaaaaacactattgttttatcaaaaacataagacacattattgtgtcacactaaaatcacagaacaaacactattgttttatcaaagacataagacacattattgtgtcacactaaaatcacagaagaaacactattgttttatcagacataagacacattattgggtcacactataatcacagaacaaacactattgttttatcaaaaacatgacacacattattgggtcacactaaagtcacagaaaaaacactattgttttatcaaaaacataagacacattattgtgtcacactaaaatcacagaacaaacactattgttttatcaaagacataagacacattattgtgtcacactaaaatcacagaagaaacactattgttttatcagacataagacacattattgggtcacactaaaatcacagaacaaacactattgttttatcaaagac

SEQ ID NO: 24039 - DNA, 1348 bp, Heterodera glycines
aaaaaagctgttaatgatggatgatgtgagagaatgcaaaaaattgtgtaaaaacaaattttaaaaaatatttattttttttgcgttataatttttgagaattaagcattctcttgagaaggttaagatttttctttttgctgttttttttttgaattttaaaaactgaggatagttttgcatccatttttatgcgattagttaattaaatttttgcataaaatcagaaaatttaagaaatttgtagaaaattttgtaaaaaaaacaaaaatcatataaaactaacacttctaggtttttggaccgtaataaattctatttttaatatggccagttaaatttataattttttttcttaattcaaatgaatgtatagattttattttatttgtccatgcacaaatgcgcgaaaatgtgagatttgagaaaaacaaacaaataaacaatagcagcaaaaaaaaatttggcaggaaatgtaatcccaactaaagaatggaatgatcaaacagtgagagaaaaaaatgtgaccgtgtgggattgatcaggatttgatgaatgggaacaaagccaaaagtgatcgagaccgggtaataaaaattgtcgtgctaattcttgatcccatcaatcggctttgtttgttatttatatgtaattttcatactcggatttgagaagtgacagatgattttaatttttcattttcagctaattaaggttaaagcgagttggattatattcaaaaatttttgattgttaatgactaatgatctgtcccacgttcgataaacaatttaggcatgaggaaaaattgcaaaaattccaaattgattcgataaaattgaaaaagccatacattttctataataaacaaaaaaaagtagaataaaacaaatgaaattggaagggattacatatttggagtgatagaataatggtgtatgttttgtttatgtgaatattgcccgtaattatggtttgaaaaattgtgcaaaaaattataattgagagagaaagagagttttagaaaagaggaaaggaagcaaaacgcgaaagcagcagagcagatcaagaagaagaagatcaatattttgatcatgaaagtcaaaaccaccaacagtcagtcatccgagaaaagaaaggcgagagagagagagatgggttaaagaaccgctgatcagcagcaggagagcagcttgaggaggacaacaacaaacaacaacaacaacaacaacacaagtgtttttttggaatgtgaaactgatcagcttggcggagagtgatcaatcaatattgtagcgatcaaaaaatcggttttccaattgactggaaagtaaaaaatgatgcaaaa

SEQ ID NO: 24040 - DNA, 1892 bp, Heterodera glycines
  misc_feature (1839)..(1839): n is a, c, g, or t
  misc_feature (1863)..(1863): n is a, c, g, or t
tcattgttgcatacctgactgaccctccttaatgtgcattgcaatttctccataattgtgccatttgccgggtctgtctcttttaaactgttcaaatttcggtacttctcttcccagttgattttcttcttggactttcattttatctttgtttttgctgaacatttttaccatttttttgaacattcccttcttctcattcttaatttaatattaaataattaatttatgctgcttatttaaaaatgaattaacacatcccggcataattgccccatttacttaaaacacattttatcaaaaaatcttgaaaaaagcattacaactcgaagaaaaaaaggtaacttttctggggcaaattaccacaaatccttagctttaaaattttggaagttttcattcccttagctgttaggttccgtcagcgaatgccaacccgcccgactcattcattgtaaatgtcctaagactcaaacggtcagtctcagctgttcgtcctcaactccccgtgctaaccatgctgtgctgctttgccattttattctgttgctgctgctcgaacacttcaccaatcaaatattcattttcgttcatttcccccacaaattgctcaaactctccccgatcaatgcgttccatttcgatcagttgcgccatggaagtgcccttcgcgagtgattgcgcttcactttccattgcgatcagttcggccaacgtttgtctcttttgctccttcgccatcagttggcctaatgtcgtcctctctcttatgtcaatcgatggcgaatcatttagcgttttgtggtgatcaactacataaatggtgtacttaaaacttttccgattaatatggaaaaaataacaaattaaatattattcattaattaaaaaattcaaaattaattctttcaaatattttattatgatttattccaactttacctttgtctcctgaaatggtttgggatgaaaattgggacaatagcagcgggatgacaaagtattttaatactcccattctttgagtgcttttaaattaatattttttaagagacattatattattgcccgtacattttctatttaatttatttggatcaaaaaatgttcaatattttaattaaaaatggcattttgtattttagaatatgtatgtcaccgtgtaattttgattatttgaaaacgagaatctcgggcaaaatattttatgtacattatcgtatgacgagaatctcttttgggcttttggattgatttgaaaaataaattaaatccgagtttggacatcggctaaaaaagcattcactgaaatgaataaaattgctaaatgaccgttatataagaacagcatctgttattgttatttctctcagcaaaaaaagccgaaaacatgggatcgagccgtgccatccgacttctcatactcaaaacatagccaataatattacatggcaattacaataaaaaacaaaaaatgctatatgtttattaagaaaaaaataataatttaaaatgatttggatgatgtcaaaattaaaaaatgttggaaaatgacgttatacaaattaatgcatacacacagctcttcctttcacaatccattaaggtcgataattattttttcaattcgacaattttatgttattttttaatatttcccaattaattaaacataatgtaaagatagtttattatgacaaatatatatttttttttttggaaatcgcagttaatagataaactattttcccgcaggcggcgcctatcggcaccactgaccattcaattctcttttaattttttaaattagcaagactaaaaatgaggcttttggcccanaattatgctaattggtcatcagantaagaccttttataatttaaatttaagaa

SEQ ID NO: 24041 - DNA, 1999 bp, Heterodera glycines
  misc_feature (1992)..(1992): n is a, c, g, or t
ccccccccctcccctcaaaagggggttttatgtcagagagtttgactctaattttctggggggggactataattcaagaaatacggtatataccgacgcaagccctacccatgcaaattttgaaattttgaaattgtatttcattttgtattattcaaaaaactgtactttttcagaagggcttttggtttagtcgaataaacaatttgggtttggtttaaataatatctcttgaaattgaatggtttcccaaggcattgttttgcggccaaaacttaatttaaaactaacaaataagagataaaaccggtaactcagtgaaaagttagggaactatattatgaaataatctctcaaatttattagtgaatttgttatgattttataaaataaaatttctgctctatgagagaactattatttccacgtcccacattaattgcgaattttttgtaattatatttttgttcaaaaaagtgatctgcaaattaaaccaaaatccaaaattgaacagcaaatccagaaaaatgggattaacaagtcgaattaacctgtgagcagcagtaaaagctgacggcagcaggtcgtccgtccttttctgcacaattatccatccgcagataattggtaaatctggtccaattttaatagagcaggttactacggccaaaaacaatgtgaaggttggttggttgtcaaatgcacaaatttccaaagccatgaccgccgcggggctttgggcgaaaataatttcattttttttttgcaaaatcagcccatataaaagcaagttccttttgcaccacaatattcactcgaaatatttctctttgacagaattatttatttagtaaattcattaaaatttgccaatttcaaaaattatttttaagaatttaattccaattaaaaaaagttccttattttttttgttgagaattgcaatgctttgtcgcctcccttttgtctttggtttcatttccgttttgtttgtttcgaccattttggcccagtggtggggcgacatgggccccggcacagccgaccatcacacgagcggcaccattttacagcaaaacggtggcaataccataaggtgacatggacaaattaatgaatatttgcctaaataaatgcctaaattcttttcccttcagaagcgatgggcacaatgaatactattccaatcacaacgcatggaacaatccgagtaaaaacaattaaaataacaaataaaatatttgaataaatgtgccgatgtttttcgcagatgcttggaacggagtgcaatggcccgcattccccaactttggtcgtcgctaagaatcccaaaggatcgaattttgatcggaacagaaaattcgatggttttgtattaggctgtgtaataatatttgtatgtttttgcgattgtattttttcaattaaaaattgatgttaattaaaataattacattgaaattcccctttatttcttgtctaggctaaataaatttttttcattattgaaaaagccaatattgactgcatggaatattgatttaatgattttggcttttaaataattaaaaaaccaaacacatagtttttattttatatatttaatggtaatatgtttattatatatgctttaaataaagaaaaagtttcatcagtctttttctcccttttaaattctttttttaaatttatgttttctcaatttgtttttgttttaaatagaagacattatacattaatttttgtttacatttataattaattttttgtcaattgatttttcgagaggaaaaaagacttccatttccgtttttccaatcatgcaatattaatttgctctcataaataattagataatatttaatttcattttagcattttttaaatttaaattatgaataaaatatcttttgacaaaatgttattattacttgcactttttgtgttcattttcttcgggggagcattcgctgtggcattttttcaaaatgnttttaaa

SEQ ID NO: 24042 - DNA, 514 bp, Heterodera glycines
gaacgcataaattataaataaaaagtgattgtctgtatagagagatcgaattattctaagttaaaaactggttcattggatttcatgtgaggcaaatgtctttgtccactttttcaggttggtatagttaattttcaatttcatagcaagtttttcgtcactaatttttggagtgagttctttgatttcaaaatattgctccatctttcttaatgtggcatcattgatatagatattcataggtaaaaacaaaaatttaaatagagatagtgttcgttcccttgcttttcttgtaatttggccccaattcgtttttagcagttaataaatcatcttttaaaaatggcgcaattcattcacaaattctttgtgcttgtgatgttcataccctccccctccccttatctcactccctgtcccttctctcttctctccccctccccctccccttatctcactccctgtcccttctctcttctctccccccccctccccttatctcactccctgtccc

SEQ ID NO: 24043 - DNA, 682 bp, Heterodera glycines
gtagagcccggatttttatgtttttacatatttttttacggcttaattatggcgagagaagcccaaaaaaagcattttcaaaataatttttgcattagagcgacttataaaaatataaaaacacatattttggccttttggcacataaaaacatatcgcacatacatatttcggggttggcacatattttgcacatattttgacattttgagaaaattttgtaggaaaaacagaaaaaattgaaaaatacactcctaaaaatcaacattcttgcaattgcttacaacattttcaaattttttaaaatttatttcaaatgccgatagtaactaactcaaattcttattttgtcattggatttcgaaattctctgctggagcttttaatttataaaaatttttaactgaaaaaaatatcaattttactttcgaacaccttgaaatgtatttgttttgcaattgttcgggcgaaaatgataaaaaaataagattttttggaatttttatgcaaaaatgcccttaatcccgcatttaaaatttgcgggatcccgcgcgggatttcgagattttggaaaattcgaaaaatttcaattaaatttcaaaaaatttccaaaaatcaaaaaataccttggttgagaaagaaaaaagttatggtccgaaaatttattcagtgattctgtgta

SEQ ID NO: 24044 - DNA, 2176 bp, Heterodera glycines
  misc_feature (2146)..(2147): n is a, c, g, or t
atcaaataacacagattttttccagcatttaaagatcaactattacataattttgcaaaaatgctaaaaagcctctgctgggggaggggagaaaatttatgaagctatccggaaatcctgacaaaaaaaaacaatttaagccaggttatgttgggggaaaactcactcggaaatcctggggaaaataaaaacgaagtcgaaaaaaaacacatggaaaccctggggcaattctctgggaggcgggggaggaaggaaatctgattaagccttcgggaaatccactaaattgctccatcgaaatcctggtacctaatttttgagcccggcctaagtatgattgaacagatgtggccacaaaaatttgaactgctggaccgtcaaaagaataaatttccccggccaaaaaagccataatgggcggactcgatcagttgggcgccggcacgtttgtgcccgggactatgacttttttcattcttaatcaaatccaacattgttgatatcattcgatagccctaagtgtcctctattagattgcaaaatttcgaaaaaatttcgtcaattttgaacaaacttatgattttgggggatgaattgattttttgaaaatttattaaaaacaattaaaattttcaaaaaaaaaatttctcgcctataggcactgccgacaccctctctccaaaaaaaaaatcaaaaaaatttttggctgccgaaaaatcaaaaaaaaaaaacttcattatccgccgtccctgatcaccacaacacatctcggaatcactagaggaatatggttcaacaattcaccatcattttaacacacaataatgatcagtagtgatcagaaaagaattgttgataaaaaaacggggaaaaaggggaaaaaatgtccccgaattgggcgcgccgtccccgtccaaattgtgccctttctcctcaagtggaactgctaaaataaattggcgcggtgcgccgccgcgccgcgcgccattcaatcgaacgacgaaaataaatccgtcacagaatttgtgcgccaaggttagttatggggggggggggggacagtcattcagcgatcgtgaccattaaatttggttaatttttgaatggaaaatttgggttaagagcggcggcacgctgccccgaaaatgtggtgcccattagacacaaaatttaatgggtcaatatgtttttaaattgtttgtttatttatttttattttagaaatttcataattttatttttataaaaatattaatttattaattaatgaaagcatataatttaaaatattttgaattgttttcttgttatataaaagcaattttcagattaaaattaaaaaataaatttaaaaaagtataaataaatcgcgggtttttatattttatttgaaaagtaagtaaatcattttaataatttcttattaaaatttggttcaaatttaatattttgggaagaaagaagcaatttttataataaaattcgttcgtaaaattaaaaaaatatatattgtaaatttaatatattttaaattgtgaatttatttaaaaataatataatcattttaatttaatgttagaataaatttaggtatttaattgtataaattcatttatcaattatataaaattttaatgcatgaataaatatgttttatatttgttattttttaattaaaatattaataaaaataattaaagctacaaaaaaagaatgcaaaattatgaaaaaatttaaattaattaaaatcttttcatattaaaattcatttcgcgtgacataccggtttttggcagtgcatcataatacaaatatatccaaaaaatgtgatagcaattagtggcggggaggaataaaaaaatctaattatgattatataaatggtggaaggtcatgagaagaaataattggtgcggcgaaaattatgtattcttttctgaattggattcggcatgatcaaaaagcgtttatgaaactaattattgttttatttatggaaaatgcgaaattatatggtttaaaattgaaaaaagataattgttagtttttaaaagttattttaaggcaaataaattgaaaaattaatgaaaatttgtattaataatataaattaaattttattaaaaatgtgtgaacaaattaaaanntattttttgtcatgaaaaattctattaat

SEQ ID NO: 24045 - DNA, 1520 bp, Heterodera glycines
cctccgactcttcccccattttattgttgcggttttaactttgtgatttgtctccgtcttggaaatatttgtggaggagaagcagtgatttagccccgacccaaacagcatttatttagcacgctattctgtgttatttcgatcactctaaattgaagaaccactcaaactgtggattgaatcatagacattgagtttattaaaggcacttccattaaaaaacaattagtaaaaatctgaacaaaaaccgatctaataccctttaaataattctaattagccacaaaagaatattaagagcctgaaaatatatagaataaatacgaaaataactaaagaaaatatgagtaaattattattgatacataaatacacacaaaaatgctagtgaattttttaatttagttaatcgaaataattaaataaaaaaacagaaatgacaaaataaaatttatttttatgaaaataaatgtaaaaaacgaaagttcactcatccttatttttatcctaaaaccagaggaccttgaatttttttcaacttaatatcattaaacacaatgtctaattatgatataatacaaattcagcaaaaatataaatataaaaataaaattacattacatttataataataaccgtatcttgtagaaacaaatatttgaccagaaaaaaataaaataccaattaataaaaataaagtgcagtgagtaatatggtttctatgaagaatccaacagaaatattttcattatatcatttgaaattaaatgctccaaatattaatggccttaaaacagaaaaaatttagaatattttgtaaataatgaaaaaaatcatttttttgaaaaattaacagcataaaatgttataaaacaaaaaagaaaataagaaaacggtgctaggtcgtttcttaaaaactgccactatgggcgtttcttaaaaactgccaagtgggcgtttcttaaaaactgccactatgggcgtttcttaaaaactgccaagtgggcgtttcttaaaaactgccactatgggcgtttcttaaaaactgccaagtgggcgtttcttaaaaactgccaagtgggcgtttcttaaaaactgccactatgggcgtttcttaaaaactgccactatgggcgtttcttaaaaactgccaagcgggcgtttcttaaaaactgcaaaacaaatatatttatttattaaaaaatgtttatgtcagttgtttgccaacgttataaataataaaaatatatatacatataatttttacatcatttgtttgccaacgttataaataataaaaatatatatacatataatttttacatcatttgtttgtcaacactatcttcaacaccaagctcagtagaattaaaatattaataaatttattgcttctgatgattgtagttaataaaatttacaaatgagctcaacgatatatttaatattttttcttgataaattaattatttaaaatgattactgataagcttattataattaaaatttccctttgaaag

SEQ ID NO: 24046 - DNA, 1512 bp, Heterodera glycines
ttaaaagattccaaaaattctgaaccttaaaataggcatcataatcgtactcagcacctcaaaatagcccagaaaaaaaattgtcacccccattttggcccacaaaaaaaatttcgaaaatttctagggggcctagctcgaaaatttttgaaattttccagacttatagtacaccattcgatagagtttcgaaagctctacaaaaatgttctaagacaatttttcgctaaaatcaactcctgacgagttatgggcccgggactcaaatgtcccgctgaggccaaaaaatttttctatttccgggaaaaaatcgaaatttttccgaaaaaaataccaatcgatagagctcgaaaaactatgttttggaagtggtctccgtttttctgggaaaattcgttaaaaattcctaaaattcaaaaacccgaaaaccgttttttaggcctagctcgaaaaattttgaaaattttcgaaatttttaaatttcagaaaatcgagctcaccgagctctacaataagtctgctggccaccctgcgctcaggtcaaagcctaatgagtttattcaacggggactgaactgggcaaagttggtactgaaaagttgccaatttctgcagcccttccaagtataggtagaggcctggaattttttttgaaaattagaaaacacttcaacttaaaatcctaccagcaagaattttccgctccctgtcctttaaaaaaagttacgggccttcaaacgcaagcaaaagtgagaaattagccgccgggactcagttggccaccgaagagaaaaacccgtatttttcccagatgcgcctcaaaaagttgtaagacccttccactactttcagacccctcccgacagccgttcgactcaaattagtttttaagacgagtccccctttttctctatatatatataaactagcgtgttggaattgacgggggcggcgtaggcaattggcttttggatgaagagaaaatggacatgctcatttgttattttaaaacatacaaaacattaattgcattagtgtgctgttttaaagcgctatcgcgctatgggacgcggcttcgccgcgtcgctagaaagtgatgttatttagcaattcatcgcagcctcaggacgggcgcttcgcgcccgtttttaattttgttgagaacattcgccgcttcgcggcctcaggacgggcgcttcgcgcccgttttttaatttttcgggtggcattcggccgcttcgcggcctcaggacgggcgcttcgcgcccgttttttaattttgcggggaacattcggccgcttcgcggcctcaggacgggcgcttcgcgcccgttttttaatttttcgggtgacattcggccgcttcgcggcctcaggacgggcgcttagcgcccgttttttaattttgcgggtaacattcggccgcttcgcggcctcaggacgggcgcttcgcgcccgttttttaatttttcgggggacattcggccgcttcgcggcctcaggacgggcgct

SEQ ID NO: 24047 - DNA, 1970 bp, Heterodera glycines
  misc_feature (1964)..(1964): n is a, c, g, or t
tcattcacttctgctgctgatcacttgggccgggaattgcgcgagaagcctgaaaatagaaaaactattataaataagaatttttgaaaaatcattcactgacccgtctccgatttgttcctcataaaaaatgtgaatgtcaattctgttccattgataataaatttcccaatcaatcgcttcctcctcccattttgcccatttgctcgcatctcgcgcaattggacaacggaccaacagcagcagacagtcgtcgtcgctattgtcaattcttttcagtgtcaattgctcccgagtcaattcgttggtcagatcaaaaggcacaagaacgaagaaagcaacggatgaaggaataaaccgaatgatgacaatgaaattgacgggggaagaagcattggcaaaagcctaaaatgtgggaaaaaacgaaatgaatgacaattttacagttgggaggaggacaaaaaaaacaaaaagatgagagaacttttacggttgagatggaccaatttgggcataaaatttttaaacgaaacccaaaagaatgtaaaaagccaaataaattattgaaaatcaccgctttgaagtcttcaatattcgacgccaaattcccgagatccatttccaatgcgcattggaacacttttggcacattgctttgaagtggagtgaaaagccatttggccacggcttgtccattcgatgccatggcattgtcaccggccggaaattcgatgaagtgatcggcgacagaaatggagaaaacacgaagtgatggaaaatcgttgagaattgacgggacgaattgccgcaaacggcgaaaaacatccgcagataattccaagccataaatgttttttccgagcattggccaaatgttgcgcaaaatcgactccaaaatgcggtcattgtagtacgggtcgatggtcaaattaattggacaattggtgaaaagctggcaaaaacggcggagaaaagtgatggcatttcggtcaatgaaactgaaaataaatagggaaaatttgtataattttttagcatattcgccaattttacaagatgttgatccgttcgaaaccgatgactttgcgtggcatttcaatttgcggaattggcaatgcttctccaccatcagtgacaatttccatttccttggtgccattctttccaattttgctgtgaatttgaataagtgccaatgtccatctgcgcgtcttgaagtgttcgtccacgtaaatgtcaaaacggtgactgatcatcgcaattccgtggccaagttgtgaaggcgtaatcaaaccgaacacacaaagccaacagtcggcggagatgaaactgaaaaattaaatcgacgttttgaaatttgtttatttttttacattttcttttttggttttttgaagcggtcccaataaagccaaagaatggcacaacatccgacaaacccgacaaacaatggcacaacgaacagactaaaacaaaaaagagaaggaaaagggtaaatgttgagaagaaatgtgaaaaacgtacagaatcatttttaaaggaattgtcagagagaaaaagttggagagagagagacgaagcaaataaatggcgaatgaataataatggaaggtggaggatgaggagcaaccacttttatactaatttttatgctcatttgtacgcttttgcattttccaattttttctcgactataaaagccctccctccctcccccattttttttcattcactcactttttttaacagtgtatgaagacaactttaataaagcataatttttttgttcgtaaaaagcaaaataaactttgtgtctccgaatactctaaagtttcaaagatatttaataggtatgtcttttttctaagcacctaattaacctataaagatgggcttgaaaactgcagaaaagtcagaatttagcctatgttggctctattgcactttatgagtcccaatcaaantattta

SEQ ID NO: 24048 - DNA, 1639 bp, Heterodera glycines
tccttgttttactaactcctccctcaaaaattacggggcttaggtagcaaagactggaataccggtagtaatacatccaattcaatacacattccccaacacatacctttgtgcgcgtccgcaacactgcccacttcaacagtcgcagaatggttgatgcgcatgtgctgtttgggccgggtaacgtcaagcacactgatgttggcaatgtcccaaaaaatctttgtgatctgacaaggatgaaatgttgaagtgttgcagtaacaaaaagcttttactgtcgccagtaaaacgcttactactggtcaaaaaaaaattccaaaaaagctaaaggcctgtcagttttattgtaacgacgacaatgtcaatgcttcataacttttcttcaaacactcggattaaaaaccttattgctatcattcggatcacaatcagcaaacagatactgaaaattcgctttttcgaattttggtaatgtttttgaaactgagtgtaccgacccattttgttcatgtgtactactatataaatcgattattaaacagcaaacctcttcgacagaaagcaatggcaatttcttgttcttattttcaatgccgtcgacgaaaagtattgtggacggaggaattggaggcaacttgttcattagaggctaaagaaataagatgaagtgccgaaatttacaacacaaaagaaaaccacaggttggcgattaaatcctgggcgtccactgaaactccgagaaaattcgcgcggacccctcacactgttgttacatcccgaaccatcagtagaattggtcatttttgcttggctcggagcccagccattgttgttacatccccaaccgtcagtagaattggaagtcatttttgcttggttcggacgcaacgcactgttgttacatccccaaccatcagcagcagaattggaagtcatttttgcttggttcggacgcaacgcactgttgttacatccccaaccatcagcagcagaattggaagtcatttttgcttggttcggacgcaacgcactgttgttacatccccaaccatcagcagcagaattggaagtcatttttgcttggctttgaccccacccactgttgttacatccccaaccatcagtagaattggaagtcatttttgcttaatcaaatcaactttaatttatatatattatacagaatattgttcgatagtgatcaatcagtttgtctggccagttccatatgagataaatttttgggcgctaagaaaagggttcccacttgaaaaacaaaacaaaaatttacatcaaaaaaagtgaaaaaatttccaagtgcgtcactatgggtcaagcccagtgtcactatgggtcaagcccagtgtcagacaaaattgctcataacgccaaatagcgcatttggcgtaaatttttgcgcgctatttcaaaatttacactggaaaatgccttttttgtattttttattttgatctgccataactcgcttcattcccaattaaactgaacaaatttggtatctaaaaaaagtttttgaaaaggagaatctttttctaagcgaatgctaagcaatttgacatctcagaaaaaagttgtggggatttcaaacttttatcatgttataacgcaagtccta

SEQ ID NO: 24049 - DNA, 1423 bp, Heterodera glycines
tttttgttcaacaggtgttggggtcacttttgaaaaattgtaattttttccattttccaaaacaactcctgatcaattggaaatcttttatgaggaaattataatatattaatagtggaaaactttcaaatttaaaaatgcaatgttgattttgatccccttcaagtggattggttcacattttctcaagaattgcacgttcaatatggtggttataacatctggcgcggatttccttatcaaagaggggcaggtgttggttcagtgtttagaagtttcatgcgatttcttttacctattggataacaaattggttcatcaattgcacggcagggactagaaagcggaaatcgagtgttaacaaatgtattgggaggtaaagatctaaaggagtcactcgtaagtgagggtaaaacgaggcttaaaactctcctggaaaaggcagcaaataatattgaaaaacaaaaaggacaggggtttgattttaaacgttataaaaatgaaccaacacaaaaagttgggaaaaccaggcgaaaaaatataaataaactccaatctccagttgggccaccattggtatcattccatgaactcaaccattggaatgagacctgtagacgtaacctttgcaaatgctgaagaattgagaaaaaaactatacaatgaagcagctaaaaaccctagaggaaatcccaaatttcatgttggagatcgggtccgaattgaaaaacacaaacacgtgttccaaaaaggttatttgccccggttcaccaatgaaatatttactattacggaagtacattctgagagatcacctattgtttacaaaataagcgacgataataatgaaattattaagggatggttttatgcaaatgatttatgtagaatttttgaaaatgataataaattgtatgacattgaaagaattttgtcaaaaaagaaaagaaaaggtgttgaacatgcgttggtaaaatggaaggggtatagtccccaatttaatagctgggttccattaagttcaattactgtgaaaaatatataaaaactcttaaaaaacttttttttttaataaaatgccttctaattcgttttatattgtactcccatcaaatacaaatgttgaagggaacagaaccaattcttttcggacacgtataccacgaaaactacaattcaacacggaatgggaagtaggcctcgctgtaattgtttatccccattcttggccttcaatcggtactgcacaacaacaatttgttgaaattgagtggcagacaggaaaagcgttacgcattgaagttccaccatcaaatgtcacaaacccctacgaactaagcaagaatttgtacaaattattgggcgagggaagtgatcacttggcaaaacactgagaactaagccaaaatgctttcctacttgt

SEQ ID NO: 24050 - DNA, 1645 bp, Heterodera glycines
  misc_feature (1564)..(1564): n is a, c, g, or t
  misc_feature (1618)..(1618): n is a, c, g, or t
agctcggtcagtgttcagatggcgtacccgctcgaccatgaaaaaccctgaataagaagaaactgcttgacgaaggtgacagacggacggacaaaggcggaattctaattttgggatttgatttgaaaaaaatattacagggggggagccggtcccgaaagttccgccgccgaaactccgcgagacataactctgccgaggaaaaaagtttcaaacttagaaatttttcaagaaaaaaaatcttaaaaaatattttcacagaaaacttggagaaaaaatattttcatataaatcgctggaaaaaatttttgaattttctcggtaaagctgatcccattttgcaacaaaaaagaaaacaacgtatttcgggattttcggggggtggtggtggaggaattggtcaattatttactccgtttgtttttggttgccttttcattacaccgattgtctcataatctcaattttcaggccataagtacgcctgctccgcctacgagctgtgcagcgacgacttcaacgtgttgaaatggactgctgccgcggttggctcacggacggactttctcggcacgaaggagcgcatcgaacagggcaatttcttcagggtcggactttgaattcttataattaaactaattaaaccaatgccattgtacaaaatcgcaaacagtttaatttacgaatttcgcataatttgtttaatattcttccaaaaatagactcatcgaattttgacaaaattttttgaaggttataaatgtgggatttgcatcagcgaaaaaaaattcgaaagtcggctccgaaattttttttttccaaatagcaaattttttgagttttctctgcaaaaaaaagcctgagaaacctgataagatttcttattttctcaaaaaaattttttcaggatgttctcgacaaggcattggccatcaacccggaggagtacactgtgagtcagaataatgggattggtccaacgactttctctctctctttttgttttttttgctcattgccccataaaattgccccgtcttttcgccatgcacgcagtcttcttttcctcttcagctgcttcacatgcgcggcaggctcgtcctctcggtggcttctctgtcgtggattgaacggaaggcggccaccgtccttttcggcccgccgcccgaagtttcactcaacgaggcgatcagagtgggtgcagcagcactgccaaattagtggtcggaaatgcttttgggcttctcaaactcttcctccaccgcatgccgtgccaaaaacgcgtttaatggtttcccacccccttgaaggacttcacggcggtgttggagttggcgccggattggctggagaacactctcttcctggccaaggcgtatttggccaacagcgacagggaaagtgcggtgcaccatttgaaacagctgatcgattcctaccagcagaacgaaaacgacaaggaccagcccgaggcactgaaggaggccaaggcgctgctcaagaagcacgggagaaaatgacctcaatgaaaatcacccatagatcttcttaatggactcattanaggatttgcataatttctaatctgtgccacatttgaatatgtgactctcactanatttaatttctttttttgtttgcattc

SEQ ID NO: 24051 - DNA, 1393 bp, Heterodera glycines
ggattacccatgaaaataatttctcaaaacttatttttttttaattttttgggaccaataatctttaccattgccaacttcaaaatcacataaaatactaaaaaaaatattattaaggccctttttggtccaaaaacacaaaattcgaaaatttgacatttcgactttttgttcgagttcgggttcgggatagaaatcggtcgaaatggatgccatattcgtgatcagcgacctagaaaaccccaggacacttgttttcaggactttttaaaccaaaaagtttttgaaaaatttcgacccaaaagggggacccaaactgaaagagtacccaaaaaataagatttttaacaattttgggtaggggggtaaacccaactcatccaaacccaactcatccaaaccaactcatccatacccaactcatccatacccaactcatccatatacccaactcatccatagcacgatacgagtcgtcgccgtggcatttaatgccacgactaagaccgtacaaccaaaaaatactacgactaagaccgtacaaccaaaaaatgccacgaccgagaccgcataatcaaaaatgtccacggtcaaggccggcataatcaaaaatgtccacggtcaagaccacataagcagaaaatgccatgccacgacgatgactcgcagcgttatggatgagttgggtatggatgagttgggtctatggatgagttgggtatggatgagttgggtatggatgagttgggggtgactcgacgctttaactctttaatttagtcatttaaaaattgtgtaattttttttggccatgaatctcacatcaaaatgctttttttttgatttaacaaattaggtaggtacgcttttgtaattttttaaatttgaattcacggagttttcacttatcacttccgcacaagcggcgtcaattggctcttaggaggcgggtgtggggaggaggggagaagggtgcctcgaagcggaccatgtacccgtacgtatatgtattacaaccaatttgaacatgcctatctatcatcatttagataaataaattcaaatgtggcgaaagattggcaggcgccgaggtgacgcggctccgccccctcctcagcccttcctttaccctctcttaatacatcattcattcatttattttgatgtttatttgaaatattctttggaatgggattagtgactgactgactgttcgttcacctttccctttctaattttttatgacgcggaacaaagtttaaaaaattatgcgggtgtgccgcgatacgcgttcatataccatccttttgatatgcatatacaacaacaaattgacaaaatccgtattacagatttaaagtattttttaacatcttaacaccatgtcccctta

SEQ ID NO: 24052 - DNA, 1838 bp, Heterodera glycines
tttttttttgcatatccactcgtacgaaaacggcggtacgaaaatgtcccccgtacgaaaatggcggtacgaaaacgtcctggcccggtaaatagtgctgctcataattggttgcctcacacgaaaaagggtgcaactttgatcatacggacctcaatttcgaaaatctatgatttttaaatcaatgataagatcaagggatttttgcaaatccgatatcttattcgtgatcatgaatttcttacgcccgacttatttccttaaaatttcggaaaaaatcaagtactggatgaaaagtcatagacaaaatcaacgattttcagaatctgagctcagattcgtgatagtgcatttttagcccagaaaaattgcttcttataaaagcttactattttttccatcgggaccacaattccacaccattgccgaaaatctcgcaaaaagtcaaaataaattaaaatttagattagagcccggtaaaaaatttccggcaagggaatcaaaaaagggaaggaacgagattttgatttttttgaattttgttatttaaaaatttttttaaatatttgtgctaaattttaaaattcgaagccagaaattagaaagtattccgtatcatccccgatgtgtgccaacacccacaaaatgtcgtaagtgggaaatcggcattccgactcattgatatgcacgttgttatgaacgtgtatttgatgattagttatgaaatttaatttaattactctcttctataataaatataaagtctaatacgatttttttgtggtgatccagcggtgtcgacatgcgccactagggaaatttttgaaaacttaataggctcaatttgctaacaaatgtgctccaaaaaaagagaaacctttggttaatttttttgagttttaggccgttattaaaaaggaagaaaacaaattaccgaagctggaaaaagttactaaaattaaaaataattacagattattttaagaccccatttttaccaatttccacagttttgagaaaaaaaaattcgggaacgtgattcccgcaagttttattttattagccatacagggtcaatgcagttcccacaatggcattcatatatatttttataatttgtgcccgtataaatttaagtggtaaatggaagagtgaattttattacagtaattaaaaatttattgcgttatgtccgctaattcttttttgatcatcttcgactttcgttgttttttccatttgtggaaaatgaaaaaagaaagcgtgcacagcatcgccaataggaaaatgccgaaagcccaacaactgaagggacattggcacacagttttacgaggatggcctatcagaagagatccaaaaaagtccaaatcctccgacaaatatttgctggtcatttgatcgtcgatcagtactcatccctcagcaaatgtcgccgtcccgcaactttggtgataaaaaggatcatggaccagttattggcttatttaactgactttggtatttgctcagtccaaaatttcccggcgcatattgaaaagcagtgccaatttcatcgtattcaaattggtaaagaaaggttggcacatttcgccgtgaataatcagcagcgaacagcctttgacgcattcggacaatgccttcccgccgttttcatagtttaactgacagactaatcgacgacagtaaagcgcgaggcggaccttgtcgacccgaccagttctcgggctgagcagcaccgctccgtccagaaactcctttgaaacggtgcccgtcattacgctgtgcttgcccctgtaacggctcatcagattgaccaaagtgtcgttgattatcta

SEQ ID NO: 24053 - DNA, 2415 bp, Heterodera glycines
  misc_feature (1848)..(1848): n is a, c, g, or t
aaaaaaataaaaattaaatcctttccataaaaataaaaaattcccccctcccccggcaagccggggcgggggcggctggtgggcatggcggcgttcccccatctcttccttttccggcggagccaatcctggaggtttccagtcatgctggagcctcgttgaggtcacaaatgacgtgggtcagattcgagccgagaccacagttgagcaccgggcaacgcttcaaagactagtaataataagtaacttaaaattggaaacttatgacaagaataagcccaaaaatggaaaagtttcggttttaatcaactttcttaaaattactaaattttggctctattgaattttttcttctaaaatgattttacataccctatttaatttttaaaatgtttagcttaaaataattaatttgaagaattttggaaagttttaccttcaattaaaaaaaaattgtgtatattttcgacttatatgcatattttgcaatttttggtgcatattttgcgattttatgtgcatataattccgaggcctaataatgagatacgtacataatttttaatcaaaaattctcgtcaagaaaataaataaatttttgagaaattttgcatttcttagtggtttatttttgaaaatgttagggtcgattctttggggtgtattttttagagctgagcgggaccgggaattttgacaaaaaccgggaccgggacttaccgggaccagaaaagtcgggaccgagacctcgattttcgcccgggaccgggaccgcgagaaaagccgggaccgggaccaaccgggacttttcccaagagaaaaattttttgaaaaaaatttgcaaaattctaaaaattttttgagaatttttttattgttttaatagattgaaatcttttaaattttttgtttttaaattactctttttgtggcgctgttttttcaaaaaacttttgtggaataaggggccggctgtgccgattggcgccgccgccgggaaagttttataatttttaatgcgaattgttaacagatttgaccacaaaaatgaccaaatatttggttaatttttgggtttttaggctgtttaaaaattaaagaaaaattaaagttggaatatttctttattaattaaatttaaattgaaatcatgtaaagataatatgaaattatatcccagtggggaattgaacccaagcgaaaaataatgaaagtcagaaggtttagccattacgccacataacgacataaacaaaactgggattcgtttttttcaaaaaccgggaccgggacctgaaaaaaccgggaattcccgccccggtcccgcgctcacaatcagctctagaatttttcgttcttattgcattttgttaataattttgggcaaaaacaatgtttaatttgagtgcttgaagaaagtcatgaagcgttgaagttggcagtttattttaaaatttttaatatttattatgtaaagttaaaaagagtaaatttaaaaattaaaaaaaatgaattttaggatggattgctaatgcatttcatacccgtggagattgatttaaaaaactggccacaactttgcttaaaaagcgataaatgttacatttggcatcgtttgataggtttgataacctcagaattaaaaagaaaatccacagatcccggcttttctgtccgacttaaactcccggccccgacaactcaattcataattaattgtaatttcgaatattcgcttaaatatttactattctgcagcttgattgtattgcagcgggggaatatattaaagaataataataaaattatttttaatttttatggcattgaaattgacaatcccccccnccccccccctcttttgcgctaatcaaataacccctcatccgcccccccccctccatctatcgctggttcgtcctgctgatgccaaatgaattgcatctgtcccgtctccccatttttccttccttttcagcccctcgggagatgggcggtatattttctgagtttgcccaaaacttctttcccctcattacatcacaatgccaatgccactaattgatttagagtaatgcgaaaaaaaggaagaaaatttgtcgcgttttggcggcttctgctcataattcttagacaacaaaaaagagttacctaaaaatgcgtggaccaatcgaaaattaaattttaaatttgcttttgttttttaaatgttcatttctgattcattgtttccttccattttggggcattgttttttaaatttaaactaattttgtcgcgccgtattttatttgacacaaaaaatcagattttttgtgtctctgaacgaagtacattcaattcacttgacactatttttctttgttcgcaatcctctgctgttggtgttcggcactttgtttcacccctttgggt

SEQ ID NO: 24054 - DNA, 2239 bp, Heterodera glycines
aaatccttgacatccagatttgcttttggtcataatgtttcaagaaattttaggattgattatatttgaccccgaatttttgactttaattctgttccatggcacaaatccgcgtcttttttttggcattttctccaaatcccccgccccatatcagattaattttttgttccgctacgaccgagttggatactccgaatttaaagaatattataaattaattaataaattaaattttacatcttccagtgcttccagccatgaatctggcgcaaattctgtggaaaatattttttcgaatttttaattttataattttcttgtaattttacttacttgaaaaaacttctttcacatgttttaatgtgcgtaatgtgatcatggatgatgcttgttgtgcaatgttgtcaatttgtgcagcgttcagtctcgggggaagctgaatatttttatggaagctcaaaaatttagcagtaataatttcaaataaaaaaatcgattaatttcattaatttatttttgaataaaaattttgaattattaggattaagaaaatataatttggggccaacttttatttcaaaattcagccaaaatgccaggcaaatgtatttttagtatataaaatttatttttaaaaaattgaatttttcgattaattaatataggaaataatattttttatttaaaataaattggttttacatatttaacgctaaaattagcttcaggcctcattttctgctgctggttaatcggctcatcattatctttggagaaagcgttcttaaatattaattaacattataatttgtttaataaatttcattatatttattaattttttgaaaatttttacatttgcttcattcagtagcattttgaggctgcagttgttgagtcatcttcatcggaacttgatgatgaatcacgcgactaaatttatcattttttaaattaaaattaatttttattatttaattatgataaaattcaaaatttctttgttctaatgttttacaatttttccagcttcatcatgggttgcatctgctgttttaacagtttgagttccttgaccatttgtagcacagttagtcgacttaattttcaaatttttattacaaataaatattatttccattatttattttaataattagatattaatatttgttactttgttagcaatgacagtcaaaagcaataagaaatgaatggtggcataaattttgttcatcattttgttataaaaaaaattttcaactgattcaatatggtcatattttgcccattaaaatatgggcagaaatctctttttttttattttcgttactaatctctttttttaataatggattaatggtcattttaattggaattatatttaaacaaaaatgtttttcatagggattaatgtgaaagagtaagcaaaagatttttcgtgttattacagataattagcaattaaaatacagtgaataaatatgtgttgaaattgaaaataatcatttgaatattttatttaataaatatactgtgtaattcttgagcttttgcttatttttttgtttattcatatttgaaatgttttaggaatttttcatatttaactgtgccttgtttaatttccgaatttagtatgaattttcatagaaaaaaccctggaaaatcaatgcctatgaaaaaccgaggcttgagtccagccaatgattttttcactataaagagtgacaatgaaattcttgccacaccaatttttatcaatttttgacaagtttccggagaaatattaaatgaaaaaaaaattttgttatcaaataagcacaacaaaatataaagaaaagtggctattataaaaattacattaaaatccgggcactaattatatcaatgccattataatcgacttagtcaattgatgcaaatttctttatccatctgcgcagagttcctaatttcttagcaataattttgtcactaatttttgattttcttctttaatttcaaaatattgtttcatcttttttaatttttgctcattggaatatgatgcttaaaactagagttgagcgggagcgggaattttgggcgcaaaaccgggaccgggaccttttcgggttgaaaaaccgggaatttttggctgggaaaaccgggaaaaaaccgggacttcggtactcagttgtactcagttgtccgtgttcaggtcccggtcccgctcaactctacttaaaacaaa

SEQ ID NO: 24055 - DNA, 2091 bp, Heterodera glycines
tgttgaaaattgtatggaagagggaacggtggagatttggaggttgaggatgaggagacggggagggggcaatctctgatcaagcgcttatcgatcgaacggctaattaagcgtgtggagggactgatcggctcattcgaatcagtcgccggtgccatggaaagactgctcgaattgcgagtactcacttcagaggacagttcagcaacagaggaagagatcgaacagttatacgaacagatggacaacacaaagcaaaagctgaccaaacagcaccaaaaagtgccaaaaatgaacggggaaaacggcgaggagctgcgaccgacgaagttcgaatatggcacactcagcagtgagggcgaattggaaggcagccgaatgtcggcggacgaaacagagcaacggcaggacatcgctgggattgctcactccgcgcgaccgccccggcgcaaaatgagtttgggcgagcagacgcggctggacacggtcactcgactccgttcatggcttcaggtggatgatttttgcaggtcaacaacaagcgaagttggatgagtttaggaagtggagagggacgtgtcggcaacggtggacttgtccgatcagcttctgatcagacagacattaggcaaagtgcaggtgcgcaactgatttgtccatcatggttcgtcccgcattttgcagaattgcgtggatgaaattcatatcaatctgatggagattgtccgagttttggagagtgccaaggatcggctgatcatcgaacgggctcaactttgcgcgacggagatggagcgcgtgttggccatttgcaaacggcgcaaggcggaattgcagcacattttggagcagtgccgcatttgggagcagttgcgctcctcaattgaactttggcttgctgatggtcggtttggagtttgaccataattgcgtcaaggctttctttagcgagtgatcgcctttgttttgggttgctcgtcgtcgaattgtcagatggcgaattgacagaacaactcgaactgtgcgagcagctggtggacgagctgaacagctggaaaagcaaattgcaggagctgaacagaatatccaatcagtgagaaaatggacagacaaatggacaatttggcgaatcgtttagacaattggacacccaccgaagggacaatggtcacaatttgtcgcatcaaagcagcaaactgaacgcccaatggaccaaattcaacgaccaattgcgaattcgccgcgccgttttggaggcagccaaacgatcgcggcacgactttcagacggcacttggacatttccaacaatggctcaacaaaatgaacatggaaatgcgcaaactgaacgaagagacggacaacctgcaacgactgaaggacaccgcgcgacggagggaatggttggcccaggaaaaggtggcaatagtcaaatgacaataagaaggcaccaaagcgataatataagaaaattaaaataagcggatacggtaattaccgtaaacgccagaggatgaacagtaattataaaaaacatttttaggaggcccgcgtggaaatcgacgcgcaccgcgagattatggaatcggtgcggcgcatgggacggaaacttatggaggagcagcaacgcgaactgagctcatcggcaggagaagagacaccgccgccgagtgggaacagaacgacggagcaaatgaaaagtcaagtggaaatggtggagaacgaatggcagtcgctgttggaacaggcgaaaagtgtgcgggacagattggaaaatgcgcaggaagaatgcgaacggttaacgtaagtcgtaaagggagtggagggaggagaacaatgctaattgggggtgataatgcttaattaggggataagacagtaattagtgggacaatgtttaattggggagaggcaaggctttttagtgggaatgtggcaggcttaactaatagagggcaattcgggcaaggcttgattaaagggaaatttacccaatcaataataagcagagcggcggttgcctttcagacaatctctgaccgacttccttaagtggaccgatcaacagctgaaaagcattgccgagtcaaaa

SEQ ID NO: 24056 - DNA, 921 bp, Heterodera glycines
agtttatgcatgggagacatgtggttcagcatgggaatgaggagaaaatgcgcttgtaatcagtcgtaaaaggaaattgagtttaatggaaatgtgggcagtgatgatgtaaggcaaaatgagaagggcaaacattcggtaatgagaaatgcaataaatatacagcagcacacaatgaggaaatcagttggccaaagaaatcagccaaacgttggcagtaataagcgcttaaatcaattagcaaatgatagaaacaagcagcagcagatgaagccggtgaatattgagcaacaacaattagttaatgttatgcaaaacaacgtgcagcagcagcagaaaaagcgtttggatgggcatagaaattaccatcaaaatgtcaagcgctggcaagcaactgctggagaaaaccagcatgtgaatggcaaacgtgccaaaacggtaaacaacaatggcaacaaacgaatgccaaaattcaccgaagacaaaaagcgccgcttgaaaacagttcatcacgtcaaatttgatgatgaaaaactgcaacatgtcggcaacctcaaacacaatgaagatatggctactaagaaggctgaaaatgccaaaaagcacagacacacaatgccagcagcaaaaagtggcgacacttttacagcacacgaagagcaaccattgagtttgctggataataatccaccagtgaacgaggtaaattaaaaattgtttcttattgataccggaatttcgcccaatctgaggaattttagaatttttcttttctttttttaaaaattatttctctttcttttaaaaattctacgctattttcattttttaaacggagtcaacggtaaaaggaaattttttataaaaaaacctagaatttttatgttgaaataataaaaataaccataattttacaggatg

SEQ ID NO: 24057 - DNA, 1489 bp, Heterodera glycines
  misc_feature (1389)..(1389): n is a, c, g, or t
aagtccattagtagtgcccaggtcaccggctggcacttagccgctaatggacagttccattagtagtgctcaggtcaccggctggcacttaaccgctaatggacagttccaattaagccgcttcaattgtctggcatatagcaccagacagcgagcggttccggcatcctcaaaattcaaattttccattagtccttccatcgctccccccccccccccgatcaaccctgacccagacacatcaattaactgacttatgaatgaccgatcggttgagggctttataagcgccactttgtgggcttaataagtaaagatgatgtcgcgcccccattcacttcccccatccttccgtcgggcacgctcaaaaaggagcatttcggaaagtggcatccgaaagcccgccgctttccatagcgaaatgtggcaggacccggaatatagatactttgcccgtttacacgataattctggggggcggcggcttatcagcacaccaaatcccgtgtattttcaaaaagaagcttccccgagtaggtcctattcatgtacaacaatgatattaattcccgagtgctttttcttttttttgcattttgcaatttttattttagatcaaatgcaaatccaaaattcgcaacagctagacaaaatacagcacttacgaaactctacaccgacttcagtcgggttcgcacggcgataatgagcggaaattctacctgtactgagacgctgacgcttagactttggtcattaaacaaccctcaattggtaagtcaacttttttttgcttcattcccaatgggacacggaacccagaccagattcgtgatcagcgaccatgaaaaatcttctttttttgcttaaggcatcagcaccggttcagtctgagccaatccgccttgccactccgtatgtcagaccgaaacgatggaagaatgacgaatggcggaggtggtaattttgagtttcaataaaaaaagttataaaattagaggggtgatgggcatttttatctcgacaattcattttttccttttttacatgccccttctaattttataatttatttctgtgattttaccttattttattagtcacaatgtattccttactgtgatcgcctttcagtagtttgtgatacacattttttttttgtctttcaataaattcattctttgtagtctttcttttttaaaattttaatggcaatatcttttaatgtttaatgtaaaaaaaataatgtttttttacttgatatttactgtgataattttcttttctatttatttatttgcctttttaataaattgcttctttttttattatattatccccacaaaaatcgacaaaaagttattcccttcacaatttcccttccgctanattgcaacatttttggcgtcatattatactcccatcccaccaccatccttgttgttatgcccgaactttcacccgccgccgagtttggctagggaaaact

SEQ ID NO: 24058 - DNA, 1134 bp, Heterodera glycines
tcgagcatgatagagagggcggtgcgcaatcgatcttttatttgagggaatttttaaatttatactctatcccagaaaaatggctatctctttttttgataaattttatacacaacaaatgctctcgagcatgatagggagggcggtgcgcaatagaccttttattttacagggaatttttaaatttatactctatcccagaaaaatggctatctctttttttgataaattttatacacatacaaatgctctcgagcatgatagggagggcggtgcgcaataaaccttttatttttgagggaatttttaaatttatactctatcccagaaaaatggctatctctttttttgataaattttatacacaacaaatgctctcgagcatgatagggagggcggtgcgcaatcgatcttttatttgagggaatttttaaatttatactctatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgataaattttatacacaacaaatgctctcgagcatgatagggagggcggtgcgcaatcgatcttttatttgagggaatttttaaatttatactctatcccagaaaaatggctatctctttttttgataaattttatacacaacaaatgctctcgagcatgatagggagggcggtgcgcaatcgatcttttatttgagggaatttttaaatttatactctatcccagaaaaatggctatctctttttttgataaattttatacacatacaaatgctctcgagcatgatagggagggcggtgcgcaatagaccttttatttttgagggaatttttatatttatactctatcccagaaaaatggctatctctttttttgataaattttatacacatacaaatgctctcgagcatgatagggagagcggtgcgcaatcgatcttttatttttgagggaattttaaattatactctatcccagaaaaatggctatctctttttttgataaattttataacatacaaatgctctcgagc

SEQ ID NO: 24059 - DNA, 1774 bp, Heterodera glycines
  misc_feature (27)..(27): n is a, c, g, or t
ccctgctgatggttctgctgttggtgnatggttgggtacctcctagggaacgatgtagacagttgaatagtcatattttcgcgtatatcgtgggaaataaaaacggaatcctttgggttaaatttcagttgggttaaacaaaaaaaaaattgggtttcatactgtaataagccacggtgttcatttgatagattggtctactgtataataatgctggcgactcggtactgtatgtacttattctcttgtgaaaaataggagacaagcagcaccaccaaattcaaaacatatttggcgcctaccagcattaagcggcagcattgccaatgcttgggtcgggcgttgtgcaccgttggcaacattttgaatttggtgcaaagcggcggaggatgactggcgcgaggcgactgcccgctggtgggtacggcgttggttggcgaaccaattgcaaatttgctgaaaatttttaaattaaaattttaaattcaattttaaattcactccctacccacctgataagtgactttgttgttcgcccgtcggtaggcagccgcgttcagaatgttcgcgtaggacaacagtttctggcgtgtggggttcgggtcggagcggaaccaacgctccagacgaggcagctcactcaccggactgaaccggatgttgctgagggggctaaaaaattggaaaatgtttaaaaaaaaaattaaatttttaaaacggctcccggaaaatgggctggctcatcctataacacgctaattggtctaaattaaaaaattggaagttaatttaaaaaatttcttaaatatttaaagatatttgcattgattggatccgttctaatccggccctgcccattggcaatggaggactaattaatttttgaattccaatgccaagaaatgaaattgaattcgtctttcgaaatcgaacctcatcagcccaaaaattgggaattaaatatccaaccagaataattttatcaaaaaatttttgggaacggcgttcttggggtttcttggccatgttgccacctcttcctgctgttctcttgctgggccacaatttgttccagccattcgttgaccgcttcgctttgctcgcggacgcccatccacgcggagcattcatcgtcgccggccatcaccttgcaatcaacaattaatgcagttcaagaaacacgagaaaacctaattggctttgttaattagtgagcgccaaatggaattttccggttgcgcgaacaggtaaaactcgataattaataccggtccctgttttttagaaatgaccgataaattttcaagaaaatcgtttaatttttaaagttatattttgattaaaaaatcaattattcactccaaaacaggcacggatgaggggggtgggggttttccccacaaatcaatttaataaaaaaattcgccaaaattaaaacaaaaattcccggacgatgccatggttgggaaatgtttcagtcttgggacatgggacacccctgaaattttcggtggacggagtgccaactccaaaagcaatttatgccgaaaagcggatgagcacacctgttgaagaatttgcttgacttcttgcccattggacgaggtcaaaatttgcggctgcttctcaatggcagtcttcagcaggcgctgtttgaggtcgacgaggcattggccatttgagtcattgggggaagtgcaattaattaattaggcaattaattaggcaatcgagagagtaggcaaatagtcaaattcatttttatttccacaca

SEQ ID NO: 24060 - DNA, 1743 bp, Heterodera glycines
  misc_feature (1714)..(1714): n is a, c, g, or t
ataaaatactgaaaaaatagtgacattacgccaaaattttaattattttggcgaggagccttaaagtctgatttttgtggcctcaaaatcgaaaattcaatgctgacatgcttttttgagctcctttatcaaaataaaagcaaaaaagttttttcactaaaatcacggctctattactgacgtaacattttagcacatttgttttcattttagcaatggaaatgtgctgctcaacagaaagcgaccggtgcctcaaattgtcaatcaatttgctgggaaattggtgatcaatttcgctggttcggtgtggatgaatgatgacacaacggaagactacttgcacaaaataatcggcgcaaagctcttcgttggcgaacgcctcttggtttgggatgcgtttggcagccacaagagcgagagaacgacgaaggtggtgaagggattgggagtggaaacagtttttgtccctggcggctgcacttaattcaaccaggtgccaagtcatatctacctatctcaatgaaatccatttttcttccctaggctcccgatgtctcgtgaaataagccgttcaaggagcgaattcgacacttctacaatatttgatgtccaatgaggcggaaaaggagtttacattggcgggaaacccgaaggcaccggctctccacgtggtacttgactggatccaccgatcatggcaggaaatttccaaagaagtgatcatcaaatcatttgagggttcagttgaaaaagaaaacggaaaaattcctgaatttttagtctgtgggttgacaacgccattggacggaacaggagatgaaaaaatagcttgcttcaagccgaaaggggcaattggatcgataggaaccaaacttttgcgcgagtttagagcaactgaaactatgaaagatgggcgaaatgatcacgaagaagccggcttatctgatgatgatgtgatgtgagttggatcaagtcggagatgaggatgaaattcttatttgttagcgttttttactgttatttttgaaaaaaaattgatacaattttccaaataaaaattccatttatccccccggggggataaatggagacgggggattattgttcaacctccccagaaaggggggggggggataaatggagacggggcgataattagagataatacggtaatgcctatttgcctatttttatgcgtatttcgccattttttgataaaaaaattttggtttaaaaattgtccttattcgaaaaactttaaaaaattgaaatataagcaaaaaaattaagtttttgaataagcttacgtgatttgcttcctaaaaagcgttaataaaactttcatttgccattttgtgcctattttgcgatgttttctgcctttttaggtgcttatttcgcgattttttgtgcctaaaaatcgcatctctaatgtttatatgtcgtgccatttagccgggagcctcgttaccgcgctcaaccaccagaaaagtgaagtgaaattattttaaaaaactttattttattattgaaaagctgcgaagaagagctaaatcattagaaaagatggcgcccccacaaagtgtccaagccacgaattgtccaagccacgaattgtccaagccacgttttgtccaagcacgttttgtccaagccacgaattgtccaagccacgaattgtccaaaagagtaaaaaccaggaaaattgtccaanagtctaaaaagctcataaaaagccggaaa

SEQ ID NO: 24061 - DNA, 2350 bp, Heterodera glycines
  misc_feature (9)..(9): n is a, c, g, or t
ttttaagtncattttttcaaaagaaaaagtatagactctttttcatagaaatctaacaaaaattaaaaattctgtttctctattaatttttaaaatttcaaaaaaatccgatgtgacatattattttcgttacgaaaagtccaaaataatgattaataaaaatcagttattaaactttccatttaattgtgccaatcgaaatacaaaaattgttttttagggattttataataccaaaattgttaagttctgttgaagcttcttatgctgagaagtatagagtttgctcagacagaattttcgtcttttttttcatttttatcccatttttcattttaaaaaattctttgttttatattttcgttttttttaagaaatttaaaaatatttctaaaaatatataatatctgcttactttgcatatattattctgctgctgctggtcacattctactggtatgtgcaatttgttcacggggttttcaaaattgtcatcacaaaattgcgcctcagtttttggcactttttttttggaaatttgtttgtggcattttgtcttcctgtttaacaagtggttcaattttaattttccctaattgaacttcattatcgggttgctgctgttcctctttcacttttcttgcttttgcctcctttccatcgttttgggtggcttttcgttttcccaaattctgcgatttcgttgaagatgcctgttgccatatttcataaacaaatcgtcgttttcatttgctccaactccgaaaattccatcattttctatataaaaaattataataatattgaaaaataatattttggcgaacaacatttatttgttcataaaatttttataattataaaaaaatggagagggaaaattatttattttccatcattgcgattaatatttgtaaaagattgattttacgccaaatatacaaataattatgcttgaatattagggttggcaaatattctaccggaaattaaatggaaaaaattttaaattttaaaatttttaaatatctttcttcatggttaacttaatgcttaatcgaattttgtccgaaaaagatgaaaaagttttgcgctttttggtctattttaatgtaattcgcgaattggggggcatctgtgaatttgtcccaattagatttagaaaaaaacttattttaaggattgatcaaaatgatttttgaaatttaaaattttagaaaattcatattttctcaattttttttttgttttgtaagtggctattgaacattgtatttaaaataggctttacagaaaaaatagtttttttcagtcactttttttatttttgtactttctcgtcaaaatactttcttttatgcacacttttgtatataaatatgttaaatatgcataaacaacaaataaaatagaaaaataaaaaaatacagagagaatttaaaaaatagacggatagccataagaaagaaaataacaactaaaattaaagatttacaatgaaaaattgtcaaaaaaagagagcaaatttaaaaagttacaaagggctccatttgcttattggacattattcctccataaaaaatcatcataaaaactaaaagtttttttaaataaattttggtgttccgtttgattcaaattaaaaattcatgtctccccgactctacttctgctgggagaaaatatggtcgagagtttcagaaaagcgagaattattatttggataagttgctgtcggtgcaaaaacagggttgacatagtttgacgataaatccttggttgactttggcgtctgatgagttccggcattgttaaaaccattcccactctgctgctgttggaaattaggtgcttccgtgttttgctaccttccctcccctcggaaaattttaaaaattcatattttggggttttcaaggtcactgatcacgaaaatagtgcttgttttgacatttgatgacatctggtcataggtttaacaaaatatctatgattttttgaaatttaaaatttttcgaggggggtagcaaaacaaggaagttaccgagtttttctgcttagagttagaaatcgctgttttttgtaaatctttattttttccttccattccgtaacaaaaattggcacacaatgccaacacaacgacgaacaacgccagcagcagctgcagcacagtgatcaggcgacggaattgcatggttttgatctgatgggcctgcaaataaattgtgcaaagttcaaaattaattgaaaattgtaaaagttagtgcccaactaattgaaaattaaattttatgcgtcggagaaaaaaatgatgggccatcatttaatgaatgatatatgacttttt

SEQ ID NO: 24062 - DNA, 1365 bp, Heterodera glycines
  misc_feature (96)..(96): n is a, c, g, or t
  misc_feature (101)..(101): n is a, c, g, or t
  misc_feature (122)..(122): n is a, c, g, or t
  misc_feature (156)..(156): n is a, c, g, or t
ataatgtgcgaaaataataatgggaaaataattaccattccctcacgggggccatacgacaataaattctgataaaaacattactttttaaaaagnatatnaattgataattttaaaaaatnagaaaaataattttgttttttaaaaattatttangatccatttccatttaggtgatgaactccggttacgagaaaaaaattaaaaattttattgttcatataaaatagcaaaataataaaaaaaaaattattcttctaattaataatgtttcgacaaaaatttaatcattatttggactttttttagaaaaaaatatcaaattatatagagctatcgtatggcatggcactaatgatatctaaattgattaaagtattaaatttatcatatttttttatagaaacaaaatataatcaatctagaaaataaaaaaactcagctaaaatttttttttggtaatttctaataaaaaacaataattctttactttttcatactttaaaaagatatattcacaaaagacataatataaaaagataaactataaaataataattttactgaataaagaaaatataaaaaaagcatattgagaaaattattcaataatattttatatgattataattatataaagaaagaaaataattacaaagaataataattatgccaaaagtttatgtaaaaatcatttgttataaaaaagaataatgctaataattatttaaaaattaataaacgaattcaggaaagtttttataattggttgaaattactgtgtttgaactgaactatcaaaaagcataataaaatttttgagattaaaatgtaaataaatttttagttgtgtcaaaaaaaacattgacaaatataataaaataaccaactgagaaaattaaaaaacattttagttatctctgaaagtaagtaattaaaattattatttctatatttgattagaaaatttatttgcaattattgcaattttattaaagatattaattattttttaatcttccatttgatcgttgccaatttttaaagcagatttttttggcaaatcctcaattttacaaatagataaaaagggaaattaaagcacataaaatttttatgctgattgtttgattcattatttaagttaattaaatttaatataatattttttctgtttgttccgaaaataatttttattcaatttgattttactattttttattgacgagctccgattagttatttgttaagtctattatatctcttgttttatttaagattaataaatatataactttgtataaattaattttgttgtaaatttattaatttaaaataattttttttatattttctaatcaaaaa

SEQ ID NO: 24063 - DNA, 949 bp, Heterodera glycines
ccccccaatgttcccagaaagttttttgaaaaagagcagccgcaaaaaagcgatctgaaaagcaacgtaaaattaaaaatcatcaatcctgtgggttaccgccgacccaagctttaggcagaaagattcggaggtgggaggaatcatatttttttgctttaaaaaaacattttttgtcttggctttagaaggaatcacttacctaatttaatgcctgatcagacttattcaattgcctaaataatctttaaaagattttttattgttgctaaagccattgctagtagtaaaaaaaaattcggtaacgcttgaacaaaattttcaaaattaaattttcggcaatttctaaatacgcaataaaagcagttcaaatgcatgaaatatttgtcttgccttcggaatcgtattcttcgttttatttcatgcattttattgcatatttagaatttcaaaaagggggggggagtaacatccgtactaccgtattatctctaattatcaccccggggggattattgttcaacctcctcagaaagggggggggggagttttaacattaaaaactcattttttgatcgggaccaattgggggggggggggttgtttcgacaatattattactcataccttttcacaagcttatcaatagcgtacctccttcaaattccgaatcctcttccccgtttaaattgcttgggataaaaaaatccgatttcattggatagtttattaattgacaattagtaatccatccaacggtcagctttttatttctaattcaagttttggctttttttctaatacaagagaaagtgcttttgctgattttttttcagttgaattttccattataaatccactaatggtcaattttgtccttctgatttcttccgtcgattattcggaggatccaatgtccccgggcgaacatttgtccccatgggatttt

SEQ ID NO: 24064 - DNA, 1568 bp, Heterodera glycines
tgcatcaccataaaactctctaccatggggttggatgtaatacaccagtgtatcattggcatcgtagcaaaagagattaggatttttttgactactgtaactgagcaaaccgttctcatgacgcttataaaaccgtgctccttgggctaagtctgagaagtcaatgacagtattatattcataagtttcgcgcaataactgtacggtagcggtgcccaacaactgaaaatggaaagtgagaacaattaccggaccaaaataaactttaaggattataaaattattccaataaaataataagcataataaaagttttttcaagaaagaaaatattaaattctgaatttttgataaaattttccaattgttaggagtgtattttttgaaattttcgactcgattcttaaggtgtattttgattttattgtatttctgtatccgaaaatccttaaaatcggtaacaaaatagccataaaaataggtaaaaaaatttttacaaacaattttctggcagttaaaaagcaaacaaaaaggttaaattttggattattgctgtgtaaacgaataatttaaatattatgagtttttcttagaaacattgacatcttaccaaaaaaaaaaatttaaaaaaattaaattaaaaattttgtcaagaaaaaataaataaatttgggagaggaatttttgagaaagttttccaattcttgggggggaggtaatttttcggatcaatttttaggggtgattttttgattttattacattttgtttaagaattatctgaattaagtgttgacacataaatgaccaattaattctactaatttatacctttatgtttccattcctttttgcatagaaaaaaatttggtcttttccgtctaaatgaatgggccattcattaggacaaatcagtaagcattgttttagagccagaatatccatttttatttctttttcaaagatcttgccgcgattgatcggataagcattggaataactccaaattcttaactgatcatttccactgaataaaagttttttcttcattaccaaatgcaaaactgcgtgagttcgtcgcatttcagtcaattcaatgatatcaattagctaaactaattaatcataatgatgaaagggataacaataaagcgcggttcaggatgggaccctgtgcgggattttgcggcatcccagtctgcaattctcacatttttggaattcgggattttgcgggattaatccatgcgggatcccgccctgtaaaattttgagttccaatcccgcagcggaattcgcaaatatgatttatgaaaattgtcggatttatgggagaatttttcttactttggtataaccattctgaaatttttgcagactggttatcatttgggcttttccataaaattaaaaaccattctatcaagaatataataagatataagatacataatacctttctcaaaatatataaaattgcctagtaattaataaagtttattcaagaaaatttttcataactaattagacatagaataaccttttttaggctttcaaaatgattttga

SEQ ID NO: 24065 - DNA, 2251 bp, Heterodera glycines
caaattttacattaaggattaaattattaaaatattttcattagtgtgaaggcggagtcacgatggcatgtgtgctgggccaatgcgagtgcaaattgggcttccaaccggttcgctctttaagccaaaagtcatggcactatttaaaattaattgttgttcatcattttggaacaatgatcatcggtacccgagctgtgagcgaagatgcactttggaggaggtaaggacaatttgattgttaattatataatattattattggtttttttttttgcagttttgttacttactcaaaaaaaacaagggcttatttgacgaaatttttctcgaagatataataaaaacacaaaatttctccatttaaattgaacttttcacaatggtaaactttaaatattagcatttttcggattttgtgttcctattttttatgcctatttaggcgcctaattcgagatttttctagcctaaaaattgagtctctaatttctataaacaaatttattgttgattgataaaattattttattaacattatttttttttggtaatatcagggattttattggggtgataatttttaaaatttattattttttgaatttttttttaaatgatcaggtgcccgtgattgatcgatgtttgaaaaaagttgaacttggagagcgttgtatgagcagcaaacaatgtggcgatgcggcagccgagtgccgttttggcatctgtcagtgcctttgcaccttcaaacagacggtcagtgccaaacttagaatccggtaaaagattatgtggaaacatgaaaatgggtgggatcacatgtggaaaatcccatcttttttacgattccgtaaaaacccggtcggtgttaatccgaattccattgtgaaatggaaaaagcctaaaatacatttttcaaccaaataaaagattctagagattttagagaattttttctcttttgtttatgattgattacccactaccaatttgagcgcttcggtgagatttgctttctgatttatgacaattgaatattttttcgaatattaccaagttttccattagaaaatgaattttcgttcgaaatttccaataaagaatttttagaatttatttaattagaatttatttaataggtttgctagagaaaatagtcaaactgaaagttttttctgctcagaaagttctttttgaagataaaaaaaaatttaattcataaattttttttttatcatactttaagaaaggcgggggcaggggataaacgagctgatccaagctaagagtgataagaaacagagaataaaccaaaggcatgaaacatttttttttcagggaccataattatttattaaattagcttaaaacaaaatttactttcttccgaatttattttttcccgcgtttaggagagaaaattgtaagaacgggaaatggaaaaaagcatatgggaaataaaaatcattaaagggaagagatgcaccgtgacccacggtcacgattcacggtaccaattcaaggttattccgtgaaaaatttacactggataaaattgaatatttatgaaataaattttgttttcatagagaaatttggtcattttttgggcaaagtttgctaagaaacaaagcaaaattatcttttgaacaaaacccacctaccaatattgtgcgaaaaacaaataaaaagcaaagtttcaaggatgaccccagttaaataaaaaactcattaaaattttttttaattcgctcaaataaagttaatttgcgcaaaatcagtttaaacaaatcccatttgcaaatttgcccttgaaatattttcagaatattttgggcggacccccgcgctgcaccaatccggacgacccactcggcttcagcaatattctgacacgcgttgagcaaatcttccaaaatcggcaaaggagtgccggctttagtgagggatgagaaggcaatcagcggcagaggacatttgcgagccgacatttgggcaccgagaaattttaaatgccattaatttgaaggtgcctgacagagcaattaaattttaattgtcttattaatcagtgtatttattattctcagaatttattttgtattatgaattaaaacaataatgctaattaaagttttttggcatctaaatgttgacaaaaacgcgttaaggacgaccatgataaaaaaaaattacgtgaaatgtaaaataaagatgagaaattaattcaaatcattgtttaatctgacaa

SEQ ID NO: 24066 - DNA, 1021 bp, Heterodera glycines
atttgttaaaaaattcatgatttgttaattgttattagagaaattaaataaaaaatttgctaattttggtgtttaatgtaactgaaacaaaaaataggtttccatccgcaaaagtggttgtccgcaaatgtcggctttaaaaatcaccaaatgtcggtccgcaaatgtcgggtaacctttttgagacatccattttcaacaagacgcgccttcgcggagacaagacgtagagcaatcattcaaaggccattttgtagagaattttgtgctctttctgttcgtcatattcatcttctatggaaaatttttcccaaccccctagaatttttttttcgaatttactcagattttcgtattttttcacccgcaaaaattttgtgtttaatgccttttttatggcataaaatgaataaaaaatgcttaaaggatgtctgtacgttatcttagtgctgattgctgttagtttgattcggttgggcaaatgttagaggcgatttaagccttttggcccttaatttctcctgaaaacttagaaaattcaacataactctgcctaaaagacatatttctgttcgcaaaataaacagaaatgtgaaaaaagatttattctttcttatttagtttgttttatctgtttatttttggtagttgttgagattttgttcgtttttatcaagtgtctctattttaaattaacaccccatttttgaaaaaaaatcgtaaaacttttttccgtcatcatttcggtttctcactttcagaatcttaatattttcagaattgctacgtacagtcaaaaattcagctcgatcggttcatgggaagtggtcaaactcccaaaaaacagggtgtctttattttaaattaacacagtgtagaagctttttctaagcaaatgctaaacaattggatgcattggaaaaaatgagcttctaaattttgttttagattttagactaaaataaaagcgattattttgtttaaaaaagcgattgaaaaatgtagaatttttttctctatc

SEQ ID NO: 24067 - DNA, 1064 bp, Heterodera glycines
aaacgatataaccaaaatataaggaaaaatttttttcatttttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaataaatagattttttcaagtgtccgtttggggtactcaaacaattatggggagcaaaaatccaacgcagaattaaagtacaggctatagggaagctattcccgaaggatgcggtctccccataaatctgggcgcatcggttcgggggggactgccccgaaacacaaaaatcattttttgcagtgtccgtgtgcggtactctaacatatatggggagcaaaaatcgacgcagagttaaagtacaggctataggg

SEQ ID NO: 24068 - DNA, 2136 bp, Heterodera glycines
gtcaccattgaaacgcattggcttcgccaaatccatgcggttcttcgggacgggcaatgaacagtccagtttctctgtttatccaattctgttcgatgcaatcggtcaacgtcaatgcaaatgtcggttgtggcttgcgaatttcaatgtagccgtatttgagggcctccggcagagaaatttggtattccaaaaggcggaacactccgacgtaccggtccaaaaaatcttaatgggaaatattgttaaacaaaattgtataggtgataaagaaaattggaatgtttaatgaaacccaggaaacattgaaaattattgggtacttttttacagattttcaaaaaaaaaatttttttttattttttaaagaaaacttttagggattttaggttcggaaatccgattctggtatctattttggcccaaattcaaacgcggaaccaaaatagatgtcagaatcgggttttccgacgctaaaaaccaaaaaagaagtttattctcaaaaatttttttgaaaagataattaacaagtaccaagaattgttaaggtcgcactaaatctaaaatttggccaaaacgaaaccatttttaaaattagttaaattcgcattttgggccgaaaatcctatttaggtatttagaaactttttcgcccacttacacttcagtgcatgatccaagtccatcggtgtcacttttatagccccaaatttgacgtagaggtggacagtgtttggcgaatggaatgctaaggaatcccaataatccatctgctcattgttattgagaaattgtcgggtgactgggtcataaagtccaagtgcaattgcctcgttaagggtgatgttcaactttgtttgcgggtgttttagcccatagtgggcattcaatattatggcgtcaattggattcattctcaacttaaaaaatcgaatgcaattaattaaaaagaacacattttgttgtaatggttataaattttcaattataccttaacattagaaaaatttctgtaggggactcctttgagtctgcaattttcttaggagtatgaaaattttgcataaaaaacccagtgataccaactgcttttttggaaaaaaacctcaaaaagcctccttccattgttttatggaaactgaattttatttaaatttaaaatggttggcatttgagaggccgtttggccagtaaatcccaaacccagaaaaattagatccttgaaacttttcagcattataaaaattgagctacattcgatgaatgattaattcctagtatacatatatcgttgaaaaagttttggtagttttcatttgctttttttctcttcaaattcaaatttaaatacaaaacacttagccaaatgctaaaaagctaaaaatggtcaaatatggactaaaaactgacaaaataaatattttaaaccataaaattccaaaaatatatttatattcaatatttgctaaaatagacttaaaatacgcgaaaaactgccaaaaaatggattaacatttaaaaaatgccaatttttattaaatttagcttcacaattgcaaaacaaatgcatctaaaaatgtttataataaataatatctccgcgaaaattttcggatggacaaaatacataaaaaaaaattcagaaatttcggaaaaattcttttttagaggtgtattttaaaaaaatttccaaaaatacccagttttagggatgtatttttcactttttttgcagtttcttgtgataatttgccaaaaatggccaaaatatggactaaaaacacaaaaattctttgcatgtgcgcagaaaaaatatgtaacttataactagggaaccgatttctagtgaaaaaacttttttttttgctcaattgttttgaagaaaggagctcaaaaaacgcatttctgcgttaaaattttttcatttggacgtcatttttcgtcactagaaatcactattttagagtttcgtcacttaaaatagtgaaaattcacttttttggctttttgtcactattttttcacttttcgacattttttgaaaaatccttaacaaaaatgcaataaaaacaaaaaaatacacccctaagaaccgacctaatttttttttaaatacacccctaagaaccgacctaa

SEQ ID NO: 24069 - DNA, 2190 bp, Heterodera glycines
  misc_feature (30)..(30): n is a, c, g, or t
tttggggatggcccttcgacctgcgctctncgcaaagtctgtgctctctcgctgtgtgtcgaaaattgtctgctttctctgcgctctctcaacggcactttgaaaaggcggcacactcagcccatcttaacgcatttctcttccccccagcaaaagggagggacacgcaattgtgaacataccaaagccaaatccataatacaacatctgatgacagaagaaggcatcacaggacaaagggagagaaagaagaaaaggaagaagccaaattggaaaggaaatacgacgcaaatggaaaaagaagccacgagcaaataattacaaatggaatgaatgaataaatgaacagaacggtctttccaatcctttgtttagagaacaaagattagctaaaaaaagaaagtaatttatttaatctaacaataaaaaaaaggaataaaataagccaagtaaatcacataaggcatgccacatgcttaaacaaaacgggacaagcaaagttatttgctctaattgaaaaacagaaaattcagagcaaaaaaatgggagaaaagggagaggaaaaagcgcattttcccaggtaattaattaattaatagcagggccattacacaatacgacaaacaaatttcaacatcgaaacgaaagataaaatgataatcgatagaagggttgttagcatatgataaattggacaaaaaccaaaaggacaaagggaaaaggaatgaatgttattttggagagagaggaaatttgaaatcgggccaaagcatttttctaattggccattaagttttaaaacaaaaattacactttttcacctatgaagcacattttcgatttccttttttttcctgaattcgtataaattcatccgttcagtaaaaagaactccttgtcatactgcaaaattcccgtgttcagaatttgccaaaaacggaagtcatatcgatgtttagcgctcaaacaccggaaatatttttctcaaagaaaactggaggcaattctgcagttttaccaaattcctaaccattaattcaattctttataagttataaaaccggggcaaaaatgaacaaaaaatttattttcttttttatgtacctatatcaattataggcctgtttatacacagacaaagacatgcaaatgagtgcttaagaaattattcatctatgttcttgagccaattatgctccaaacattgccctgcagtggcgcgttcagacggtctgaaaaaacaaattaaatagtaaattacaaatgaaagcgagcttgccaaagggaatgagggggagacactcccgcccccaaacacagcaatccgggaattttttttgaaatttttttttactaatttcatcaaaaagtcatatttctttcctccggcccctaaataagaggccttaaggttttgtgaccaacgccttggaattggttagactgcagctaataatgtaaatgttgaaaacaaaagactcactcatagttaagcataggaaccaaaaatgcagcaaatgatctggcttggtcgaaaggccactggtatttctgagtaaggacctgaagttttcttcattttaaaaatggattttagaaaaattcacctcaagcagagaccagggcttcagattcggaatatggagcaatcgaccagtctgcaaattccatcttttttaaattcgaattccgaaagtctctttaccttatgaaagaattctcgccaatgttcaccctttttgaaaacagtcggagggatgctgcccaacagttctgttaatccaaaaataaaccaatgattgggcttaattatttgtagcaaaagtcaaatgcggaaaccattccttttttaattaattaaagcagaaaccgaaaattaatgccctcaattcgttacgattgcctaaaaatgaacaaaaaagcaccgattatatgtgccaaatggtcttcgtccctgctgtaagttccgccttaaaaagaaaaccaacagtaattcaaacgaatcttgtcattctcaccgctgtgcggttcgaataaataatcgccggtcgccaattcgaaagccttttttagtgaagaaatttactaatggtaataaattatcacaaaaacaactgaccatacaggcgacactccaaatatctgctgatgcatcatagccctaaaaccgaacataaattattttagtaa

SEQ ID NO: 24070 - DNA, 1451 bp, Heterodera glycines
  misc_feature (1427)..(1428): n is a, c, g, or t
  misc_feature (1441)..(1441): n is a, c, g, or t
tctcttagacttgtaaatttcaaaaattgatttggtaaacctttttgaccacaacttctttgaaactcaacgaaaattttttgtattttacaggaaaatagaggacactcagggctatcaaaagatgccaagaatgtttaatttgggtgcttctataaaaagttatgttgcctgaaatttatcaaaatataacatggtcgtgtctttttttgtggtcgtgtaaactgaaatagagcaaaatataattataattatggtcaacaaatctaattaatagattaaaaggtcccggtcccggttaagcccaaaattcccggtcccgctctaaatggtttgtaactaataataacattttgacaggggatagtgaatggtatcattataaagcccacaaaaaatgctacaagaaatataaaacatatatacacaatatagtcatattgagattttataatcaatttaaatcaaatttggtagaaaattttgagtgttcctaaacatatgaccatgactgtatgtactgaatgaataacggtgtaaaaatgaaactgattgctgtctcaaattttttttcttaaattttttttcgggattttatgcaaaaaatgcatccagtcagaagcagatataatcttttaattgttgtgttggcacagacaagtgccaccggaccggatggtgccaatcaacagccagcacaacatcacactgtcctcctccaccagtgccaacaaggagaagaaggcgtgctgttctgcctcctaatttattgattgattgatcggaatgatgacaagtggtgtgatcagagaagagagaggggaagagagcaatcatttaattcaaaaaataataatataaataaatttctgcgccttgcaactcaaaaaaaaaacaggagtgtaaaattctggggctaggactctggactctttgtattggtactgaatctgcggtttgcacgcaaaaatgctaccaaaaactagagttgagtgggacagggacctgaacacggacaactgagtaccgaagtcccggttttcccagccaaaaattcccggtttttcaacccgaaaaggtcccgggtttgcccaaattcccggtcccgctcaactctaccaaaaactcacaatttccaaattttcattggccccgtttccgaaaaagtttttttttgtaagaaaacgcgccgcaaaaaaacgtttttattccttttttatttgggataaaattttccaaaatacaggtttttaagcatttttcatgaaaatttgtactttttcggtatgacaaagtgcgtttcagtgtcaaggaagtcggccgggtccgaacctaggaaacccccgggattttgttaaggacgctgttaaaacgaaaaagaaaattcattttccggaaggacatgcaagttgtgtcacacaaattcnntgggcagacaaanagactctaga

SEQ ID NO: 24071 - DNA, 1962 bp, Heterodera glycines
gttttggtgtggcgttattttaatttggaaaaacactttctttttcctcctttaataaatacaatttttgatcgaagggcaattaatttctttaaaaattgctaattttcatcaggttccctccttctgatcacgaaaacttaaagaaatgatcagatcagctgttaaatttaaaatattttataaaaaataaattaaaattttatgtgaaaattcaaacatttttttgtgtttaaattattaatcgtgaaaatttattcgatgaaaagcaaatgatggatgcgtacagcagatgaaaatgtaagtttttgttgagagaaaagtcgtaaagtgacaaaaattttggagagggcaattcaaagaaaaaattggaggaaaattgggggagagagagaaagggggaggggagggggatcagcggaagagcaaacgaaaaggggtcaaaggttttgggggaaaatggggggggggggggagaaacacacgtcagcagctgatcagcagcagaagatggaatgaatactgactgatctgaagcacagaagcagcagggcaaagtaatgaatgatcagtaaatcagcagagcgcaacacaaaagtgttaagcagagagagagggggagagaaatagagagggatgaagagagaccgaaggggagagagagagagaaatagtgagagagatagattagagggggagagagaaagagaggagtgagagaggggggggggggagagaaacagtgagagggcgcgatgaggagagaaaggtggagaaaaatgcattagtcattttgatcaaatgacagacaatgtaatgctgtgtcagtcattagagcagcagcaatgagtgtaccataaatggaaatgcccttttatgacatcattgagtgggggaatgcttttggttcgttaattgatttgatgattgaaatggaaacagtgcgactgatcagcaccgtattaattttaaaaagggaccgtaattgaaacattgacccgcttcgagattcccgaactgttgggcctaatcctttttggcagttttcttttgttggcccaattttaaagggatttccccgggagggccaagcaaaagccatcggcacaattcggagacgacctcttaaaaaacacacaatgtttttggcccaattaccatagggacgatggacaatgaagatgaatggaaaatattttggccaaactcaggaaaaagtcggaaagttttcattttgcatttttaaaaagcgacggacggcaaataaataaataaataatagtcgaaagtcaatcggaaatttgaatgatcggaacgatgcgacttaaaatttgaaaaatttgggaaactagaattaaaaaaatactgtatgcagataccgtaacgcaaattaattgaaatactgtaagtccattaatttccaaaattattttattttttattggcattttatctgtccactaatggactttttccatgtcaattaggacctaattgagcacatcaattagtgtgggcaacatgcgtttgagcagaaagagttgagcaaagcctccgccgtggttggatttggtgggtgattagcagcacaacgagcgcaacaaccgctgctgggggttggttgcgttgccaatgcaaaagaatgtgccgacgctgccgaatcattcaaattattgtatttaagcccccgggggaattccctcggcggacggcggaggtcacagaacgaacggagggattattaacgggtaattaataaattaagcttccgctgacgaatgagtgttgcccatctgttgttgctcaactgaatttggaggaacaattgccttctgttgctgatgagagacagtgccgactgaattggcatggcatggacgaagtgctggcaccaccgcagcaggggaggcaaacagaaaagtaagccgaacggaatttcggaaaatgggaaaatgccgaaaa

SEQ ID NO: 24072 - DNA, 1067 bp, Heterodera glycines
acgacttgatgacttgacttgatgttacatcaagtcgtttgataagcgtttcaataaaaatcatcgtctgccgcagactataatcaagcgaattctgtttcagtccacatcgtttcgccaacttgcatctcgccaactgactatattattttaacttttaatttattaaaatatgaatatttattctatcaatgaattaggagtaatcgagttatttaaatgttacttttttggtgggaaaaatcaaaagaattaattttagtaaatttggctttttccaaagtaattcagctttatttaaattgatttcattattctttaaaggataagcgagatattttttgtgatttaaattttaaaacttatttatttataacaagtttttgatatatagttttagaaaatttgttgcccttttttcgactttttatgaaaatttactcccaacgatggtttgctccccgacatttttaaaaggtaatttcctattctgtaaccacagaagaatatatttttaaaatcacgaaagtcgtgcgcaatttttatttatgaaaagacaaaaatattagaacataattaatttaacagaaaaccatccatcttagtcgtaacagtatttcttgttaggagttcgacaccggttgacgttttcatttgaatttatttttatctgaataatgcagggtttctttatgttcttatttctaagaaatgttctgattttagggcgtattttcatccaatgaatgaaatttctgaaaaatttggctaatttctaacaaaattcataaaaaaaatttcccacggcggcgcctatcggcaccaccggcccccaaaaaacctattctttcttaaaaaattagccaaaaatctctaaaatttggtaattctttagacaaaatctgggtaatttatgcaaaataaatagaatcgaggcgatcaacgaataaaggaatgtggagccaaagaaatcattcataaaaaataattttttttgtgagattttttggagctaattcaaagcaaactcccgccccgtccccgcggaggcggaattatcgtgcccc

SEQ ID NO: 24073 - DNA, 1006 bp, Heterodera glycines
ttttccataaataaaaatactccccttatttaaaataaataaataaatatttttttttattaatatgttgtttcccattttgcgactgaatttatttgtgatttatcaattctaaaaaactgttcatttaataataattccttttgatgaaattttttgttcaatattatttgtttttatattgtattgtaatatggaatttaattccaaatgtatagttcacaatatataatatttaataaagtttttagattaaattattttattttgcgaagttaatttctaaatataaattttttatttaccttaatcgagtagaaacttaagtttttgttttgttatatataaaataagttcgatttgtaaaataaatattattttgaatttattatgacatcgacagtcggttcttttcggtatattcaccggtaattattttaaataattttttattatcaattaaaattttattttatttcaatctacaaatatttttaaagattaaaatagttgatttttcttaatatttaaaattctttttcgttttaaattttttatttttggttaattatatgaacaataaaaatttatggcatcaaaaattggtttttgttcgtttaatgctcacaattaaccttagataaatgttataactaatgaaaagattgataaattacatatcatattttatagcatttcttattttaattttacatgtttaatttttacatgtttttgaactcttttttaaaacttattcgaatttctttacgaaaaattttaataattttcacctgcatttgaaataattctatgaaaaaatgttttttattatttgatttaatttttatttgctcattaattaaattaattaaataactgacgaatttggataatgaattgatgagaatgattaaataatctaaggattaaatttttttaggtggatttgtttaaacctaggaggagtatcatatttcttttctttataacttaatttttattt

SEQ ID NO: 24074 - DNA, 167 bp, Heterodera glycines
ccaactttcgcgcacttcaccgccgttttgctcagttggccaccgacggacatttggtgtacgtgttgagacatttcgaccaaaatgatcagaaggtaacggcaggcagcagctcgtagttaatgcactccttccatcataactcaaaaaataaatcaaaatttttg

SEQ ID NO: 24075 - DNA, 2785 bp, Heterodera glycines
  misc_feature (29)..(30): n is a, c, g, or t
  misc_feature (35)..(35): n is a, c, g, or t
  misc_feature (71)..(71): n is a, c, g, or t
  misc_feature (2773)..(2773): n is a, c, g, or t
tgtatgaattaattaactcaaatataagnnaaatnaattattcgcctttcaaatccaattattaaatattntaaatgattttagggggattaaagttactatttttaaagaattttttttcaaaaaattaaatgtattttgtctaaattaaataatctttctctgattgaaaataaaaaaaattttttttttttaaattttaaattaaataatttattttttaaaataatttattattttttgttacattttttctcatttgtttaacagagcccatctgaactgttgccaacaaaaattggacaagctgcacttgttcgcactgacgaccgttccaaggtggacaaacggacgccaattttcaaaaaaaaaacgattttttaaaggagtttcgtgtcacaattttggtgcccgaaaatggcatttattatttgttggtggactaccatggatgggagcgcagtgcaatgccggtccgtgtacgtgtccaacaaagtgatcacactgctgaaggcgttttgctggtgcgaaaataatgattgccttacaattaatttttattctctcctgggattacggtagagtttcttagagccgttactgtaaatattaaataaaaataaatggtaataataaaaaaaaattgtgtttatcacatgcattaggacatattagtcgcacagtacaaagtgctttacagtaaactgccttatgtctcattatggtaaaagggatatgttactgtataattgtttgattgattacggtaaaaccaagggtcacattaccgatttgaggaacaatttggctaatagaaaaagaatagccgaactaatggctgtactgtacccgtagtcctttacagaaggatttaaaaacatgaaaattctagtatttttgcaacctacagtaatttattggcctttcttttcactcgaaagaacgcggaagcaatcattttattgatccctacagtgggatttcaaaatatgaaaaacatgtacagtatttttgcactacggtattttattgcttttcttttcacagatcaaccactgtccgtacgcgtttttctgccgcgaaatgttgtccgccggtggccgtgccgcaatgcttggcctggagaagagtccaccgccagtgcttgtcacccttcaagtgcagcccgggcgcgaattttccatcggcgccgtcacgcttgtcaaggaggagcaatggcacaatgacctgcttggccaggtcatccccctcccacttttttgtggatgaaaagccaaaaattgcaatgtaaaaaatcgatttacctccaaaaatgaggtctctattttaaagattagccctaattagtatataggggcgaagccttattttttttatctctctctcctaataatgacgacaataattcaagggaggggattgtaattttaggaaatatggtaaatttttggcatgcaaaaattctaaaattttcgttaaaagatttcggggaggggactgtatttaaggaaacacggtaaattttcggcaagcaaatatgccaagattcctcgtcattgcctagttttgctagcttgaatttggtgtccatactcacatattttttttcaaattaaaaaaaaacgccaaaggaatgatttgcgaatttcaaaaatttttgattttggtcaaaatttttattgaaatatcatttggccaataatttgtttggcccaccgttttcagaaaccgttttgtgtgcgcaagaatggcgtctgcgttgcgcaacgctttccgcaaccgtctaattcaatccggactgaagcggaaaagtcgggcaaaaacatcaattccagcattgcgggcgacaagttgccattcccagtggccggcgaaccgtcccaaatgcgtgtgatggcattggccggttccggggctcaggtgggaaaaacgaaaaaattgaataaatttctaccgtaattaaaatgactaggtacggtaacaagaatattttggatgggtgtttttttttgatcttgcccaaaatttatttgctcaatttttcatatttttttgaggaaaaaaaataaaatttattttttttcagtccataaaaatttttttttagttttttatggtgaaattatgattaatccttaattaaatgaactgcttcggtgttaacagatagccccttaaattttcgaaaaataataactttaattttaaaagagaatgaaaatcgtgaattttagtaaaattaattcttttaaaagaatattcattttcttttaaataattaaaaaaaaaataataataatttattgtgatttaatattaggaagaatttatttcaaaataataaattaattaattttcagaaataataaaatattaattttatttatgatttatttttagaaaatattttatctaaaaaattaattgattttcgtcgaatttaatttagaaaaagaatttaaaaataaattaattgttcatcatcaaaattattataattatgaaaaatgatttgatttacatgctcaatatttaaaaaaaaaaccaaaaagatttttatttacattttcatttttaattatgttcagagcacattggacattgagggtgttgttgcgacgccgaacgactatgtgttcgtggtccactacttcagcccggacaacccgccaattgttgtcgatgtactcatccaaaatgaacattttggcgacgcgttgttccactactgtccgtccatgagcggatgccggacaattgtggtaggaaacanaaaatttaatca

SEQ ID NO: 24076 - DNA, 1095 bp, Heterodera glycines
ggaaaaacccatttatcacgtctaaaaagacacctccttaaagcgtgaaaacataggcttttactttgcgagaatagatattataagtttttccttctttataattgacaaaaaaaacatttgtaacagttatggacaaaaacagcttgccgtactaaaccgaccctcgtactaaaccggccgtactaaaccgaccctcgtactaaaacggccgtactaaaccggccgtactaaaccgaccccgaccgtcagaaacatgacgctgacccacaaaatgtccagcccacgaaatgtccaagtttcgaatttgagtttttttattattcagatgggcctaaggttaggcaaggggtaatataaagggtatattcgtattcagcgaccccgaaaaccctaaaaatcctaaattagactcattttgttattataaattttgaaaaattttggacatttcgtgggtttttactcttttggacatttcgtggcttggacactttgtgggggcgccaaacatgatattcaatatcagaaaactgatgtcattatgccaaaaaccccgctaattcaaaatttttggtaatttgatctcttgttttccattcgttttttatctctttgaattaaataacaataaagtaataacattcaagcatttataaagcattacgaatggattccgaggaaaattcgccaattcacttatcttaaacacctgccggactccattatcaagtcaggaaaacaaaacttacgcaaaaaagtgaatttgcaaatctatttttaaaagaaaaattatggaatgtcaaatgtgcagcaaaagacaatgtgataaagacgagcatatgcaatttataacatcagcagggggcgcataccgaacataagattaaattaattaatgaatttaaacaaacaacacacaaaaaatccataaataaaaaataataaacaaaatcatgtaaacaatttaaaggaattacaagatataatcaaactaaaaaaagcgttattttaatacaattcttagtgaacaaattacaattatttaattagcatttaattgaaattcaataataaattaatagctttattaaa

SEQ ID NO: 24077 - DNA, 826 bp, Heterodera glycines
ccagcgcaattcttcaccagaacggaatttttaagatctttggtcccgtacttttggcccagcgcaattctttactggcgcgggatttttaagatttccggtcccgtacttttggcccagcgcaattcttcaccagaacagaatttataagatttccggtcccgtacttttggcccagcgcaattcttcaccggagcggaaatattaattttccggtcccgtacttttggcccagcgcaattctttaccggagtgggatttttaagatttccggtcccgtacttttggcccagcgcaattcttcaccggagcggaaatattaattttccggtcccgtacttttggcccagcgcaattcttcaccggagcggaaatattaattttccggtcccgtacttttggcccagcgcaattctttaccggagtgggatttttaagatttccggtcccgtacttttggcccagcgcaattcttcaccggagcggaaatattaattttccggtcccgtacttttgggccagcgcaattcttcaccggagcggaaatattaattttccggtcccgtacttttggcccagcgcaattcttcaccggagcgggatttttaagatttccggtcccgcacttttggcccagcgcaattctttaccggagcgggatttttaagatttccggtcccgtacttttggcccagcgcaattctttaccggagcgggatttttaagatttccggtcccgtacttttggcccagcgcaattcttcaccagaacagaatttttaagatttccggtcccgtacttttggcccagcgcaattcttcaccg

SEQ ID NO: 24078 - DNA, 804 bp, Heterodera glycines
gatttccggtcccgtcttttagcccagcgcaattcttcaccagagcggaattttttaagatttccggtcccgtacttttggcccagcgcaattctttactggcgcgggatttttaagatttccggtcccgtacttttggcccagcgcaattcttcaccagaacagaatttataagatttccggtcccgtacttttggcccagcgcaattcttcaccggagcggaaatattaattttccggtcccgtacttttggcccagcgcaattctttaccggagcgggatttttaagatttccggtcccgtacttttggcccagcgcaattcttcaccggagcggaaatattaattttccggtcccgtacttttggcccagcgcaattcttcaccggagcgggatttttaagatttccggtcccgtacttttagcccagcgcaattcttcaccagaacggaatttttaagatttccggtcccgtacttttggcccagcgcaattctttactggcgcgggatttttaagatttccggtcccgtacttttggcccagcgcaattcttcaccagaacagaatttataagatttccggtcccgtacttttggcccagcgcaattcttcaccggagcggaaatattaattttccggtcccgtacttttggcccagcgcaattctttaccggagtgggatttttaagatttccggtcccgtacttttggcccagcgcaattcttcaccggagcggaaatattaattttccggtcccgtacttttggcccagcgcattcttcaccggagcggaaatat

SEQ ID NO: 24079 - DNA, 1669 bp, Heterodera glycines
  misc_feature (1571)..(1571): n is a, c, g, or t
  misc_feature (1624)..(1624): n is a, c, g, or t
gcaaagattgctttggcgggggatatgtatgtgttggcgtcttgggcaaaaacatcgcccggaggggggagcatgggatgtcgacggatttgtcgtcgtcgtaattttttcgatttttcacccctccctttttataggcttttcggtccacggatcggacaacaaacagacgaatgaatgaatggcgatggtagtggtgaataacacgtgttggcctgctgattagaggagaaaagatcgcctcagcgttttgtttatgtgtgcgaagcgattgaagaagtttttaaaaggataaagcgaagggacggaaaagaaaaaaaggtcggaaaatgacggacgaactgaaaacggatggccaatcattttgattggacgaaaagggggggggggggggagggaaaatacgattgaaatgaaaaagaggaaaaagggaccaaaaaataataatgaaacaaaacgacgacgacgggggcgggacagaaaagttggggcggccacaaagaaagagttgtgggtggtggccaatcggggggattaagattaagctaagctcggctatcagcgaagagcagcaaaataaaggcgcagcaacaactgacaccagcagaagcagcagaagagcagtgggggcggagaagcgaaaaagaaaagagagagagagacaaaatggacattaatcccccactccgtaaagcgatcactgatcggaaggaataggaagaaaaagctgatcggaaggggggaaacacaaaaatgaaaagcaaagcgggagagggggagctgaggtgggggaggaacatcagctaaccgacggaggaacatcgggcaaaatagaagcggtggcggcaccggtgggcgtggcattggccaaggattgcttggccaccccaaccgaacactaaagcattcattcattgtgcacggcgatgacctcgtcgcggaacacacactcaggtggtcctgactcatctgttgttgttgctgacgatacaaataacaagagggaccgactgatcagaagcaaaggggggggggatttatggttgggaaaggatcgcataagcacttaatttatcctatatccacaagtatccatattttgaaatttaaaaaaaatataacagttcaatcagctgaattgcccttttagatattctaaaaaatcgaaaaattttcagaaattagaatttttttcgagtatattgcttaatttaaaatttctaaaccggtaaattttattaaaattgaaatctcacttcaggtcgtttaaaaaattaataaattttaaattatgttttcgattttatccatgtttttatagccctgtaatgaaagagaagtatatacattctatggtaagtaaatgagaatacttatgctttatacagtaggcacaaaaaggattgattaaaataaaaaattttaatgtttaatgctgtttgccgaagttattaaatattaaaaaactcacaaaaataattaacttaaaagtggcaaaataatgcagaaataatggaaaaatagtcgcaaaattattcactaataaatttgcaaataaatgcattttttanattttttcaaaagtcaattcttatggcgtgtttttcgtttttactgaattttntgttaaaaatttaactcaaataatggcaaaattagtcactaatta

SEQ ID NO: 24080 - DNA, 1463 bp, Heterodera glycines
cccagttttcctttatcatcgccttgatcttttccttcacaattttcacagtgtccccggcattcacctcaactttgcaaaaatcacttacattattaggaatggagaattggtaatttacggaaatttcaaacacttccgacacaaaaatggtatcgccttttacaatgttatagaagtacattgtttgacagtcaccaaaactaaattctgttctatcggaaacatcgtctggtttatacaaatgagccaatttttgtctttcaagcggaatgccaaacttttcttcaattttctcttttaaaccttgtattgagaggtcgtattgcaccttaaccagggttgagaaataaagcaatataaatgtacaaaaacgcccaaaacatatctattagaatatgtaaattaaattttgtttttgttaaatagggcgcaaaatgccataaaaataacccaaataggcttattgttaaaatcacgttttagggatttaaaaaaaatttatttttactacttttttttgaaaaaaatcagtttattgaggttcttttttacaattttttgaatttttaacaagaaaactctaaactcaaaaattctcaaaatatttaaaataataaaaacatatacgataaaattgtgaaatttatgatttttgggcataactgtaatttctttaaaagatcctcaaaaatggcaaaaatttcctaaaggaaaaaccaggaaaaactagagtgccacgggaccgtgaatttttgcaaaaaccgggacttgccgggacctgagaagccgggaccgggacctcgatttttttctgaccgggaccgggaccaaccgggaatttttaaaaattcaaataaattcaaaaatttttaaaaaattcaaattttaattttttttgcaactgaaaataatacaaaattaaatttttattttgttttttattccataaaatcttaaagttaaagctaatttaaattaatgaaattttcaaacaaataatcattttttggactactaggtcgttgcataaaaaagggcgctttttcaaaatgactttttttaagacttgattaacgtttgctgtcttttttgtgtgtaattcttttatctgaatgttctcgtcatgtttttgccaaaaattttgattttgtccttttatatctaaagttacagtccaaaaaattgggtaaggtcaacaaaatttggctaccattttacaccaacgtccataacttgagttaaaattgtcaaaacgacttgaaacttggtcagattatgaaatttgatgagcttaacaagaaaaagcctgaaagaaatttttctgaaaaagaaaaaacaaaattttttggccatgtttattttggccaagttccaaatctattggccaaccgaaagtcaaaacaaaatcaaaatatttccatcggggttttgaggctttttatgcccttaaatatataaaa

SEQ ID NO: 24081 - DNA, 1540 bp, Heterodera glycines
attaaattttatataattttttcgaataaggaaaatttttaaacctaaaatttttataaaaaaaaaaaaattaaattttgacgattaatttttgagaaaatttttcaattcttaggggtgtattttctgtaattttttttagatcattcttagggttatataattttttcagatcatttcttaggggtttattttcccgatttattgcatttttaatggaatttttttgaaaaaacgccaaaaaaggcaccaaaacggcaaaaagccaaaaaaggcatttaaggcacgaaaatcccgaaaagggcaaaaaaaaggcataaagtcaacgtagaagcctcaaaccaagtggaaaatgcttttttatgcttaatatatcgaaactagtgcgcaaaaaaaggcatatgcctcagaagtcggcctctaatataagatatttaaaaaagaagaaaattaaacgatatttgcggaaatttcgcctccccctccgggctccaaatttaccattcgaatcaacgactgatgatattgtagttgttgttgtttttgatggtgttgttgtcatatggtaatcaatcttctgtgctttttgttgatcattatcttaatgaatttttattttcagggcattttctcaattttaaaacaatttttctacagaaataattttaattttttttgataccgcgaaattcgtaaaaaatcaatgttttcaatttgatttgattttttgtcatgaaacgatataatttggaaaattgaaaaacccaaaattaattcgagaaaaacccatcttatttttcttaaacaaaactaaataaataatcctgattcattcgttagctttggattgctctattatacatgaaaattttcatgactatcttttttgaattaattttttggtcataaaatcaaaaaagaaagttattttataattttttttttgtcttaaaatttacattccgtgagatcattttgttgttgttgttttataatgatgcaataaaataatataattgccaccaaagcggtaaatattcctttattcattgccgtcgacatggtgatgctcagttcctaaaagcaaggaaaagctataaatttattaagatttttttaatgtaccaagtgagataaatttttagttttaatttaaaaatatgaattttggtggaagatatagtatatttttcattaactaaaaattaaatatttgtttcaaaatcacagataaaatgccttaaaataaagcttatttattttgtgcgtcccatgccatattatgcgttccatgaccatttttttacgtcccaatatttgattatattaaaaaactatttgaaattgttgatttaacatgacatgttgattttggacccagccaaccctaaaataaacacccagggtaatgaagccataggtcgcattaagcaaagttgttgaaacctttgctgcatgggaatacgcctgaaatgttcaacataatcgcagcttcacgggttttttgtcctaatttaaaaaaataatacaattggaagca

SEQ ID NO: 24082 - DNA, 1732 bp, Heterodera glycines
accgagtactttcatcgcctacagtcgaaacgaatttccgtttttactattgaaattcacacaccatttggtgaatttgttaaatttcactggggaagttgtattcttacattacattttaagaaaagtatattttaaaaatgacacacgtatttttcgatcccgagtcggttgattggtcatcttttttcacttcacaacatgggaggggacagaagcaatactttgtcgggagcaagtaccagcggggattcggtttcctcggtaatgtggcacgtttcttgacccctattgcgaggaatattgcctcgagtgcaggacatgaggggctcgccgcggggcagagagttctgagtgacatcgctcagggccgtgatttaagggatgccgtcagggaacattcaagacaggggttgactaaccttaccgacaagttacaacaatgtgggaaaggaaaaaaggccctgatcactaataagatcgaaaacgggtatttgatcagttaagtttcatctaaaggtataaatagaacaaataacacaaataattaaaaaatgtcaactcttacgaaaatagacaaggcgagtgaggatggtctcgaggggggcctttcgctgtttgatatcccccgacgaacgttgcaattaataaatccagtattagggaattactccctctttcagcaataaatcaatctgggccgtatatatttagacttttttcagataatcagttttgtgatctcaataaaacttttctctatttgtcaacttcaatagagagaaaagacaaaagcaattggattccaattaccaaggacagtgaagctgaccaacacgtcggtgtcattcaaaattttgggcacagctttgtcaaaaccttaaaggtgtcaatttcaggtgttgagtcttatgattccggcatttactatgcgtttagggcatatatgatgaatgaattgggattttcagaagatgtcaaaaagggtctctgtgaagcgtcctgctattatgtcgatgatgtcgaccaggatgattatacaaacagtggctttaaaaacagagcgtcacgttttgctgatggtgcaaaatgtaaaacaatggtgaaacttaattttgatctcgcccgtcagcccaattttttgcttaataactctgacgtgatttttagcatacaccgtaacaccgatgattttctaattatggcaccgccatatgtttccggaaatgcagtcatagtgaacccgcacacatatcgtattaacatacacgatattagaatttatgtaaaaacagtagatgttacccagtcattaaataacataataagcaatcagctacaaaccaccccggccaaatatcctatgagaaaaattgagatcaggagtcttttcatcccgcgtggcacttctgatctttcacacaatgtttttacaagcattgttccgagacgtttaatcgtcgggtttgtttcaaccggtgcgtataccggaaatcctaaagagtcacccttcgtctttgaacatgccaaaatacgctctatcagtgtcgaagcgaatggaaacattttccccgggtcaccctattctcttaattttgatagaaacaaatacattcgagcatttgttgatatgtatacgggactcggcatggacgacggtgaaagaacaatgtcgatcaatatacaaaaatttgtaaacgggtggtgtttcttcgtcataccgatgacctct

SEQ ID NO: 24083 - DNA, 820 bp, Heterodera glycines
gtcttaaaaaaatcaccctattatttcacgtaaattcaaagtaattaattaggctaacgcaaaatgcatcattaaattgccaaaaaaaatatcgttgccaaaaaaaaccccgtaaaaaaaaaaatagtcaaatatgcatttaaatatttgagataaattgtcagataaaaaaaactcattaccaaattggcactgctgaaaattccaattcggcatccaatcaagcgggtgggatgacactgaaccgacgggctccgggtcctcctcatcatccgaatcgcatcggcacggcgggcgagcattcggcttgcagcatacggcgtagaccagtgcaacgaaaaaaacgaaaaaaataaggaaaataaaaaatgccgaaaaaaacattctaaattatacattttaaaaggcaaaaaaaatgcaaaaaaaaaagtaagcttacattaaagtgaatgcgttgtccggccggagagtcttgcttgttgctgtgatctcattcctgagagattgtcccgaccgataagcaatgggggggggggggggggggataacggcaaacgttccactaaagcataacggaagggaggggtaaaaggcagctaatagctggcggaagcaggaggggggggggggggtaccgaattctttgtcataatgagatacttgtcgtcacaaagttgtgcatcagaaagaatagtaaccctttctccactgagttgaccgactatcgataggagaacaattaactgacacattactgacaaaattcttaactaatatatcggacatcgggcgaacctttatataaaccatcaatcgaatc

SEQ ID NO: 24084 - DNA, 2132 bp, Heterodera glycines
  misc_feature (1752)..(1752): n is a, c, g, or t
  misc_feature (1754)..(1754): n is a, c, g, or t
  misc_feature (1758)..(1758): n is a, c, g, or t
  misc_feature (1761)..(1761): n is a, c, g, or t
  misc_feature (1769)..(1769): n is a, c, g, or t
  misc_feature (1776)..(1776): n is a, c, g, or t
  misc_feature (1792)..(1792): n is a, c, g, or t
  misc_feature (1794)..(1794): n is a, c, g, or t
  misc_feature (1819)..(1819): n is a, c, g, or t
  misc_feature (1825)..(1826): n is a, c, g, or t
  misc_feature (1832)..(1832): n is a, c, g, or t
  misc_feature (1860)..(1860): n is a, c, g, or t
  misc_feature (1864)..(1864): n is a, c, g, or t
  misc_feature (1871)..(1871): n is a, c, g, or t
  misc_feature (1877)..(1877): n is a, c, g, or t
  misc_feature (1895)..(1895): n is a, c, g, or t
  misc_feature (1899)..(1899): n is a, c, g, or t
  misc_feature (1906)..(1906): n is a, c, g, or t
  misc_feature (1918)..(1918): n is a, c, g, or t
  misc_feature (1924)..(1924): n is a, c, g, or t
  misc_feature (1935)..(1935): n is a, c, g, or t
  misc_feature (1939)..(1939): n is a, c, g, or t
  misc_feature (1952)..(1952): n is a, c, g, or t
  misc_feature (1971)..(1971): n is a, c, g, or t
  misc_feature (1996)..(1996): n is a, c, g, or t
  misc_feature (2001)..(2001): n is a, c, g, or t
  misc_feature (2004)..(2005): n is a, c, g, or t
  misc_feature (2016)..(2016): n is a, c, g, or t
  misc_feature (2027)..(2027): n is a, c, g, or t
  misc_feature (2037)..(2038): n is a, c, g, or t
  misc_feature (2065)..(2065): n is a, c, g, or t
  misc_feature (2076)..(2076): n is a, c, g, or t
tgatctcttgaaaagcagcaaaatgcttataaattagcagagtcccattttgtgactataaaaatgtttgtcttttcgagtttcctctcattgtaaaaaaatttctaacataattacctattcttctctttaatcattcgaaaaaccgtcaaattgtgttaattgtctcaaaaatgaaccgacggtaagcatttcaaaaattaaatccatttccctgttatttttatcgaaatttcagctgggtgtgtaacgatgttttgatggatctcttcccattttttggtcgtcttcaactcggcctcaaattggcgctgctttcaccacgtttcaatgcgcttgtggacaaacatttcgatggaaagaacgaattcacaatttggagatggattggatttcgcaagaacaatggcacagcagcgtcagaattatctgtcctcatcgattatgccaattctgtacaatttccttggctcgaccttccgctgccacacaaaattcgcttcaaacaccttcagattgagtaattaaaaatgcaaagttttacatggaaacaaaaacattccattttcagttacattgaccattccgtcatcgcttttctccgctccaatcatcaaatttttgacaaaggcaccaatttgcggttgtggatgtcttcttcgcagaccacggatgaccagccgatttgggaagttttcgtccgtgaaatatggccaatcttttcgacaaacattcgccacttgggttttatcggcgatgaacaattggacaatttgagtcgtctcatttcaccggcaattctcactgatctccatcagttgaattcaatcaattccggtgatttgttgcctgatgtgatcggtgattttgatgggccaaatgcaactgctggtcaaattctggccaaatggctgcatactcctagaaaagacgggcaaccgaagcaattgcgttgtcgtgatcaaacttcaggaacggttgcatgggtcaacaatttcaaggaggtaaaatgaactgacaagttttaataatctgttctcgatttggttccaattttagggccttctgcgtgccaccacttcagccgactacaaaattcagtttattgttgctccgccatcaatgtcaatggtgccatttgaattgacgaacggacgaaccaacgaaaagctgacaatgaccaaatcaagcgaaaatgcatgggccagccaatggataattaagcgatgccaaattggggagacggcggcggtgcaatgggaagatgaaaattggaacgatttgagcactgtccaatttatgatttttggcaataattgtatagggtgagtaacaaaaagcttttgactttgcctaaacaatttaaatttcgttaatctaggccattatctcctccagaagaagcgggacaaagcagcgaaaaagggacgtcttctgacaaatgagtgacggacaaaagagcaaaacaacaacagtgatcagcagaagaaatgaattaattaattgagaaatgatacgtcataatttatcagtgataaaaagtattttatgaaaatatcacaaatatgtataatatgtgcatatatttaaataaattggatataacccgtctaagaccttcctcaccaaatttctaaaagaattcataaaatttgacccaagttgccaattttttccgtatttttcattaaaattctttaacaaaaatccaataaatccaaaaaattctataaataaatcggattaacaatntnaatnttnaaatatanaaggttnttttaaaattttaatntnattaaaaaaaccctcaattttccanttaatnnccaccnttttttttcttctaaattcatataaaanacanaaaaatnccaatnactattaatttttatttnttanctaacanaaataaaatatnaaaatntatttcttatnattnttttacttaaatncccactctttttttctttnttaaaaataattttcacatcctcanccaanctnnctctaacccancccataatatnacccctaatnnattattctaataggtggaaaatcatanacaaaataatngattttgacctatgttggagaagattcgtgatcagcacatttttaccctaaactca

SEQ ID NO: 24085 - DNA, 1760 bp, Heterodera glycines
attgcaacaccaacaaatcattatttagcaaatgcactttttatagtcatcgactttcaaaaacaagttttcattttttaaaacaaaatttttcacccataagtggggggaggacatgtcatttttgtggaccagtaaaaccgatgattacggtatcggcagtattaccaataaaatgcttcgaggacaccaaatcttgaagtttaaaaaacaacggcccaaatagaggtacaattcgcagaattacagtcgtaacagaaatttaagtataaaaattttctttccaaagatttaattttccgggaggagcgcaattctgcgatatttaccaagtccggacgtaattaagggccaattgtcatcggaataatttaatttttaaatgaaaaatgacaaacttttgattgcctgcccatggcgctgcacatgcgccggcgtcagatgcaaaaagttgggaattttcatcaattccaagttcccgtacggcccttttggcgcgaaccgttccggcctacggcggaagcccatgcggacgggcaacggcaccaccgatgaacggaaggactgcgcggtgggccaaacacttggccagtcctgcgtggtcgacatgtcctcacgacgggggttgcgttcctgcaaaatttggttgccatgggcattttgcgctacttaaaaggagtcacccccaactcatccatagacccaactcatccatacccaactcatccatagacccaactcatccatagacccaactcatccatacccaactcatccatacccaacatccatacccaactcatccaaacccaactcatccaaacccaactcatccatagacccaacatccatacccaactcatccatacccaactcatccatagacccaactcatccatagacccaactcatccatacccaactcatccatagacccaactcatccatacccaactcatccatagacccaactcatccatacccaactcatccatacccaactcatccatagacccaactcatccatacccaactcatccatacccaactcatccatagacccaactcatccatacccaactcatccatacccaactcatccatacccaactcatccatagacccaactcatccatacccaactcatccatacccaactcatccatacccaactcatccatacccaactcatccatagacccaactcatccatacccaactcatccatacccaactcatccatagacccaactcatccatacccaactcatccatagacccaactcatccatacccaactcatccatacccaactcatccatacccaactcatccaaacccaactcatccaaacccaactcatccatagacccaacatccatacccaactcatccatacccaactcatccatagacccaactcatccatagacccaactcatccatacccaactcatccatagacccaactcatccatagcacgatacgagtcgtcgccgtggcatttaatgccacgactaagaccgtacaaccaaaaaatgccacgaccgagaccgcataatcaaaaatgtccacggtcaagaccggcataatcaaaaatgtccacggtcaagaccacataagcagaaaatgccatgccacgacgatgactcgcagcgttatggatgagttgggtctatggatgagttgggtatggatgagttgggtatggatgttgggtctatggatgagttgggtatggatgaggtgggtatggatg

SEQ ID NO: 24086 - DNA, 1280 bp, Heterodera glycines
tttttgcgcgtttctgtgtcatcaaaagaaggacaaaagcaatgggaaaagccatctaaatcggcgatgaaaaaggcaatttcgcgtttggaagaagaacgacgtaaacgggaaaaagcaacaaattccgcggcagcgaaattaacggaagaggtgcagaaagaatactcaacaaaatatttttgttttatttaaaaaatattaaaacctagtatctatacgtgattttaatatgtaaaacactccaaagtttttttttgtccggcgcgccgctgagaaatgagaaaaacttatctaaaccagttcattttaagttttaggattaggtgcctcgaaatcagtccaattcttcgaattaagtaaactttgaataaataattgtttgttaaggcaaagtcagtcgcagaacagcaacaagaaatggcacgagaaaaacgtttggaagaagcaaagaaaatgcaagttaaattggacgaatccttgcccgaagcgaagcgaaccaaaattcgcgaatgtccggcactgtgtggccagcgggtgaaagtgttcgcattcgtccatcggatgagacagcaaagtgcgtagcctcacgctcaaaacggaaatggcccatttttagggaaaaacttgatgttcctcgtccttcgcgatggctccggcttcctccagtgcgttctcaacggcactctctgtcaaaccttcgaagcgttgacactgactactgaaagttctgtttgcgtgtttggccaagtcagtcggttgtctttcttttgagtatttatcccttcgaagatcaacaaattgcccattggaaaagttgcgcccggcggcatcgaattgacggccgatttttgggaacttatccacggatcaccgcccggaggggttgacaatgtgctgaacgtggaggccaacgtggacgtgaagttggacaaccgccatttggtggtgcgtggagagaattgctcagccattctacgaattcgcgccgctgtgacacgcgcaatgcgtgaacatttccatgaagctaaatacatggaagtgtgtccaccaactttggtgcagacacaggtcgaattttcaaaattgtgtctacaattgctcagaattagaggtcggcacggacgggaacccgcgtattaggttttacgggcttatccctcacggaattccgtcttgcgttttcaataaaaagaccggtactaaggcgtccattggaaagcaggtcctttagtttgcatatttaagcaagggcgtggctacccccccccccccccccc

SEQ ID NO: 24087 - DNA, 1756 bp, Heterodera glycines
  misc_feature (1630)..(1630): n is a, c, g, or t
tgtaagttagtcctttaccggggagtatccctgcatctacacggacgcttctgctcaattagcaaaaaatatgagtgatctaattttcactaaaaaagttaagcctacattttttggcatatttaaaaagcaattaaaaaattttaaaatttaataattttcctgcaccgaaggtactcactcggcctcttcgcggcctcgtggtgggccttcgcccccccccctcccacgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaatcgattttttcaagtgtccgtttggggtactcaaacaattatggggagcaaaatcccacgcaaaattaaagacaggctatagggaagctattccggaaggatcggtctccccataaatctgggcgcatcggttcgggggactgcccccaaaacaaaaaaaaaaccaaatttttcaggggcccgttggggggccccaacaaatttggggggaaaaaatacccccccaaaataaaaaaaggggttttatggaatttttccccaaaggagtttgcccccccccaaaaattggggggccccggttgtggggggggggcgcccccaaaaaaccaaaaaaaaaaattttttgtggaaaaaaaaaatttttaaagaaggagggcgaaaaaaaaaaatatataaaaaaaaaggggttttttttcccctttttttcccaacccccaacccaaaaagaagggggggggcgtccctctgatttattaaaaaaaaaaaaaaaaaaaaaaaaacacaaaattatttttttttgttctgtaaaaaaaaaaaaaaaaaaaaaaaaaataaatataaatattattttttcccttcctctctttttaaaaaagaaaaaaaaaaacagaaaaacgcaaaaaacaaaaaaaaaaaaaaaaaaaaaaaaggggggggccccccccccccccccccccccaaaaaaaaaaaaaaatttttttattaggcgccccccctcttttttttttttttaaaaaaaaaaaaaaaaaatataataaccccccccccccccgcccccccccccccctttttnttttttttttctcctcccgcccccccccccccccccccacaaaaaaaaaaaaaaaaaaaaaaaaaaaaattttttttttttttataaaaaagaaaaaaaagggtgttttttttttttttttttttt

SEQ ID NO: 24088 - DNA, 1898 bp, Heterodera glycines
cggagggtactgttgctgctgctgctgttggtgcgctccccccgggtggaacattggcccaactgcgcctccgcccccccctccaccgcttgtcgaactgctcgctgtcgtgcacggggaataggaggacggagacatgctcaactgctggtcgacctgctgctgctgctgaattgccattgatgatgacccactattctgttacggaaaatggatattcgaaaatcattttaattcggaaaactcgagaggggtctcattcagaatcctaatgatttgaggggatttatgaaatggcattttttgaagataatgcactgcgcctcatctttgtaataaaggcttttgcaccttcacttaaaagttcccttctctcttgtgctgcattaacaacaaaccattggcattggcattttacacagcaattgtgcattgccccgctgtttgaccgatgcgtatgaatggacggacaaacgccgttgttgttgttgttgttgttgtggcacgttgttgttattgttgttggcatccgttatgtttggcagtccttcgtaaaagctggacaccatcggggcgtattctgcaaaataattaatttatggcatttattattattatggttctaattaggattatcattatggtgttccaattgaccaattgtgccgccctccgttccgttgtccgtcttcgcttatccaaaagcccacttgctgctgttgctgctgtgctttgctcccatttccatttttcgcctcatttgcgacgcctccgtacagcgaggaagtgagcgttgtgtgggaggagtgaccaccgacggcactcatctcaaagcattggccaatttcagtaaagcaaaagttaatgctttcattcaattttaatcaaaatttaaaatttgaaggccaaagttgaaacggatctaatgactgccgaattacgtacaatgagtaaacgtgaaaacggacaatcaaattaggcgaaatttttgctagtgatcttaccaaaaacaaaaaactttatgtggcaccagcccattttttcgtgtggcacttcgttttcgatttttgcaatttctttttcaccactttctgttgcgccgggtggtgtcgtcggccccgcttcgttctgaatggcatttgcagtgccgcactgccgccgcctgtctcggcagcggttcgtctacgacccaaacagcacatcagtaaattaaagaggcaaccgataaggaacagagcgcacaaagcgatgcccaacatgtacaggcgcgagagttggtccatggagacgcactgaaggtgagggggacgaaggcgggcagagggagcggcagcactgtgagggagcaatggcacaaattaattccaaattcagccggctgagtctccccatatttgaataccggataacattatcacatttcttagttattgaccttatacaaatataaacattaaaagcatttatgataccaaattaacaaaaattggtcaaccaacaaaaaagttgccatgaaaagtggggatttattcgatcacattttatttacgctcgatgacaaactgattaattttaacaaataaatattattattattattcatgttaaagtcgcaaatgttaacgtactcctgtggcgaactggtggaatttgtgaagttataagtcggcataattgctgaatcggttgacgaaagcatgacaaaatccgttgaatcgttgatgaacaggggattatggtcaagggcggtactgtcgtcggtgtgctttgaagtgtccgccggcggttgggatgcttaaaaatattattaagtaatgttacaataattatttaaatttaaggaaaggacattgggtgagggaatataatttttgaatttattctatttttttctttct

SEQ ID NO: 24089 - DNA, 1833 bp, Heterodera glycines
aaaacaatcaaatttttctttactcttcggtgccctccgccgcgtgtcgcccattgtccgtcgccgtcgtacgaaaaatggccaccatttcggcatttccgctctcttccgcgaaatcctgtgcccgtttgcctgaaatgggcgaataaaacgctcgttagcacaacaatttggccacttccgctgctgctcaccttcaatgttccgttggttaatgtccgcgccgatggccaccaaatgccgcgccacttccgtcttccctttgatcactgcccacatcaaagcattgtgtccctccacgtcaacatgttgaaggtcggcgccatgttcgacgaggaaattcactgaaaattagggagattacatttttggcactttgccacaattctctcccaccgatggccaaatgtcctttactggcagcgcaaatcacaggagtgtatcgctcttgaacggtttgttggttgacatctgcggcccactcttccaccagcagacggcacacctccaaactgccgccaatggctgcgtcaataagcggaaagtatcctgaaaattagagacaatttcattacatttttgagtactgctgtaaaacccaccttcgaaatccatttgctcgacatttgcaccatgtgtcagcaacaagcgcacaatgtccacctgaattcaaatggaaaaatgttggaaaacatttcaccaatggaaatttttccttacatttcccgtgtaacacgcgtacatcagtgctgttgccccatcaccattctgcagattgatgttggcaccattctcgacaagaaatgtgactgtggggggaaaaatgacgggaaaaaattacgtattttttcaaaatttcgtctctctaccaatttccgtttgcgatcttttgcaagcgtgcatcagcggcgttgtggcaaagtccgtgcccaagtcaatgttggcaccacgcgcgaccagcacacggcacagcggcaaattggcatggcggacagcaaggaaaagaggcgtcatatctgcacaaatggggaaacaccattattttcagagcaagcaaaaatataattattttccggtatccgtttcgaccaattccgagccgaatccagggacccgaattagatgcatggtaacaacgatttcatcatcaacaccacccactcactcgtgtttatgttgttcacttggtcagccactggctcatccggatcggcgcccttctccaactgaaaatgccatacaaaattagtgccgacggataaaattgttcatttcactaccaagagatcaacaatttcggtgtgttgtcgtaaaaaggcactccaaagagctgatcgtgatcgggtgttgtcgcgctccactggatcaaccgtccaccgcagcaaaatgttcagctcgtcggcatccagcgaatcgatcagcacacgcaattgttggatgttgccatcgttgatcaggtcgaagaagcggagagtgagcgtctcaaagttgtccacaacagcagcagcagtgggatgttcagtatctgccttaattgtgggggaaatcagttattgaaaaagaattctgagttgaacccgtgcaacacatttttcagggagggggggggggttcattatcacggatcagtgaccccaaaaatccccagtggaaagatgatttttaaaaactaaacattcgaaaatatgaaggggaattgcacttgttgttcgtgttgcaatcacaaccaaaacatcaatgttaaaaaggtttcatggaaacaaaaaactttaccatgcgaatcagcgcagttgaacagtgacgacgaatatgcattggcaattataaataata

SEQ ID NO: 24090 - DNA, 1297 bp, Heterodera glycines
  misc_feature (70)..(70): n is a, c, g, or t
ttgactcgttgtagacctatttctaacaaaaccaaatgaaatttccgaaattttttgttttttaataganaattgtaaatattttgcttaaaattctttccattaccctgcagagtgagcaggttaatgaaattggcctaacgtttcgggattatttttgtcaccctttttaaaaaagcggaaaaaccaatggattctttaaccaatgtctaataagatcctaaacaagtcagtaataacagttgacagggacgaatggcaaatttttaaaattttatagctaatattatcgggagaagtgccatttttattcggaagttttttcagaagattttgggtctcgatgatgttaaaatttatatccgatataaagcattgatcaatttctataatattacccaagcatggattgcttgggtcggtttcactattattaaatgaattggcaaataaggtggcaaataattcacatttctcagcactgttatgatagcatttattttcataaattagattaggtatttcaaagggattgacattgaattttgtatatatttataaattgaatttcttccctttgaaatagcctttttctcaatttggctatggtatttatttgtttgtatttttatatgtaaagaaatgctatcgtgtatagtgcttttttggatgggtcagttttagcttgcctgaataatttagccttttctttgatggatgctattaaatgttgtgggtatttaggagtcaaatcattcttggttaaacgctttattggaatacactcatttaaaatttttaacaacgtactgttaaaggcggaatatttttgatttatgctaaagcattcatatgacaaggcatttagccttgatgctatgactatattaaaatgtaacacattcgatggacaataccaacgaaagtttacgatctttgttttcggttttgttttaggagtaattaatgtaaaaaattgtgttaaatgatccgatgaaaatatgcctcctttaacagtacaatcagtaataattttttcattggcagataaaatcaaatctagccaggaattaatccgtgttggctcattcgtggccaaaacgtaagaaaatctattgaaaaagtcacaaaatatttcaccatatttactcattgaatagggatgcccatttttccataccaaatccttattcggtaaattaaaatctcctaaagtcagtgaattttcattaaaaaatttttgtaaaaatttgaacaaattttctgtttgcttaagtgttgttttgggtggtcgata

SEQ ID NO: 24091 - DNA, 1116 bp, Heterodera glycines
  misc_feature (1020)..(1020): n is a, c, g, or t
  misc_feature (1083)..(1083): n is a, c, g, or t
atgtaaagtataattttaggaatctgtggcagctgctgggcaatcgcatcaacaccggtttttgcgacggcggtttttgatgcgcgcattggtcaccagcaaaggcttttcaaatactcggagcagtatttggttgactgcattcagcgtgtgggagaaagcctagaagggtgcaatggagtgccgcctacctatgcgttcatgtaaaaataaaattgtccaaaacaatgattgtgttttttaattagagtccgactttgtggcagtgaaagtcctagtgtttggacttagaggctttgggtactcgttggaaatgttttttagccatttttggggtttttaaatttttcttggaataccatataattccgaaattttttaaatcgtcggctgactccctttggcgctgctgtgctatacattttgctctaaaattcttaatttttcaaaaccgtttaggctcatcgaaaaaagatggcttgccattaagcacttattatgaatataagagcggtgggacgggactaccacaaccgtgcggtttggagcctaaggttgcgctcggtaaaacaaagaaggacggtctgctgtacaaagcgtcacagtacgggactgtacagggctgtgctcagtttatggatctaatggcctccaaccgaataccgctgatcagccgtgcgcgtttttataataattattttaaatactttacaaagctccaaaatgattataatttattttaggcatatttgttcctccgtccttccatgaatatgttggcacctttgtttacgacccgacaactgaagaatgcgaaaaggcggagcgcgaacatgacaaaacaatgcatgccatcactattataggatatgggagagaggaagaaaaggattactggctaatccaaaatagccacggaaagggttggggcttaggtggcataggcaaatttatcaggggccaaaacaagtgtggcatagaagagttcggctattatataaaaaatgtcgtgcctattgngcaataattattttattgcttggcacggctttttatataaagtcagttcctctattccatatntctttaggtctccgataaaactgatattatgat

SEQ ID NO: 24092 - DNA, 2896 bp, Heterodera glycines
  misc_feature (782)..(782): n is a, c, g, or t
ctgcaaatgattccaaaattaatcaaataaattggggactccacccggcccgtagaatttcatttcagctccaaatttttgttttaagcatatgagataaatggtatttggagaatgaaacttcactttttatggccaaaaagcctgatcaaacaattaaccaaattaagcttaatgacgtgcgaatatgggtctcttgaaaatttcaaatactgaaattaatcaaatttaaatgatgcaattaaataaaattaaaatgcagtgctcaaactataattgtatagaattttatctaattagcatttcatttatgaggagtatagtttcttaataaacagggatatgaaggtaatttttggaaatttctggaaattattattaataaaaacattggagtttagattcggtttctacaaatttatcaaaaatttcaaatttttctttaaaaaatttatatccaaaatttcaaatgccaacaccgctttaaatgttgaggttaccggtagcccaaccgttctttacaatacaaattcagtaccggcatcgccggcggttgggctactgtaacacggcaccgtatcaactctcatctataaattttttaaggattcgtccgaaattgtgctggcatttggccggcttgaatcatccgcactgtcatcagctcattccattggatttgttggctgtttgggcgacctattgtttggcgctcagcaattgcttaggtttgaaaaattaaaaaatttcaaaaaaaaatttttttgaaatttctagcctgngcttcgagttcgtccaatgagcttacactggtctggttgcacaatgggaccaccgaaagcattttctgcaggcaaagcggcgcccaaaaatgaggtgggttagaaaaaaaaaaactaaaaaatggtaaaataatttaaaaaaattttccccaggtggacgagctgaagaaagcggaagatcttgagggccaaaagattgaggaaaaatcaccccaaaaagccaagtgggaaaaatatctataatttaaaaatttttttgttttccctaaccaaaattttttagttttttttggtcaatttttttagaaaatttacggaaactgatgagccgttgaaaatactttgctcagtcaaaatccataaaattcataaaaaactaattttgcttcttttttttttaaattttaatttaaagtttattattctctgaattctttaaaaaatttttgtaataaaaactttgtaaatcaatgccaatctgtctacaggtgtgccacaaattccatcatcccaagtccgtccagaaggagcttgtgcccttccacttcaaccgcatggagaacggtagcaaaaaaaaaaatataaattttttaagtgatttcaagaaaaacatttctaaaatttttctaacgattttttcaaaattttatgatgaatttagtaaaattttttcaaattctatccatggaaattactaaattttttttcgctatccttgctatcttttaaagcgaggattcggccggcatgcgcttcggcctgacgccaaatgcacgcgttgaatttgcgctgcccgacacgctgcacgagtccgcggcatccgatttcacgcttgaactacaattgcgtgcaacggcagcaaatggttaaataaaattttttttttaaattttaatgattttttaacaatttttacgttgatttttggaattttctaaaaattctaatttttaaatttatctatttattgagtcaatatttcatttaataaaaatgccaaaaatatgacaataatcacatcagtaattaacatttcatagattattgaaagtacgtattattatatgattaggccgtgttagaatatttctttgatgaaaatcaacgtgttttgctcatcgtaaagtcggagtaaagaatggatgatacaagcgattaacaagtggaaacatgagaccctgaagcaccaaattttcaaattttgaggccctgtaacttttgaagcaggcggaatgcaccgctaaaattaaaaattcacaatacaagtcgaccccgctctatccaatggtatatagcttatatgcattttcccactcacagctcggaatgttcccttgtcaactgaaattatttacaaaaaatcttttgtatgcaaaatttcgatcaatttctaaaaaacccaagtttatttaatttggcggcgaaacgtaaaaaaacttacaaccacttgattgcaaagtctttctatttcttcctgaatcgtattgacgcaaccattgtaaacctgtaattaagaacataatattgcttcgtgttttcggtttctaattccaactatattttgaaaaaaactcattatggtgtttttaaaaccattgaaataaaacaaaaagacgtgatgtgaaatttaaaaaaagcgccaactcttaagtccaatctgcagtgaaagcttaattaatactatatcgtcctcgttttttaaatattttggattttcataaatatataaattttttgaagtgatcatttttggcattttttatttttagccctttatggcagttttataacgagtcatgcgaaggcgctaactttctgctctaaaacagggctgccaagtgtccttatttctaagatttgtccttatttggaggggccagatcttagaaaatgaaaatgtcctcatttctatttcttatttttaggcttgcccaaactttttaaattttttgtgcttattgatttatttcgctgatttaaatgctacaaaaactcccaattttcaaattttttcccggcggcgcctatcggcaactaaaatatttttgtttctttaaaaaattagctcaaaatcacaaaaattcgtcattttttggtcaaatctattaacaaat

SEQ ID NO: 24093 - DNA, 1930 bp, Heterodera glycines
  misc_feature (19)..(19): n is a, c, g, or t
  misc_feature (24)..(24): n is a, c, g, or t
gatgggcatataaaagcgntgcgnactttccttttccgccatttcattccgtcttcgtcttccattttcactattatttccattgcatattcgtcgtcattgttcaactgcgctgattcgcatggtaaagttttttccatgaaatcattttacagtgatttttttggttgtaatttcatcatcgtataaaatttaaatccccctcccatttacgaatttttgtttttaaaaatgatctttccactggggattttcaaggcgctgatcagtgatcacgaacctcttccccttctagaaaatgttttgtacgatttcaactgaaaatccgttttcaaaaactgaaagtcatctttccactgggattttcggggtcactgatcagtgaaatgaccccccccccccctgaataaatgttttgcacggtttcaactcagaatcctttttcaataactgatttttcccccacatttaaggcagatgctgaacatcccactgatgctgctgttgtggacaacttcgagacgcgcgctcgccgcttcttcgacctgatcaacgacggcaacatccaacaacttcgtgtgctgatcgatgcgctggacgccgacgagctgaacattttgctgcggtggatggttgatccagtggagcgcgactacacccgatcacgatcagctctttggagtgccttttttcgacaacacatcgacattgttgatctcttggtagtgatcaaacaaatttatcacggcactaattttgtatggcattttcagttggagaagggcgccgatccgaatgagccggtggttggccgtgagaacgacattaacacgagtgggtggtgttgttgatgaaatcttttttaccatgcagttttttggtgtcattcagtgatcacgaatccggcggcaccatttcgaccagctccgaacttcgttatctgacaataaaaattggattttttttcttcgaatttggtcaaggattcgaatcggaattggtcgaaattcggatgccggagagtttggcaaaaaactgatcacaaatctgacatccatttttgaacaattccggaacacgaattcgaacaaaaagtcgaaagttcaaattttcgaatttcacaaatttcgtctaaaaaatttaaatgatcttttgttgctggatggtgactttcagtttgttactgtgtatttaacccttttcaagaatttgaactttcgactttttgttagaattcgggtcggaattggtcaaaatacggatgccagagattaattatatgtttgtctgtcttggacataatgttgtttccccatttgtgtgcagacttgacgcctcttttcgttgctgccctccatgcacattttccgctgtgccgtgtgctcgtcgaccgtggtgccaacgtggacttgggatcggactttgccacaacgccgctgatgatggcttgcaaaagatcgcaaatggaaattggtagaccaaaaatttgaaaaatgcgtaattttttccgtcattttttccacaacagtcgcatttctcatcgagaatggtgccgacatcaatctgcagaatggtgacggcgaaacggcattgatgatcgcctgttcaagggcaaatgtaggggaaaatttttcattggcaaaatgttttccaacatttccatttgaattcacaggtggacattgtgcgcttgttgctgtcacacggcgcaaatgtggagcaaacggattacgaaggtgggttttacagcactcaaaaatgccatgccacggattttgtctctctaaatttcaggattccgtttcgcacttaagaacgctgccaatgagggccatttggaggtgtgccgtctgctggtggaggagtgggccgcagatgtgaaccaatcaatcatccaagatcgaaccactgcactgatttgagctgccag

SEQ ID NO: 24094 - DNA, 1014 bp, Heterodera glycines
agagaattttaaaatttatcttatatccaagaaaaatgactatctcttattttgagaaattttatacgttataaatgctctcgagcatgataggaagtgcggtgcgcaatcgccattttatttcacagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgataggaagtgcggtgcgcaatcgccatttaatttctcagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttataaatgctctcgagcatgataggaagtgcggtgcgcaatcgccatttaatttcacagagaatttttaaatttatcttatatccaagaaaaatgactatctcttattttgagaaattttatacgttacaaaagcgctcgagcgtgagagggagggcggtgcgcaatcgccatttaatttctcagagaattttaaaatttatcttatatccaagaaaaatgactatctcttattttgagaaattttatacgttacaaaagcgctcgagcgtgagagggagaacggtgcgcaatcgccatttaatttcccagagaatttttaaatttatcttatatccaagaaaaatgactatctcttatttagagaaattttatccgttccaaatgctctcgagcacgctagaaggggcggtgcgcaatcgccatttaatttcacagagaa

SEQ ID NO: 24095 - DNA, 1314 bp, Heterodera glycines
tcttttgcatattgtaacaaattttgtcccctttccaatggccttactaaaattttccaaaaaaatttcctaaccccctaggaatttttttctaaaattttcccgattttcagtgtattttagggtgtcccgatcactatgaaggagtgatctgatcaagttgctgtaaaagacttttttggtcagcatcaaaagttagaacggcaggaattttttcagaatttttggccaacaaaatattgacgcattcattgataaagtgaaaaaaaattatggttaaatttataaaaaatttttggggtgtgttaaacatatgaccatgactgtaaccgcaatttaatttacaattattttcgtcagttaattttggctttttaacaaatgctttttatttttgtgaaattttctttttctcagcactgattatcggagtgcgttcaagcgtgagtttggcttggtcaagaaattgttgcgcattggaagcacgacaacagtgcccattgtcagtgccaatgttgtccatgttaattccaatagtcggcagcaacgctttcgttctcaacattcgccagcgattgtctgtgctgcacactaacgatgcctaattgactaattaaaattgttagatggactatacaatttcacattagacctctttttttgtcttcctcaactgagcttacaacttttacttcattgatttttcaggaagtaaaaaaaaagcaatttattgacgaattaaacaatagacaaataaaatggtaaagaaggattattttatttgtaagaggatccgttcaatacgatagtttaataataaaagcatttttgaaaattaacagagtagatcatcaaaatgacaaaaaaaaacgataaaaatgttaaaattactgatccaataattccttctttcaataaatatggtctgttattccctccatttgagctgatccaatcgaaattccgttcagcgttctgtaaactttttggtcactttgtcagacaaaaaattgcgcatcccttggaacaactcgagcacccatttgcttggactctgaatttaattaaaccaattaaaaatacaaaaaaggataaaaattccaaaaaaccaaattttcaccctttccttttgttcgtccgtctcctccgttggccatccgttgtttaaagcatgccaattgtcccatttgtcagctttaaatttgtataaaaatatctcagaaatactcttaaaatcacttacccccttccaaattgctgggtggctcatagccaagccaagagatccagcagatttcggcttaaaaatttaat

SEQ ID NO: 24096 - DNA, 1211 bp, Heterodera glycines
agaaataacctattttaaatattatctagtcagttcatttaaataatttttatccaaaaaaaatttttttttggatttcggggcagtaccctgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttcgatatacctctactttatttttaccttggatttttgctccccataattgtttgagtaccccaaacggacacttgaaaaaatcgatttttttgttttcggggcatttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagtctgtactttaattctgcgttggagttttgctccccataaatgtttgagtaccccaaacggacacttgaaaaaatcgatttttttgttttcggggcagtccccccgaaccgatgcgcccagatttatggggagaccgaatccttcgggattagcttccctatagtctgtactttaattctgcgttggatttttgctccccataattgtttgagtaccccaaacggacacttgaataaatcgatttttttatttcataaatattttttcagaaagtgctctaaagcgcaccaaattttatttacatgttagtttaggcactctgatgctttttctatcaaaaagggagatggagaaaaatttttttaaaaatttttccttatattttggttatatcgttttgcttttggtggggtgcttggaacagtggaatcatgcgctcccgtccgatagggaagttaagcaacgattgctgactagccaaagaggttcg

SEQ ID NO: 24097 - DNA, 2019 bp, Heterodera glycines
taaattagtttaaattaaaaaaaaagttaatttatattttcaattaatacaaattaacaaataattatattaattatttaatgaataaaaaattaaagacaattttttttattcgtttaattatatgtaaatatatttgggagtttaaaggtagataattaaatcaatgttttaaaaccttaaaattaattataactgaaaatctatgtatattaaacttaattattattcatgtttaatcataaattaattattttttaaatgtttaattaattaccttcaagattaaacattttttggtagttagtgatgaccttaattcattagggttaatcattagttctttcatagtaatttttttttcttgcaaatcccataaatcggggattgctggagaaattttttaaaaatttgaggagcaaaacttttataaaaaatccaaaaaagtaatataataaaaaatttcatagaaactcatttaagagattagctcattcgattttgagtgcaaatgggccgttttcataattacttcccccttcaattagtgaataggtaaagctcacttttttcttgttcatcatccggtctgtcaaactttgttgggcaatcttttttgcttgtccacatgcgatcctcaaaaataatttttttaaaaaaatttgtatttttttttaccaatgggcaacgagaagaacgggaatgagttcggatgcacaggtgacaattgccgattttaaaagaccataatgaagacgataccaaatgtgctgctctttgtgcaacgatgttttgctgcaactgaagccatttttgctaaaataaatataaatttttaaaataataaataggacctggagcaaaaaaaaacaattactcaaaagtggtaaaaaaaataaccgaaaaatttgcaaaaaaacactagcgaaaaaacccaaaatagtgggtaaataatgatgaaataccaaaatgttggtgttatgcctaaaattaaaaaaaatgcaataaacacagaaaatagacccctaagaagcgatctcgtgcatttttcagcgaaacaaaatctgcataataaaaattaaataactaaaaatctccaccaaattcattaccattatgttatatttttttattattcttagggtcggcaattaaaacattttttaggctggtggggggacttggcttcaagcggttgaatttatttgtaaaatttcgaggcatgaaaaaaatatgtacagttttttaatttttaataaagccctaagaaaaaaaaacttcttaactccaacacttcggctttatatttagcattttctcaattatgagtaaataattacaagaattcctaatttccttaaaaatatatcaaaaaattattcccttaaaaatttacatgtatggagggcaaaaattcttgataacggagtctacatcggtttgatcacgacaaaattgctgaataaataaataatacatttaatacaattaattaatttttttttgttgttgtataatttgcctcaattataaaaagagcctttagcaaaagaaagcggaaccaaatcacaccaaacacaaaatttattgtgtttctggtaatccgatcaaaagttgctcgtaaattgccgacatatgaactgaaactttgcagaaaatttcattattaaataataatcattaataatttacattttttattataaaattagtttttttttttacaaccgttggatgatataaatgagcgaaacaaaagcataagcggcgattgtcaagcgtaatattgagtctatggtcaaatgttgccaatcttgtgactcaacagccctgtcgcatccataaagtgcaattttataaaccttaatttatcttttaataattaaaaatcctaaatttttgataattaaaacttgttaaactattagtaataaatgtaagaaaaaaaaagatttttcttgtaaataaatttttttattgtgctaattgttctccataataagcttcgaatttcgtgaa

SEQ ID NO: 24098 - DNA, 919 bp, Heterodera glycines
gattttgcaagaacccttcattttgtcgatgatttttcatcaagtaccataaaaaaataatttcagccaagcgggctcgaaccccagccctcgtctcatatgacccctaggtattaagatcaaaatttcaaaaattcatagaaaattaaatacttgacttctcaatagattcaatagctcattcgaaagctttttttaagctctacaacatctgtgtattagtttttacgcccgactaattttcttaaatttttggaaaaaatcaagtacttgataaaagtcatattttcaaaatctgagttcagattcgtgatgagcctatttttctaccccagaaaaaatgctttttaaaattttactatttttcccatcgggaccacaattctgcacctttgcccccatttttttctgatttggcctgcttattaattgaatttttaagcaaatcccattttaattacctactattttttcaatgctgctctcaggccgtctcagccgtgcattttctccacaatttttgcggtatggatttgcacatttttttaaattttgcattgtagagcaaaattcgaaataatttgtaaaccaggagcgaaaaatccaagcgttacattgtttttaaatctaccattttggatacacaaaaataaataaattgctccaaatctatgcaaaatggaaaattttaacgcattttttcctttcgtttttttttggagggtccccccgaaaagtgggtacttctgtgttttgctacccccccccccgcggaaattcatgtctggggttttcaaggttactgaccacgaaaaaggtgtttgttttgattttgatgacattctggtcatcgatttaacaaaatgtcaatgatttttttgaaatttaaaatttttcgagggctggtggtagcaaaaca

SEQ ID NO: 24099 - DNA, 2016 bp, Heterodera glycines
aaaatattgtcatttgctaatttttctttaaaaaccatttaaggatcccaaaaatttccacagggctccaaaattccccttaaattttcaaagtttaacgtaaaagttggccattttgttatggttggatttaaaataaaagtaaaattcagtcataataatgtataggaaaaaaagtaagattaactcctagaaaaaaaatcaaaaaaaaattagaaaaaatataatcaaaattaaacctaaaatttacagaagagattttaaaaatattaatttttcgaaattaagtcaggcgttacttgaaaatcgaattgatttatcaataaactcagtgttcaccgttgaacagaaatataaagaatttttaaataaagttctgaaattatatgatatttttatacccaataggcctataaaatcgataataataaaacaatcgtatcctcaaaaaataagagacttattttcagagaaattacgtttgcataagcttgtaaaaaaatttcctgaaaaaagtgatctcattttaaattacaaaattatttctagggaaatgaaaaaacaattgtacaaattaagaaatgaacaagagtcaaaaattatttcccaggggcaaaattcagttaacaaatttattcgaaataagttatcaaaagttaatgaaattcctacgttaattgataatgctggaaatatgttttccagcaatgttcaaaaatgtaagatattagcagaaatatttcaagtcttttttaagaaaatcaattgttaatggtccacaaactcaatcaacacagaataagattaaactttctgacattgaattgaatgcgggaataatttggaatatattaagaagacttccccggcgtaattccacttcaccggataatgttccttacattttattaaaaaattgtgcagaaccaattacaaaaatattagcagatatatttaggctaattttggattccggtcaaattccggaaatatggcgaacatcattggtggtaccaattttcaaaaaaggtgaaaaaactgatccattaaattatagaccggtttcattaaccagcactgtctgtagagtttttgaacgaattttgagtagcaaaattttagaatttctgaacagtacaagattctttgataaagaacaatttgggtttctaaaaaataggtcgactacaacccaaatattaaaaacgatggacgatatatataattcgatacaaaagaatcagcaaattgacatcatctatattgattttgtcaaggcgtttgattctgttccaattgatttattacttcaaaaatcaaaaagattggaattgaaggaaaaattcaaaattttttaactaactttttaaaaaatcggagttttaaagttaaaattggcgaagaattgtcagaaagtttcaaaatattttcaggagtgccccagggaagtgtcttagggccattactctttttaatttttataaatgatctgccgtcctttattacaattgaagcggcatcagttggcataaaaatgtatgccgatgatgttaaattatattatgcccatgaaaatgatgaccattcgaatcagttggataaagcaattgaggctttggaaaaatggtcaaaaataaatgggttagaaatttcaactggaaaatgttttgttttatatttagggatatgaaaaaagaatattttattaactcaaaaaagatttcagaatcggataatgttcgtgacttgggaattataattgactcgaaactgaatttttcagaacatattaaaaaaattgtacgaaatgcatatcttagaattttccaaatttcgagagtgttgaaaagcagggaaataaaaactctaacagcagcctataaaacttttgtacgacctcaattagaatatgctactgaagtttggaaccctaatcttaaaaaagacatagataaaattgaacgtgttcaaaaattttttaaaagaaaagcacttagaaaatgtggttttgtgtac

SEQ ID NO: 24100 - DNA, 1720 bp, Heterodera glycines
  misc_feature (1672)..(1672): n is a, c, g, or t
  misc_feature (1690)..(1690): n is a, c, g, or t
acattatggaaaaaaatcgatgcgataatttccatttttaaacacaatttggaaatatcaagttaaattgagagaagtttttctctcaaatttccttactatttttctcttctctgcccgccgctaaaaatggtagcagcgacgagtcagagaagagaaaatagtaaggaaattgaagagaaaattttatttttttattcaaaacaatttaatgattaaaagaggtacaacagtgattagaagcggtacaaaagtgattaaaaaacgtacaaaagtgattaaaagaggtacaaaagtgattcaaagaggtacatcagtgattaaaagaggtacaaaagtgaaaagaggtataaaagtgattaaaagaggtacaacagtgattagaagaggtacaaaagtgattaaaaaacgtacaaaagtgattaaaagaggtacaaaagtgattcaaagaggtacaaaagtgattaaaaaacgtacaaaagtgattaaaagaggtacaaaagtgattcaaagaggtacatcagtgatgagaagaggtacaacaaatggcagaagaggtacaaaaatgcattaataatttttaaaaattgtaaaataaatgcctctttttattattaaaaaaaactttgaagcttataataatttaaatttatttagattgaaatcaaattagtttctgaaaaactcaaataaaaaaaaatatatgaaattatttaattaaaaaaataattaattttaataaaatttttcataaaaaaataatttaatttaaattaaaaaaatttattttttattatataacaaacactcttttaaatgaattaaaaacattaaaaataaccataaatataacgaaaataatgtacaccgcccggattcgaacttccccacccctcccccctcaaatgatgctcagaatccccaatcacacagggattctgaggtcttatcgatgttaaaagtaaaatctgatcacgtattcgtgatcagcgtcataaaatagccctaattacatgtttttgaaagatttttggtgaaaaaatttttccactcaaaaatcctggtcacccccctttggactggaatcccaaaatcacttttatttttataacatttttcaaaaaagtgataaaaatgtgaaataaaatttataaaatagagctaaaaattgcggatttttgtagcattttacttttcctgaatatcttttcagaagcgagttataaatttttttctgaaaatccgaatttttacagaatttctagaataacttttttcatatttatgttacaaaagccaaataaaacccataaaattctcctgatttttctccatttttaatgctttatttaatcaaaattggtcaaatcttaggccagatatgaattttcaaattttaacccaaatttccaaggaccaaaaaaataaaaatattttcgaatttttaaaaaattccaaaaatcatgaaacgaaaaacaaacatcatattcgtgctcagcaccccaaaataccccagaaaaaaattttacacccacattttcaacccaaaaaaaaattccgaaaatttctagggggcctagctcgaaaatttttgaaattttccaaacatgtagtacaccattcgatagcatttaaaatgctctaaaaaatgtcctaagtcaatttttcgctnaaatcaacccctgacgangtatgggcccgggactcaaatgtcccgctg

SEQ ID NO: 24101 - DNA, 1105 bp, Heterodera glycines
  misc_feature (11)..(11): n is a, c, g, or t
ttttaattttntggacgaggaatttttcttagcctgtctattgaatttgtcgaacatacgtcggcttgtctattacaataatgctgttatctggagaaattgcatctttaatcaccttggcttacaaaattgtcgaaattccgaattgtcaaatacgagttatttcggtgttcaatagcgatgaaaattttgttcagcaccgattgtgcccgtggcaatgtcgttttaatttgcgttatttacggcggcaacttcgaaagggcgtatattagaatcggcaaggtcagaaatgaaaagcagattttcttctcttggtgatgttgatgtctgccttttcgcattttagttgactaaggcgccaaagtcaaaaacattctgagatggagcacaggacagctgaaagcactgcaacaaatcaatgcttatgtatttcgtgacaaaaacaaattctttaagcctatattgtctcttgaaaatttagctcatgtggattttcggtaggaaatgtgttcataacgaacatacgcagtggatgataattacccaaaaaccgcacttgtatgtcctctactaacaccgttcatataatgaatggttagcgcaaatgttgagtcctattctgtattatagcagaactcaaagatagaaattattagcaaagggtgccgtccgattagtaaaggcatttaataaatccataaattgcttttgcttcgcctccatttgcctttgttgttttagctcatctgagaattagatgaaaaagagaaaagacaaggacatgaacaacaaggctttactctgataaacagagaaacgtagtcaataatatgaactgaaaagatttgcgctttactcaggaaaaacatccggatttactgtgttctggcaccgtacttctgaagacaacagccaaaagcacagtaatcattggactctctttaatttctctctgtcaaatcttgttgtaagtttttgtttcaattccaatcagttcacgtggtgttatcatttatggtcactcaaataaatgtttagatcagggctgccatccgtccttgaatggcaaggacgtcattgaaattgggccctctttcttgaatat

SEQ ID NO: 24102 - DNA, 1026 bp, Heterodera glycines
ccagtgactaaaatgtggtggattgagtcccagtgattgaatgctggtggattgagtcccgttgactggaatgttggtggattgagtcccagtgattgaaatgttggtgggttgagtcccagtgattggaatgctggtgggttgagtcccagtgattgaaatactggtgggttgagtcccggcgattggaatgttggtgggttgagtcccagtgattgaatgctggtggattgagtcccgttgattggaatgttggtggattgagtcccagtgattgaaatgttggtgggttgagtcccagtgattggaatgctggtgggttgagtcccaggtattgaaatactggtgggttgagtccaggcgattggaatgttggtgggttgagtcccagtgattgaatgctggtggattgagtcccgttgattggaatgttggtggattgagtcccagtgattgaaatgttggtgggttgagtcccgttgattggaatgttggtgggttgagtcccagtgacttgaatgttggtgggttgagtcccagtgattgaatgctggtggattgagtcccgttgattggaatgttggtgggttgagtcccagtgattgaatgctggtggattgagtcccagtgtttagaattccggagatttaagtccattgtttggaatgctggtgggttgagttccagcgattgaaatgctggtgggttgagctccagcgattggaaagcctgagaattgagtctcagagattgaaatgctgatgggttgattttcagtgattggaatgtcattgaacgttagtgggttgagtcccagtgtttggaatgccggagatttgagtccattgtttggaatgctgttgggttgagtcccagagattggaatgtcattgaaagttggtaggttgagtcccagtgtatggaatgccggagatttgagtcccagagattgaaatgctggtgggttgagttccagcgattggaaagcctgagaattgagtatcgagagattgaaatgctgatggg

SEQ ID NO: 24103 - DNA, 962 bp, Heterodera glycines
gcagttaaagttcagatggttcccttgataagtgccgtacttcatttgccattttgaaaacatttaatggattttaaatgtatagcaaaaggaagtaaaaaagttttacagacgggatttgttcgaaagataaaagccgacaaagggagcaataaagcaatgctcatacgaagaaacactttaaatttctcatgccagcctaattctacggaaatttagaaatttaaaaacagtaaaaatgttctctcagctttaattattttggccgacaatttgatttcgttgattatgaagatagttctccaaagtgcatgttgataaactatttctttcaggcccaaaaaaaactttttgccctttccccagcagcagtgtcaatcatcgccttatttgtcatttatggccattttaatcattttgtgtttaaccgagtgattttcgccatcataaatactaaagtgccgtttaatttgacacagtgttaataaaatcttttttgacaattaggtgttaattataagaaacttatatttttccgtagactgactgtagaaggcctgaaattcatgaaaatatattagcttagtttgaagcttatagggtggacttttattattttgcgattttatatacaaataatcacagatatatgtactaataaatcaaaataaaaattaaattaaattaaaatttttttatttgtagctttaaaaaatatgattgaaattatttcatttttggtttattttgtcttaatatttttttcgccaacaccggacgacgaaggtacgtctctttattttcgggttactcaccgaaccgattcggggattgtttgacttcaaatgggaacggtcggggagtaaccctaactgttttttataaataataaattaataaataaagaaattttttaaattacaaatttttcagaatacgtgtatcctgaacagctggacctg

SEQ ID NO: 24104 - DNA, 994 bp, Heterodera glycines
gaaaatatgcttacatgatactcataaaaaatacaaataattcaccccacttattctatgaccacattctgaaaaaaatcccagaaatacgaggaaagatatgcttggtcacaataaaataaaaaatggctagtgtgtaaaaatttgcggtcacaaataaaataaaaaatggctaatatgtaaaattggcgtccagaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagttgatgcctcatgaaactcggaattggttatgtttagtcgaaaatatccttacataatactcataaaaaatacaaataattcaacccacctattctatgaccacattctgaaaaaaatcccagaaatacgaggaaagatatgcttggtcacaataaaataaaaaatggctagtatgtaaaaatttgcggtcacaaataaaataaaaaatggctaatatgtaaaattggcgtccagaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagttgatgcctcatgaaactcggaattgattatgtttagtcgaaaatatccttacataatactcataaaaatacaaataattcaacccacctattctatgaccacattctgaaaaaaatcccagaaatacgaggaaagatatgcttggtcacaataaaataaaaaatggctagtatgtaaaaatttgcggtcactaataaaataaaa

SEQ ID NO: 24105 - DNA, 2287 bp, Heterodera glycines
  misc_feature (1275)..(1275): n is a, c, g, or t
aatgatcaattttaagccatttccccttggtatttctcttattaggatagtccattttcgacctttcgtttctccctgggctaaagtcgtagagacctgtggttttttgaattttatagctcattttgttctcattcggttttcaatattgtcgcacacgaaaaaatttttccaacccactaggattatttttctgaaatttcccggttttaagccattttagagttttcagatcaccctgaaggagtgatctgatcacgttgatgcaattgagttttacgataagcacaaaaagttatatggaaatttattttttagatttttcttctcctattaaaaaagttacatcttcagatttttgacctatatttttgttacagcaatttggcattcgggaaaaaatcatatacaattttttctgttatacattttcagattttttttctgtggatcttaataaagtctcaaataaaagaatcgggcgattccgataggcaccggtggcatttttttgatatttaaaagaatttaatgcgcagatttagcaccaaaaaaattattattattagttttgttttttaatgaaagtttttagaggattggtgtcccgattagcccatagggggaccgaaaaattgaaattaattaaattaagggctccaaactgaaggttttcaaaatgagcatttggccaacaaaatcctgcttaaaaaaattattccaatgaaaaaatatatttgcgattttttgcaaattttttgagaaaaattggaaatttgaatttggattttgggggccggcgttgtcgataggcgccacaaaatcaaaaagtgaaaaaagaataaagacttgaaaagatttaaaaaatccaatttttctccgacggtgcttacgcggtagaggtgagctctgtgccagcaaaattctcaaagctatcttgttttcgttgttgacaaaacttaacaaaatggtatcattcgaaaaaattggtaaaatgcggcgttgaaacgccccgcaaaattagccgttgacccccccagactttatgaaaatactcaaaatgttttaaaacctattgacataagaaactaatttttaaaaattaggaattgatcacaaaactattaatatatctaaacatggaatccatctccgaccatgagcctctacaagggaaaaaaattggtcaacaagaaatatagaaatcaatataattcataaaaacaagaaatacactgataaatttatggaaatacacccctaagaattgctcanatattgatcgccaaaatttagtttaattctttcttgaaaaattttttgatttaaaattatccttattcgaaaaaacattattaaaatcagaaaagaaactgagacaattgtttaaaataccgaaatatggagaatgaaagatcaataaaaaggaaaaaaataaaatttttaaattaaaattaaaaatgatagaaatgaataatttaaaaatgaatgatgatgaaaagttaaaacgaaaatttaaattatccgaagcaatttatctttttattgttaatgcacgaatgcattttaattaattattattttttataaaatctaatatttaacagccaataaaattcgctcagtaacaaataatgaattaatagctaaagtatgaaaaaatacctaaatatttagcgaaataattattttaaaaaaattactcataaaccatctttttaaatttaaaattaatcaacaaaactaaagtattcctaacccacttctaatatacagatgttataagagagtataagaaacaaaatattgaacaaaacctacccatatgatttattaacaagtaaataaaataatttattaattattaataaaaaaggattaataatgacaagagaaatttaaagaaaaagtaaaaagcaaaaaaaaagataacaaaaaaacatggacttaaaaaatgaggtagaaatcagtaagaaaataaaaaattaaggagaatgtaaataaattcttataactttcattacaaaaaaatatattacagacataaaatataaagtaaatatactcttgggagtactaacaaataagatgaaaaattaaatcaaatcataaacaataaaacgaaataattaagtaataaaatagcgaaaaatacataactatcaggcgaatttaaaagcaatcaaaaaatataaaaatggtggggccagtcttgaagttgcttctctattggtagcattcaaacttctattcaccgagaaaatcgagatagaggaagaaacaaata

SEQ ID NO: 24106 - DNA, 1013 bp, Heterodera glycines
tgcagtaggatttggatttttgaatacaaaatgggagaccggtatagtggaaaaagaaaggaaaagccgagaaaagtcatgggaaccgccatccaatgctttcttaaaatggttcgggtgtgcttcgatccctcactctttcgtcgcccttcccacactttttcttggccacgaaatgcccccctttggccattgtttttgcctaacttcgaatcaccaattgatattttgttggcactttcttgacttgcttttctcagagtgtaagtcgcgaaacacgtgccctgcgggtcccgctggtccgccgggcgacattggaccctcgggcgtgcccggcatcccgggaaaagacggcatacccggacaggcggccgaagactcgcaaaacgcaccgctcaaaggctgcttcgtaagtgccaacacgggagggaaaatatcatgtgtacaaatgttaatttttacgcatggttcagaattgtcccgccgggcccaccggaacgccaggcaccgccggaaggcccggcattcgcggaatgtgagcaatacaaattcataaaaagggcataattacacagtgtgtcaacaaaatgccgaccaaaatatgagtgacataagttaaacaaattgttaactaagaatgccaaatttcggcaaaaaaaaactaaatcctattttgtctataaatattttaaaatattttatttattaatgtaacaattttattgatatgcttttttcttgaattggcctttttgttgggccaattatttgtccgcccgtttaattcaatttaattttattttaggcgtggtcctaagggttaccctggccaacccgggcgtgacggaggtgatttttcggcatttttgtgttttaaactcaatcaccgtccataattaagtgcccggccttcccggcgaacaaggccaagtgggagagaatggattggacggacggctgggacccaccggattcaaaggcaaagacgaggagaagcaattgggacgcaaagg

SEQ ID NO: 24107 - DNA, 1847 bp, Heterodera glycines
ttttttttttgattgatttggttttatttttgtttgattttgtcaactgtttcagctcactcgtgttttgttgttaggttgaatgtttgacggcggtttggtcaggttttgatgagcaaatggacgaatttctgttggtcccggcggtcgtggcaccactttttgtcgttctgacgacggcaaaaaagtttgaatgggctgggcggacgtattcagagcgagttgacaaaaattaaagaccaaaggcgccaaaaattcactttattttgtaccctcaaactcaaacttgggtaattaaaccataattaattaatgaacaaatataatccgacatgataaaatgggcacaaaggggaatggtaaggggaaggcgcagggcacggcacagggaaggcgcagggcacggcacggggaaggagcagggcacggggcaagcgcacgggcacggcacgggaaaggcgcacgggcacggcacggggaaggcgcagggcacggcacaggaaaggcggacgggcacggcacggggaaggcgcagggcacggcacagggaaggcgcagagcacggcacggggaaggaatggaaacttcggagggaaccaatgagcgatctgaaatcactgaaaacccagccccttttatacggcttttttgaaaccatagtacgctccaatttataatttttaattaaaatctgtttttgttatatccgtttgggttttgccattttcccattaattgtttgttttccactttttcctttacaattccaattcctttaatatattcaattaattattaataatttgtttacgaacgcaatccttaacagaattcgccatttaatattaattaattttcgttcctttcattcctgaggaaatgcacttttccttttcaaacaattttccgttattcatttcaaaaggtttttccatttttatgtaattatattttcgatagttttttataatattatttttccaaaataaatgtaaaaatattttttattatttatgttttatttttccccattttattttctattgttttttatttttccccttttttattttgggttttatcttaggatttcgcgttgtcgcgacatctccaatgtggcccaaattttaggcccccagccacagccccttgcttctcccagttttaagtcttggatttgtcaaataaattcaagacttcaaattaatattcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttatttattttttgtctgtacaatcgtgtcagcctgtactctatccgagctgatttgtctgctattataagtgaatataaaaggctaatcaaa

SEQ ID NO: 24108 - DNA, 1759 bp, Heterodera glycines
acttttatttttgaacttttttcaaaaggtgataaaaatgtaaaataaaacttataaaatagagcaaaaaattgcgaatttttgtagtattttacttttatacagaataactttcccgaagggagttaagatttttttctgaaaattcgaaaatttccaaaatttctggaataacttttttcatattgatgctaaaaatcacaaataaagcccataaaattctcctgatttttctctatttttaaagctttatttcatttaaattgaccaactcaatcatatgttatgaaatattagcccaaatttccttggccaaaaaattggaaaatattttcgaatttttaaaaaattccaaaaattttgaaacggaaaacaaaggtaatattcgtgctcaggacctcgaaataccccaaaaaaatatttttcacccccattttcaacccaaaaaaaattagaagaggtacaaaagtgattagaacaacagtgatcagaagaggtacaaaagtgattagaagaggtacaatatggtttgaaagtaaataaataaggaaaagtttttattaaaattaaaaatcgaattcatttaaatttaaaaaatttttataataaaaattttttagtaattaaaaacaacattggaaattattaatggaatatttatttaatttgaaattaaattaatttttttacaaattcaaaaagaaataatgaaattctttaattaaaaaaaataaatttaaataattaaaaagaaatcttcaaattaattaaaaacagtgaaaataacgaaaaaattcatagaaatataatgtgttgccgtccggatttgaacttgcccccacccccctaaaatgatgcctcagaatccccaatcacacggggattcagaggtcttaacgatgtcaaaagtaaaatcagatcacgtattcgtgatcagcggtccaaattacccctaaagacatgttttcggaagatttttggcgaaaaaatttcttcactcaaaaatcctgtccaccccctttggtcccgaatcccaaaatcagttttatttttgtatcttttttttaaaatgtgataaaaatgtgaaataaaatttataaaatagggctaaaaattgcggatttttgtagtattttacttttccagagtgacctttcagaaccgagagctgaatttttttctgaaaattcgaaaatttccagtttttctggaataatttttttctaattcatgtagaaaacccaaataaatcccataaaattctccttatttttctctatttttaaagctttatttcatttaaattgaccaactcaatcatatgttatgaattttcaaatattagcccaaatttccttggccaaaaaattggaaaatattttcgaatttttaaaaaattccaaaaattttgaaacggaaaacaaaggtcatattcgtgctcagcaccttaattaacccctgaaaaatatttttcaccccaattttcaacacaacaaaaaaattccgaaaatttctagggggcctagctcggaaatttttgaaaatttccgaccatatatcacaccattcgatagcattttaaaagctctacaatttagctctaaggcattttttcgattaaatcaacccctaacgagttatgggcccgggactcaaatgtcccactcaggccaaataatttttctatttccgggaaaaaactgaaatttttccgaaaaaaataccattcgatagagctcgaaaaactatgtgttggaag

SEQ ID NO: 24109 - DNA, 1544 bp, Heterodera glycines
ccgtaatggttcaacttgccgtattcggctgcacttttgaagagtttgatcagcctaaggggggggaatgttctcgaaatcgccattgggtgggacttgccttcccaattcgatcagtgaaagagtcaatgccatctgaggggggggagattggcacttttggaaaagcaatgggagacggacatggaaaatgaccagcacaattggatagtcgaagaagaattttgtcatcacaatgcgcgagagaaggccattgaccagcgaaacaccgccgtacaaaatcaaactgagaaaggaaaagccaaaggcatcggcggatcaaacgaaggaaaattttagggggcggggtacagtaagaggagaaaaggggaaagggtacagtaagaggagaaaaggggaaagggtacagtaagaggaggaaaggggaaagggtacagtaagaggaggaaaggggaaagggtacagtaagaggaggaaaggggaaagggtacagtaagaggaggaaaggggaaagggtacagtaagaggaggaaaggggaaagggtacagtaagaggaggaaaggggaaagggtacagtaagaggaggaaaggggaaagggtacagtaagaggaggcaaatggcatttaccgtaacaaagactgaccttttgaccggcaccgattgttggagaagaaagtccatttggagaggaaacgggaaaattgtgagtgaaaatgaatgaatgagaggagaaatgtgcaaaaggggggggggaattcgttcaaatcgaattttgagggggtaaaagggaattcgggcggagatacgaatcttttggtgtaaatgacctaatttgggataaatggaagaccaagtcacttttggagcatttatttcgcaaaataaataaataaataaatttaaaaaagtgaaaataaaattaaaataaatggaaaaaggcaaaaaataaacaaatgtttggttgtgcacaggaaaagctgttctgtcaagtgagatcaatgggtgcgtttaaagcaatgcttctcagttctcagctgttcctttttcccttttccgtgccgtttcgccttccgccggtgccattccctccgtcgcccctttctttccgtttgtttcttcgtcatccgaagaaatgataaaaatcgccggagggttaaatctcaaaaattccgctgagtcattctgccgattattcggttgaatgtttccgtttttcgtctcaattgccgccatttcgtcaccttttgggatttgatcatttattatcaaccttttacaatgctatgattttttcccgctttttcttttttttctgttggtttttccttttttttcccctccgcttttccttttcctcctccgttttttcttttctctctccattttacctttttctcccgcttttccttctgtcttttccgttttggcaccttttgccaaatgtttcaccgctcctttcagtatttccgatgcttttctgactctcagcccaacactttctctcgtcgtaatgccttcgtcagtgcaagtcgactgactgat

SEQ ID NO: 24110 - DNA, 1976 bp, Heterodera glycines
  misc_feature (1911)..(1911): n is a, c, g, or t
  misc_feature (1935)..(1935): n is a, c, g, or t
  misc_feature (1942)..(1942): n is a, c, g, or t
  misc_feature (1955)..(1955): n is a, c, g, or t
ttctcaaaataagatatactcatttttctcagatataagatagatataaaaattctgagaaattaaatggcgattgcgcaccgccctccctctcacgctcgagcgcttttgtaacctataaaatttctcaaaataagagatagtcatttttgttggatataagataaatttaacaattctctgtgaaattaaacggcgattgcgcaccgcgcttcctatcatgctcgagagcatttgtaacgtataaaatttctcaaaataagagatagtcatttttctcggatataagataaatttaaaaattttctgtgaaattaaatggcgattgcgcaccgcacttcctatcatgctcgagagcatttgtaacgtataccatttctcaaaataagagatagtcatttttcttggatataagataaatataaaaattctttgagaaattaaatggcgtgtgcagcgccgccctccctctcactctcgagcgcttttgtaacgcataaactctctcaaaataagagatagtcatgtttcttggatataagataaatttatataattatctgaaaaagtaaaagaaaatctttggtcaaatgtcttttcaagatttattctttctattattaaaacttaatttttttttttaattataaatttattggataatacatatttagaggtcttgagtgttagaaaatttaaattttgggtttaattaagacacaattaattcgaatgattaactaactatacataatttactgacggaacccgtcagttggcccccggcacgtttgggccccagcggttttttggttataacttttttctttgtcatccaaatcaaacattgttgctatcattcaaaagctgtaaacgtcctctattagcctgcaaaattttgaaaaattttgtaaaagttcaaaaaaattatggccagaacaactcaaaaaaccagattttccaactttatggccataaatttgttcaaaattgacgaatttttttggaaatttgcatgctaatagagcatctgaagggctttcgaatgataccaataatgtgtttgatttggatgacaaagaaaaaagggtactttcccattatgtgaccgcaagccaaaattttaaaaaatcaacaaaggggcgcgcaaatttgttgcaacgccaaaccgggattcgtttgtcatgagagctgttcttatcacaccgcgcatatcactgccacaattatacactctcgattgacggactatccctttttcttgcagaaaaattttagcttgcggtcaaataatgggaaagtaccgtccgaggcgcaaatggaaaaaaaaacagataatgccgacaaaacatttgatcaatgatcatttacaaaatgaatgtcaagtaaaaaaggcaaaaattgcagcatagattaataaatgttcatttttattcaaaaaaaaaaaactcgtagaaaatgcacatgaaagagatctcagcagtaaaattcaattttgaagcagaaatgaaggcagacgaacgcgatatttgcgcaacagttccctaagttcaatgtttgggccggcaaaaaatgcttccaaatgctgtctgagcctgttggacattggttcatctaaacaaaaaaaaaagactttctgacgcacgcatttgtgtcatacaaaaaatatctttaaaaaacataattttatcgggtatgcgtatcaacatttttgaacgtgggagtggggagtccggcgaatttcgccgataggcgcgcgcatgggaaaatttttttttcttcgaaatctgagtgcaatttgttaatggatttatttaaaaaggacagaatttttcgattttgacgtacaaaattcttggtgcaacggaagaaaacaaaaaaattttggttgaaatatgctttttatatgcntttttccatttctttaccatgttnactgtgntctttgattttgngaaaatgactaccatacatgt

SEQ ID NO: 24111 - DNA, 1481 bp, Heterodera glycines
  misc_feature (177)..(177): n is a, c, g, or t
ttatgagggacaaatgaagccgatccaatttgggaggaaaagcagcgtttgcaaaagtgcgcagttcgccatgtttgttggtcgacggtccgaccatcttccgtttcatcgacttgctcgacaatcgcgaactcttcaggtccgttcattgttttgcactatcaaaccagacagatntcatttcgagtctcaaaaggatgttttttggtaacaaaggtcaatttcgccccttttggaatttgtcaaaaggaaaagtcaaagttttgaattctttttttctcccaggaaattttgcataaattttttgaattttttttttttgataaaaaaggaccagggaattccacgcctggaaaaaattaaataacactgattttgattaattgaaaaaattaggcaattacaatacaatatttttgcttatgatttaatcacgtgcagttttttagaggcttgaaattttttccctcctaattaaagctcattttaaaataattcccattcgacttttttcttgaatattttttgattaattttttttcttaaagaaatgtcataattctccaaagtgtttgggcgtatgtgaagaaaatgaattcgtcaatttacaagcggatgaatggcatttacacggaaaacgttggtcgaatgtttgtgtttctcaacgaattcgtcggtgggactttcgtcgagtcggcgtccattacagtgcccgaattacagtcagccgatttctgtttgccctttcttttccttttcaccttccgtttttcttcagccaagagcaatgcctcgtcagaagtgccaattatttgttggaccattggaatgccattggaattcgtccgttggttctttgctcatcagaagagacaaaactgcgacttgacaaatcatttgaacacacattgactttgctcgactacgcccgaggtttttcagagttttggttttaaagtgcaatttatgaaaggaattgactgtgaaaaatcgcttcttgaaagggtggaggatttatgcagaaaagagagccgaggaaaagcactattccccgaatattggacgcaggaaaaattgttggagggcatttccaaaggaacgctcaaaaaagggaaatttaaggtgggcggacggagaaatgcgaatgaatgaccgtttaaatttaaaacatttcagatttccttcgaaaattatttggaggctttcgttgagttcgaaatggaggaccaatggtttgttaaggtcggttgacccaacacaaaatgcggaaaacaattctcctcccaaaaatattaaaaggggtcgaaatgtatgaaccgcgcggtgcacggcgacgttgtggtggccgaattgctgcctgaggagcaatggtaccacaatttctcctccgccctttcccaatttaaattttgcaggtccgcccctgacagtatcattcggttgagagacgcggaggaaggccaaacggcggagatggcacc

SEQ ID NO: 24112 - DNA, 1381 bp, Heterodera glycines
catcgcgtctacaaatgccacagtagccgacagaccagacgctgatcgcacctctacaatgtctctgtagcgcctgttattaatcctggttgccgaaaaaatgctggtccccacatagaattgtttgttaacactattttttggtttttctattattttagtagaaaaacaattttatattttggaagtaatataacttctagcggattttgaattttgaatccagttatctgcgcccatgcttcatctacaaggtccagattttgtagatccggtccaatttgatgcggaaagaatcgctggtttatgctatcattactctcatcatcatatacattaaaatcgacatcaattgcttttatctcatttcttacactttttataatattataaatagtcccactttcctcttttgggttttgtgagtataactcataattcgaagaactaaaatattcaagcttttccacttttggtactgaaattatactgcctaagcgtggatactgattcagttttaaattttgatgaactagtgcaaaatatggccatttgtcctccttatccagctgaacagccaatgcataattatccattctctgaaaaataatcatccttagctgatcatctctgtttttatccttttttttgtcttatttggtattcatcgctttctggtttaaccattgcccatgcaatagtatcagtacatcttaaacctattccagaactagaaggacagtctatcaggggtggggcgcgcacagaaaaatcccgcggtcgcggatcgcgcatcgcggattcaatttgccgcggtcgcggatcgcggtcgcgtcccagccctgcagtctatgttattaataggttctgttggattcttttcatcactttttttagtatctctcagttcagatgttttttcagtatcacattttattgccaaagctgccattgttttctaatcatttctctacaatgatttatttctgcaattcttttcgtttccttttcattttcggaaaaagaatacataacccataaaaaaaaaattgtcaagaaagatgaattatttaatacatgaattatagaatgccataattaaaatctataattattatgcgtagagagagaagaaaaaggaaaaagaaaaagaagagaaaaaaaatttacaaaaaattacaaaaattaaaaaatcattttcatttaaaaaatgaattttagagtgagagagaaaaaaaatttacatttatgatggttttccaaaatttttctattttaaggtcgtattttacaaaaacaaaaaatattgagtggtgtctttgagatttgtaaaaatgccgtaatatgaatgtacaatatggaaatatagacaaaatcagaa

SEQ ID NO: 24113 - DNA, 1582 bp, Heterodera glycines
  misc_feature (1188)..(1188): n is a, c, g, or t
  misc_feature (1193)..(1193): n is a, c, g, or t
gcttagtgctatcgaagaaatgaataaaatatttagttcgtctttgagcaaaaattatgggtaatttttcgtcaaaatttttcatattggtggttttttaaaaaacgactctgacccattaaaaataaaaagatgtaggcataattatcatggtgaacacttaaaaacaaaattacttgttaaaattttgtggagaataaatgtcaataattaaaattatgaggtgaaaaattctgccaatctttcggctctaacagccacaagcacgctggaaaaggtgaatcgtgcacccatttaagaggttgcactccttcaaagtacggctgttatcaagccgacgtcctgaagaattttaatttatgcgcaaaataagaatcaaggattatcgaaacaagtttaaaaaattagtttctcttatattggcacaaatcgctaaaattagtacaaattctgttaataaattgccactcggaactctgtttttcgaaattgggcctcttaatgccaaatttttccaggcccctatgaatttttatatttttttccaagactttccaggttttcaagacatttttagttttcagatcaaccagaaggagtgaccagatcatgaattaatacaaatgttgtattagcattattttttgtcagatcttatcaagtacacaaaattaagtgtctccaaatttgaagttataattttaaacgccgaatttgtgcgaattttcatgaaaaaatgcaccaatagtttttcttctacatatttctcaattttttttgtggttcttaatctttataagggcacacatccatctcaaaattcgtctacattaacgcaaaaaaaacagtctaccagcgaaaatcagtctttgatgatcatacagaatgccttcaatgcgctcaattttggttttgatttcctcgatggtgttgcttggaagaagatcactgaatgtgagtgttttgccggacataatttttacatagattttaaatccatgccgattctgtgcacggaaaagggaaatgcaattaacaaaataataatgaagatggatgggaatttaattcgaaaggcatcacggcaatcatctgattttagtcccacaaataagggaaaaaccaaaataaagaaatttaaagcaaaattgaggcgctgagcacaagtctgaccacctatttgtacantttcnatactttgaaatctccccaatatatctcctttttatattttattataattggtaaatgttgaaaactctagcgaaattaatcgttttataaaatgcaatttaaattgcttgaaaaatattttttttacttttaactaattttttataacttttgttggatttttttaaatttttaatcgactttttattaactgattggttttcagagattttttgaaaaaacttagtagttcatcataaaattctgaaaaaatcgctgaaaagtttttccaaaaatagtttcatgtttctgacgaagaaatttcctaagtattttttttgaaaaaatttctattaatatatttttttaaatatttttcggaaagaggaggacctgctccgcaactgat

SEQ ID NO: 24114 - DNA, 1384 bp, Heterodera glycines
tgcgtcagcaccgtgatgtcgggcaatttttttacaacctttacagtcaaaacaacacaaattcgtatgaacaacatgtcgacgaaaaccatgttcgttatttgatttctctccgtgcccgtgtggagggaggcgtaagtgaaacgaaacaattaaaatttattaaattacataaattatacttcctaattggtcaggtcgagagtgtccgcaattactttaactccaatggtgttatttctgcatattcgtctcgtttcaattgcgactttgtgtttattatgctgggtggttctgtggtgagtaaattatccaagtttaagtgtcaatttttaacgaaaaattagaagttttatgggctcatagtgtgtcgatagacgcttctgggtgaaaaattggaatttttgtaatttttaacattgtttcaccgaaaattgactattttaggttagcttttgaaaattttaccctagaacctttaaaaataagtcgaacagtgattttttgatttataatttccctttaccaacagcatcttttattaattttttcataggatgtcgataggcgctgctgggtgctcaaaaaaactaaaattttttaaattttcttaaattttttttttttcggtgacattatatcccgacgaattttcggcggtgacattttgtgtgcactgattttctacataaaattgatgaaattttgggggtttttcctaaataaacatgtgaaaatttataatttcgactaacccgtaaaccggtcccgggtccagaaatttgaaaatccggtttgaccggtttttgagaggcatggccaggaaaccggtagctcctgaaaaagtcagcccggcactgcagattcggaaatctcggtctctaatttttaacatattatcaccgaaaatgacttttttcattacctgcggcatcttttattaatttttctctctttttttagccgtgggatatagcccaagtgacgttcagtgtcgagactttcgttaacaattgtacagcgctgatggaatttatctttttccgtgtcattaccatggtgtgatataagtggcaataatttttaaatatttaaattgctcttacatatttaattttcaaattgcctttttcagatcgagtctggtgatgaaccgcaaatccctccaatgcaatcggattcaccgccgaatttggacgaatgatttaattactgtctcgacaaaagaccaatcatttatttatctgttttgtttcgctttcaaatttttttcccattgattctctatcaagtaaatcattcgccaaaaaaagcaatttaattaaagttttgaattttaattaaaaaaagaattataaatatagttgatccaatgatccatgga

SEQ ID NO: 24115 - DNA, 2191 bp, Heterodera glycines
aaaaattatataaaaaaattaaaattaagtaaaatttatttaaaatgtagacaaacaattataacggaaaaaataaaataaatcagctaattctttaaataaaaattaatggtagctattataaataaattaatatagctgcggaataagtattttagttgtaaagaaacaaacaaataaaaaataacataaaacggatgtattgttttgataggtagaaacttttcagcgaacaaagagggagggcttcaagtttaatgttaataattattcattagtatttttttggtaaaattaaatcagtattattaaaaacaacactaatgcatcaaagagtaataaataattatatttctaattaaaagcaacaaaaaataaaagctggctgattagtaggtttcaatcaatttaaatatataaaaaaaaattttaacaataatccaaaaccatgtaattttgtttgccattcatcgctgtgtcaattgccaattgtcaaatcatttcgttaattggcaatttttgttcattatccaatttcacttcatatttcaacctctgctcattcaacaattttggctcaagatcatatgtaaaaaaattatttaatttgtaatccgaataaaaactcttatgtgaattaaaaaatataagaattgaagaacaaaacaccgcatttattattgttgcttcaatttcattggttcttcggccgtggttctccttagcttgtttcccttttgtcctctttcctactgttcgtccagcggatctttggccttggttcgtcgctgggactgtacgggctcctttatttggctctcctcccgtgtctgcttgtcattcccaatttgtccttccatctccgaacttggggccagcaattcggttgtggcgccatttggttgccgtagcggagaaatgtcatgggcacgtggatgtcggtacttccgcccagtttggctctcattaaggtgccgtccacggtgccatttccgccttttgttgatccctcgatgcgtggcataatgcacctttctcggagccattccgcgtggtagttcccaacgcatccgctccttctctgcatttctctcggctctccgtttttcgtacatcttcctctgttcaagtgccatttccttatcaaatttctcctggcgtgccaattcctcaaaggaatttctggctcgaggtctccgggaagcacttccatcggttcgaaagggttacgtgtcgttccgcccgatgatgattcgacattcgtttgccgttgagaatcctttcatgatttttccactttctcctgtgctgcctttctttcactctcagcgacgcgcctcgcgtcatcttccatgaatttgactttatcttttcgcagcctttcttctcttagagccgggttagccttctcttgcagctctcgtctcacaaattcagtgccgcccaatccagcgaacaacttcctcaatcccgaaagatcaatcgtcctcccccgtcgtcgtcgatacgtgcgtgtttgctcattgtacgcaacttgtgacggaaagaacgggtttcggcgaggaattctgtagttgcccgggcgcagtggatcatatggcccattcgtctttggtttgcgcttgcctctgacgtcttcggtcgactgtctctttcgaattctctccttccttggttgccgctcattcctccctctgactggagatagactcgattctgtcgtgacgatttgagaatcctgcatcaccgtccctggaggcaaactggactccattgtgacagattgcaagtacatgccttgcatcacagcacttggagaatccataatggcagtcacttgaatttgactgacttcgtcctccgcagaagggttaatttctagagggtacaaaaggttaatcgctcgcacaagagtttttgcttttgggtgtactcgggccgggcgcgcgagaccatccctccccttcaagagattttcgacttttcgcattaggcaaatggacagtggggcttccccttcttcgaccaagacaatatccccctctcttgggagactttctccagcttggttgttacgatctctttctctgagcgaaagtaagtactccgatctccacagtttccagaaaacgatcaattcgttttattgcaactctcatccaaagaaggaattcccccccttttccggggt

SEQ ID NO: 24116 - DNA, 1672 bp, Heterodera glycines
  misc_feature (41)..(41): n is a, c, g, or t
  misc_feature (93)..(93): n is a, c, g, or t
  misc_feature (140)..(140): n is a, c, g, or t
gggtgtattttcgctttttcgcattttcttgtgaaatctcncaaaaatgaccaaaatatgctctaaaaatgcaaaaatggcaaaatatgcatntattcttgaaaaccccccaaaatatgcttaatatgcactaaaaactntcaccaaatcaaaaaattttaacgtagaaatgctatttttgagcccctttgttcatagcatatgcgcagaaaaaatatgcaaaatcatacaacttcgaacccctattaattaccatttcaaattgaaaaactaaaaaattaaaatttagcaaaaaatgataaaaattattgcaatttatccacaaatctccaaacattgaatgcactgaattctcaaagaattggtgagcattgaaacgaataatttggataaatattgcattaaaattataaaatataaattatttagccaaaggaaaaaggctaaaaattgttcaatcattggaaaataagcgaccaaatttgacgcataaaactcactttgattacatgaatcagttgaagattatgctggcaaacaaatcggaaattgaaaaagtgcgaaacgcaacaattgctgccctcgggggagaatttgaaaaggaaaaagtatcgtaaaacaaaaataataataaattaaaaaagtgattaaattccacaggaaaatgatgcttattcaatttgcgcattaaatgaagcattaggaaaagccaaagaaatggccgaacattcggaagacaaattggacgaaactgaacgcatttttgaaattgcaagagtaatgtggaaagcgatcaaaaagcatgacaaagtgcgaaaaagggatgtaataagtcaaaaaaaaattgaaaaacatttacagaatgccgtgggcattgtgccgcggttgcgcttcatcggtttagtgctttggcatttggcggttcggcaaagtccgctaattgaccagcagcagcagcagcacaacggggcaccactgctggagttcactgccaaaatgaggccgaacattgacccgcatgacccaacggaatggcaaacgatgctttggcatttcgaccaaaatttggcgaacgcagcgatggatgcggaggaaggccaaaaagaggcgaatgaggggggaattgaggacggaaaatgggagggggaggaagagcaaaatgatggggaagaaatcaaattgctgagagaattgggggagaaagtgggccaaggccgggcacaatttggggaccgggaaaggcacgccgaactcggcaaaaagttcagtctgttgaagaagtcgactagcaacgacggagcagcccatgggatggtcaacttttgtgttatctatcgagcatttctcgtgttcggctcacaatcagtggacattcttttgttcatcagggtaattaattaattattaattgagcaattagtttttgattgttggcactttttcactctccagggcgtttggaaggtcatttcaatgcaaaaacaatggacgaatatttggagaatggcaagcaaactgagaccaattcgtacatgttgaccactcatttgtcacttcgaaagatgaccattcattcaattgctgacagtgggagaacattttggatacaaattttaatgtgaagaattaagaaagtgatgaaaactcataattgttggctgttaaatttaat

SEQ ID NO: 24117 - DNA, 1306 bp, Heterodera glycines
caagcaattatctattttggttttttacggcactgatccccttaatgcgtgtgccaatagcccagggcgtgccccgtttcgtgtgccaccacatattcctacatggtcagaggaagtgccaaccattaaattttgccattggcaccaacacgaaacctcggcacattccgagccgatgataatgtcctggaagccgccattgcgaccgatgtactcagtgaagcagctaaaatgagcagggatttcatacattgatcacacgctgctgatcaaacagaatgagcccaacatggagaactatcggagttatccgagacggtgatcacttcccttgctactcctctgatcagtgcctagtgatcaatcatgtcttcttctctgatcagctaatactctttctcttccattctccgatcaatttccttatcgctctctgatcagacctgtcgccccgctctagcacatatctaatcgcatctgttgcctgaacattctcgcggaaccgtaagcaggtcgactcctcccacctgaaaagcgggagaaaggggggggggaggcaattacggcggaataatcgatgcacgcacattttaatgccccttctgatcagattttgaaactttgctaaattggggaggtgcatcaaacagtttgggaaaagcaattaacgagacgagactctcgaaaaagtaacaaaaaaataaaactgactatcgccgccccaaatttggaatgggattatgttggagctccattcgtacacctggccggcgatcacctgagttgttaataacagcattatgcccggcttttttgtcggcaatcgaaaatattttaatttttttgttgtaaaatcattaaaaatttaaaccattaaatcagcaaattttttttaattcagaaataaagcaattaactgctgtaaaatttaaagcacttaaataaagcaattattaatatttgatgcatttaaaaaaattctgtttagaaaatgtcttaaatttggcattttcattcaatttttctataactattttagcattagcaattcttttagctccgctttgatttttttgcacaaaacccgagtgctaaggagcatcaatttcaaaaactgcttttgctcacccacctcaattaaagttgaaattttgtaaaattctttatcaaagcaatcttctgctaacggccctctaacctgaaatccccgcgattttttcatttgggcccagaagccctttgagtgagcccatatctcccccagctgttgatgaacggtccggtccccttccctcctcccttcggt

SEQ ID NO: 24118 - DNA, 517 bp, Heterodera glycines
ttcatttcgttttatagccttgtcaagttgtcatgttttcagttttgaaatatactttcttccaatttccccccccccccccgcttcttttgcctgtctccgatgccgtttttgttgctgctgcggctttgtcctcgacacccgctccacaatggcgtaatattggggcccaacaaatttgtcggagccgcccataggctcaaggccgggcagaagcggaaaattggtggtggaggacgacgaattgggatgaagaagcatcggacgaacaaaagggggcgcaaggaaaaagagaagggcaaggaaaagcggaaaatgaagcggaacgaacgaagcggcacgaggaagacgatgaagatgatgatgatagggatgaagccgaggaaaagcagtgccagaaaggagcatcttttttggggggaagggaaaatggggaagaaccagtgaataaatgggaaaaaggggggggggcggtgaagagggataggaaaaggatgagataaagcacaaaagggga

SEQ ID NO: 24119 - DNA, 1964 bp, Heterodera glycines
gtagagttcgtcgagaagtacaaaaaatcagctggtatcggcaagcttagcttgggttgcccatcgacagggtcgggggcgaggctgagggtcctccggcagatgtgcccgacccatgacgggctccaagtgaatggattaagaaccggacccggcctggtagatagctcttaaaaaactgaacaaaaaattgttcttaaccgggccggtccgggttccggatcaggcacttttggtgcccgaaagtggtgcgataggcttccggaaaatgaccaatcaatcactgagttttttgtggatcgcccacactgagtttttttgtggatcgactcagcacgtatttaaagtattaacattttttcaagtttaaaaaattaaaaatgaccatttttattgttttcacttctttaaagctaaagcgaacaattaaatcataaatagacaattaaaaaaaaaataataataattaaaaaatttctattcattaaaaaattttgcttgtaaattagctaaaaagcaaaaattaattcttggtatcatattcgatcccccagtgttctccattagtctgatacatcacagtttggaagtcggttcaaatcccaccccgggggccagttgtcttttacacaaaagatcagcagaaaaatttctgaatttaaatgggaataaaattcgtcgatttttttactaactggtccttctctttttcaaggtgatgatattgtgttgttgaaggagggcacaagagtttgtggctctggtggaattttgggtatcgataaattgtccgaaaaagagggaattacaattggtttttaaaggaaatgtgccacttctacaaaacaaatcttacttccaagtgcacatccatcagtcgggtaggccaaaattccactaaaattgaattgtttttttttgatgccaaaacaaattcaggaatttggggaatcggattgggcaccagaaaaactgatctttcaaaggcaccaattgcggacactgcgtggatgttgctaaatgatggcacaattttaatggacaatgaaattgttgggaaagtggagcagcccattggagaaggggaaacaattgtaaaaatatttatttttcaaatccccttaaaaaaggcgaataattaaagaaaatttcccattttcatggcgtcgcatttgaccatgttgagctgcacttctacagggggtggcgtgccgatttggactggtccgatcaaagcgtccgatgttggactcgttttctacccgtgtttgtgcattgatgagaattgtgttttggatatctgcttcagtgcggctaaatttagcccaaaagcgccattgggctatcaggagataatgtctgaacagacattgctttaatttttttggggcaaggacgatcccgggggcgggggaaaattcttaagaaaaaaaagcaaaaaatgatgaaagatttttttttcctacgtttacctctccccaagccccaaaaactaaaccctagaaccatctctgtctgtggacaaaataaccagacaagttgccgcaccgcctagcttaaaatgagaattaaagggaatttgtgggttaagttcgtttaaaaaatgccaaacttcatgcaaattgattttttttaactcctttcattttttcaaaatggatttatatatattttataacaaaatagcataaggcttcttaaaaatttcagtatttttaatcaaataaatacaaattttacaaaaatccgcctgctttcaaaacagtgcgggttttgagtaaattccctatgctattaatgtattttgcttttttcaatcttttcatcatgaataccctacaccgttcgttattaaatgcataaaaattgtagaaatgtgaattaaatgctttttatttacacaaaatataatcaaattcacactaatgttaaaataattaaaaataaaatcccgtatctcaaaa

SEQ ID NO: 24120 - DNA, 2067 bp, Heterodera glycines
tagaagtttttcacgagtcgtgccgccattttgcgcctttgccctgcgtccgtcggcacaacaccccgaaagtggctgggaatggcaacaaatcggctggacgtcctcgccttggtgggtctttgtttaggatgattagccagccaaatgtcttctcttgcgttttttggttacatggcattttacgcgttaaaattgccaaaccgattttaatgactcctttaaaagccatgtaaagacgcataaatcaaagaaaactcaaaattgccaattttacaagaaatccgcttattttcaggtgatttctgtcccgactcccgcccgatggttcctccgctggtcattttctgcacttacttcttggaccactgcaaaacatacatgccgtacagggacttgtaccaaattgaggggtaattctttaacgaaacgggcaaaaagaaatttggagggcaaattgatgaccatttgattattttgggccttaaattgaaaatttccaaggaaaacattggttccgataggtgccataagtaaaaattgcattttcgacaaatcattagtggaatttcatcatttttagaagccccgctgaagtggaggccgtcacaaagcaatttctcgccgcaaacaaaagctacccgaaattggtacaaatttacaaattatactaattattatttgcccctttttaggacgcttttcctcccgctgtcatttccgcttgtgtcaacaaatttttgatgcaaatccgcgacccgttgatcccctattcatatggcaaggagatttgtgcacttttggaccgctgtttggccatcgatgggcccattttggagggatttgccggcattgtcgaggatttgccagtggtaagtgtttccatttgctgacttttttagacctattcccattaaaaggcgcacatggacacgttgggtcacttgtgtcgccattggaatcgtctggtcgcgaattcggtgagaaaatcgtccaaaatttttgcatgaaattcactgacattcgtaattatgccataaaattcgttggcccaattttccactggggttttcattttgagacttttcttccatttcatttggttatggggcaaattttatggtccaaattgctctttcctgaattttcagcatttggcaaaattctttctactgacaatgagtcatgcatgcgttatttaaaaaattttatgtccattgaatttttggcataatttcctagtttgattgtcgaacccttaaaattcggacaactctgacaattattgaaaattgtttaagttcggtctgctgaccatcgacgcgctgtcagttccgcttggtccgctcgttttcggctccgctcgccctgactgtccgccgctgctgcgccaccgctgcgtcagtgccatggcccaattgcttcggtttggcaacgacgacttctggaccgacacttctgtccgcacactgaccaccagcagcagtgggggcacgccaattgtgcgcaatccgtcgcaacgctcggcacggagtgcggtggtggcggacggcggcggcggaacgccacagcagcccaattttggtaatactaattcattttgaaaaatggagtacgtggtcggtacccacattctattatttcagaaacctaaagtccaattggtttaaaaagatgacatttgaaagataagactcaatcgcattccattagcagataccgctaatgcttgattattcgcaaatctacacggtcagcaactaacatgtttatcttgaaatttgcgaaaaagctatcgaatatgatcaaaaattcaaattttgataaaaaaaaaacagataattcgcttctaattaaataaaacacaaaaaatcggccaaaaactcaataaatgcaaacaagtcaaaaaataagaccaaaaagattaatgaaaacaagtcaaaaaagaggaccaaaaagattataaagattaaattcaaaaaaatccaaatatagccaagggtagcaaattaaatgcttttttttaacgaatttatacaattatgcaaatgtttttatttaaaacac

SEQ ID NO: 24121 - DNA, 1270 bp, Heterodera glycines
gaaaaaaatttggaccttcgtatgaaaataggtcccgagacacccccccccccctgtcccaatcgtccgtcgtatggcccttggcttgagacaccccttgcacatgtatgaatggcattgttagatcaatcgattgttcttttttaaattctttcgatcgcgatatctttcaataaaataccgaaaaataaatacatattgaaaacatcgaccgataattatcgatacaggtggtctttaatttttgtatttaaggaaaagaattattttttagttaaaaaaatttctttcatcttcccaacttaacctgctgtgtgctttttgcagttgttgtgccatgactttgtccaattttgttttttgtgttcctcaactgttgctgaacagttaccgtcgtcgatggttgagttcttttcttttcatgagttcgttcaaaaaccggtgttagaacaaactgctgaaatttttaatagaaatcagcaccaccacatttattgttagggttcggaattgtatggaaatcccaacttttttcctggactgtgactaggctgcctgaaaaacatatttatagcttggtttgaagcttctatgatggatttcaatatccatattttccattattttctataatatttcgcgatttatgtccatatttcaattccacattttttcaatattttggggcattatggccatatttcgtgattttttttgtatccgtattttccgagccctatttattgttagttatccccccattttttatcccaccttttttgtgtcattagccgacgcggaaggaagccattcatttttctcaaaaaccaacatgtcccctcccggaaattcttcctctaaaatttgggatttttccgaaaaacctaaaaaacatatatgtatttttatttaccctcgggtacactgtcaatggcctcggcaatttcaggcaattccctgttgaagtcaatctttgtctgagttgacgactgcactttttttcactttccaccttcggttttgtgaattcaacttaaaacgtgcaattggataaaatgaataccaatccggagcagatcgttcctccgagaaaataaaaatttatcaaaacttaaaattttttttaacctagaatttttcaaagaaatttttctatagaaccttagaagttatgaaatcatatattttatggtaacatatttttttaatttgctggctagaatagaaaaaattctttgtttttttttgagaaaaatttttgttatggtaa

SEQ ID NO: 24122 - DNA, 1770 bp, Heterodera glycines
ttgaaattgaaattaatttaatttttaaaataaaaataatttttaatttatgcaaaattggccaagtaatagtgaaaaataaccaaaaactgcatgaaagacccccaatttcgcctttgtttggctcaattttttatgtccgaccaacacaaagcccctccggggatttgcaaatgacttggccacagatggggcggcaggcacactgcggaaccaaccccaaaaattgggccaaccactcactcagagcaaagccagcaaatttggcatcataaaaatccaatttttcaaaattttaaaatttatataaattaaaattaagcaaatgttttgattatgtttaatgaattaatattttttataaaaatctgttttattattggtgccattttatgctgcaaaatttgcatttaaaacacacgcaaaaattggaatgataaaaattatcagaaaattcacgccaatttcccgcgctgaattgcagagatctgttgcgcaacaacacacaaagtcttttaaaaataataatattacaaaaataattattaaaatttaataaatttacccgtcgttccgtcctcgtcgtaagtaatcggtgcacatccatcgccctataaacaaaagttttcaaaatttttcttcaatttaatttaaatttattaaatttctagaaccaattttttccattcttattgatttaaaaatattttttattaatttaatggagcttttcaaaataattttttgcatgtgaaaaattaattgttcattttattttgaaattcctaaaaccaattttttttttttcaattttcttagctttaaaaatttatatgttattttttaaatttaataaaggtttttaaaatattttttgcctgcaataaatatattatattcaagtttaatttgaaatcgctaaaaccaatttttttcattttttaggactttaaaaatatatttttttaactttaataaacctttttaaaataattttttcttgcgagaaattttgttcaatttttttatatatatcacactgcctgagggcattgtgcggcggaagcgcagtcgcgcaccactcggccatcgtacacatcggccttgaggcaatatgttggactgccgggcaacgaagcggcacaacggacctgaaaagatttggcaaaatatgaaaaggatatcatcattagtggatattcgagaccgaaaattcccgagagttgagactttttttttaaatttctcttgttccttataaattgattaaaattttctatttattaaaaaaaagagaattttttgaggcttttcctaagatctaaactctcgaacatcaccaataaacaacatcatacataattgatgaatttggcaaattaaaaaattaatccctaaaaaataaaattcagaaaatgggtgtctaaattaaatgtttatctctctattccttgtctttttaatattcttttaaaatttggtgctgttctgctgatcatttttaaaagaattaatgagtacctaaatttttgctgaaaaataattttttttttaattttcattaaatttgttaatacattttgccgtaaataaaaaaatctcgattttttgaaacaatttttaattggcaaaaatgggagaataaatttaaaataaaaattgaatttcgttgctcccgccacatgctatgctttacctgctccacgcccaacgcgtaaccgttggtccgataacagtccaccgggccaagctgatcaaccgagcaaaaaa

SEQ ID NO: 24123 - DNA, 1262 bp, Heterodera glycines
agagaaaggaagacagagaaagatgaaagagggagcaatggaaaggacaaggcagaagagaaagaaaagggaagagagggagagagaatacagggacaaaagcagaagagagaaagatgagaaaggaataacagaggataaagcaatgaagagaaagagagagagagagagagagagggagaacagagcgcaagcttagtgtagagagaagagtaaagacagacagagagagggagaagaccgaaaaaacactggagaaaggaatggaagagaaagagagtgaccaggctaattccgtaattacggcttttttggttccttcgtaattacggattacaggttctacggtatccaaaattaaggaaaaggacatttggcgccaagccaaagaaaatcaatttaataatcacatgattcaacaatggttgtcctttttttagcttcacccaccgaaaaataaaaaatgaatttataacagggattatacagatttcataattgaaaatccagttacgttctcaatgttcagtcctactggtgatgacccaatccgacagccgacattttcccacttctccccctcccccgcccattgatccctcatcgaaacactgaccaactgatcatattttgttcgacacatgctacgcagcaacaaaaatgaatacctaaattattttgccattattcaaaaattgaaggcacaatttggtccttctcaacattcaatgccctccccctcctccctccccccattatctctctctcttcttcttctctgtgtcgtcccattgcctttctctaccggtttgtccccccccctctctctgtcaattggctgtactttctccgttcttccgttgttttgtcgcttataaccatccgaatcttctaatagcgaagaatgggagaacagacagaagcggaacactgcttcccaacggacggaagagaacgaaagcccttcacaaagaaaagcattgagtcgcccccctcccctggcaattccttatttattactattgttgtccttaggtaactaatttgatccatggcatttgtcacacttgctcctttttcccctccccaccccttttttttgctttttcagccttttcacaaatttttctctctcattctctctctctctctctctctttctatgtttctctcttcgtcgtttctttctttccgccgatggaaatgctgcgcaatgcgatgatgatgatgagcattcatccgcagcagcagcagttggtctt

SEQ ID NO: 24124 - DNA, 1529 bp, Heterodera glycines
tgctgcggatatcggtacgatcaggcaggagattcaaatagctcccctcgcatttcaagggccgtgtggagcgcacgagacaccacaggaaccgcggtgctttacgggcgcaacatccctatctcaggctgagccacttccaggcacgcacaccctaaaccagaaaagagaactctggctcggactccacacgacgtctgcgagttcatttgcgttaccgcgcaaaacagctcttgcgaaccgtcatttccctagcctggcgtgggaatgttaacccacttccctttcggcaaccggatggaccaactgcgcaagcacagaaaagtcgtcatccgtagtgtgttacggcgttagccggtgccttaggatcggctgacccacattcaactgctgttcacgtggaacccttctccacttcagtcttcaaggatctcacttgaatatttgctactaccaccaagatctgcactggtggaagctccggccgggcccacgcccaaagccttcaacgcaaccaccacgaccctcctacacgtcatggccagactacgcgacaagcacgtgtacaagccaatgacggtggagtataggtggcccgctccagcgccatccattttcagggctagttgattcggcaggtgagttgttacacactccttagcggattccgacttccatggccaccgtcctgctgtctatatcaaccaacaccttttatggggtctaatgagcgggcactttggcaccttaactccacgtttggttcatcccacatcgccagttctgcttaccaaaaatggcccacttggagctcaaacattcaacgcctgggttcagagtcaagcaaccctggcttcatacccatttagagtttgagaataggttaaggacatttcgtccccaagtcctctaatcattcgctttaccgagtataactgcttaacgagctccagctatcctgggggaaacttcggagggaaccagctactagatggttcgattagtctttcgcccctatacccaagtcagacgatcgatttgcacgtcagaatcgcttcggacttccaccagagtttcctctggcttcatcctgctcaggaatagttcaccatctttcgggtctcagcgcatacgctctgtctccgccccatcgcatgcgatcgagacgggactatgttgcgccccaacaccgcagtgccagggatcacacatcagctccgtaagaagccttcactttcattgcgcctttgggttttgaacacccaatgacttgcgcatacgctaaactccttggtccgtgtttcaagacgggtcgaacagatgaccggcttttacaccgagaacgcacaactgagagcccgagctggaccgaactggttgctggtacgtgtcgcacgcgaccgccaccgacccccagctcgagtcaacacggacccgaaaccattgcacaattcacccagagtaaacagcactcccccgatccgggtaccagaccccgaaaggctggcctcaagaccgagctcacgcag

SEQ ID NO: 24125 - DNA, 1474 bp, Heterodera glycines
  misc_feature (1447)..(1447): n is a, c, g, or t
  misc_feature (1457)..(1457): n is a, c, g, or t
tacaaaagtgataaaagaggtacaatagtgattagaacatgtacaaaagtgattagaagaggtacaaaagtgattagaagaggtacaaaagtgattaaaagaggtacaacagtgattagaagaggtacaaaagtgattaaaagaggtacaaaagtgattagaacaggtacaacagtgattagaagaggtacaacagtgatttgaagaggtacaaaagtgataaaagaggtacaatagtgattagaagaggtacaaaagtgattagaagaggtacaaaagtgattagaagaggtacaaaagtgattaaaagaggtacaacagtgattagaagaggtacaaaagtgattagaagaggtacaaaagtgattagatgaggtgcaacagtgattagaaggggtataaaagtgattagaagaggtgcaacagtgattagaagaggtacaacagtgatgagaagaggtacaacagatggtgattagaagagtcacaacagtgattagaagaggtacaacagatggtgattagaacaggttcaactgtgattagaagaggttcaactgtgattaaaagaggtacaaaagtgattagatgaggtgcaacagtgattagaagaggttcaacagtgattagaagaggtacaaaagtgatttaataaatttttaaaaataaaataaatttccttttattaattaaaaagagtgtttgaaaagtacaaggattgaatatttatttaaattgaaattaatattacaaattctaatttaaaaatacaggagttctttaataaaagtaaataaattattattttaatttaaaacatttttcacaaaaaaacaatttaatttaaattgaaaaattttattttttatggattaaacaaaactattaatatttattaaaatgaaagttaataatataatatttatttaatttgaaatgaaattaaacatgtaaaagtaatcaaaaaatgcttataaaaataatgtacaccggccggattcgaacctgccgcccccccccccccagaagatgactcagaatcccctatcacacagggattctgagggcttaacgatgtcaaaagtaaaatctgatcacgtattcgtgatcagcggcccaaataacgactaaagacatgtttttggaagatttttgacgaaaaaattttttcactcaaaaaccatgtgcacccccctttggtcccgatgcacaaaatcacttttatttttatatctttttttaaaaatgtgatagaaatgccaaataaaatttatataatagagcaaaaaactgcggatttttgtagtattttacttttctcaaatagcttttcagaaggcagttacgaatttttttctgaaaaatctaaaatttccagaatttctggaataacttttttcatattgatgttagaaaacctaaataaatcccataaaattctcctgantttttctctnattttaaaggctttatt

SEQ ID NO: 24126 - DNA, 1421 bp, Heterodera glycines
  misc_feature (28)..(28): n is a, c, g, or t
acatttcaataatataataaacaatttnttgaaaatatcttcgtatctcattgttgacccatcagaataccacagccgccgaaagcaaaactctttctaccctcttacacgttttcatttaacaaaaagattttctatatatatatcaataaaatttgattttaattaatttataacttatacaaaacctaatgtattagcaaatatattatgattatttttttgaagaatttactaaaatataaaatattttttttgaaatgttaaaaaatcaaagtaaaagtcaatgaaaattttaaaaaaataataaaagtttaatagattttaagcaaagtcagatcatcgggtctttaaaaataacgactttttaataaacaactccatctttaccaatacgaaagaatttaataaaaacataaatttttgaaaattaatatattaataacaaaaactttaattttacgggatgaggtcaaattacttaaaattaaaaaaaccatttctattaatagatttcaaattgttcaattaagaaacaaactaaagaaatcaaaagtagttaactatatttaatttaaattaattcgaaatgaggtaagaactgtcgcgaaaaacagtttctggacgagtgaattaaatataaattatatttgaaaaaagtttttactaaaaattactaagaatacttttataaatcacttgcatttatttaagtttaataaattcattaaattgaaggcaaaataattaaaagattatttgtcagtgtttaaatttaatcttttataatatgaataaattcttaaataaatattttaaattttgtataggaaataaagtactcaaattttaaattatttattgcataaggtatctttactataaatattgaaaagcacacaaaaaataaaagaaaatttttatgaatttttttcacgaaaatcagcacttttttatctgatataatatgcaaactttatgctatatcaagcaaaaaaattttatcataaagtgacaaaatttgaggctttttgaattgttttctaaattaaccaccggtcctgtaaatattttttttcaaaaaataaataagacgggccctgctggggggtctgtatcgtttcggcgccgccgtttcggcgccagcccttgtttttggactataactttttttgttgtcgatcaaatctaacaatcttggtatcattcgaaagctgaacatgtttagaagctatttctaagcaattgcttagcgattagtcgcttactaaaaaagttctaactgaaaattgcaaaaaagtcaaaatttttgtgatttgttcttaataacttctttacaggtcaaattttttttttgactttttgtaggtctaataggtcttctgaagggctatagagtgataacatgattattagaattg

SEQ ID NO: 24127 - DNA, 1677 bp, Heterodera glycines
ttttttcagttgataaagtgctgttcactttaatgagttgtgtacccacaaggtcagcttgtgcccgtggctactatgaagacgcatttgtgacatgcactaatgtcaagtgctgccggaccgacctttgcaaccgcgtgcccgaacgtgtggtcaaacagtgggtcgaaagaataggggtcaaccaaggctttgtatttctggaccaatccaagtccagttaattttttggctgtgtgctttttgctggcctgtgggttttcatgaaccaagccaggtccggcaattgtttgactgtctgatttttcctgggactgtaagttttcctggtcccaggcaggcccgggcaattttttggctgtctgatttttgctggcctgtgggttttcatggaccaagccaggcctgggtaatttttttgctgtctgatttttcctgggccgtgggttttcctggaccaatccaagtccagtcaattttttggctgtctgatttttcctggtcctgtaagttttcctggaaccaagccaggcccgtgcaattgtttgactgccagatttcctggacctaaaaggtcaaggcaaatttttggctgactgagcttcacagaaatttttggctgctgggttcttggacctatgggttttgctgaattttttccccgggaaaaaacccaggctccggtcaaacatgaaacccaggcaagcctggcaatttccacaatttatccatcattaatacaaaaagaattttcgaatttcttacatcataaggtatgtacatctaccctgcccggttgggacgcttagcccggcttggacgcttggcattggcggcaccattttggtcgtgttaattgccataatttttgcgggtaaataatgatgttgttattaattaaaaataagattgcatctctgggttggatctggctaattagaggcaatgaaaaaaacgcgccaatgttacagtatcatttaataaaatgagattctgtagcacctagatatttatcaagaaatcgaacgatataggaaaaattggtggcgctggcgaatggataattttagaaatttttatttctgttaattatttaaattttaattaatttcacaattaaacagggtttgtcaaatggtactggtcaaataataatgaatgaagaaacaaagaatgaaaaattaaaactatcaaatttcaattttatcgatcaaactctcattaagattgttcaagtgttaaagcaatttatcccttaattaatggttcgcttataattaattagtgtcaaatcagacttttcgatcactaattcttaacgtggattaattggaacgaaactgttcgggtggtcaaccccgagagataaaagtacacaaatgcattcattttccctttgcatgtgtctatttcttttcctctccatttccccactctctaattattgtgtcttcctttatttatgtaagacactattgatttattatgtccattgcatatcctttcccctcattcattcagttgcttttgaagcactcaatttcatcgcctaaatttattttgctcctccaatatttattccgcctccgacttcgcccatttttattttaaattgttttaatttatttgttctacaaataaacattttattgagtcggttcaaagaccgaacagaaa

SEQ ID NO: 24128 - DNA, 1961 bp, Heterodera glycines
  misc_feature (1926)..(1926): n is a, c, g, or t
aaatgccaaagtggcgtcatctactgtaccaattatgcattcttatgttcagctacagtatccgtcaatatgagtaccaccgtgttttaactcactcattgaatttcgtccagcgactcgtgcatgaaaatgaacgtaaaattgttgcggttgttgtcttcatgtttggcgactttttctcgtttcgcgtacagctcgacagaatcgccataattgaacaaggtcggcaattttattgtgaaatcgttcagcacttttatatttttagaaagcattttggttttgaccagaaaaatcttggaaaaaatgaaaaattcttaggcctaaaaatgaaaattttatgaattttgatattttatcgacaaggaattttgacttggtaaattgagctatgataaaaaaaattacaaaacaattttgtcatggcaaaaaccaaaaaaaaatcgatattttatttaaaaaaataattggggatttttttttggtatgttttgccttaacccatttgactgggaatgttacggtcaatttaagtagtactgtattcttccgaaacattcgtggattgcttttaacaaaatttttaaagttttttcatttagaatattagagaaattgtatatatttatatcttttttttttgtacatttttgccataaatattttacctcattcggatcagtgttttcgattttgccgctgatgattttcatcttgccactcagctaaagttatttgatcgatttaaaatcttttaaaaataaataattaatatattaattacctggtcaatatataaataatccgggtcgccaaatgctgtaacatttccttcgagcttaaaaacggtaaaatatttagataaaaaatgaatgaaataaataatttaaattcatttctttttattttgttaaaatatgttcaaaaaaaaacttggtttttttttgtttgtcaggtcataacttttttcgaaacctaatgaattttttttgaaattttgcagtataatagaaaacatttggagctaccgaaaacatgaataaaatttaaaatttgattttcattttgagggaagttattgtatgaataataataaataatgtttcgtccaaaattttccatttgatgcttttttgactaatatcccagcatccagcagcagttgtactcacccggatgtaattcgcggcccaaaccggaagttgccgtttctgttgggtgttaactgtgacattatttataatcacgtagagcagttcctttttgaacaccgtttgaaattcaaatgtgcgctgctctccatttttaaataattcattgaacttgttttcgatcgttttgctgtcttcaggcatatccttttttttatttttctaaaatttatatgtattttttaggaaatttgtattttgaaaaaagcaatgtgcctggattccatgctggacctggacaaaaacccaagaaaatacaggttgcaggaaaatggcctggacctggactttgatcaaagaaaaatccaggcctggatccaggcccagcaggcagatagatctctagtatttttaagatttttttttcagcaaattgtatattttggtgctagattatttgggttcaataaaaatcaaccatccaagagcagattttggatgccgttaaaattctcgagaatagaacccggacgagtcgggttcctggaatggagcccggatttttctgagtcccaaactgagtacatttgattgaacccagattttttctgggttcctacataccggatacatttttcaaaaaaaaactttgtctaaatcattactaagacaaaatccagtacaaatcagaacccggttcaacctcaaggatcaacaaccaagagttcttttacgtataatacatgccatgctgaattaaaataattcttactanaaactcgtaaagttcgattctcgaaacgttctcct

SEQ ID NO: 24129 - DNA, 917 bp, Heterodera glycines
  misc_feature (904)..(904): n is a, c, g, or t
actttatgagtccaatcgacttttatgagtccaatcaattgacaatcccgggtttttatacaataactttgttcatgttcgaacaaaccctatctttttggtatcattcgaaagtacaaagtctaacgaagctaaaatatataaaatcgcagcgtttaggcaattaccaaaaaagatttgattatttaagtaaatacttattattttcgtttgtaactttcttgaaatgttagaattttcttgttttctcgtattattacattatttagacttcgtactttcgaatgataccaaaaagatagggtttgttcgagcataaacaaagttattgtataaaaaccattgattggactcataaaagtcgattggactcataaagtgcactagagccgtgattagtgcttcaacattaataatactttttgttatgagttcgacaccggttgatttggcttctaacaaaattcatatacacggcgattcaattttgggctccaagtacaaataagtttattatttatttagtaatcagaacgccaaaactttgcaaaacttaaaatttattggggattttcccttgtaaaaatagaagagccgatctcgagttaaaaacttaactttcacaaaataaactttgaatcgctagagggggccaaaatatgggcctaggcaaaatttcaagaaaagttacccacaggaaaaaattttttcccagggcaaagttttttctttttctctcattttgacgcactatttccatgtctctaacatataaaataacacatggttcatttttttgccaataaacaattttttaaacttttgactaattaagaaatattcttcagaattttcccttcaaaatgagcacaaaatggttttgtttggtctattattggccaangttataagctaaa

SEQ ID NO: 24130 - DNA, 1948 bp, Heterodera glycines
  misc_feature (28)..(28): n is a, c, g, or t
ccttaggggatttcatttgtaaaataanttcggtcaatccttcaaagaaatcgacttaattcaattgaggattcagtggcctttttgaggttgcgcaattcgctatgaagattttctctaattaattggggggtttccgtaccttgattttagtaattttattacgatagtgtaatttttattggtaaggggatacggtgacactattctgtacggttcatcatgtaagagccctcgaaggtatttgagtttttgtatattttctaaatttgggtcattgtccactgaggatttgaagtcatcccagaaactgggccattgggagaatttgccattaaaatgcgtaagcgtttggggtggaagctttaatcttgatcggtaattgacaaatggtatacgatcatggtgtatttggtcattcaaggaaagttctggcgattcgtcttcattgtcactttcatattccttttcttcttcttgttcttcaacttcgtcttcattttcatgttcataatcatttgattcatcttccgggtctgagtctgaagatgatttttctttaagtaattttaatctcctttttacctccaaatttacgtcttttaatgtatcgagaatttcatctatttctttaatggttttaaggtagtcgtgtttttcacgaaagattttttgaactttccattcattattccattcttccttgttcatttttctcattaaattttgccatcttttatttaaggcttttaatttttcaaaatttggctctattttttggataatttcctttgttttattgaatatccgcatgcattctccgggattattttgatcatattcgaatttgttttcctcaatttttgttttgatcgtttctatttccctttttaatacgcgattaaggaggggtattttgctacgaagcgtaccggacatagtttgtattttaaaaattcaaaataattaactaagtacccttttatggttatttagtggataatcagtatcgagtcgaattttaattggtttatcactggttaaataatttttattaaaatttaatgatcacagaattaataattgttatcacaaatttaaaaatttgatcacagaattttatttgtttttgttaattatttgctcctttttttcataaaattctttcaatatattctccgtatgttttgggcgaagtttcgttaatttgtattccgtttgtgtttttaattttataagttcagtcagtgtagtgcttttcgccacttgtttctttttcgtgttggctttggtagtcggagtaaatgaattaggagtcgctctgtccacttaattatttaaattagtgatgggtttgctgtagggtttattatgacttttaattatgtttggctttttatggtgtcctttttcggttttttgattgggtttggtgatccgtgtgtgtgtgtgtgtgtgtgttttttttttaattgggtttgtcaacccttgattttgtatgggcttggtgacccttatacttccggatgacgagcagttgcgcaacggtgaatttgacgttttgacgtggcaatcaggtgcagaccggacaggcagcacagtaagacgaatgggcacagcaggacaaacgggcagagcggcaggcacggcaggacaaatgggcacagcggagtggacaggcacaacagggcgaacgagcacagcgggacgcacggcaggacaaatgggcacagcgggaaaggcacggtcccgggtcgtggcaccaatttttgtcgggacgacaaaaaatcgacgacgggctctgcggggtggtggggacggaaaggagaggaattgagcgaggcgcgcagagggaccgttgggagggacgtagggggtcgggaccgagcggagagcgttgtgccgtgcctgggttttttcagaatacgccaagtcgggcacaatttca

SEQ ID NO: 24131 - DNA, 1242 bp, Heterodera glycines
ccggtaaaaaaaattttccgggaaagggaaaacgaaaaagaacggggcgggattcccgggttttcccgcgggaatcccgttcccgctggtgagtctgtatcgtttcggcgccgccgtttcggcgcgagggtcgtttcggcgccagggtcgtttcggcgccaagccaaaattaaaaaatcataaatcagttggaaattttgagcgatttaaattttcaaaaattaaaaattttagcaaaaatgtagaataacaataaactaacaaaagaaaatttaacaaaaattcatttgtttaccgtacttactcgtttagaaccccacccctctaaattagaagcccccccccccccaaaaaatatttgtttgccaaaacgagtttaaatttcctggctatttgacacttaaatgtggaccaattatgttacaaaaaaggtctaaaataaagaaaaatctggagaattttatactttttatttgaattccctattttcaataaaaatgattttgaaattcaggaccaaagggggaggacatgatttttgagtgcgaaaaattttcaccaaaatcttccaaaattttttttagaagttatttaagccgctgatcagtgatcacgaaaatataatcagaaggatcttaagattcgttaagacctaagaatccatccgtatcagttgattctgaagggatggcgctggtcaggttcggatcctttcgatataattttttgtgcattttgggtcttgtaaactttattgtgaatttttaaccattttcgtctgcttcaaaagttgcagggccttaaaaatcagaaattttttttggcgccgaaacggcgtcgccgaaacggcggcgccgaaacgacccgttcccttttttagaacctaaaacccggtgggggtcgattgggccccgccggttgggccccgccgattgggccccatggggcagtcacttttttagtcgacttttggtttactttcactaaagaaaaattattacctatgtatatttttaaataaaaaatggtttttttaatcgttaactttgttgcacattaattacaatgtattttttgtttgttggggacgaacctggacctccgaaaaatacgaatttaacccactgatccaccggtttttgttaattttccccacttcaccaccgtccctgaaaagcgaataaaatgtcaaagatttgaattttgaggtgcaataaattatctatttagcttcaaaacacc

SEQ ID NO: 24132 - DNA, 1272 bp, Heterodera glycines
  misc_feature (1222)..(1222): n is a, c, g, or t
tgaatcgctaattagcttgcactttcgattattacatataattagccctctcaatttcctttcgggcctcagaaaatggctatctctttttcggccaattttgtacgaatcaaagggaaaatggcttaattcaggccccaatgtgcgcctgaatcgctaattagcttggcactttcgaatattacatataaattagccctctcaaattttccttcgggcctcagaaaatggctatttctttttcggcttccttcgggcttcagaaaatggctatctcttcttcagttttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagcttggcactttcgaatattacatataaattagccctctcaaattttccttcgggcttcagaaaatggctatctctttttcggccaattttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagcttggcactttcgaatattacatataaattagccctctcaaattttccttccgggctcagaaaatggctatctctttttcgggcaattttgtaccgatcaagggaaatggncttaatcaggccccaatgtgcgcctgaatcgctaattagcttggcacttt

SEQ ID NO: 24133 - DNA, 994 bp, Heterodera glycines
ttttgctgatccgctttttctgctgttggcattgtgccgcccccatgctgctcggcttcacctcctcctcttcctcctggtgctgctgatgctgttattcatcatttccgctggtcaccatcgccgctgtctcatcgtcgtcctccggcgcacattcgcgcgatgacgcgttggaaaagcgcttgttcatgctgtttttttatcttgaaatttttgaaaaatgcctggattagaaaagagtttccggtattaaaaaacgaagaagcaatttttaacgaattttcaaaaattttggctcagaatttctaggggaaatcgaaactcccataatcccagggttggggggggggcagctattttgtcacacccctcaaacgcggaggggcttattctagtggagaagcattaatcaaatggttactgtacctattttggaaaaaaatagtacagtatttaggggtaaccgatttccaatataaaaaagcatttgaaaatttaaaaaaagtcatttttgtcattaaaaagccaagcctaatggggggggggggggtgaatggtgtgcaaatgcatcggttttcgggacaccatcgaaaatttcaacaaaatgccatttggaaattttaaaaaccatatttttgtcgtaagaagccaagcccaaggggggggggggaatgaatggtgtgaaaatgctttttctgtgttcataaacaccgccacacattgtaaatgaatgaacgaatggatgaatgggaatggaggatgatgggaggatgatgatgaataatgaatgaataatcattgtcgaattcacaattttctgataaaatcgagatcactcattctcgaaatcactcactcactgtcgaaagcacctgggacgattttttgtgctaatatttctagtttttttagctctataatgcaatcatctaattttatatataatatatatatatatatatatatatatatatatatatatatatatatatat

SEQ ID NO: 24134 - DNA, 1337 bp, Heterodera glycines
tcggcgttcgaattcgatgtggcgcgggttgacaagcgctcgaagcggcgataaagcggagtttgtcgacttccctcctcctcagaggaggagtaattggacggactccggctgcgcggagcacggaaaagaggctcggatggttaaatttctgttaattctaacggaaagtgatcatgatgaatacagccattcatccaagtcggaattccggtgcggagacggcgtgccatgcttcgacgggaagtcccgcgaattcctcttttctggacgatagtcggcagttcgggacgacgcagaggaattcgtcggtggtctcgccagtgatcagccaccgacacattgggctgaactcggcgtgccagtgccgggacgcggtccaaatagtgccaaacgatcggctgatgattaagagaatggcggaggaggaggggccggagaatgtcttctgcctggcgtcgtccatcagcattaatccaccaaccggttccgaggcgagagtcgagaaattggtcggcacgcagtcgatcaatgattgcatgtgggcgattgacgggagacgaatggtggacttggcggattggcggttggcgaaattgctggccccctttacgatagacaagcgatgggcgacgggggttagagacggatcgccagatggcccggcccaaaacacagagaagggtgaaagtggcgaaaacaaagacggcggcgcacagcgaagttaatgcaggtgtcgacgatccgtcgacgggttgagggggtgagatggaacttgggcatgttaattcgaacgacaatttttggggggtgactgacgggataagcagtactcccgcacaaattcgaaaaattagacgataagtggcgaaaattggcgaaaatttgacgaacaaaataagagcaattgccgcgacaatggcggcggcgagaatgacgagaaggattggcccatttccgaggagaagcaggggggaaaatttgtcgaatgcaaggttcgaccagaaaccggactgttccggatcgaggatcagcgtttccgaaattctttgtcgatgtccgaaacgaagttggcggggaatgtactgtagtgttccgttcagccaaaatcgggtttcccctgcggggcatctcactacacattcagtggcaatgttggaatggtcataaggcaaaatttgcctccccctggtaccatttggggcgcagttaacgacaaagagttggccatcagtgcaggaaacggtggccaacgactgatcgaaatcggagtggcaaaaatagtcgaattgtgcccccgtcgagcagctgaagcatccaatcagcctaggctgttc

SEQ ID NO: 24135 - DNA, 1411 bp, Heterodera glycines
aaattatgatttttttgttcaaatttagattaggaaatcggaattgatcaaaataattgaaggattcgtgatcggggacaccaaaaacccagagaataaatttttatgactatcacaaaaaaaaattttgcaaaacaaaagggtcccaccttttgtttcaaaaactgtcactttccatatagtgccaaaattcgtaactctactgatttgattgtctttcattcacaaattttccatttcagttggtcgacgcgggccaaaacaaaaaggcaatttcggaggcggacagaattttgaaaaaacatccgaaattgcacacagcaaatgcgagtggagaggggcgggggagaaatttaatgacagttatttttcatttttaaacaattttaggcactgaaagcgctttcattcatacgaattggtacgcttctttggatacaaaattaaaaaagaaacaatattggatttgtctgggaagggtgccagagggctttttgttgaacgtttaactgcaaaaaatcatcggccccaaaaaccttcaaaatatttatgctctccaattggtgcatttttgaagaacgcttcgtcgacgcggaagcactgattgacacgttggaggacatttgcaaaaatgaagacgttgacgagccatttgtgcaggcattgagccactgctataaggtgaaatcgaagcaaaattataggaaatctaatctaactcatttcattttcgaaaacagattaaatacatttatttgttcatttttgcgtgcggatcaactggtttttggggtatgactcctttcataattgttcgaattgaaccaattcattatttagtcgattcttctaacaatacgtattctttattagcctgccaaatttcaaaagattttgatgaatttctaagaaagttatgtggtcaaaaatgttcggaaagccagtttttgaagtttttttgtgcataacttttttgaaactaaataaatttttgaaattttgcatgttaaatagtgaagacttattgttaggctatcgagtgatatcaaattcattcaactcgaacaactatgaaaggagttatactccaaaaaccggtatgggaccaagtccgtcattttttgctatttcgggcttaatgaaaaaagtgaaaataatttgacccaaaaatataaatttactttggttgaattgcaggagctgaacaggccggaccgcattgtggacatgtacacggagttgacaaggcgccagcccacctacgagccgttcatgcgcgagctgttcttcgccaacacacggtgtgccaacctgaaggagcagcagcgggtggcactgcagttggccaagatttgcaccacgacggagccgtccacttattacatttgggccgtgttagtcatccttgtcc

SEQ ID NO: 24136 - DNA, 1955 bp, Heterodera glycines
  misc_feature (1909)..(1909): n is a, c, g, or t
ctctccgaccccgtcctcctccttcccccccttcgttccttttcctccgcgttttcccctccatggccccgggccttttctttcttccccccccttatgctctccccttcctttcacttggtcatcgtccactcgtcccttctccaacagttccaaaaacatccggtgatgttctctgtgcaattgcgtcaccgctcgtcggtcgcccgccaaaaatccgccgcttagcaccgccacgtcctgctaaagtgggggaaatgccgctgaccagcagcggaccaaggcttttgtgctcccacccgatagagttgcttcagcgaatagcgtgacaacaaatccctgggcggcgttaactgaagagagtgattaggcatgcctaatgagtggcggctcactttgatcacggacattttgccgcgcgggaatgttggacgccattcccacgagggcgggaaaatggcgcggtccccgtgcccgtagccggcgtccagccaaacgaagaattcggtgccaaacggattgtctgtctgaacattttatgtaatgcctagggagaatgcgccgaccgccgcttgggccagaaagtacggcttggagttgacgaccaccacatattcggcctgagtcgcctcggggtgacttcgcatggacaagtcccaatcggagggccaattggccaattcggagtccatcagaagggaaatgcgcttttggaagatggccaagggcaattgatcaagtgataattggacgacctaatcaaaattaaaaaaagaaaaattaattaattaaaataaattatttaaaaattaaataaacaatgattaaggcaaagaatattaataaaattcttcatttctataacaacaaataatttgattaattataattaaaataatgttgcttgttaataacaataataaatatttaatataattatttcatctaaaaaaataaaaataatattaattaatttactgcacatactattttatcaaattatcatttgcttaataataattatttcacttttgtccattgtccccaattaatccgtgcgcgttctctgtgcacaaactctgctgacttttcatccacaatgacaatctgtgaacaaataatgagtatgaaaatgaaattggaattgcacacttcctattttcggttcttcgttttttttttgaatttgccattaccattggcacgcgaagttggagcaggttgcgcatgaattggtggtattggcgaagtgtccgtccgtattgtctccaccggtccctgccaatgtccaaaagtgcggtgaccaccgtcaccgaatggtcgcctttctttgggaattgcgacaaaagtttggcgtgcgccggcactcgctgccgtgccaaagccattcgatcggtcgctgtgacccgaatccgtggcgacgtcgtcgtggcggacgacgccaactgcgaggagaaaaaatacttggaggaacggctgacgttcaaacgaagacgagtcgaagtcagtggaattggggacgaagcggagggaatggcactgattggagacgaagcggagggaatggcaccgattggagatgaagcggagggaatggcaccgattggagacgaagcggagaaaatggcaccgattggagatgaagcggagggaatggcaccgattggagacgaagcggagaaaatggcaccgattggagagagataggacgacggagtggaaggaatggcaaattgcctgtttactgaagccaattcgcttgtgttgtttgtacggctgtcattggcattctcttgtgccgttgttggcattagccaatgtttgcttaactgtcaccaccgatttgcccatttttgagttgccaattcccaccaatgttttgaccactttgtgaactttgtcccatcgnttttttgttgtccatttccattgtcggcacattttcgtcttaacat

SEQ ID NO: 24137 - DNA, 1498 bp, Heterodera glycines
  misc_feature (1482)..(1482): n is a, c, g, or t
aaaaagatagtcagtaaaataaagctttgtttaggaatatttgagtatatttacacaacaaatttttgagcaatttctaaagatgaaggaaaataatttttttatcaatattttatattaagttatgtttttgaattgattgaccctatcaaatgaacagtgatgcagttgtaaaatttttcggcttctcgcgcaaagtttttcctggactgtttctgacagattgttgagataatttttctagatgtttgttcatatctcaattcattatttatcgcttttaaattgaatggaaatgaattgtcagtaacaaaaaaaatattttgtgaacatttataacaaaaattttttaagcattttctaaagaggctttttgacttcaatcataattatattgtcaattgtttgaaacgcatctgttgcagttggaagaggccgatggaaaatttttcggcttttcgcgaaaaagttttcccagaaaatggcgtgggacaaataaaaattgtacttttattatgagcaatatatatttcctatcaatttcgggtttgctttacacgtttgccaatgaaaaaatggagttttgtgaatgcaaattttaacggattttctttcgacgtgtcataagctggttgtttcgggacaaatgcaaaccaatttgatgctattcgaatgagctaggcgcgctctaccctttcaaatgtatcaacaaagggtctaccgccactccctggcgagatatggccagtcaaagcagagtgggtctaataaaacaagaatttttaaaattttcggcatttggccttatttcgagcctgctctacgtgtgcttcttttgccaatatggccctgctatagaaatcttgtaatggttcacgactaagtgatgaaatatttttagcccatttcttttctatccaagcatgcgaattgtttattgcattttatagccttctggaaaaagatagtcagtaaaaataaagcttgttttaggaatatttgagtatatttacaacaacaatttttgggcaatttctaaagatgaaggaaaataatttttttatcaatattttatattaagttatgtttttgaattgattgaccctatcaaatgaacagtgatgcagttgtaaaatttttcggcttctcgcgcaaagtttttcctggactgtttctgacagattgttgagataatttttctagatgtttgttcatatctcaatacattatttatcgcttttaaattgaatggaaatgaattgtcagtaacaaaaaaaatattttgtgaacatttataacaaaaattttttgagcattttctaaagaggctttttgacttcaatcataattatattgtcaattgtttgaaacgcatctgttgccgttggaagaggccgatggaaaatttttcgcctttcgcgaaaaagttttcccagaaaatggcgtgggacaaataaaaattgtacttttattatgagcaantatatatttcctatca

SEQ ID NO: 24138 - DNA, 1393 bp, Heterodera glycines
ttaaatttttgaatttttataaaattttatttttttcgttcatcgatgacaaattattaaagaaggtaccagcctcaggaaataaaaaaacaaaaaaagtaaagaaaattttcgaattcgggttcgggattcgaaaaatggatgtttggaacatatccgaccaatttcagtcgtaaacaggcactcacgcgaaaacgtaccccacgcgaaaacggccacgcgaaaacgtaccccagccacgcgaaaacggccacgcgaaaacgtcctggccccccatagcgtgggtttcgcagaaaattaattttcagatccctctttgagattgggagttcaattcccgtggtattaatcccgcaaaaatcccgcgcgctgtctatgttttttctatggatagatagtattttattagaaaagtttttctccatataattttcaattataatgatttgtaacataaaaatactacttacaattagttagatttgaaagccattgttttctctatttgcttgcaatatttcaaaaaaaaatttcgttacttttcaataatgaaatcttgcaggttaatggagaaaagaatgtttgattatttttgtcagagagcagctgcggaatggctgacgaatttgccaagccgaaatttgacggcaaaatcttccaaaaccccgacagcttcacaacatggaaaaacccgccttcggcaggagacccgagaagttggcgggacttcattaaatggaaatgggatgcaaagagcacgaaactgcccaatttgaaagtatgtttaaaaacttcgttttttgtcactaattgtaaactgcaagaatgccgcatttcccatttaggtgcttgaccagactttgccggtgttaaagcctcggttccaaacggattctcggctttcggccacttggctcggccatgccacactttttgtgcgcattgacggcatttcagtgctcacagacccagtgagttggacacaataatagacaaagacatctttttgaggactttaagtaaaaaatatttttcattccaatggatgcgagaagggtaatgtgctccaatttgtccaaggaaaacaaaaggactaattttaataaattttctgtttcggtgtaaattccgccaaaatttccaaaggtttgggcgatgtttgccactccttcgttccttcccttcttcaaattttgcccgcgttttcgtccaccgccgtgtaaaattgaggaattgccaaaggtttgtattttgtataaaaatttgacagttttttgcgtaatcattattaaatggaactaaattgactgacctcatattgacattgatctcatctcccacaactattactaccatttggacgtggacgccattggcgatttacaatgaatgt

SEQ ID NO: 24139 - DNA, 1202 bp, Heterodera glycines
aaacttccctttttttgataaaaatccaaaaaaacaaagtttctttagctgattttatagttaattaaatgaatttatatatgtattaattaattaatgagcctgtttaaattaaataaaacctggaaatacccaaattgctttcagtaatatgcatattgaaattagataaataaataccaaaaacggataatttggaaaaattcgagttatgctaaatggcaaaaaaaaaatcaatttggaggacagacttttccctcattagtcgtcaactgcttcttttgcgtgccatttggctgttcagcaaagatttccggtcttttgggcccagggccaaacccaaaaagtgccgagccaatgaatgagtgagtgatgagcaaaagtggtggtgagtgcctaacaaatgtttggccaaatgatgagaaaaggcaagtgaacttttattgtaccaccgtcttagcaatggcacttggggagaaaaataataatatttttttttattaaaaattgtaaaaaataatttattttaatgttttttaatgtaaaagaaattatttaaaataaattatattaattttgaaaaacattttttattttacaaaatatcaaaaaataaaaagtactaaattatttttcaaaggtaaaaaataagaaaaaataaattttagataataaattgaaaataaaaatttatttaagcaaaaataaaaaataaaactaaataataattattactaatgaattttatttttgaatttttcttgcccaaacttccataaaatggcactaaaaatgccatggaattgctgaaatgttcttcctttttttcctccgtgctttgtgaatacattaggccataagaaaagcccatctgtggtgggacatatggtcacggattcagaaaaagaagcggatgaaacatgagacaggaggaagaaaaaattttttgttgtgtcgtttttatgtgcttttgtctactcatttactcatgtgaagatgaatgattatggcgtaacgttaattttttttcaaaattttttgaggccaggttttaaatttcttaaatttcttttttcatgagattttcgcataaaaaatagctttttaaattgaatttaaattgtttttggttacataaaaatagggttcggaccccgcccccgtccccgggggcgggacaggtttttggggctcacccccgt

SEQ ID NO: 24140 - DNA, 2236 bp, Heterodera glycines
gcaggtctatggcttaaaaaaaaaataataatttcgggtgtcaatttcattgagagccgcttcttgtaagtacagtagtccgagacagcctgaccatggacaatcgatcaaattttatttattcattggttggatttatgaattgacgaccaatgttcagagcagagaagcaattagttgaaagtaattataggattaggggttggaaaaaccgacggattaaaagattggatcccttaaaaaattcaacaaaaaaaatcccaaaaaaggttacaatatactggagcagtacaagagacaaaaattttccgtgcaagtcgacgaaattttttgaaattttttgcaggctaacagagaacagttagagctttcgattggtacaaataacataaaattctgttacttttaagaacagtttgaacaaatttttgttgaaaaattgtacatggatttttacgaaacgatcgaaacggttggaatttgcgaagattattggtcccgcccgaaaattttttttttaatcttttctgaaaattcttataaacatatttctatggctgttttgaggcgctgagtacgaatccgcccacctttttggcgaatttcgaacccgaactcgaacatttttcgaaaaactcaaaatttcacatttttattctatgtgaaattgccggtagcctcgggtatcgaggacccaaataatgccacaggcttttctcgactcgaaacccaatgcctcgggggactctctcgtccggccattccactgaccattcccattgccccccccccccaccgcggctttgtccaacatgaaaaattgcaatgtgccattgtatgtgtaaaaaaaagcgtaagttcgcggggatggcactcatttttggcggagaatgggcgaccacaacaatttgaggcgccacaacaattccccgtgggaatctctgttatgtgtgacgacgcgctttttttacagcaaaatttgctggtggttgtgagtcataaaaatggccccccccccctcctccgtgccctggggcggggagagagtgccgttggcaccgcccctttcactcgccaaccccgccccctgagtgggaggaggcgggggtggatggttcggacgctggcgtccaaaaaataaagtttgggtcgtaaaccgaataaaatgcgggtcggtcggtattcgagtcgaaaccatataaaacgaaaaaaaaattttatttttttttgaggttaagttatttcaaggttttcgggttcagtgcattcgatttctggtctctgccatttttcgtgtgtgtgttttttagctcgaaatttcgaagtggtaaaatgaattttctgctttttgttcgagtccgggctttgcaacaggccaaaatgggttttagaatctagttctccaaccccgaaaacccctaaaacattagttacatgtggcggactcgaacttccgcccttttcccttcacttttttacaaaaacacttcgccatacttgtaaatctttcacacctttaaacttgtgagcaggggacgaaaatttcatttacgaaacattttctttttatatgttccatggtaaaacacccgaattgtgagcgttcagattcgaatcattttaaaatgtttgagtgtttttgactaatttttcaaacggatgtttgtcgaatatctcaaaaaaaaaaaaatgggaatgttcaacaaataatattcatttttcgcatttaacaaaatcaacaacagtggccgatcggtggatggtcaggtcacacatcaaaaagatacggacgcaaaaatcgtaaccgatcagaacagacgcaccgcggggcccatcgtcgatttgatgttcaacgagcgcacattttgccaattcttcttcagcaacgagacgaggaagttgacgcccagcgaaatgttcgagaccagttcgtcctgcgacatctcaacatgaccaattgcaaccgccagacagagcacctgaaatagtggacaaaatgcattattttttaagagtttcatttattggaccatcctaattaatgttgactcataatcacggatggactgaaaactattggtcaaagttttcattcaaaagttaaaaattagaggccgaaatcctcaaaaatgccggaccggctgaaaaagcaaccggtttccgggcctgcccagcctctccaaaaccagtcgaaccaaggtttttgcataagatcaatcaccggactgtttgccag

SEQ ID NO: 24141 - DNA, 517 bp, Heterodera glycines
cgcttcgcggcgtcaggacgggcgcttcgcgtccgttttttaattttttggggggaattcggacacttcgcggcatcaggacggtcgcttcgcgcccgttttttaattttttgggtacattcggccgcttcgcggcctcaagacgggcgcttcgcgcccgttttttaattttttgggggaattcggccgcttcgcggcctcaggacgggcgcttcgcgcccgttttttaattttttggggggaattcggccgcttcgcggcctcaggacgggcgcttcgcgcccgttttttaattttttggggtacattcggccgcttcgcggcctcaagacgggcgcttcgcgcccgttttttaattttgtggggccaaacgggcgcttcgcgcccgttttttaattttttgggtacattcggccgcttcgcggcctcaagacgggcgcttcgcgcccgttttttaattttttggggggaattcgcccgcttcgcggcctcaggacggacgcttcgcgtccgtttt

SEQ ID NO: 24142 - DNA, 1364 bp, Heterodera glycines
  misc_feature (8)..(9): n is a, c, g, or t
  misc_feature (26)..(26): n is a, c, g, or t
gcctgcannggtctttattgttaacncgagcaaagcacaaagaactctctctctctctaagtaatgaaggagaagcagcacagcaccaactcaattagcttggaagggatacagcccccgggcaacgaccttttttttgttttgttttgcttaacccttcatttttgcggcgcggttcttttaacagtttttttagcgaagcgtacaagcgccgccgggaaaaaatttgttaaattttgaccattttaaaccgattttcatcataaaattgctacttttatgggattttttttttaatttagcgaaattttttggaaaatttgggtgaagaaggccttggatcgtaaattagatcaagctattttcccttaaattttctattgtggatgggtcttgcgggtggggggatacgtaattcgcgtaccccctccccccgggaccgtccctgattattagccgagcaaagcacaaagaactctctctctctaatgaaggagaagcagcaaagagcaaagtgctaaatgctttactgctgctgtagctgaaaaatttatctccatctccaccaccaatggtcacacacacacacacacacaaatgcttcatctcatcattatatgtgggtgaagcatttgcagcagttgcgataaaggcctcacctccccccccccctctcggatcccaagcttgtaagtgtctcctgctgtgggtgacttcattattgttttttgaaactaatttcttttgttgtccaaatgatataagttttctagctaaagatcggacttttgaaaaaagtagttcgggattattgattgacatcaggccgggataggattactagggcgggattgtgaccccgggaaaatcccggcgggatctatatcccgtccgagtctctatcgctatatacgaccccggatggtttctaccaattagaaaagatgtaaataacttgccttagaatgcatttttcgtgaattttttagtcaatgccaaaacgcgggaggcctaaaatattacagtcccacatattgttgatctgataatggatgttgtatgtgtatatgaacatattaattttatttgtttttttaaaattaaaatagatatgtatgtttatttgatcagtgggatttatttatcccaggcaaaagaatcaaaaaccattaaaagcaaaaaatgtgtgcataatatgaataccttaaatctctcctctataattaggtggataagtgaaaacccttctaaaatgggcaaaaaaaactacgtaaaaatttgaaaaaaaaaacttctaaaatagacaaaaaattgaaagattaatttttttcactgtttaattttacaaaattcgatttaaaatt

SEQ ID NO: 24143 - DNA, 2432 bp, Heterodera glycines
  misc_feature (23)..(23): n is a, c, g, or t
  misc_feature (1812)..(1813): n is a, c, g, or t
gatgagtaagttcactcattctnttttgaaattaaatagtaattttggccttctcatccttgactcttgtgccgaagactatgtccaattttgaacttttaagtctctcttctccccgacatcaattttgacgaaggcacggcaagtgtgacccattttgtgcgaaatttgctgaacacattgaagacgagttcggacgatattgcgcggttggcttccaaagcaattctttacctgattctcgttagtttaaattgttagattgtgttttttctgtaactattttaaattttttcatcagacctccaaatcatatgctgtcgaattggtcgaaattgctttcaaccattgctttgaatggctggaggaacagcaaagcactgaccaacgacgattagcatccgtcattttggccaaagatttggcacttttcactccttcccacttcttccagcgggccactgcctttttcaacgacattttcagagtgttgcgtgacccgaaactgaacgttcgactcgcagcagccgaagctttccatgccgcgttggccgtcacttctcagcgcgaaacaaagcataaaaaggaatggtcggccctttcacttgtttttaatttatttttgccatattttccgcatctatcccctcaaaatggtattcaggtacaaaaagtccttccacgaagcctgtcggtcggacttcgcctccctcggcctcccattggacgactgtgtgcacagttcattgctgattttcaacgaattgcttcgcatcgccgattacgaatatgagcaaattcggattcaccattcggtggacgggccaattgtgcagttgggcagtcgcgcggattcaatcattggccaaaacccaatcggatggcttatcgtgaaaatccggcctgccaccgtggagtcgagcacttcgcgcactttgatcatcgattgttttttctcagaggcaaatttgtttggtcccttgcccttttaattattagcaaaaatgattgcacacttatccataaacatgtcattttcccttaggttgtcaagcgttgtatggatgcattgcccagcaaatccgcccattgccaggcaattctgctcgaaattctgccccgattggccaacttcaccgactcctccaattcgcacccattccaaaatgtgcaggaggcggctgatcattttatcgccatcaacaacaaattcccccaagcgcttctgacccttggccttttgtcattaaaccgtccgcttgaaatgcgcactcgaattccacggatttttcaaattcttattcaacacatgcaaaccgcggtcaacaagttagttcattctgttttaatagagtttcaatttttgatgattttcgtcaccttttgaaaactaaaaaatttggtcctttgctctgaagttgacgccgtaagaaattttaaaatatacttcgaataggtcgagaaatcagtctttttttaaatttaaaatcgaagtatacataaatcttaaattcggtaacattgttttgtaaagagcaagctcaaataattaaagcataaaattttaaacggttggaaatttgcctaattttcagaaaaaagcaaatgccaatgctcgactttcattgtttgtcgctgcttattcagtctcaaaagagccatttgtgcgaaagagttcgcgagtcgctgccacttatgttttccacgggtatttcagagggacttatccaagtaaaaaatgggtgaaaatatccaaaaatttaattattttttaggctctccatgtcacaattgaacacattccggagctannagccgatgtttttgacgggttaatggatcatttgtaccaattacttatggtaggtactgacttgcattgaaagaaattccacattttggtttatattatttaaggatcgtcctcgtcccagcaaattggctcctccaacgcctccacccattccaattggtcccattcagccgaaaaacatcccacaaacccaattggctctcaaaacactcggcgaattcaacttttcccggcactctcttcagatgtttttgcgttatgttgctctcgtaaatcattttaaaaattattcaattaaaaccaaattttaagggctatttgacaagtgattccacgaaaattcggctcacttccgtgtttagttgtggcgaaatgttgaaaccattcgtggacatttacgagcatgtacaaacggagcaaaaggcggaactgtactcattgatccgtaatgtgttggaatgtcttgtcaagacggcaattgttgacacaggtcccgtcattggatagccaaatggaggctttctcattcgagcaatcataagaattgagagggtcactaattcaatttattattaattaaagtgaagttttatcatttgcacttttttaatttaaaacc

SEQ ID NO: 24144 - DNA, 983 bp, Heterodera glycines
cgaaaaaaggtattacccaacttggataacaaagacttaagaatatttaaattggaaactattgcactttcgattggattggattataaaacgtttttctcccgtaatttcagtgcacatcactcgggaatatatccgtggagagtgttcctacgaatttactcgtaaacagctgccaatgtctaatgttgcgctcggtgcatctgtttgattgtgaagaaaagcgaacttgtgcattgtgatgaaagaattctaacttatgcatcacaaagaacccaaacatgtaataaagcagggatttctctttaacttttattatgcgccgttatgagcgcttttcataaaatgcacggtgatttaagtatgggttttctgtttataccaatactaacactttttaaaagttttttgtcgcatacttttttggagtaaaaatataatttttgcaaagtaaaaaattctcatcgactacaacttaaatgattaaggaaacgcgttactgttgatttggcgcgtttctttgtatgtatttcatttcattttagaattgatttttcgaagcgaatttcttttctgtttctctcatttccgtcaagggccaggggtttcctctctcaacactgctttttttctcttctgctgcgcctttttccctttttatgctggcgtcggcgacgcatcgttttcggcgaattaatgaagacgaatggttttcggaaatggatgtcgactgctaattgacaactgcgctggcgagcgcgtgttgctaaatgttaaatgcatgcgattgggtggagcggtcgccttttttgtcacacctttattttcctttcccttttcgttcgtcctttttgagtgcatgtgcacgtattccgataatttgttaatgaattcctttccatgttaatccttgttcgttcatcagaaaatccttaatcgtggggtgggggatgaatgaggaatgttcaatttttgaagactaa

SEQ ID NO: 24145 - DNA, 1095 bp, Heterodera glycines
ttaattttgccttggatttttgctccccataattgttgagtccccaaacggcccttgaaaaaatttattttttttttttggggccagtcccccggacccatggccccagattttggggaggccgaatcctttgggagtactttcctaataccctgtactttaattctgcgttggatttttgctcccccataattgtttgagtaccccaacggaccacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgattttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataagacctgtttgagtaccccaaacggacacttgaaaaaatcgatttttttttgttttggggggagcccccctgaacagatgcccccaaatttatggggagaccgaatccttcgggaaaaacttccctataacctgcactttaatctgggggggatttttgctccccataattgtttgagcaccccaaaaggacacttgaaaaaaccaatttttttttgtttttggggcaccccccccaaacc

SEQ ID NO: 24146 - DNA, 1305 bp, Heterodera glycines
caatggaagacgacgttccagcagtgcgcacagtgccacggcgtccttaaaaacgaatggtgaatgatcaaatagaaatttggtacatcaaacatacgcttagaagcagatgccgtgccggttgtttgagatccatgtccacgatgttggtgtttcggatgtgtcgaagtgccagcaatggaagacgacgttccagcagtgcgcacagtgccacggcgtccttaaaaacgaatggtgaatgatcaaatagaaatttggtacatcaaacatacgcttagaagcagatgccgtgccggttatttgagatccatgtccacgatgttggtgtttcggatgtgtcgaagtgccagcaatggaagacgacgttccagcagtgcgcaaagtgccacggcgtccttaaaaacgaatggtgaatgatcaaatagaaatttggtacatcaaacatacgcttagaagcagatgccgtgccggttgtttgagatccatgtccacgatgttggtgtttcggatgtgtcgaagtgccagcaatggaagacgacgttccagcagtgcgcacagtgccacggcgtccttaaaaacgaatggtgaatgatcaaatagaaatttggtgcatcaaacatacgcttagaagcagatgccgtgccggttgtttgagatccatgtccacgagttggtgtttcggatgtgtcgaagtgccagcaatggaagacgacgttccagcagtgcgcacagtgccacggcgtccttaaaaacgaatggtgaatgatcaaatagaaatttggtacatcaaacatacgcttagaagcagatgccgtgccggttgtttgagatccatgtccacgatgttggtgtttcggatgtgtcgaagtgccagcaatggaagacgacgttccagcagtgcgcacagtgccacggcgtccttaaaaacgaatggtgaatgatcaaatagaaatttggtacatcaaacatacgcttagaagcagatgccgtgccggttatttgagatccatgtccacgatgttggtgtttcggatgtgtcgaagtgccagcaatcgaagacgacgttccagcagtgtgcaaagtgccacggcgtccttaaaaacgaatggtgaatgatcaaatagaaatttggtacatcaaacatacgcttagaagcagatgccgtgccggttgtttgagatccatgtccacgatgttggtttttcggatgtgtcgaagtgccagcaatggaagacgacgttccagcagtgcgcacagtgccacggcgtccttaaaaacgaatggtgaatgatcaaatagaaattt

SEQ ID NO: 24147 - DNA, 2133 bp, Heterodera glycines
ttttgcccacggtcagttgtacacggcgctttcaaggtgtacaagtcgtgataatataaaaatttttgctcccaacaagccaaaagacgataatggaaaccctttgattagaaatgttattgcccctggtcttaatttggattaaaccttttaatttaatatcaatacatttaaaaaattttctcatcaatgtgcgaagatccccggtaatgcgggaggtgccgccacccttaaagtgcgaggagccccggtaacgcgggaggtaccgccacccttaaagtgcgaggagccccggtaatgcgggaggtaccgccacccttaaagtgcgaggagccccggtaatgcgggaggtaccgccacccttaaagtgcgaggagccccggtaatgcgggaggtaccgccacccttaaagtgcgaggagccccggtaacgcgggaggtaccgccacccttaaagtgcgaggagccccggtaatgcgggaggtgccgccacccttaaaatgcgaggagccccggtaacgcgggaggtaccgccacccttaaagtgcgaggagccccggtaacgcgggaggtaccgccacccttaaagtgcgaggagccccggtaatgcgggaggtgccgccacccttaaaatgcgaggagccctggtaacgcgggaagtgccgccaaatcttcagagcttagctcctcgccgggggcactaaaaattaaaaataaattaacaaattacagtaaaaaataacacacccccggcgagtggggtccatggtttttgccagtttcccaccgtgctcctccgcgtggtggaccctgggggttggacagtttacatttacaaaaaaaaattgtccaaccgctaatgacggttaataaactggcctcatgtccgcgcaagaactagcaacgaagtcctttgcgcgaagcgcttatgtcaataccgattatattggggttccagaagtattttttctactttaaagccaactggtcaccctagttatatactactaaagaaacaaggagtttcgtttccaaaaacaaaatctccttacggtttgccgggagggattcgaaatttcgaccttgggggtaacttttgacggcgcattcaggaaaactatagattttccgatccgagggccaactgagcgccaggcgccgaaaagtcacttttttcgaagcagtttttgcagtttttgggattcaaaaattttttaaaggcttaaatgaaaaatcggcctcgataggattttaagttggacttttttggattttttttgtttcttgaccgaaccccaaggtcttgtcagtttttccgaaaaactggctaaaaattgcatacttttttgggccatttcagcgccggctgaataactcgccggggtttgaccggaggaggtcggtgtaagcggcttttttgtacagcttgacgagctctatccaaccatgcttttagatttcagaaattttcagaaattttcgagctaggccccctcaaaaattttccgtttttgaattttataattttttacagatttttccggggaaaacggagaccactttcaagcaaccgtttttcatgctctatcgattggtgtcattttcagaaaaatttttaaaattttttttggaaatagaaaatttttggttgctaggcctcaatttcagttctggcgcaataactcgtcaggagttgattttatcaaaaaatcgtctacgagcttttttgtagagaattttaagcccaatctaatgtgctttatctcatgtttttatcttgaatttaaaaaaagttataaaattaattgtgattttgaaactcaaaaccaaaggggggaccccatggttttgcatttcatgaaaaatttttttgctcctaaattagccaaaatgcatttttatggcctaatttatggtgctgaagacgaatatatactttatttttggtttcagactttttggaaggtggttacaaatttttgaaaaatcgtctaaatttgagccccggaaaatccagtcaaatttcgaaaattcataactctcttcgtttttgatcaaatttagtggaatgtagtttgaaaaatagcaaaaaatgaggagaattttatgagattcatttggaatttctatcttc

SEQ ID NO: 24148 - DNA, 1429 bp, Heterodera glycines
tagagcaatcgaacgctaacggacgacctaatgtcattaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatcttaaaagtttaataattttcctgcaccgaaggtactcactcgg

SEQ ID NO: 24149 - DNA, 1665 bp, Heterodera glycines
caaattggtgcctttgtcaaaaatctgctgattggagcggagaaaagcgatgacggaatggtcaatgtaactgaaaatggaatgtttttgtttccatgtaaaactttgcatcattaattactcaatctgaaggtgtttgaagcgaattttgtgtggcagcggaaggtcgagccaaggaaattgtacagaattggcataatcgatgagcacagataattctgacgctgctgtgccattgttcttgcgaaatccaatccatctccaaattgtgaattcgttctttccatcgaaatgtttgtccacaagcgcattgaaacgcggtgaaagcagcgccaatttgaggccgagttgaagacgaccaaaaaatgggaagagatccatcaaaacatcgttacacacccagctgaaatttcgataaaaataacagggaaatggatttaatttttgaaatgcttaccgtcggttcatttttgagacaattaacacaatttgacggtttttcgaatgattaaagagaagaataggtaattatgttagaaatttttttacaatgagaggaaactcgaaaagacaaacatttttattgtcacaaaaatgggactctgctaatttataagcattttgctgcttttcaagagatcagagttcccaagtttttttttcaaaataagacaaaatggcctaaaaactaagattctgaccccaaaaataagatttttctaaaactaatatttgcgtgaaggaaacgcaataaaaacatgaaaaattgacttaaaacaatattttattagcgtaaaaacgaaggcctgtcaactgaaaatttcgtaaatcagcattttgaaaaattttattcaaaatttaaaaattaataatgtttttgcggcgtgctttttccaaaaaagttttgggaattggggggccggcagtgccgataggcgccgccgggaaaatttttgaaattttgtatgtgatttgttaacagattttgaataataaaacaccaaattattaaatttttaactaattttttacaaaaatattggaattatgatgtccaaatcgcttattatattatgccaagcactgtctgtaaataataaagcaaaaaaaaaaaaaattatttttaaaggctttttaatctcatgcaaattcaatttttaaaaatttaatccgcttaaattgaatgaacaaaaaatgaatttgacccccgtttttgccattattctccttccccgccccacgcttatcaaagtaagtcgtgcccattatttaagttttctctcttttctttttttttcctcactttctctgcttttactcctccatatgaaagtttccccatttatttatggacttccaaaagggtaatgagcttagtttaagcgatttgcgctgtttgttgggtgagtgaggagtgttttgtgcattaattgttgtcgctttggccaaccttttctcttttccctttccctccgtcccaaatcccccggggggagcaaaaaccgaatctccgccagcggcgagggatttgacatgcgcagcatcagcagaagcagaagtcagcaaagtcagcatttggcctgccccgcctccgtcaccgccatactttcgctctttttggtcgcgcatgtgtcctactttggccgggggttggggggcgacatg

SEQ ID NO: 24150 - DNA, 1428 bp, Heterodera glycines
tatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccacaatgtgatgccagaaggaacggagtgtgggagaaagtgggataaaggacctgagagaacctctaaaagaggcgcccgtagctcagttggttagagcacggcacggattgctggggtcgtgggttcgagtcccaccgggcgagttaccttttatgttctacatggcgctcctgggtggatcccctccacactgccgggaccactggaccaaggagagtccaagtccgtcggtgaagggccaaggagagcccgagggaccggtcttccgagggaggcggaatgtgatgccagaaggaacggagtgtgggagaaagtgggataaaggacctgagagaacctctaaaagaggcgcccgtagctcagttggttagagcacggcacggattgctggggtcgtgggttcgagtcccaccgggcgagttaccttttatgttctacatgaattaaaagatatataggtatttattttgcaaaataaatcgcctcgtcaaaaaattcttccaatggtgacaattcctgaaatttgaaaaaaatctaattatgtcgttcacttaataattattcttttttttaattgcgcttttaaatttattgcttaattaatttttggattttcttttttcgacaattcactgattttaataattttctaattaataaattaattcgaaaaaactacttttttaaacttattaggagacgcaataatcattgataataaacaggaataaattaagaaaaagccgaatttaatacaaaaaagtaatagcattattttaggcaacaactaaaaaataatttctttattaaaagctaaaatgaataaaacaattttattattgaagaagcaaataacgacgaaaaaataaagcaatatttattattgaatataaatatataatattgatgaaaagcataatttttcgaggaagaaatgacttattttttaaaatgattttcatgtgataaaattgtaaaatattttttcaaaagtgaatatttttttaaaacaaaca

SEQ ID NO: 24151 - DNA, 1518 bp, Heterodera glycines
tcaatgcacagacaatatatttgcggatcttttggactatgttaaacgtcatgtctatgcacgagcataaacaaagggaaattgttcactcgttggggaagtgacctatgaatgcattgggtgttgacaagcggaacacaggacgagcagagaagcccggtgctgcgggctcgggtcgaccgattggcacatagatcaaatgctgggatttagttcgtcacgttcggcttgtttgggatggtgctgttgtacatatcgccgtggtttcgccatgtcagttacatttgctttttgcggtgccatttatggtgcggttgttgtccatgaaattgtcacttaaaatgtttgttgtttcgttttcctcttccctcgactagcaatttgttgtccaatttagactaatctaggatgagtttgatgttggggtcatttccgagatcgtaaaatggggatgatttgacatataggtaaaacaggttttttcgaaaaagtcgatgtaatgaaggatgttctgaaatgtcccaacatgacggatcttacgaaacgacctagcaccatttattattaacattttggaatttaattaatcatatatttcccgataacttccgagtcaaacttttttatttcttgcaaaagctgtaacaattatataattaacattaaataattatactttaaaatcgtctatagtattatcagtttttattaataaatccattttcaattaaaaaattttggactttatatataattatttcattcgatttttttattacgtaaatatgaaaaactatggtattatagttttgtaaattatgttatttgttcgtgtattttaaattatcaaattgagtgaattttatacttcaaaattttttcttagattttcaatttatatcaatgataatttggtaaaattattcaaattataaaaattaaatattaaatgagttttgcataattagggtagatttttatcttttttagtagataattaatttatttaagactattaccagcaattgtttaaattaattttgtatgtgtttacgctagcaatctccaaatcattcgagatatattgcgtaacattgttttgcaaaaaatttccttcaacccttgccatggtaagaattatttaaataaaagtagtaaagaataagaatgtttattacattaattgttttacatgtgttgtatttagtatttgattagagttttcatttattgtattcttataagagttattttaagtataattttaattattgttggagcttaaattttttttttattaattttcactacaatttcaaaatacgcatgtaaagagcaaaaaaaaaagttaatctatcgtaactccaatgaaaaagttgctcagatatgctctgatagtgaattttatcgtttaatttgtaatgatattatgttaatttaatttttttttctattaagtatgaaaagcattcaattccgttaagagattttttttaattgcatgttttaaaaaacatg

SEQ ID NO: 24152 - DNA, 1660 bp, Heterodera glycines
agatgtgtaatcatcagtttcttctccgtaacttgtaatgccgccggcggacgttcgtattctggaagtagcagcattcatcgctttccgtctgacctttttagggcccttaatttttttgtcatcatcttgactgtccactgcgtcgagtttgttgaccgtgggtttttgtatgcccatatacggggcaatgtttgctggcgctgtgcccgttgcattttccactatcaccttttgtggcttgttctcaatcatatccttcaactgatgcctttgtttgtacaaccatgaatgtcgcttgattttgacatctgcacccgctttgctgtcgctaaggttgctttgtatttgggcatcgagagcagctttctcattcagaagtgagtcagatctgccggcgcctcctttcaacatgttaataagcgtcagatattcactctccggtacaaggaccatttttttagtgtgcttcatgttgtttttgttgttgacgccggtgcggctgtaacaattttttggatcaactgctcagccaaaacgctaattattggtgccaaaatagctcctaaagcaattccgctgccttgttgtagccgctgtctggctgtgggctcactgcgtgaacgtgcgattgctcggtagtagtctgcgtacacggccaaccgcctcctctgacgcctgtttagtcggaaattaaacttcagaatattagcacaaatttccaccaagcctagtatttgttctgctgaagcaccgcgaagcaaatcgtttttctttttgtccgatttggtggaagctaattttttaagaaaatccgagttatcgcgaatgtatggactgaattcgtacattttgcatgggtaaaatttctgctttccttaaatagttttttattgcttaccaacacgcacatgcacgcgcatattactgttctataggcaaatacacctcacggttctctccaggaaatattttgctgggcagccgctcattttcaggagcatttgggtgcatatttatcaccaaataactgaacggctgactggtcgcttcattgtaagcctccataaattaatttaatcgttttggaaaaagttgtgagccgaccgttctgacttgaagttggcccgacgggtttcttgtcagtaccagctaatgactgttcgcccttgcggtcttaatattacgtccgtgcaggctttgggtgacaaaaataacgctgacattccaattgtgggaaccgcgtgtgaacagcaaatccaaaaaatcattccctacattaagcatcaaatcatcaagcacaagcaatggtttcggctgattctggatcagtgcttgatccggaacgccattatgtgtctcgattccgcgcttcatcagctcaatgactgattggttcatctcagagtagcaatacaatactttagcaggcggagtatcgataagttcagcgtagctctcagtaatttcattagccattgggttttaccgctcccagtggcccctgacagaattagagtgaatgggcaataaacatttttattttttgcaatttgtaatttgtctttgtcatttatatacattttcagttcagatgggcggtgattaatcattttttcctgttaaatactttaagattaatgaataaatgaaagctgtc

SEQ ID NO: 24153 - DNA, 1017 bp, Heterodera glycines
ctttgggcttgctcacctctttctccgccgttgccaatgattccatcgcctttgggttcaccgttctcagcaagtctttgctgcgcgtcttgcgctcgtcgtactcgcgcttgcccatttcgaagctgtaattgcgaaaatcgtacgccgtgccctccacggcgaagtgtttccgttcctcggctatccaattgtgcgccttctccaactgttgggctcttttctcgaaatccttcgcatttttcagtgcttcctccctgtcccgtgtttttgactcgattttggcttccaaatggcgaacgcgcttcttcaagtcctcaatttcggcagttttcacacggatttgcttctcctgcgagcgcacttcgttgttgtacgtctctaacttttgttgcgcttttttgaccttttcctgcaaataaaaacgaagcattgaatttttaaataaaacccactttggcttccatgacgaatgcgttagatttggctatttcagtgctgatttcctcaatcctctcattcatctgcactatttcttcctcgtcctgcccaattgagttttccaatgcattaatttcttctctaaatgattttaaaaataggttttatttcccttcttgccaaccttagccctgccaatgactctttgatgcccgaaaatgtgcccttcaactgttccaactctttctgcgcatttgccaattcttgttgggccgtcttccgttctctctcttggaatgctctttcattggtcttccgttcttcaaactctttgactcttttcgtcagtttttcaatttccggcttcgctgtttcaatcgttgcattcgcttcgccaacttccgtttccaattgcgcaatttctgcccgaatcacttccgccggactgtgcgcaactgttcattgattgcgtcaagtcgcttccgctgagcagtgagttggccattgagttggtcgtattgttggacgaggggactcagtcttgcgagttcccctgaaaattccttcaaaatactg

SEQ ID NO: 24154 - DNA, 968 bp, Heterodera glycines
ggaggggcctcagtcttgcgagttcccctgaaaattccttccaaaatactgacaacatcgggaaagcaatcactttcaattgcgccaattcggtggtcaagctctcggatccgttcatattgtccactgatttcgttgagcgcagtcaaaattgacgcgtccggcttccggaatccgccagtcagcacaccggtcggcttgaaatcctcaccggacaatgtcactgtacgacagtttatggcccggtcgaatgtcagctgcttggcctggtccatgtccccgcaaatcttgacaaacactcaattcaagaaacacgcaacgagcaagtggagagttttcaccaggcaattgccaaaaacgctgagaatggccagctcaatttcccgttcgtattcgatcagctctccggggaagaacacgttctcctcgcccaccattcgttttgcctgcccaattagccgctggtcgagaacatttgcactgattttgtccagcggaagcattgtcacccgacggggcagccccgccttaagcaaatcctcgccggtcttcactttgtcgatcacaacgtgaaacagctcaaaaaagagagaaggatacaatcaaaataatttttatcgtttttttggcaaaattaatttcaaaagactcacccgaccacccgcaacgacttccaatgccgtggcatatctttgttcgttcattttaaacagtttagcaacgacgcccttcactttgttccggtcgaatccgttgtaaggcattgtatagtcaaagcgcagtttgaaatttcttgagaaaaatttggaattgtagagtaagcacggtcatggaatgaatacctggcctcaaaccggtccaattcttgcgcacattgccctctttctctggccaattgaacacgctcctgctcaagctggtggtccaagtgcggatcaaagttaagggcgcgtaacttttgctgaaaa

SEQ ID NO: 24155 - DNA, 973 bp, Heterodera glycines
acaggactcgggctcgggctcgctcaagggatggatgttttcagtcatacgtgctcttccacctcgctttcttctcgctgttcgtcgtaaccgtcgacgtcttcttcgtcgtcgtcgtcgtcatcctcatcatcttcgccgcttgtgcgatggccgagcgcctgggtgagctcagcgtccgacataatgctggagcaggagcttgtcatggctgggaagaaggcgcgctgcacgtcggggaactcctcgacggtctccagactgccctcgctgtgtcttcgtcccttgtccacagaggacggcgagtcgagttcgcgagtcgagccagaccgtggcaggtccgccatcgttggcgagtttgtggaatgtgagctcaccggcggtgaagaggtggtagcggggccatggctcgccgcttcgtgcggattgagccgcgcccagcgagcgtacagcttgagcacgagttcaaccagttctgccttttcaatgcacgtgacgtcgctgaagcctgcgcggtcgatgcacgccttgagctccttgatggtcatcttgtgcaccgtctcgatcgacacccccggctccagcgggttgtgcagaacgacgggcgtccgttgtggcttttcgggtgacgacatcgggctatcgagttgcagcggcaacatcccaatcattacgcgcacaaactgcaaagcctgaacgaagaaattggccggtcgcgggctgttgtgaccaccctggaactggtagagctggttggggccattgtgtgctttggccagggcacgaacgtgatgtggaccaaccagctcgtcgttcagtccagcgacaaagaacgctgagatggcgcacttgttgactctggcaatcggtttgagcttgaacatgtcgaacttggcgcgcttcttaatatcgcgccgaatcaggcgcatcaccagggttgaccgcgatcttggggacgcccagtttaccgtca

SEQ ID NO: 24156 - DNA, 926 bp, Heterodera glycines
atattttcctgttcgtgtaaccaagcgacacgtacttgccctggaccaggaatgcgcgagatcgtcaatcacgagccaacagctccaccagtgaccacaccacacgcacctccgacagccctgagcctgaaaagtcgagggcaaacgcactgaatcctgctggaatcgcgtagctgacgatctcgagacctcccaagcgacacgaactgttgccgtgcaagatgacaatgcacggcgtcttctcgctccgatccgtcttcggtcgccaccaactgcattcgagcgtgtagccgccggggttcttcagcttcatgtctgtgcgctgcatcaccacatctcgcaacattgcacgctttggaccaaggtcagcaggtgtgtacgtggcacgaagcggtcgaatgaccgtcatgaccagcccttcgtagccctctttgatcatcgaccacatgccccgtcgatcgccttccgacactgcacagcaggcaccgtaccatcagtattgcgccataaagtacactagcgacaaccacaatgaccatggaaatgcacgcgcaagcacacataaacacagagaaagcgagtgcatcaccagcgcttctcccccaaaataaagcagccaacgctgcttcaacctcacacacagagactgcagcgccacattcgcattccatcaccaggcttcacacacacaaacacacgctctctctctttgtccacgtacttgagtcgtccatcttgccttcggggtgcctgccttggtggcccaatgcacacgtgcctgctttactgtgaccggcagctgctgctgctgtcgacgttgcttcctttgacccaggtgctggaatgattcaaagcacttctcaagttccaaatacgggtcccgcgcttgggtacgctggtcccgaaacaagggacacatgagggca

SEQ ID NO: 24157 - DNA, 1540 bp, Heterodera glycines
cattttggcatattggattttgcaatctctaattgcccaattaaaattaccaatttataatttgactttttccaccgtaaatttaaaaaaaattcgtttcaagtttttttaaactaaaatgagcattcgcaccattgagctgtgcgtgtccattttggaggaccattttggcttttatgtgtcagcggttggtgccgttctgttgcgccagcagttgccctttgtactgcttgcgaaggagttgcatggacgggttcgacccggcgaggtgcataaatgaattctttcaatttggcacgattttgtaaatccgttgacaataaattcactcgggttaggccttcaacttaatttaaaaaattttttttgtcagactcaaaatatagggggttggctgggttatcttgtggtaaatttaaaataaaaaattttcacaccgcaaaatttataattcagatgaagcgttccatcgccatcctggaccaacacaatctgctcaggtgcggattcaccatggattctgacaaattagctcattttaatgggaaaaaatcgttccccccgacgaaaaatttattttttttcaaattttgtaacttaaaaaaaagcctcgaaatttccaaaccctcgctcgtcactttagagcagtacattgcaatttgatgatggttttccatttgatcatcgcctctcattttcagttttgagtcgcccgcgcgtgccggtgccgtcgtcctctacacagtgttggccccgcgtgtgctgaatttggtccgtgccccgcgtgccattctcaccgtcaaaacgctgtacagcagcggtgccatggaggcaatctttgaggacgtgttggcccaggggcggaccagctgctctcagtgcattcgacgggtggccaaatgcatggtggacaacctgccgatggacaaggtgtgtccacccacagcaagcagtacaggcgctaaaaaaaattggaaatttttggggcctaattaggcggttcagctcatagattttttgcatttgtaaaattgtcgaaatttttaaaaattgttaaaattaaaaaaaaatctcaaacagataggcaccgacattgaatttttttggctaaaaattgttaaaaaaaactaaacaaaaatgtcgctaggcgctgtcgtcggtggtttttttgattgaaatttatttaaaaaaatgccttttttttattccatggaacgaggaacagaaatacatgcacttctccccacaccttaaaggatttctccgccttaacattgacaaaatggcacatttttccgtcgaaaatcgaatcccctcctccttgaaaatccatttaaaaaattttctaaccccccccccccccccccctccccaggtcaaggacgactttgtccgactggccgaggcacaacttgtgacccgttgtgatcgcattgacgacagcgcgctcgccgtcaccggctgacccacattttgtgccgagcccgacccctttttgatgccggaccgcattttggacgtcggtgtggacggcggcatg

SEQ ID NO: 24158 - DNA, 1775 bp, Heterodera glycines
tcgatgacctctatcaccgtgttgtgaagcatggtgatctcatcaatgatgatgagttgggcctcacgaatccgacgggcaaagaagctctccagcggaatgcttgggagtttgtctaatgacacttctctacccagacgaaacgtggaatgggctgttttcccatatggcagcaaaatggctgcacacccagtggatgccgtagcaagcactttgtaggtgtatggggcctttcgcaagcgcctaataatttggccaaacaggaatgtctttcctgtgcctccatcgccgtatatgaagaaacggcgggggacagtcgaatccctagggtttgactgtattgccaacaaaacagcatcaaagaccttctgttggtcgctgttaagtggcggaggggtatttggctgtggacgaggatttggttgccctggaggcaaattcaaatcatcatcgccaaagaaaaactcattaattgccgcatttgtatttttggcaattgagtttggcgggtctggcaagccaaaatgcacagagcttaagttaaagcagctgtgcagccgccaatcaatgtcggctagggcttcaagctctgctgcttggcgttgtgccgatgtggtaatgccttgaggaaagtacatttggtctttgtacttgttccacaattcgacggcattactgggctggccataaacgaggatgctcatgaagagccacctcatttgatcaggccatcgtgacaacgctgcctcagcgagtgttttatcccagattttgtcatcctcaagaagaccgtgccttattgcagcatcagtgaaagaggtacaaggctgaccatttaccattttaagatggtcagggtcaccgggaaagtggcgcataagtgaatagagcgcgaacctttccggatccttgggtggaacagggacaattcgaccgattggtggtctctttgttaggttatatttccttttgttccatttgtcctttgcccatataaaatgctcagggactttttcaaaaagcatgtccttgagcttcggatcatgcttccattcattttgccattgtttccaataggcagaacattgcgtctctggcagtttgccttgctggatttgttgagctttgctcaccagctgaaaagccctgtacacaatcggttgttgattaggcatatggatgctaagtttgacaacctgatgtgaaagtttggcaaatggcagtgaatgaacaatggcatatgcttccgttgcaccacggaagttcatcttggcatattgagccggctcatcaattccgattttattgccggactcttgtttgcactcgacataacaatgtcctggccctttaaaagggtacttgagtgcgtatttaatatttgctttgttaccatatgcaaacagtacattatggtgtactcggtaacgtagcagaatataaggattatacggcacgacatgtgagttgtcgtatattaggccgtttacctctaattgggcaccaccatcagttggtgaaggccggaaatacatcgcgggcctgtccgggcgcaaaatcgtacattttgagtaaggggctgggaaccccttcttgcaccgcccgtaaattgggtcgctaggaccacaccaactgtcactgcatctgtgcagttgcatatgcattgtttcgcggatttcgcgatgcatttttgcaatgggcgtgtcgtcatctttatcaggcgggaggaggaatgtgcgccctatatgtattcctaagatgactatatgggacct

SEQ ID NO: 24159 - DNA, 1542 bp, Heterodera glycines
gcaaaaatggggccaaatttcacggacaaaaacatcccaaatttgatccgtttcgtatgaatacacttccaactccaaattggtgcccattctgtcccaaatttgtttgttgacacggataaatgcaagcacagaatggtcaatgtacctgaaaagggggaaatgatacaataacacaaattatgaattacataatcataaggtccataaatcggattttgtttggcaacggatggtccggcatcggaaattccacaaatttgtccttattgtccttgatttgcataaatagtttcgcttttgctccaattttttcctcatcctccatgccctttcgaattgtaatgtcattccaaattatcaattcgctttttccatcaaaatgtttgtccactaaaaagtcgaaacggtcggaaagcaatgccattttgagtccgagttgagcacggtcaaaagatgggagaatgtccatccaaacatccgcacaaatccaactgaaaaattggaaacgaaaattttaatttttcaaaataattccttaccgtcggttcattttggaggctcaattagcacacttttccctttaaaatctgttgttatgtaacttaaaaagagacagttaaaatgagaaagcaaagtacaaatcaatcaatgatgcataaggctgggaatttaaggcactaaaaatcttcaaaaagtcgactaaaaaagtcataaaaatcgccaaaaagtcacgaaaaaaaatcctgaaaaattaggtgaattaatttatagaataacactttgatcatatttaaaatatcttaattttaggccattgtcgccaccagcgaaagaaaaagaagaagcgggcaaaagcaacgaaaatgtcgtctaattattagggaatagaattacatggaaatccatatttttttcctggactgtgggaggcctgaaacgcacgaaaaacatgtttttagcttggtttgaagcttctaggaaggatttctatatccatattttccatatttcgcgatttatgtccatatttccatatttttccatattttggcattttggtccatattttatgtccatattttggcatttttcaaaaaaacctctattagaacggcccccagcagctaaattagcttttttgagcccaaaacccgaaaaatttttcaaaaaatcattttttcgccaaaatttctcgagaatattgaataaatttaaattttcttaaaattaataaattatgtcaaaaataagcaaaaaagcgaaaatttcgcttttgttgttgattttgcgctaaaaaaattaataaattttagcttttatgttttttttcttttaaaatgattgcacgtaattgccgaaaaaattcgagaccaatttccgaatgttgaccgactaattgcaaaacgaaagccgtctttgtcaaagcgccttaccgagtcaaaaaatttggaaatgtatctcatatgcaatttcaaccaataaatttgaagaaaatttgcactccatttttgaaaatttatgtccatattttgacatttt

SEQ ID NO: 24160 - DNA, 2081 bp, Heterodera glycines
cgtgacaacaacttttgaaatttcttcagtcacgattgaacagtttcgatgaacacaataataagcttttactttttgcttaatttagccggagaaattaacaaagaattgttatttgaatttgtttttctgctaagtaattaaggtcgggaaataaatgaggagagaaaacaaaatttgtgcttaatgggcaaattaagcgaataatgaatgaatgagggatggagggaggggttcttctggcctaggacccaatgatcacgagcaattgttgccaattgcttctctgctcactttccaagaatttgttttatttatccacttcgccggcgattaatgcgaattcttttgttgatcaactgactactcttttctcttaatctcgggatcccgatttgcaaattttaattgccaaattaattatcactttttctttgcttacgtcccttcctccttttctttcttgtccaataagctctttgacaccaaacagctggccaagccgttttcgtcagccaaagttcggccaaattcgtcccccttttgccgttcattcttaacaattacgaaggaccaaagtccaactccaattctcgtaattgtccccaattaattgcccaaaaacttatgttctctaatttcatcatttgtacatctttctaacttatttttgtccatttctttaatttaatgtgtgttggtccccaacattaatttctgcctttcgccaatcggctttccacttggcccggcgatcgccactcctttcatcacttttggctcttttgttcagtactcagcagacggaggcggggaataatgaggccaacaaatgagagagagagagagagagagagagggaacagaaagtgaacgaacgatttgtgagaatttaatgaaaagaaatggtcgaaatgttgtgaactgtgaagtgactgttgggacagggaaaacgggctgaaggggcagtccattttccttttctttcaaactttattcatttttgaacaaagttcattttcattttccacttttctcaaaaatttatattcctcatttttgttcgcatttcggttcagagaacgtaaaaaattcttcaattgtcaatgtccaccacttgggaaattagtcaaaactgtcccatcagctgccctgagtcttaccattgctttgaacccactgagtttaccgcgcctcacctctgcttgccgccaggcgtaactcccaattcgtttcggcactacatttcatttcgtgaggaaaatgccgtgatgattttcggtgccattctcctttccggtctcgcattgtggtggctcatttgcttcttgttcctctgctttttcccttactgctttcgtccgattcgacgtcttaccacgaaacgccgttgtgggactcattctggcacttctaaccctttggccgattcctcaattcttcgccgtccgtcaaacaccaaaagtggcgttgctcgtccgcctccttcgtttgctcttccattcagtcggcccttcgctcattccgtaagttcaatgtgaacattttatcgtattttcaccttgtcacccttcaggccaatttatcgtctgtttctgtctcggccgtctgatcatcctcaaaagcacattctcgggtgggaattccacatttcacacttttaattgtccttatttttttaatttaaattttctgactttcatttatttttcttttcattatttcagtcgctgttaacaccgccttgtgtcaatcgatctgaacttttcctctgagcttttccggccgctctttgccacttccacttaatctcttccatttcttgcattttcactttaaattaattaataattttcgccttttttaatttataatttgttaataataaaattactaatccgatcctggccaaatacatttatttatttatttattttttacaatttcgtagatatcccgagaggcgggacctccatgaaataggcgacgggtcccttcccaattatcccagcggcggcagttgattatgtccttttattgagtaaatgtgcgcacaatacaaatatatatgatgagtatat

SEQ ID NO: 24161 - DNA, 1618 bp, Heterodera glycines
atgtttttcccctattactttttttctttgtcatcaaatccaacattgttgatatcattcaaaagctcttaacatgctctatagccttaccaaaagcgaaaagattttcaacctggaaaaaattttattaagaaaaaagttcaaaaatttcgacttttcgcaatcgtgaatcaatagcttagaaaaagcttctaaagatgtattaagctttcgaatgatatcaacaaattgtttttgaaggtttttgctaggattggtcacgagcggtcacagcactttttgtcgcatttaaataataataaatcagttaaaaataaatgcgggatgaattattttgaaaaaattcaaaaataagaaaaaatgtaaatacctatcgaaagattacgaagtggaaaagcttctactctaaatttctaagcaagaaaattataagcccatttgattaaaaatcatagtttttataaaatttaactcatattaaaaaagcgaaatatggattttccattcaaatataattttttttaaaattatttttggtacaattatttaattaaatatggtttccaatttttgcacaaaaataactaaagagcttaaaaaataataatgatacagaggtaggaaaattaaaaaaaggtttaatttatgtcattaaatttgaagagaaaaaaaatcaaagttattaccaatgagaaatgcgcaagggctgcaaattgaaagacattcgttgtcgttttctcttccgcattgaaccaattgataaatttcttcagtgcatctataaaaattctcacaaaaatcaattcaaaaaattttaattaataatgataatatatttgtcaaaaaatatatttctaccgcaaaaaagtccaataattcgaagtcaatttattaaacatttccgtttttataaataattgagacctattaagaattttcaaaattttgtttttcataaaaaggaattttttgtttttgttaaaatttaaaattttattaattttgtaatcactcgcctggaacgtgatcagaatgaagcatcggctccccgctgacctcaacttccgtcgttcgaattcgccctgctgcctcgtcgttaggtgaatgcttctgcagtatgagcttatgcagattcataagcttcttaaaagcaaaaacaggtaatatataaaattaatttttaatttttttaacaaatcgaacattatattcggaagaataattttatgcaaaaaacttatgacatagattgggcgcttatttcttgttttttaacctttttcggcaaaaattatgtattttgacagatttttatttttgtcattaaatgacaaaattaccagtattctaagaaaaaagatttgtacgatggctaatgattttttactgattgtaagacctgtgttacattttgtccatgttttaatttttatatatttttttatccgtatttcgccatattttacctttctaatttcaataatttttaatgtcattacttacatcaactgtcatctcctcgttgtatttgatggtgtccaaaaactccaagtagttcgcgtcctccgagaacagtgaaatggagtcaacacgccgcatggtccctgcgcggtcgtcg

SEQ ID NO: 24162 - DNA, 1611 bp, Heterodera glycines
  misc_feature (18)..(18): n is a, c, g, or t
  misc_feature (1069)..(1069): n is a, c, g, or t
ccccccccccaatcgttncataattaccaattcgaatttttccgatttgtacggtttttccgccctaaaaatttgtttttttgtgtcgtcaacaacgggaattgtaaagaagctgcagcatcgatgaccctttaccctttccccaagaaatatctgaattggtcaatttccttttcggatttggtgccaaaaattccctttacttttgccacttttcgttttgctttgggccgtgccaacgacggtggctttgtctaaaactgcgttcattttcgttggaaattcattttcgtatttccgcattttggtgtcccaaaagtacggcgaagacttctgctgttttgccgatgattgtttctttgtttctgaatgccaatcctttcaatgctttttcccctttatttggtccccgtcatttgttaatcattaaaactttaatgctttatccaggcaggctcttctgctacgatcactaattcaaacttatttcttaaaaacctttccagttaaagaagaatttcgaaataatttgtactcttttttcatctttttttgatcacttcgccttgcgcccgggggcataaaactgtgcgtcagtcggcatttggtctcatttctatccgtggctttcattgcggatcctcccgactatccccccccccatttttggggtgccaatgctccccggttcggtggcctacgaatggcactttggccgactcacttgtgccaatctcttccgttgatgactcatcctcctcctcctcttcgtattcttcttcttcctcttcctcctcatcttcttcatcctcctcttcctcctcctcatcttcatcctcttcttcttcctcttcttcttcatcctcctcctcttcttcgtcccaatttttgtgccatttttgcccattttccccattttttgtgcctctttttgtgctcattttgtatgctttttgctcctttccctttgcttccatttcattttccgatattttgccaattatcactgtcagcacaattacaagaacaaaggacagtttcattaaattattttttaaatctatgcttncattaaatacaaaattttttattttataaaaattgtgattgattgctttgattttatccaatgtataagataataaaaatgtaatgcattgatttaaattgtacataaatcaatttataaataaaaatattttcataaaagcctaaattatccaatgccaaggggtgtatatttgttgaattgaaaggtcagtagggactatttaaaatctcccgggcatttcgacataaatttcaaatatgatctgtgaatagctttccaaatcttcttgttgctaaaacgttttgcccaaagaattcaaaaaaagacacttaacaaaaagagagaattaaaataaaaatgataatttaaattatgcgaaaagttttcttatggattcatctcaatgtattcctttgtttctttagaagagacaataaaacattttgggtaaattgtgccaaaattagagattagattaaagtgtaagaaaaagaaaaatcaggaataaaaaggacggggggggcggcattttattaatttatgtgatagaacagaagggg

SEQ ID NO: 24163 - DNA, 1687 bp, Heterodera glycines
  misc_feature (21)..(21): n is a, c, g, or t
tttcactaaaatagcgtaaangacgctccctgattgtacggttagccctttcaaccacacctgcatgcagatgtggggaatacatcacatgctttataatgtccttctttttccaatagtctaacatacgctttgcttgaaattctagcccagcatcactgtacagtttgttgggcagaacatttgcctttttgaacaccctttcaaacgcctcgatcatatgttcattctttttagactcagattcggcggtaaaaatgcgtcgactaagcacatcaatacagaccaataagtaacggtatccatcgttttgatctttcagtgcatccattatgcacaaatccattgccagtcagtgtgaagaccgcttggaatagtctttagacgcgggaacttattccgacgcggtttaaacagagtgtatgttcgctgatcatgcaaaaatttttaaacatcaccaataccaattgttttgttatacttttttgcttcttgccagaccttaagaactcctgcgtagcttgccgtggagcgaaggtcataatagatttgctctagcagtttctctacagttttgcccatattgctggcttaaacgtaaatttttgctgttgttgttgttttggagaagattttgcatttagtttatcggcataggctgttctgtgtagtcccggtgtttttataggggtgcgaacaagggctaagaaatttttattcttggctctacgtctcttaactccctctccggactgctgcgattggtttagatgtgggaagaattttaaaatttctttttccctgttcaagcgttggattaaaaatctatgtcctttcggtctgttgttcagctggtttggttcatcgacaaatctcttcaccaaaatttatccagtttctccgttatgcatggcacaaaggggggtatttgaacacaacagatgatgattttaaaaattttgtccatcctgttaaatatctttttgattcaaaagggccggaaacatgccaaaaaatgtgctacgatcagcaattccttattcggtgcgctagatgtgaggaatttttgtgttttcatcatttttatgtggattatcatatttgtcaatgaataaaaattttcaattcaacaaatataagcataaaataacaaaaaaaatgttaacagtataagggaattgaaccagcaaataaaaaaagaaaacttatagcacaaccaatgcggcaacaagggagttgaaggtcgctcttctctattgcatttattgggataaaaaaagtttggcacgccatatctcggcactcatgctcatttggcaaaaattatcaaaattttacaatagaacctaggtgtgatctacccacccacaaaatttcatttggaaatcccacggtcacttgccgacccctcctttgtgagagattatttttcaacctagtgcgaaaggggtagataatttcttgcagattaatggagactggcatatattagaaaaaataaataaaattttccatagaaatttataagaaattattatttaattaattttatgttgatttgtaactagtaaatgacaaaaaaatttataacttattatttaagaattaattgccgttttcaattataaaatataaatgtaataattttttaagaaataaatttatactaaaaatcaaatttcatgcc

SEQ ID NO: 24164 - DNA, 2104 bp, Heterodera glycines
  misc_feature (179)..(179): n is a, c, g, or t
  misc_feature (214)..(215): n is a, c, g, or t
  misc_feature (228)..(228): n is a, c, g, or t
  misc_feature (272)..(272): n is a, c, g, or t
  misc_feature (283)..(283): n is a, c, g, or t
  misc_feature (292)..(292): n is a, c, g, or t
  misc_feature (300)..(300): n is a, c, g, or t
  misc_feature (311)..(311): n is a, c, g, or t
tttaaagtgctctcttacaattcgaaatgttcccttgtcaggttcaattgcctcttatacggtggaccaagtcagattaattttaaaatttctgttccggtacccagaataggcttttcgggactcgggcccgattttcccaaaaactgagcatctaaacctaatttagacggcaaaancaaagttatgctgcttcttaagtggctggaactgnnaactgggtccaanctgaattgacccgcattcttctaaacttaccaattccttcaaanccattcttccntcacaaaancgtcagcnccactccaccntgtggccaataattaggctaaaagaaccgggatggtatttatatttttcattataaaatttataaaaatgtcgcacatcggtaataaaacggttccacacgttcgcccttttggttaccattttttaagtgattatggagttatccatttttggaattattataaaaagaattatggttcctttccatttcattaataagcactaatctttttgatttattaaactttccacacggtctccctacaaacttaattccgtactgttttaaataagtgaaaaaagtcaactaactaacatccatgtatttattttgtaccaaaattttaattacctcctcatcatcatcagtagacgccgcccaattttcattgaccatcaacacaaataacaagctgaacactgctgcacccaggaaactcattcccttgttcgacatttgtggtgtttggatgttgaaagtgataggatttaatattttttgaataactaaaaatataattatttaaaaaatattagagcactattgtataagaatgaattattttattttcaaaacaactaaatggtaaaataatattgtgattgatgtgtttgttagtacttctctccgctaaatgccaaaaatgtgacgtgtcttttattagtgtccgaccgtcggatgcaaaaattgatgacactactgatagctttaattggttttttggagaaaagtataacattcgcttctcatttactattagttcagtaatgccaattggcagccatggtcgatgactgttccattgaatggtataatttaattaatgagaaaaattgtgatttttgtgattcatgtaatttacttgggatcaaattttgggtaaatgcctaaaatttttgcacacttaatacgttgagataagcacaaaaaaaacaactttaagtttggtttgaagcttctaggatgactctaaataattttcgaaaaaagcttcaaaatatttaattatttcgtttaaaattttgaaatacacccaaaatatagttttttttttgtttgttcaagaaatatttaattaaaaaatatttgtcttttttgtgcctttcaaggaattttaagatttttttaattatagagatactctactatttgcgttgttttcgtgcctaaaagttaggaatatatattttttgcagaagggttcggcagtgccgataggcgctgctgggaaaatttttggaaatttgagtttgatttgttaacagattttgtttaaaagtgtcaattttcgtttttaatcgtcgccgccggtaaaaaattggatatttttttgtgcgatttagtaaaggttttacacaaaaaaggccaatttttttatgtaaaatataaatttttggggtccggctgtagaccggaacgaaacggaccaactctacctgaataaaattgagtcaatgtaaatttttaagtttttgaccaaatccaacaatcgtgtatcactcgaaagcttacaaaggctctattagtctaagaataattactgagaatgtcgaatcttcaaatcatttaaagctttcaattatactattttgttgaattttatcaacaaagatttttttattagggatttttagggagctaaacacgtaaaattaacaaaaaacttaattttggtcttttaaatgattatttaaacttttataatatttttcgaataagaaaatttttaaacctaaagttttttatcaagaaaaaaatgaaattttggcgattatttttagaaaatttttttaattctagggggtgtatttt

SEQ ID NO: 24165 - DNA, 1415 bp, Heterodera glycines
ttgttgcaaaacgctcgttgtccaccactcgccaatggcttcagcagccgactcatcgtccgccgtcctccgcgctcagcgctgagccgttcatgaacgccacgtcaggtgtgtacattgagcaaatgtacgagagttggcagctcgaccgtggctctgtccacagatcatgggacgcgtttttcaccaatgtcaacgcgggcgccgcgccgggccaggctttccaggtttaattttgttggcttttttgacgggtttaccgagctatttgctttggtggatgaaagaattcggtggggtctgattttttcgctactgtttttggtggtggcgttggaaccgaattgcgaatccattttttgttgctaaaagtcctcaaatatggggacatttggaagaaatttgaaccattgtcgaattcacttccaatttgaagaaacattgtcagttttttggggctttgaagtttttcaacggaacgtttctttaaccaaaatgaaatgtcaaactcattgtcagccccattttttccttgtgccaagaaatacccaatttttactaagttttttttacacaaattttttttccaggctcccccgtcagtcccgtcgcttagcaccgttccgcacgccacggttgtgccgcgtgacatgcgcgaggtgcagccgcaaacagcaggccaagtgatcccggccgatgaactgacacgtgccatcaatgaccatctcaaaatccaagtattgatcaggagtttccaggtctgtttttataaatcgcaattcaatgtaaacaaatcgaaaaagttggtccaaaatccccaaaataagccattttgggagtccaaatctgtaaataaatttctgcacaccggaccgcttgattaggttaaatctaaactcaaatcccgaatacaattttttggtttccatgtagagtattgtaacagaaatactgtcgtttttatttataccttggttgtggctgtctccgttctcttagcttaattgtaaaacattcacgatccgggcatgtgaagggtaacaattttttcgaattaagactcgtggccacaacattgccgatttggacccgctgggcatcaacagtgcggacttggatgacacaatcccgcgcgagttggagctggacttttacggcttcactgagcaggacatggaccgcgaattcttgttgccacccaccacattcatcgggggcgaacgcgccacattgtcgttgcgcgaaatttacaaacgacttaaggtgggtagcagcaggctggtcaaccagttttagaggaaaagtgtggacttttggttcactttaaaaaaaaattttttttaaacttttgactgttggaaaaaaatgccttgtggtacaaaaattcctcccggaaagattgttagcaattcaat

SEQ ID NO: 24166 - DNA, 1977 bp, Heterodera glycines
cccccacattttttctgcaggtatttggacgtccaagtgatcaatttcctgcgccgaaatcgccgcctgttcagcaccaacatctcgctgcagttcaaccttctgattacggaatttcgcgcttggcaagcgatggcacggcacatttggcccctgttgaggaacggactccgcacgctggtcagcctgaagcgcaaacaactggcactgatgcgcaaacacgtgtcgccaaccgtcctcttcgactatccgaaccttgtcgaaatcctcaccccgattttgcccgaacgtccgaccgttgacaacaccaattatgctgctgatacatcggcccgtgacctgtacatgtggctgcacatgtcgcgccctgacggtcgtccgaaggtgttcaaattgaccaaatggaacaatggatgggaccaattcgtcaacgatttgtgctcggtgagatttgtggtggatcaatcgatggggacggatttttcaatttttcactgaccttttttgggtttttattgcagttcacacgacgataaaataattggacaattttaataataactttttctagaagcatccaaataaaacattcttggtatcattcgatagcccaaagtgtcctttattagcctgcaaaatttcaaagaatttcattatatttcaaaaaagttgtaaccagaaaacttcaaaaaaaatgaattttctgtacatttttgaccattactttttgaattttgaatgaattttttaaaatcaacttaggactaatagaggactctttggactatcaaatgatgccaagaatgttgaatttgaatgcttccaaaaaaagttatgctgtattaaaactgtcaaatgtttttatgatcgtatgaactgcaacagagtcccttttttgatcattaatctgcaactgatctgatcgcatttccttttcacagtcattcactgcagcgtccgtcccggtcaactacatggtgctcacttcgttcgaattcaactacaccaggagtgaagaaatggtcaacattcggacggaggaaaggctgacgctgatgagcaatgtgcatccaaatccagctgtgggtggcgttgtgtccttggtgaagattctgcgctgtccggtggagttcagtaacgctgccatggtgtcctggcttcgcatggcgcgcgtgagcaacgaacgtcccccgaattgggtgaccattggcttctcggatgacgaaattgggtatggggacgagtcgccaacaaatttaatgttctggtttcttacgcttttcctccgttttcagaccgttgcctggctgagaaggattttcaaactgcggatcaacagcagcagcagatgagccctaggcacaatggacaatcggatggaattatataatctgatcattatcgtttcataaattgtatttatccgatcaaatgactgattttgtcactgatttcactgtgtatattctgtatgtacatattgtatttgtcataagggaagtaaagcgccgcttaacgttgtattttttgtgcctcgatttttgaaattagacaatttttccattttgaaaacagtacaatttcgtcggtatttttcttttttgtgtgaatctcttttatagccttccccccctccattaaagctcaaagttgaataatagtgcccccgagcttttatactgtcattgtaattcgtgcaatttctctgaaaaatcggcggaggtgaaattgtcaaaaaaatgtgggccaacaaaattaaacaagctgagggagtcgatcggaaaaacaaaatcattgagaactatgcgaattttccgaaatttcagaccatacatacaaaacaacacaaataaaatttatataccaacaatgaatgtgttaaatgatacatcgctttgaataccgtaaatataatacaataatacgcacatacaatacataaacatatgcatggctaaacacagaatactggataca

SEQ ID NO: 24167 - DNA, 1272 bp, Heterodera glycines
  misc_feature (1221)..(1221): n is a, c, g, or t
ttaatttgttgattaattttgaaaatttaattcttaacatttggaatttttgaattgtaatttgttggggtggtccttcctttctgattgttttgctgcggaataaatcaaatttggggttgaactaaatgaagcgaaaggaaaaaaacgctcaacaattaaataggaacaattaatgtcaatatttgtgcaaaaaaacatgcatttggggaacagaaactgaaaaagggacattttgtcaaattggacgaccccaacaaattctctctctcagcccaaaaacaccattagtaaaattaaccatcatcagcagcagcaaatgaagtgcgctcagggctgatcaatttgctctgctgatcaaccgccattatctgtgctgatcatttataagggacgagcggagtaaaattggcggggggggggaggggggggcggaaaaacgcaaaaagtggttgatgatgcggtggtggtgatgaactctgtgcaagttgagcgaacagttgcgagggtggtgctgcagcagcagcagcagcagcagcagcggcagtggtgggagggcgaggcggtgatgacgacgcaattccttccgtcctccgccgttgcgtaagggcgtgcccaccgccgaagttttggaaattgaaaatttaaaaatgactaaacatattaatgtaataatgatggtgatgatcaactgggtaattggtgcagctgcacagagaagcaatggtgttaaacaaaaaaaaaagaaggaaaccgcggcacaaaattccattcttttcgtgaaaccaaaagaaattgagagtaaagaaaaacgaaggatttagttagggatgatccgggtcccggccctttgcaggctttcggccctgtcgagtctgaatttttcattaaaatacatttacttcttgggttgaatgagcatctgatttctaaaaattcaaaaagtgtgcccgaaaaagtcaagggcaacatgaatttgattttttaaatgaaaaacttttgaaatttggtgaggtaatgggagacaatttttgaaaattgtgaacaaaattcccatttatataacactccaaaaaaatatttataaccaatttttgatgctcaattttttgccaaatgtccggcaaaagtgctaccgctgctgctgccactgctggtggcagcggaggtgcggaaacatcacacgcaattcgcgtgtaatttggactaatttgtcggccngggtgtcgttccagatgatttatttgtcaaatttcacaaatgcgcgcgatg

SEQ ID NO: 24168 - DNA, 966 bp, Heterodera glycines
  misc_feature (857)..(857): n is a, c, g, or t
  misc_feature (894)..(894): n is a, c, g, or t
tctgctttagccctgaaaaatgcaatgttttaaaaaccatttaattttggtcaatttttgtcactttttggcgtcgaaccgactctgcgaccaagctcttggtgccattccttccgctttcttctttcttctgcactagaagcccaaaacggctttggttgatatggcagcattaatcggcaataataacatgtccagatctggagacccggatacctgtcttttgcaagacatggccccgctccaggaccctccgacaagtccagacccggatacctggcttttgcaaaatcttgccccactatctggaaccgggtttttaaaaatccaatacccggttcgcaacccggtaggtccgggtccaactttgcacaaaaacacactagtaagaatgggcttctgggccaaattttgttgacaaaagtctaaggaatgaaaatttgtgtaaaattaatatttactttaataaatgtatttataaaatgtgtctgtggtctagtggttagcctctagggttcattaacttcctttctctggttcaattcgctcgcatagcccccagtttttgccaaaacatccgggcgcggggcctaccttaattattcaatgaaaaaaagaagattaataaacattttcagcaagcaaatttttgttttaaggtctcaattaaaattgcttaaagaaaaagagcttaaaaaaatgtttgaccaaaaaatggagcaaattcagaaatggaaaaccaatgcatttctggcaaagactgaaatggaagaacgccacgaattggaggcgcaattacgcaaaattcaaacacaaaaagccgcacaaatcgaatgctgctgcctgccaaaatccanatcagccccagcacttctttcacataaatttttgaantttggcatccagttgcaaaacattggcgtacagttcatctaaatcgtcgtgcaaacatattgagcaaaaatc

SEQ ID NO: 24169 - DNA, 1235 bp, Heterodera glycines
  misc_feature (80)..(80): n is a, c, g, or t
ttaaataatagatagaatttaataaatttttggttcaaaatgtaaaaaatagttatatttaaaagcacatccaataatcncgcgggatctcgaaaaaatatcttcggcattgattggcaccgggatacgcacaggtctatttccctcatttaatgaccatttgcatgggttcggacccgctcgacagatgatgaattatttggatttttcttcaaattattattccatatagcatatttttattaagttattttaatatatatttttgtaatactattgagaatttttgctgaactgacagttcgatatgttccctgaattaatttccatttcatatgaaatgctttctttctcatttttatccatttcatttttcgcatgttttgccttgaataaatttaattttataattattttttatctttttacatcggcgcaaataaaccacaacaaaaatattttaatttccgatttttttttctgcccaaccatctttgaaattttggtataaatattgcgattataagcaaaaatcaaagagattaggtcgtttagtaatatccattacacttaacggtgcgactcggaatgaattcggcagacttttgaaattcattgaaattttttcaaaatttctaagaatccgcaatcctgcgtgggatcctgcaaatttaaaatgcaggatttgcaggattgcaggatttgcaggattaatccggccggatccggtcctgcaaaaatttttgaattccaatcctgcaacaggatccgcaaatttgaaatttccgggctctagtgcaaatttcgcatttcgcgccaaaaagcgaaatgcgaaacgccaaaaaatgcgaataatgcgaaaggcgaaatgcgaaaagcgaaacgtcggcccatccctggcccaaaactttgttattagtgctgacagagaccattaaaatcaaagaattcatatgacaaagtgtaaaaaatgtcttccatttcaaataaaatatccccgcattcgccaaaatttaaaatttatttatttttatttccattaaattgtttgcttttgcttttcttcttcctatttttgatacatatttatttcacacaccctcattttttgcgcacctttcacaaccaatcattgttctgttccatatcggtgggtgtcctccccgcggggggagtgccccacctcaattagcgccgctttttccctccagtaaaaaatggaggtggggcggctt

SEQ ID NO: 24170 - DNA, 1877 bp, Heterodera glycines
ctccctgtggctcctgaaagaataagagtgaatggtgcaataaacatttttgtcatttttttgaatcatttcatttatatatatatatatatattttaagcttggtacaccactattttgtgttttattactcacttttaattatattatttagtttgcctattttgtattgcaaagaattaatattttcctcttgtttagctaaaaatgccaggacaacataataatattaatgaaatgaattgcttcgtaacccgtaatattgagttaataattcaacagcaacaacttaaagaagaagtagaaggactcaaaacagaaaaaaatcgactattgatggagacacaacgaattttaactgatcaaacaaaacatattgaaaaaaatgacaagctgatggacaagtgcatcaaattgcaagacaaaaacattgaattacaactacaaaacaacaatgcattacgggaacacatcgagataaagcagaatactgaatcattggtaaagaaaagagagatttggaggaagaaatattgaggatgcacggatcagaaaacagggaccaagaaagtatttgcgctttgtgctatgtcagacaggtcacaataataataaatattaaaaacaaaagaataattttggctactttagcgcaattatgtttgtattccttgtggtcactttgcgctttgtaaccgatgcgctgaagtggtagcaatcgaaggtacctgtcctttttgtcgtgaacaacttgatggagtgtttaaaatttttagctcgtaatgataatacgatcgttaaatacccgaacttatgttgttaaattacatgtttataaagtgattatgatttccaatgcatattgaattgttaaagcttcaccagaattaacaaactaatcataaaatctcttatgttacggtggcctaatggttagtcttccagattgtgaacaaatgttcggttccccaagaagctggcacatttaaaaattatttactttaaggagggacaaatagttaagatgagggggaaaaattatcgataaaaatggggtgggggacaaatggtcgacaaaggacaaatggtcgacaaccgaaaaatgggacaaatggtcgacaacggacaaatggtcgacagaatcgggggcaaaaggattaaggccatttgagctccagtgaacactggcgctcaaatggccggccagagcgctgggactgaaatgtcccggcgctcagatggccaccaaaacggggtcttacactactgactgcagcgaaaagagcacaccaacaagatttgaaaccatcatgattaatcaaaaaatctaaaaaaagagttatgtttagtttgtgtacttactttaactacctacctattaataataaaattaaaattttcattgacaaattaaatactacgtttaactcctaacttacatttgatgctctgaataataattaataaatttaaaaaaatttagaatgtaaaataataataatagaagatgcaaaaaataataaatgcaaaaaatacaatatatttataggccattatttatatgtatgaacattgatgcttaaattctgataaattaattagcacaatttcacgattcgtctgtagtgtaaagttgaactcgaacctggctgggaatttaaaagaagaagcaattttattttttttaaatataaaaatatatttttaaaagtttagacaaaatttgaacatgatttaattgatattaatagcaaagtcgaaaaatttaaaataatcgaatttttatcttgaatattcataaatttttagtcgatattttgccaaaataaaattaatggcttcaaagattataatttattaaagaaaaaaatttgtaa

SEQ ID NO: 24171 - DNA, 1235 bp, Heterodera glycines
ataaaggtatcatccgaaaagctcataaaaaaggctatgcaatggtatgctacttatctgttgaaattggaaaatgacaattttatacgcaattatttttttcaaagcatgatgggacaacacttatgaccatgactgtataggtaattttttttttcacctagttttaaaaaagtcaattcctttccaaaaatggtgcaccccccatcacacggcgagtcaattttttcttttcttggacatcctatatatccttgtatcaaacgaaaattaagagcaaaacaattagtaaaaaaataaaataaataaataaataaacgacgggatttcgcctagagtacgtagccactgtttcttcaacataatcccatttttttttttgtataattgttcagcaatttgatcgtcatttttagtatgcatgcgcgtcttctcgaataataataatggatggatgattggatatattgtaaagcgcattatcgcatccgtttaatctctttctcacaacacatgtgttcccgctctctcctcccaacgggagtcagttcgggcagttaatcagcagagagccgggagcaaagctcggcaaatttaatgcttatgtaattggccaattactttaaaattcgttaggtttaaaatttttggtcaaaaaaaataataaattaaaaatgcctgttattttcgaacattttttggccataaaactttttgataatctaattcggtcgtttatgcttttgaaatgctccatgatggactagagtgatgagtgacattattgccattttttgttactatttcataatgagcaagcagtggcggaaggaagaaagacgttcgttttcattcattcttcccattcattcatgagtgcatcaaaaaacaaataaataaataaataaataaataattgttgttattgacacccgccgccgcagggggcaaaatgcaacaaataaaaggcagaggaggaggaatcagctgatttttgtgcaaaaacataaatatgcctattctttccatcgccccccaatcgacctcgttttccgtccacccatccatccattcgccgccaaattctcacttttaattgccaaagcaaaatttaattgctaattgcccccggggatttcccgtcattcgagaacatatgaggtctggactcccgatacgggagtcctgaaaagtgggattttaatgacctcggacaaattttcgatcatctcatt

SEQ ID NO: 24172 - DNA, 2463 bp, Heterodera glycines
  misc_feature (160)..(160): n is a, c, g, or t
aaagaattttatttaagtctttacaaaataataattttttaaatattattattttatctaactagctttgtgtcagctacaattattctattgcttttttagatgtaaatattatttgatttgtttatggtcatttgggtctttgttgttataaaatatntaaataagctattataaaattaaaaatatgacatttaactgattttgtttgcatttttatgctttaaaatatggatttttcatgccaaatgaggcttttttcaggtttttaagtggcaaataaggattttttatggctgaaatgagaattttcaaaattttgagatcgaaaccctaagttaaggtgaggtgaattaatatttgtgtaatctattaggcaaataaatagtaaaaatggattttttgctgaatgcataaaggaaaaattattagtgaaaatggccttgggaggagagaacggaatgaccacatagtaagtggaggaatgccagtgaaacgatgtgatgtgttcgcgtcgttttttattgattcacaaaaaaatgtttgagaagagaataatggggcaaggcaaagaaatagagaaatttgaagatatgtatttatatccacatggaagaagaaaatgcataaaagcgacatcaaaatgaaaatagtttctaaatttatcagattgtcctggtttcgatgtttcgatccaatttttatttattcgctaaattttcgtttagattttaattttatttttttttgttgaaatcagtagggcttaagtatttaagccactaaaaatcttcaaaaatcgactaaataagttataaaaaatcgccaaaaattcacaaatccttaaaacgcaacaaaaaaagtcaggaaaatggaagggaaaagttaaaaaagtccttttaacaattatagaataacattttataaatagatacctaaaataagcataaatgatttttcgaacaattacgaaaaatttcatctaggttccattgtctttatttgggaacattattcaaaagtaatgcttcaaaaacaacacttcactgctgtttaccattcgttgtttttcttccacatcgtttcacaactaactactgattattatttgctaaataattaatcataacttagcataaaattttgactcagtaatttggccctaactttcttgaaattaaataaaatttttcgaaatttaactgaataatagagaaatttttgggctatcttttgatataaacaaaattaaagtaagttatttctgaaaaaagttatgaaagaattaatagggtcatatttttatggtcatccagaaaatgtaaggtcgttaatttttaaaaaattttttccaaaaatttctatccaatattaccaatttcttcccagtgttatgaaaaaacagttggatgttgtagtgtaagacaaatttcatttaaacaattttctttggtggagttttaattttattcgagatgctcgtttaatgtgtcaaaagaaagttgtgaaatttatttaacgaatgaaccgaaagttcaattaaaatttttctgaaagaaatagaaaattcagtatgcaaaatataaagccaataaaattcataaaagattaaagttttaaaacataggaaaatagctatattttaaattataaaatattttttagacaaaataaacgaaatactaataatgaaagaccaattatagataaaaatattttaataatcaaaaaatctttaagcgagcttgatcattgttgtcagaagaagttggaatattcaaaaaatgaattctaattataacattagattaagtcatgattatataaacaaaagaaaatatcataatttaagtttaggttctctatattttaagcttaaaaattcccaaacgttaatctttgccttctgcatatcgttgccagtaatcatttattgactcctgacaacgactatgaagtagggggctgaagacagatgatccagaaatcaaattaccaaatcatcaacacatgttcaatcattggggtccttggcaaacccaacccacttaacgagatattattggtggcagtcgacgcgcttttggccgccggggtcagaagaatacgcagcgaaaccacgtcttctgccacctccactacctggtcgtgcaggttgggacccagttccggcacttcatcgacatttggaccaaaggggacggtgtctgttggcacaaagttggctggagacaaagccgactgaagagaatcgtcggcgtgaaagatgggtagttcaaaaaattgttcaagttccatttttgatagttggaagggtagagagctacttaaataggagcaactcataggagtattttgtccgatcacaaacattattcatctctcagggcacctagcgcaacgttttcatgtgaaaagagcaacatttttgctctccgtcgctcgtttttgtgcgaaacaccc

SEQ ID NO: 24173 - DNA, 787 bp, Heterodera glycines
  misc_feature (74)..(74): n is a, c, g, or t
  misc_feature (90)..(90): n is a, c, g, or t
atagattataagctgaaatacgggaaattaaaaatgacgattcaaaaaacgcgcttatgtttccaaaacagagncccaaaaaaaccacgnacaggaggggaggaccgaacgagggccaaacgcagaagaggggcagaatctgtcataattgaccgtcccatgggatagcttttattagggacaacaaaaaatttgtttttattcggcccattccccctttttccaaaaaacccattcacttttaattaaacccaccgcaacttttgaaaagtgccaaatcggattggcattggcactgtccacacactcaccaacctgaatgatgaccagcccacggatgccaccgccatccaacgaaaggacattgatgaaattgtggtcgggcggactgccctcatccggggacacttcgggcaacttgtccaacacctcgtcgtagatttcctgaacacacaaaaaatacacacattgtcaaaaaaattttttttaatttcattttttcgaatgttgcaattttttgaaaactttttttcttcctttcccattattctgtgagcagaaaattatttctttttttttaactcaacaaagccgcaccctgcagtgtgaattcctatggcggtaaggtgtaaaaatcgtaattagagcctttaattgcgaatttttttttttaaattttcgtgagtgggtaaaaggggctttttaaagcttacattgtgctgcatgtccgacagtttgtcgaagcggaactgatccttggcaaatgcacggttctcaaagtcctcca

SEQ ID NO: 24174 - DNA, 2342 bp, Heterodera glycines
tcaaactttcatccgcaacattaaaatgagcatcaacgcttcatgaaatttttaatgccaatgcactgatggcttacaaaacatacttttcacatgagctctcctattcaaccacagcaaaggactcacacctaaatgcagcggggtactaccgggacccgggtgatgtgcttgagacgggagacggatgcacagcgcgacgcgatttgtttgcgctcagcaacgttgctcagttcattgccaaaattgacaccgacctattcaaccagccgctgtatctgatcaacttttgtgagctggacattgaaattttgcccaacgataacgaatttgtgctaattgcgccgctcgcaggtgcaccccgctaccgtttcgaggtagtgggactgaaattgtatgtgaagaaagtgtctctgatggatgggttggcgctggatattgcgcgaaagttggaggtgaaacctgcccgttacgctgtgaggaaaacaatgatgaaatcgttgttcatcagtcaaggccgttacgagtttacagccaatttgttcatggaccaaatcccccggcgtgtaacaatgggtctggtggcgaatgcggattatgttggctcaattcggcgcagtccattcaattttcaaccgtttaatgtccgagaaatttccattgttgctaatggacgatcttacccacaagcgccctatgacttggagtaccccaacgggaggtatgttcgcccattcaatgacatgaatgaggcggtgggattcgcaaactcatcggagagcaacgggataacttttgcccaatacggaaaaacgcattgcatttacgtgttcaatttgaccaacagcgggggatgatcaagcggcactgtttgatttgataaagaatggcactacagcggtgagcatcaaatttaaccacccagtgccagacggaggaataatgcttgtggtgatgggagaatgcgactcattggtgatgctggacaaaaaccgatcaataagcacggacaccactatttaagcttcccacaattgtcatttcatcattttgtaattaaaatgtattcaaaaaaattgggcatcattttgttctttctacgagtttcgcttccggttatttcaacaacagtgcgagaagaaccgaaaaatacttattctgcgtatataaaaaatttgactttatctcgacaacaacacgagccgtcatattcctacactgaatatttgagaaggttgtctttgtcaaaaatttatttttctaccaaaacaataccaccaccaccaccaacaacaacaactacaaccaaaatccctccaaaaagtgacaagttaattgatgaacatgtttctgctgttcttccaccgcttatccaattgtgtaaggacataccagaggaaagcaactttgcgcagcaagccatttgctgggcactgttcactctttatttaatgctcataatcagtcttgtgctgcatcaactttgctctattttttggttgaagaatggacagccttcaaatcacaaaaatattgagcgaaaaccttctgaccgggcgagtgtttcagggctgcttcgccagtgaccaattgccgcctccttccacactacagtacccggcagcgctcgttgtaaacagggacccccgacacaaggagggctctcattggtgcgccatttacgcaaggggaatggaagcaccagcgctttattatgacagccttgcccagcccatcccgcccagcattacgtcatcttttttgtgcgaatttcgtgagggaacaagaaggaatgctcacccttaccagtcccctttactctctacttgtgctgcccattgtattgtttttatttaccacatgtaccaagggaattcctttacacaatttctaactattcttaataattgtgcaagtccggacatgtacgctattgttttattacgaaaaatgttaaatcaataaatgtataatttttaattgtttttatttaccacatgtcccaagggaattcctttacacaatttctaaatattcttaataattgtgcaagtccggacatgtacgcgattgttttattacgaaaaatgttaaatcaataaatgtataatttttatgttgcttaggtgtcgttaattattcataaatgctcattgcactctcaattcacgagggaattacttcaaaggaaaatttgaaaaagccgcctttcgcgatggcgtcgaaaattatcgattgatgggaggagcttgtcgatttatgggaggctttataagcacgtccggacacaattattttaaatgattttaggccttaaggtaatacaataaatcgctataaat

SEQ ID NO: 24175 - DNA, 1841 bp, Heterodera glycines
tttttattcaccgatttggtttgttcaatttttggcgtcaagatccatttcgacataccatgtgggtggaacgagaacaccaattggtgcacagcttagccatcggatgcattggcactgccattggacggaagttggacaaaagcgccgccggtacaacggaaaaggcggacacttcgagaacggaaagagcaaattggcgcataggggaaaagcgaaggtggtcaaaaatggtaacggatcactgagcataggcaaatgtcgtgcaaataaaatccgaaattcgattagaaaatggaaattaaaggaacaaaagtcaaaaaaaagaagttaaaatggcaaagtccaatatttcagtcatcacatcaattaggtaattcattcatttctgttgctgaccatcggatcgggagaagcattgagaagatgaaaacaatattataagtattgaaattgtgatcaaattctcacccatcgtccaaacagatcagcagctgaaaacccttgaatggcattatgacagtttcaaatatcaattcaatgatcagatcaaatggcaaaacgagtcaatcggtcggagagaacggcggaaaccaaactgaaaagagaaaccaaaagttccactgataaattcaaacattaaaaattttcggcgcattatccggacgaggcatatccaaccatttgacaatccgacacattggcattcatcaggctgaaattcggggaaagtgctcattgtgaagagagtaatttggaaagatggacaatcgttgagaatggacggggccaattggcgcataaatgcatcgagattgtgaaagttgccaaattcagtcgaagaatggagcgcgaagcattgacaaaatgttgagcacaacgaattcccggaaatttgccatttccttgatgccatacaaccactttttccattaaaaataagacggaagggggaggggtggaaaagagttgaagacaaaaatttcgagagaatgaatggaagaggaggaaaaagtaatgttttatagaaaaaatattcatcatttaattttcaccatttcattccaaatgatctttgtggttagttaaagcacttttccaaatttttggtcgtcggatgacggacacggaaaatgctcattttctgcgcatatgctatgaagaaaggggctcaaaaatagcatttctgcgtttaaattttttgatttggtgaaaatttttagtccatataaatccatatttcgccatttttgaaatacgaaaattttgagttttcgtcggtcattttggcatttttaataaatatttttcgcaattttttgcgaacttttcttttttgaaatgagaattctttttgaatttttttgcaaacttggaagcattttttatacaatggatgaccataaaaaattgtattattatgggcaaagcgtgaccggaaaatcggtcagtggaaaatgcgtcagtgatacaaatattttaaaataaagttctctggcataagtattgtaatataaaagtatgatcctataagaatatcattcagaattcgaacccggaccctaacttgaacaaaaaatcgaaaagtcaaaattttcgaaattaggttttttcttaaaattcggtatccacagaaataaactaaaagccaccaatcctgcaataatagatcatttatgcagtttttgaacaaaaaatgctaaattcgaaaattttgactttctactttttgttcgaatttgggtccgggtttcggaattgacagcaatggataccggattcgtggttagtgcccacgaaaacgcaaggaaattgttattatgacaataaaattttcactg

SEQ ID NO: 24176 - DNA, 2245 bp, Heterodera glycines
gtaattgtctaatcatgaagcagtagtttagaaaaagcttctaaacatgttaagctttcgaatgatatcaaaatgttggatttggatgacattgaaaaaagttatagaaagctttcgtggaaaaacatgttggcgcccaaacgcagtggaccctaacaaaacacggaaataccaaatttttatgcaagcctttatttttggaagggggaggtcaaaacaccttggaattgcgaatattttattattttagaaaacttgcgagcaatgattttggtgcagtatatcgacacttatataaactaagtttggcattttgttgcacatttttatattttagaaagaaaatttttagctaatcaatcgaaaaaactgaattgtaagtattttttgtaaacaatttttcttcataccaacttctttagcaggaaacaggctgatgtgcttggcatttaaacgcatttttgtccaaatgcctgggtacaaatagtagcgggggaatggcgcaagttgtggcttatactccgcaataaaagccataatttcctgggaaaaataaaatttaaataatttttaatgaaaattttaatttttaataaaaatttttaaataatgttcactaaaaattttaattgtaaaaaaaacttcttgggttgtcattttggggtccatttggtacggatgacgcagctgaacgcgcaattttccgagctcatcaaaattttgttggtacaattcaatgctccgaaagcaacgaccacgacgaatcaaataaattggaacaaaaatctttttttttaaatatataattaaaatttaattgcgattattagcacctcacaacagttcattattgtgtcaccgagctggcaaaaatgaaaaaactgatcacaagccaagccaaattgatcaaaaaaatagttgaagaattgatcaacacttcgattttgagccaaaacagcataaaattcattcaattgcttcttcctcgcatcgtcaaattggttccaataaattttctttaaaatttattatttttattttgaaaatgacatatttttgtttaaaaactacgaattgtttatattttaatattcttattagggatgcaattttttttcctgagctccctatggtctgaattgctcgaaaaacacatttttttcggttgttattaatagggacgtgaattttaggttttaactattttttttgctcaattgatttgaagaaaggagctcaaaaacgcatttccgcataaaaatttttcgattctgatgtcattatcggtcactagaaatcactattttgggattttgtcactaaaatagtgaaaattcactattttggagttttgtcactattttgacatttttgggcaaaattccttaacaaaaatgcaataaaaccaaaaaatacacccctaagaatcgacctaaaaaaattcaaaaaaatacacccctaagaatcgagctaaaattttccaaaatatactcctatgaaatgaaaaaaaaatttctcaaaaaggtattttcgtggcaagaattttaattttaaaaattatttttttatgtacctattttgtttttttgcccttaaaaatcccagccctactcatttgcaatgcaatcagtgaataaaaattagttttgctcaatttttggctgaaaattatgtcactattcgtcactatttcggactttttgacactattttgtcactattttggcatttttactcactattttagttaactatttcgggatttttcttcacgcaaaattcacgtccctatacacaaaacatttaattcgatttcttgtgtagacgaaattaaggccgaaattgacttggatacgctattattagttattgggtagaacaataatttaattttaataacttttaaccgctgtacgtttaatcttttatattatattattctttaatttcgtttttcattgtgataattatattttatttttgttatgtttggaataatatttattttataacttgatatggataaatgtgtactttttcagttaaacaaaaaagttctacattctttttggacatttttttattcaatttttatttttctttagctaattttttttaataattttttatagtgttttgcagaattttctcagataatatgtatggcattaattaaaaaatatatttgttcacgtcaaattatttagccttttacaatatttatctttatttttaaagacctgca

SEQ ID NO: 24177 - DNA, 1762 bp, Heterodera glycines
tcgacatcgcttccggattggcgtacattcatgatcgttggcattgtacactgcgacgtggccgcgcgcaattgctccggtctccaacggagtggtgaatgaaaaataagcatttttcctgatttaaattttcattttttcacacaggtcaaaatatcagacttcggcatgtcctacagaggcctgaccaaagacgtgccaaaagatgagaagattccgttcaaatggtctgctccggaggtctggacgcaaaacagctacacgctcaaaagcgatacctggtcatacggtgtgctcagctgggagattttttgcgatggcgccgagccattccatgggatgaacatggaggccgttatgcgcgtggtgagtgaaaaaatttctaaaaaattcatttcacctatttatttgcaggtgaatgacggataccgattgcaatttctcgataatgcgcctgccaatttcatcaacctcatcaatgaccacgtttgggacttcgaccagcgcaaccgctactccatgaaacgcgtttacgaattgctgaaagagatgtaggaggacaacggacagtagcagaagagccacccggaagcggattcgtgttgagtatcctattgtatatatgcatatgtatttttgtatcatgttttgtgccgcatttatgatcatctccacacatttgatgtacctattgatgtatttgtatgtgctatgtatatttcgttcacatatgtctgaatgaattgtgtttaaagaatgaaagtgttcttgtgactataaataagacgaattttgagtaaaaattgagttaaattattttctatatacagtgtgtaaatttagaatagggacgactgttttttcgggagtttgacttgtcggaaaaccgatttcgaggcccccacaaaaaagaaatgtgaaaaatgaattttcataaaaattcttcagtttttcaactttgtctgcggcgattgttggcttttggtgttcgattttcttgcgcctgctcagctcggcctcgaaattgcactgatcaaccgccgtttttgacttttacgtggacgaacacttcaaaacgcgcaaatggaaattgggcggaatacgaatttggcacaaaattggagagaatggcaccaaacaaatgcaaattgtcaattccgatggaaatccattgccaattccgcaaaatccgttgccaaacaaagtcatcggattagaaggcattacaatcgatgtaatgccaatgtttcgcgactccattgattgtgatgtttttgaataccatcgcttttcgccgcttacgccaagtcaaatggttgtttaagccttggccgaacagcctgccaaaggtgatgcacgaggtatttcatgcacttttatgccagacaattattagattttgaaaaatgtcaatctattaaagattttatgaaatattttttgccccgtccacaatgctttatcgaaaatgtgaaaatgagcctcttgcatggttttagacggtaatgattagaggccaaagattttcaaatcagctgggccgcctgatatttttagaagcaaccggctttcgagttcggcttctccataaccggcaaatctgaaaactagtccaaaaccagactttccaattgccgggcatggaaccggatcatgaaaaaacagaggggattttctgcgtcacactgaacatttaaataaatttcatttatgtctattctaaattgcaatccaattcgaacaaaatcagaattcccttttt

SEQ ID NO: 24178 - DNA, 2517 bp, Heterodera glycines
  misc_feature (2434)..(2434): n is a, c, g, or t
cattaaactgtaaaagtgccgaaaaaactatcattaaaaatctcacatttccttaaacgtcgattcatttgcggcaattaacagctcaattattgtcgtaatttgtgattctgatgcgaaaaatgatgttaaataactaaaaaaaacttttatttgtattaatataaaagtaattaggaaatgattaaatattaaaattaagttctctaaaggaatcgaaggcgagaaagttttgatttgattggcgtaaaactgaaaaaaaaattgttcttctgaaaattttaacattcattcgccaaaaaatgaacattatgccataacattcataaaatgcaaatacaaatatttttttttggtttttctgtttttttttcttgaaaaataataagtctccaaattcctaaaaattaaaatcaattttgcctattcaaaagcagcaaaattgcttttaaattaacacttctgtgagcaccattgtagtttataaattaaaaaaaaattcgaattcttaaatttttgggggttttctaaattttaaaataaaaatgtagctgagatgcaagcaaaaaaacggtaatcgttcacatcattggtcccataaaaaaaggcaaaaaaggtcgtttttttcgattctaagaagtgctcgggggttatcaggggcgctgatcactaatctgacatcagattgtcatataaatcatctaatctatgatttttcgtcaaaaatttttttgatggatttcccttttttaccgttgttcatccactaaaaaatctttcatccaatatactgttttgtttataccttttatgtacttgaatatgcataaaattaatcgacaacataaaatttgtcgaaaatgttttcatgtgaaagttggatttttgacttgtgtcattcgtctcgaacaactattccagctacatacatattgatggaatttattgttgtgaatgaattacagtaaaagtgaaaatccatcaaaaaatttttttgacgttatcacttgatgaaaaatcatagattagatgatttatatgataatctgatgtcagattcgtgatcagcgccatcgataacccccgagcacttcttagaatcgaaaaaacgacctttttatgggaccaatgatgtgaacgattaccaaagtgtgcccttccttctgtttcaattcatgggataacactggtacaaaaatgacgagaagagcttgcaaaattcataaacaaggtacagaaacttttgatctctaaggaccgaaaaattttcaaaaatttcattttttggggtttttcaaaaatattaataaaaaatgtaactttttaaaaaatggaaaatatgtccaaaaattaaaaattttctatttttactcagattcttcaaaattaataaattttagctatatttttgcatttagctattttcgagatttttagcttaaatttaacgaatttgaagaatttgtgaaaatgttgcccaatttggaaaaatttatgtgcatattttttactttttatgtgcatattttgaaaatagtctcacaaatcagtgtcaatgaaaatatttaaattgaattattttaaagctattttttaattgaatattaataataattttaaaattcgaggttcaacttttcttcaatgttttttaaatgctagcttcgtaccattaataaatgcagaataattttgagtggaaaaagaatagggatgatggaaaatttatggggaaatgcatgaaatttatggggaaacgaatgaagaacttaaatttacgaaaatattgggtgaaatttcagtagaaaattagtagatttgtcttttttctaaaattgaaaatccactagtaagcttacttgcaaatcaatttgatgggttcatgatttgaaatttaaatttttcgtttccatgtaatttttttttggtcggagatggaatgcttttatctcttttttattttatttttttaaataatcgtctaattaatttattattttgacaccgatttgaattgtataattaaaattaaatatttttcatttttggcacatattttagccttttttgagttttagcacatattttggggatttttggcgcatatatatgtacagatttggcgttttttagcacatataaatccgttccctgctaattagataatttttatggcattttgtgccttttttcaagaaaataaccattttaaaaatttatttacatattttttgtacatatttttggcagccctactaatatgaatgatgctttttggcaaaagatcagtccgcggaagagtgtgtccaagtgtggcacccgtgcgaccgactggtggaacgacattcagtgtgaccgtgccaacctcgccggcgttgtgtgccaaaagaatgccgtctatagttttcagcagaaaaacagaagaaatcactanaatgattttacacaaattttttgatcggctgaattttgagttaaaatgaattcgcccagagaaagtgccgaaacaatgagtga

SEQ ID NO: 24179 - DNA, 1609 bp, Heterodera glycines
gtttcattacaaaacttgaagtaattcatttgcatcggtcggaaagaacgatcacttaagccataaaatgaacatagatcaaatgaagatctataacaaatctgatcttaaatttcgtgatcactctcgatctcgaataaaacaatagatatgttccactacaagtttttcataatttcgaaatggcttttgatcacaaatgtttttgcagtctgtgacggtgctcatgccgcgcccgcgtgcctccctcggcaccgccgccgcaatgccccttcatcagcagcagaaaatgccacagcaggaacgagcggtgcccgcgggcggcgattgggaaggcaccggcgcacagcaacaaacaacaaccgccttttgctttgtgccgttgaaacggaacagcggcggcggcaccagtcaaagtgagggagaaatggcggcggcagaaagaaaaatgccaatataaacattattaagcatattctgataattgggctaacaatttaagttaaaatgtcattattttggcgttttgcaattcttatttgcattaaaaaaaatttatttgatattttgtgacaagaaaattaaaaaagaaaagaaaaaaatcattttaaaaatcaatttatacaataaatatattaataatattctaaaaattaaggcaaatcaaacaccatcagcgaccagcacaacaacagcagcagcggcagcaaagatgggcaacaacaaccgccgtcggcgccaccaaaacaattgttgctggcatcgccgccgccgccgctgttgggccaaagcggtggaggcacatcgcacgcgacgacaacggcggcgacgacgacgacggcaccagcgtcaacggcacctgccgcggccaccacaacggttactgttggtgctgttacggcgacatcgacgacgacggcaccaccgaccaaagcgacgctcgccgccatgctgaccgcgtgccggggagtgcggcgcaacttgaaacagctgcagcaggtggtcgtcgtcatgcacacgcacgggggggggggcggtgcctctgctgatttttggcattttgcgattacaatgctcttaatttttttgcgcgatagccttgggctttttacaaaaatgacttccgagcttttagagctccctgtttacaaacgtaagctccaaagcagaattcgaacaaaaagtcggaaattaaaaattggaaaaatgaaaatattagttttctaaccttatatttgtttgaaaacttggatttttgaaaatatttctttaaatatataaaaaataggaattattctttgaaagaatttttttgaaaaatctgaatattaaaattatttttaactttgtattggtagaaaattaaaaatgcaactgataggccttaaggaagcagagtgtgggagagaatgggataaaggcctgggaggatctctgaagggtcccgtagctcagtcggtttgagcattctttggtatgggaagggcgtgggttcgagtcccactgggcgagaaaccttttattttctattcaatattgcccaaatcgactggggatgttttttttttacaatttttcaacaactccatgtttattaggttcgcactcc

SEQ ID NO: 24180 - DNA, 1849 bp, Heterodera glycines
aattctcaagaatttgggctcaacccccccccccccccccctcctttgaatgcagaatttcattttgcaggccaatgtcgcccaacatccgccgatggtccaaccaccgcagcaccgtccccccgcttcccatccgatgctttcgcataaactcgaatttccctcgcccacccacgcgtcgcctgcgtccgttgtgcatgtcgttacgcaccatcagccccaattcttcggtccgtcgcacaataacagtctgaacgccaatccgatgaacaacgggacgactccgccagccattttcgacttccaaacgcaacagtttcgggaattcgatttcatgaacagtccggaagacccgatgccgtccagcgagtcgggcggatatggcggcgatggcacagcatatggtcgcgtgccaatgggtggctatcatcaccaccatcagttgcacgcgcatttgcacggaggggagcacatagcgtacgcggaaggggacggatgcgcagtgaacgaagtgacggcagtgcagcaccaccaacggcattatggtgaggggagggtgaagtgctgctgcttaactttcgtttcattaagcctatcagcagcagtgcccttgcaaagagtgttttgccgcgtgccgtcctccgcccccaccggtgactcatccgccgtaccctccgccgccgctgccgtcctccgctgctgcggttgaccaggcaaatgcgcaacactacgcaatgtgcacttatgacaacagcagaaaaggaatggccagtggctgctgtcagcgagccgaagcagtacaacaaaaccagcaacaacagcagcaacaacaaagacagcagcagcatttgtatgaggctccaatggcagtgcaacaaacgcagcagcaacactttagggaggagcagcacggacaacaccagcacgtgcttgtccagcatcacccacagcagcatcagcaacctccgcactttcaccctcagctgcagcaacaaatgcaagcagtacaccacggggaaatggaaattgggcatgggaatggcggtgccatgcatcaggtggacagaaacggcaccaccatgaccttttatgtatccttttaaggttgttcatcatggtcatcccaatgaaaatgaagcgcaaagagtggggccgccctccggcggacatttgtctgctggaatgctggaggacattgagctggacgaagtgagcagcacgtttagcgacttgaaaatgagcggaggaagagagggagacggagcaggaggaggaacaagcagatgagaaaaagggcgaaggagagagataaggacgaatggagaggaagaaaaaggaagagggagaagaagagagaaaggaaagggaggaaaaagtggaagaggaagtgaaaaaaggaggaggaagagccccaaaggaagtggaattagagacacaaatggaagagaaagtgaaaaaggaaagagaagagtcaaaaatgatggaaaatggaagagaaatgagaagaaattgagcagacagaggacaactgaatggtctttcaacatttatgcttatttgttgttgttgttaagctgagctgatgggccaatagcgaacacttgaccatttgttaatcatttcgggtttttgtacaattcgtcggtttttctgctggtgttcatttcattagcgattggccccccttttgctccgacgatcccccccccccccacatcccctttgatcatttattattgtccaatcattccctccctccctattccatagtactctaattgcccactcacctttcacattttcacctagaagatatcgcaatttcaccccccccccccccaccaattag

SEQ ID NO: 24181 - DNA, 1698 bp, Heterodera glycines
  misc_feature (285)..(285): n is a, c, g, or t
ttgttatcatttataagcggtattcgtcctctctgagcctgccaaatttcgaaaaattttgtaaaagttccataaaattctgtccagaacgactcaaaaatccagattttatacctttatggacataaatgtgttcaaaattgacgaattttttaggaaatttgcatgttaatagagcatctgaagggctttaagaatgatgtcaataatgtgttcgattaggatgacgaagaaaaaagggtagtttccctttatatgacggcaagctctcaatatatgctctcnccaaaatacctgtgccaaagtgggcggttccccaagataatttccgaaaattgtattttttaaattttttggacaaaaataaataatatattcatgtagcacagcagatcgactcctccctttgttcggtgtcatgacaactcgtaattgaaacggtgtgtataacaaaattaagtgtgtacaaaacattagatgaatgtttttttgctcttaagcgttccaaaatgatggtttgttggtgttaaacgtgggaaatttcaatgataggtatacaaaaagattagtggggaaggttggatagaaaagttgcttttgcaattgttagggtctccaattctcagcgtaattttaaaaatttgccatattccaatattaaaaaatgtgtgcataaaacattataggaacgttttgtttgctcttaagcattcgcaatcaatagaaaatgaatgaatggtttgtttggtgttcgaaggtcaaatgcatttggaaggaggggaagggcaaaggttgaagagaatggtggcgggaaatgggaccgcttttttcccctctccgttatcatttgaaatcagacattcttataatatttattgtatcaatcagcattttaaaataaacatgtcaaaattatggtcggtcacgatcaaattaaataaggtaactgttttttgctcttcttatcacaaccctccggcccattcttcggtgtcgtttactggccacacttgcagtcggcgccgcacttgcaattctcacaaacgcacttctctaaaaaaacaaattatgtgatgcgaaaattaaatttttggggaggggggatttcgaaattcgattgttcagcagttttatttgtctcactgaaagaaaaacacgcgaaaagcctactcctattaataaatggaaggagagataagctaactcgatccgtgccattcattcccttaccgtttgcgcagttgctcgcctccttcgcaccgcatttgcagtcagtgccgcactggcacgcgtctccacaggggcatttcactaaatatgaaaattgtctgactgtttgttactcggcctatcgaaaagaaaggcacaaaaataatacaatccttcctttatatattaataatttttaaaaaaaacaccgaccattgccacacttcggaacgggctgttgctgctgcatttgaatgaagtctcacaatcagttttgaaaaatttaaaatttagctaaattttaaaggagtaatttattgttgctacatatatacaaatgtgtgaatagtgatgcccttaagaatggggctgctaatgttaatgtacacaaagatttttctgagttatttaaagaagaatggaggaataattgtcgatggattagaaatgaacgaatgaaaaaacattttgcggattaaggaaagggga

SEQ ID NO: 24182 - DNA, 767 bp, Heterodera glycines
gggacctctcctggaagggagggcaatttggtctcgccaatttttgttactgctccaactcgtccctttccaactcactctgaagcaataactcgtttcttccccgtcccaaatggtccgtggcaaaggaaatttccttctgattcggtattttcccactgctcccaattcgcgtccccgaatcttttctgccttaattataggaagcaataatgcccttctttggtcggatttgaatccctttcgattggcctttcgtctaattccctttctttttgtacttttttacctcgctgtaatgcgcgtgcatccaaagctcctaaacttttaaaatttgaatgtcaattaaaattgtttctttgccccattccaacgacctggagttcggcatggttttctggggaaaaattgtgcgactggagaatggcatacaattctttgaaattgtgccggtgaaaagaaataaccgcctgagctttgagcactccctcactgaagcgatattcgtccaccgggggaatggtccataaaaattgtgcctttgggcagtgattagaagtgccaaagtgtctaattgtgccaatgtcccaccagtcggtcgaacaaattgtgtcgttgcagaatttcgcacagaacgcccacctgttcgacagagaatgaaaagtcggaggaggaggactgttgggagggaacggcactgaaaaggcgggagagatttgggagattcagaaaatgggacaatggcgaagggtgtccgggctgacctg

SEQ ID NO: 24183 - DNA, 2032 bp, Heterodera glycines
cttcttccttctttaacgtctcctctttgtctctttcctctcaaaagtttcctttcttctgtgtctcctcactgtctcccttctcttcttccttctttaacgtctcctctttgtctcttttctcttcctcttttcctttcttctgtgtctcctcactgtctctcttctcttcttccttctttaacgtctcctctttgtctcttttctcttcctcttttcctttcttccctgtctcctcactgtctctcttctcttcttccttctttaacgtctcctctttgtctcttttctcttcctcttttcctttcttccctgtctcctcactgtctgtcttttttccctctctttctcttgcttcttcatctgcctttttctcttcctcgttttctctcttcctcgtttcctcattgttttttttctgtttgtcctcttccagcttactcttcccctctccctctccctccctttcttttttcccttttctttcattgttgctcttttcttcatcaccctctctatttatctcttccttcacgtccctcttcccctcctctttttttatggcctcctctttgtccttcttttcttcttctgtctttttctcatcccttttgtccttgttatctttccctttgtctttctttctttcttcctcattctctcccctttcttccttctgctcttcctttctctttttcttttcctcttcctttttctcttccttcttgagcgtttccttcttcgtctcctcctcctccttttcttcctttaccttttcacttgccaaattgcttgagtttactgcttcctctttgccctctgccttcttttccttttcttcctccttcaactttcttcttactttattttcctcctcatttcccgcattcattttcatctcttccaactctttccgtgttaacttttctttcagtgccgctcttcctcccttctcttcctcatcagaaacgaaaccatgttcgttcttccactttttcaactcgtccatctcgaaatggtctttcttctcttcccggtgctttttcatcttctcttcctctgctttcttttcgtcatggtgtctcttccttccctcctctttctcttcatcttttttctcctcccggttccctttctcttctttcttttcgtccctctgctttttcctcccccccacttccgtctcctctttatgttccgtccctactctttcttcttccgtcttccgcttcttctcctccttttctgcgctctttttcgcttcattctgttcatcctttttcgtccgaatttcctccttttcggaccttcctccggatgatggtaccgcttcttcttcctctgatgatgtttccgaaatccgcatgtccctctccgattccgtcgtcccctgccttttcgcttcctttttcgcctcgttcttcgctttcttctcgctctgttcgtcttccgctgttcctgtctctgttaacaccactctctcctcattcgcctccttctcttccttttccttcttttcctcttctttacactttttaactactcctttctttgtttccttttctgcctttttcacttcctccatttctgcttcttttccctttcctgtctctttttcccctttctcttttagtttcatttcagattccctttgtctctcattctccctctttgcttctttgggttctcttttctcttcttttaattttttctgttcactttctccatcagtttccgtcgcttcttttgtttcctctttttctttcttcgcctcctttttctcttctctctcattttccctttctttctctcccttctctgcttttggccccctctttttctctttgactgatatgtctctcttctcttcctgctccttcttcttctctctatcctttgcctctacgtctttctcgccttcccttttctcgttctttactttttcctccttaggctccttcttttcctcttcgctcctttccctccccttcagaagatctttctctctgtcatcctctttattttctttttc

SEQ ID NO: 24184 - DNA, 1712 bp, Heterodera glycines
tgtgccttgttgtgctgaagcacgggcgtgctgtcgtcggcctcctccgactgttccgccgcccgggcgttttccgtcgccattcccttcgacggacttttgctgtgtgctgcttggagttgtacggcgggccgtctctgctgtttgtccgttgtcgccgcattggcaacaaagtccaaagtcaaatcgatgagaccgttgcggaaaatggcatgtttagagaacaaaggcttggcacattgggcgaccagcacctgaaaatgcaaatcattcgcaatccgagacgtatccataaatgaggttttttcgtattcatatgttactcgacacagaatttgtgtgtttatatgaattttaaatttgttgtcttcataaatttatgccatttatgctggagtaaagtctaaaaaactagttctataaagatggtatgaatcgaaagaatcagaataaaagattgtctcattgtccgatgcagttattttttgggaaaatagcggacggaagaatgttttaaatataagacatttcactcaccggctcaattgtgttgcccacctcccaaacggtgaagtgcaaaatggcgtcacggctcagttccgagtagcacaccggcagtgtcagccattcgtcccatttttgaatgtcccgcgtcggtgcgttggccgaagcgtttgtttgctgacggaacgacgtctgaacacttcgaccaaccgtacggccattgcaatagacctaaaaagagcaaaaaatattccaaaaaatattcaaatgtattcagagggaaggaaggagactttcgatggggggggggggaatatggccactatccccagcccctttctaaaggcacttttgtaaatgggggccctttcaaaaccttttaattcattctttccctttttttcaaaacggtatctatcatgctttcatgatgatcgcttattatgtcaattattttgccattttgatttttgacaaaaaaaaacgtaaaaaaatcgctaaaatgtcccactacgtttatcttcttcaaaaatcacgaaatcagccccccccccccccctcaaggtatgcctagttggttcatctcttcaggagtaaggacttagtcgacccttttgttgtttaaaataattcacacaaacattgccaaaaattcaaatttcctgacaaaacaacaaataattttctgcagtagacttacgcccatgaaagtgttgggtttttatcaacaaattaagcattaataaaacgtacagtcagtcggacgaacatacaaccggatgggacggcaaaacggtgcacactgtcattggaaggcgaaggcaaatagccggacagagagaccaaccgaacgcggacgggcacatccaactcggagctgaataagtagcagaagtccttcctcatatgctaaccaaaaaaataagggaaataaaaagacgaagaatattaaaaacaaaacaacatcaaataggtagcagtgaatccaaagtttttgtttttgattcttaaaaaaacaaatcacattttggtaaactcttggaagggaaacattttccttttaatttcctcaatgagaaaagcacgaaaaagatatttatagcgcgaaaattcttcaaatcccggtcaatattgtgcaacagaaatggataaaaaatgaggcaattttggaagattcacacatttattgacaggtttttccaattttt

SEQ ID NO: 24185 - DNA, 1534 bp, Heterodera glycines
cccccctttggatggcattttgtcccccccctttcgatggcattttgtctcccctttcaatgacattttgtcccccttttcgatgggcattttgtcccccctttcgatggcattttgttccccccctttcgatgacattttgtccccctttcgatgacattttgtccccttttcaatggcattttgtcccccctttcgatgacattttgtccccctttcgatgacattttgtcctccttttcgatggcattttgtccccctttcgatgacattttgtcccccctttcgatgacattttgtcctccttttcgatggcattttgtccccctttcgatgacattttgtcccccctttcgatgacattttgtcccccctttcgattacattttgtcccccttttcgatgacattttgtcctcctttttgatggcattttgttccccgccctctcctctctttcgctggcttttccctccctttgcttttcctccgatcattccgttctttcttaggccgtttctgctggtgcattgcccattccgctgcgcttcttttttgtctgccctttgcttttgtttcgcgcccaaaaccacaattgctttggcctcttctcattcaggtctttcgttacctttttcatttggcactttccgaaaaaataattaattaattaattaattgcccttaaattcccttttgctcctttcattcgttttgtgccttttccctttttggctcattttgtccttcagcaaagtgcctacggcattgggctgttaattctcagtttggccgcgttgcctcggacggctcatttccttggcgatctgtcaaatgccccgctaaaagcgatcgctttttattcccttggcactttgatgaatttctttttggttagtctttaaaatgaaaaattgctgcattatttgggctgttgtttttgactttagttgtacatttattggcattggtattggcacgtcgaaactttgtggaattcggcacggaaattgcgacggggagagacattcacaggcagcacaatcaaaagaccaatccgacgatattcaccggcaacgattggaggaaaaatgccgttgttgggacaaaatccgatcagaaatggactgaccagcggagaggggacggaacggaagaaaatgccgaaggggagcggcagagagagctgggcaaatggagagacgataagagaagaaggaggaggaatggaaaagggggaggagcagcagagaaagaagcaacggacacatggcgaagaagggggggacaaaggagaggaaggggcacaaaggcacggacaaaggcagtggcggaagattggccatggggacgaagacggaaacggaagaaggcgcggaaaggacgaacacggaaacggaagaagaaacggaagggacgaagacgtaaacggaagaaggcacggaagggacgaacacggaaacggaagggacgaaggcggaaacggaagaaggaacagggcaatgaccgttccggcgagagagttgacagggaca

SEQ ID NO: 24186 - DNA, 1327 bp, Heterodera glycines
  misc_feature (1218)..(1218): n is a, c, g, or t
ttctgaggattttccccaaaagcctcaaaaatcctcttttttctcaaaaagccacaaaaatcctcaaatcctcattttccaaaaaaaaatcctcattgacctatcaaaaagccacaaaatgaggataaatcctcagatctgggagccctgtatatgtttatagtacctaagctcaaaaaggtcatgtggtgaattagctacgaagatttaagtctgatcagctctcttttattgagctatggatttattcaaaagcatcccgcccctctccttcctgaaacccgaaaaaaaattttttgaaattttcaaattatttatattctttaaaattcaattttcccccacggagccagtcggcactgctccggcttttcttttcgtctaaaaatatcataaaaaatttcgtatcgtcgacaagcaaaaaaggtcatcaacagggcgcggcgaaagtggctctcttgccgaaacgttgagagtctggctcggccatctgattaatttaatcatttttattattttttccaaatctattaatttatgttttgatatatttaagcagtgaattttttttttgttccaaattcctattttatttctccatcccatcgccctctttagctccgcttcatcccaactcatccgacgactctaatgcctccccttccgctggtgggtcgtccatttccgactttgtcgcgcagcttccgcccgcccctccgcttctcgtgcacattgcggtcccttttttgctaattgccgccacgtttgtcggtctgttcaactgcgctgtcgcgttcggcctgtactttgttttccgagctgttgcttcggactttggacgaagtgcattgtatacattacccagggatttcaagtgggtgctattgctgggcaaagagtcgagaatgaagcaaattagttcccggggataattattaatcactttcaagtagtctttgacctttccaagaaaattagatcaacacaaaataagggtccagggaggcgagttggtcaattctttatggcaaaatttgatagctgtaaattgaatgattgaatcatttcttgtgcttgacatgatcgaggtttactgatcggaaagctttaaagtggcctttcgctcagcaaatattatcaatttgtacattttttaaatttaatgaaacttttcgagccgtctgccaataggcgataattttgcaatttttaaacganaattataagaacattgatatattgtcaatttaattttttttcatcccctgcttacgttttgcatttgcttttgatcatcatcctcagagtgttttcactttcattttca

SEQ ID NO: 24187 - DNA, 1901 bp, Heterodera glycines
gagagcaatggccattctattctacagggaatttttaaatttattctctatgccagaaaaatggttatctcttttttgcgagaaattttgtaccatacaaatgttcccagcatgggcagaggggcgcggagagcaatggccattctattctacagggaatttttaaatttattctctatgccagaaaaatggttatctcttttttgtgagaaattttgtaccatacaaatgttcccagcatgggcagaggggcgcggagagcaatggccattctattctacagggaatttttaaatttattctctatgccagaaaaatggttatctcttttttgcgagaaattttgtaccatacaaatgttcccagcatgggcagaggggcgcggagagcaatggccattctattctacagggaatttttaaatttattctctatgccagaaaaatggttatctcttttttgcgagaaattttgtaccatacaaatgttcccagcatgggcagaggggcgcggagagcaatggccattctattctacagggaatttttaaatttattctctatgccagaaaaatggttatctcttttttgtgagaaattttgtaccatacaaatgttcccagcatgggcagaggggcgcggagagcaatggccattctattctacagggaatttttaaatttattctctatgccagaaaaatggttatctcttttttgcgagaaattttgtaccatacaaatgttcccagcatgggcagaggggcgcggagagcaatggccattctattctacagggaatttttggtactagtaaggtttgtatcccccttttgggtaaaattttttcaaaatttttttttcttttttattgtcgcaattgctttaaataacaaataaaaggagatttatgtgtttattgggtacaattcagcgatttgagaccacaaattataaaaaatatccggtcctccaaattgcttacgccacaaaaaatcagaaatgtatgtggaaaaaagtgatctgtgagtgccaaatctcgctttatgttcatgtttgaacttctgccacgtcgattcaattgtattcgtatgctggccagttccaaagcggttgattccggtctttaatccatttgtagctcatttcgttgccacagtcacaaaaacgagtggtgtgtagaagcttaagttctctgagccattcttcgaattctttgtctggtagagccaatactttgaataaatcgtcaagagtgaaatttttaagcttttccattaatctaaaaagcaattgcgacaataaaaaagaaaaaaaaattttgaaaaaattttacccaaaagggggatacaaaccttactagtaccgaattttttaatttattctctatgccagaaaaatggttatctcttttttgcgagaaattttgtaccatacaaatgttcccagcatgggcagaggggcgcggagagcaatggccattctattctacagggaatttttaaatttattctctatgccagaaaaatggttatctcttttttgcgagaaattttgtaccatacaaatgttcccagcatgggcagaggggcgcggagagcaatggccattctattcaacagggaatttttaaatttattctctatgccagaaaaatggctatctcttttttgtgagaaattttgtaccatacaaatgttcccagcatgggcagaggggcgcggagagcaatggccattctattctacagggaaatttttaatttattctctatgccagaaaaatggttatctcttttttgcgagaaattttgtaccatacaaattgtcccagcatgggcagaggggcgcggagagcaatggccattctattcctacaggaaatttttaatttattctctatg

SEQ ID NO: 24188 - DNA, 1563 bp, Heterodera glycines
aattaattactaattagtttttacattactttccccccccccccttacaattagcattgggatccggagaattttctggctggggccaccaatgggcaccacgagcagaggcagcccgagcacggacaacagcggctcgccgggcggccgtccccggcaattcgtccgagcgacggcggaagacggggagggggaggatgaggacgaagggaccgatcactgatcagcggagaggcgccagaggcactgtgatcggcagcggatgagtgaggaaaagggaagggatgaaagagcgatggatgttgggatggctctgatcatcaatcactcactcactctttccccggggggccaatgtttcgccgtctttccgtttggcatttgtttctgtgtgttccctctccccattctctgccactttctctctgcctctgctctctttctttgcctcctcccatctcacaatggtttctcgatgtcacttattattagggcccggatttttatgtttttacatattttttttgcggcttagttatggcgagagaagcccaaaaatagcattatctccgaacaatttttgatttagagcgacttataaaaacataaaaacacatattttggcgttttgtcacataaaatatgttagcacatattttggagtttggcacatattttgcacatattttggcatttttgagaaaaattgcaataaaaatacaagaaaattgaaaaatacaccccctaaaaatcgacttttttcctaattattaacataattttcaaattaaaaaattttttcttcgattgtagaaactaatgaaatctcgaattcattaattcgtcattggatttcgaagttctctgctggaactttcaatttatagaaatgatttatcaaaaaaagacaattttaccccaaacacttcgaaatgtatttgatttgcgttgtatgggctaaaaatgataaagaatgagatttttgggaatttttatgcaaaaacacacttattttttcaatttttaacacatattttagcacatattttggcatttttgggggtttttagcacatatttcagcattttttagcacatattttattacatatttcaggatttttagcacataaaaatccgggccctacttttataattctctcccattgattgatctctccttttttttttggcttttccaatcattttttcggatgactctaaatttatttattaaattaaatattttcattactttatgtttatataaatacatttgattacacaaaccgtctaattttggtaacgctttcgacgtgggtgtgatgggttttgctgtccctccccgaattttgcttaatttccctgccttttcaaatccatatggcaaacaaaagcaaaattaggcgcgagggggggggcggcaaaaatttggccaatttttgacctatgcaatggcaaattgggtcggaggaggagaacacatttccattatttctatttttttggctgtttttgtttaggagggaaagcacaaaatgttgtttctttcaaatcactcttc

SEQ ID NO: 24189 - DNA, 1465 bp, Heterodera glycines
atcactctctcatgtaatcagagagagtctaaagccctccaatatatggacaaaaaacccccaaaaatgtcatatatgtaaaaatcatgaaggtatcattatctattatttatctataaggaggatatttttaggggctattatttagctaaaatatattaatattaagtactaaggacacccatgatagatgctataaatgttaaaatatcagctaaaatacccatttttaattatgtaattgcaaatttgttcattgcaaagcaaaaaatataatgacaatttttaaatccatcatcctacgtaattatatcttgtaattaatattgaagatgatttattagtagatccatccttctcgtcgcgatcatctcgccgcgtcatattctctatgaaagaggggctttataaataatattaaataaattagtaaattcaatgtaaaaaataaaaaaatggttttagcaacgaaactcaaaacctatataacatatatataaaaattaaaataaaaaaatgatttattagtgagcaacacgcgtgcgcaatgataatgaataataacacaccggaggggaaaccattagtgttttgttattgtttgcttaaaatgagcgagaaaaatgggggcagagaaagaaaaacagcagcatagagaacagagaaacaaaatttaaaaagagttagtaaaagacaaacagatagtggcgagagaaagtacatggattatgcggcagacaagctgacggagacgagagagtatggaaaatattcgacagacaagcagacggtgacgagaacatacgggaaattataaagcagagaagcagacggcggtgagagcgaatgggaaattgtgcggcagacaagcagacagtggggagaaagtacgggaagaatggagaaaaggacacgtacgcaaaagaggaagaagcatgagctggctttaccaaaactcaaatcaatgatcaaacgaagcgtggcagagaaaaataaatgacttttaaaaaatgtattattatgtttccagaaaattatggccagaagaattgaaaagaagaagaaaaatgcttttttgacaacactctcaccaaatttgggatggtaaatgcgttattagtgctgtccttgaccaaaaatttcccgagactcgagaccgagacccaaaaccccgagaccgagaccaaaaaaagccaaatccaacaaacttggtgcatattcgagagcccttcacatgctctattagcctgcaaaattccaaaaaattttgttaagtttaaaaaaagtttgagccaaaaagagttggaaaaatctggtttttgaataattcttctagccataaattttcttgaacattaacgaaatttttcaaaatttagcaggctaatagaggacacttaggtatatcgaatgatccaaataatgttggatttggttggcaaaggaaaaagttatagccagaaac

SEQ ID NO: 24190 - DNA, 1564 bp, Heterodera glycines
ttcttcatggttaaatctaaaataatcaattaaaagcaattgatgaattcagggaatggcctttgcccgtacaaattgccgaaatccgacccaattcatcattaaattggaatgcatgggatgagcaaaaacatttgttgtcccaatacggtagcggtgcgtacagtaaacttatgataccggtgatcactcccggcttcacggaaagtaatagtacatatctattaaattggcacacagcaaaaatcatcaaaaatgcacttgacgacggtatttatttttttaattatttaaataatttctaaattttgtaaaagttttatttaattatctttaaataaaatactttaatttaattgtttatcatgtttatttacatatttaaaatattaaaataatttccaattctatgcttttcctatttttagcatttaaattgtttcattcttcaaaaagtggaaatgaaaaattgtctatgctctttgaacaacaaataaaattccacgaaaaggtatattggtaattataaaattggggacaataattaattaggtaaataccgtatcctataaattacagtattcacaatattttgcgatcacttgtgtcgcatccgattcaaatatgtttaacgaattttgcggatttgttgttacacgcatacgcattcaacttactcgcctcaccgactgcaggcgtgattatgttgatttttgtcacgtgcttttgttaaatggctgtccaccgtatactgcacaaaaatacacaaaaatgtacggtagtgggaggttatggcgttgtgttattaaagaacaaataagctaaagttgatttttcccaaaattaaatcattccgataatgcagtttaatcttttttaaatttggaatttttggatgcacctcggaaatcgcgaatatacggtagtaggttattattaaaatatgaatttatttagctatagtttttgccaaattaaatcattccgaaaatgcagtttggtcatttagaaattttgaattttttaaacacattggaaaagccgagactaattaccgagtctcaggatagattcattttgtataatccgcccaataaaagaaattcggaatattaaatgtctgttttaaaactttggagaaaattctttaataaaactaagaactatatttagcaggtgtccccaaattaattttatattttgcatttttcccatttagttcatcaaaaattttctacaaaacttggcttgtcagtgtcaaaatgaagaataacacccaaattcaaagccaaaaaagcaatgtcggaggacagttacagtttgaatttgacggaacaaaaaattcaaaaacatttcgccagaaacaatataaacaagggacggatgagaccgataatcaacgtgattttgtcaatttagaatctgaatacattggcaaacagatagtagatgacttaatttaatttaacatttatgtcgtatttatttttggatttttaaattatcgaattattattagcgaaaatgatgtaactatttttttgaaacattgaaaataatgatt

SEQ ID NO: 24191 - DNA, 1475 bp, Heterodera glycines
agttcggcctgtattcaatctcaagtgataatcacccttgatggaattaatttagttttttgttgcttttaccccgcatgatttgttcacattccgcttccattgctgctttacgagctttgtgtccgcactcggttttagtgtcgcgttctgttgtatgcgtggattcaatgacaaaagtgactaaattatcaattttaatattttatttggataaaaaattttaatttcattttcatttagaaaaatattgggtggcagtgggaccgacgaccagtaaaaaaagttgtttttttaaaatttatttatttatttattaagaaaagtgattggatgaaaaaacatttgaaattttactgaaatttcaaaaaaaaaaaattattttattccatcaaataaaaagagaaaatgaatggagaatggttaaagaaggaaacaaagaatttttaaattttatagtttctttcattcacctcaatatcgtgcgaatcttttgtatattctccgtgcatttattatttaatatatttagttaaaaaattaaataaaaataaatattagaaaaatgtaaagaaatatgtttgtacgatgaactgaaaggattgcaataaaatctgataaaattggtaatcgattgggcccactaaaccctcatcactcaccacacacaattaatatcattttttacgtcacatcaaggtcataaggaatggtgcgtcatttatttatttattttttacacaaattaattattagggacaaaatcaatttgattatcaaattttgtgctttttatgtctatttcttatctgatatataataacattttactcaactaattgttgtttcaattttttaagtgcatttagtgttcggtggattaaaggaatttaaatcaatgaatttttaatataattagtagggatgccaaaaaaatggatataaaatcgcaaaatatggaccaaaaatcgcgaaatatggacataaaatggcaaaaatctcaaaatatggacataaatttttcaaaattgagtgcaaaatttcttcaaatttattggttgaaattgcatatgagatacatttccaaattttttgactcggtaaggcgctttgacaaagacggctttcgttttggcaattagtcggtcaacattcggaaattggtctcgaattttttcggcaattctgtgcaatcattttataagaaaaaaaaacatgaaagctaaaatttattaatttttttagcgcaaaatcaacaacaaaagcgaaattttcgcttttttgcttatttttgacataaatttattaatttttaagaaaatttaaatttattcaatattctcgagaaattttggcgaaaaaatgattttttttgaaaaatttttcggtttttgggctcaaaaaggctaatttagctgctgggggcccttctcatagaggtttatggaaaaatgctaaaatatggaaataaaata

SEQ ID NO: 24192 - DNA, 759 bp, Heterodera glycines
  misc_feature (739)..(739): n is a, c, g, or t
agaactcattttagcgaaggtgtaaaggtggccttcgtcattacaattttactttttgttttttggttgcaattgggttagccatttctggaaaatgtccaaatcagaatgtacatcaaattggttaactattaaaaaataataggatttggaataagtaaaattgtaaaaaatgagcgaatgttaattaaacctaacttatgccaagtggcgagggatccctcaggcttagttttaagaatcttaatttttaaaaaagcacatttttctatttttgggttggggcccaaacgaccccggggcccaaaaacgggggcccaaacgctctggtcccattgccaatgtccttgattttcaatgttggaccgctgcttgccataaattcactgaaaatatatgtgcgattgatttacatataaaaaatgatagactaattattaattaagctatcaaaattttggttgccttttaaatatttatttttatatttttaaatttaaaaaaatgaaattacagtgcagcaaattgggtcacttcacgaaaagcacagtttccattcatttggatagttatactgataactttttcgtcaacaacaaaaaattcgtcaaagatttccatgctttaaatgtatttctgttgaaaaaattgaaaatatttttattaaatgcaaaaaaaaaaaaaaaaattagaatgatggaaatgctgcggggtgacacaacagaatcaatatttttanagtcagcagaaaattgttgc

SEQ ID NO: 24193 - DNA, 1752 bp, Heterodera glycines
  misc_feature (55)..(55): n is a, c, g, or t
  misc_feature (60)..(60): n is a, c, g, or t
  misc_feature (62)..(62): n is a, c, g, or t
  misc_feature (67)..(68): n is a, c, g, or t
  misc_feature (77)..(77): n is a, c, g, or t
  misc_feature (100)..(100): n is a, c, g, or t
  misc_feature (109)..(109): n is a, c, g, or t
  misc_feature (113)..(113): n is a, c, g, or t
  misc_feature (116)..(117): n is a, c, g, or t
  misc_feature (119)..(119): n is a, c, g, or t
  misc_feature (124)..(124): n is a, c, g, or t
  misc_feature (131)..(131): n is a, c, g, or t
  misc_feature (134)..(134): n is a, c, g, or t
  misc_feature (146)..(146): n is a, c, g, or t
  misc_feature (165)..(165): n is a, c, g, or t
  misc_feature (170)..(170): n is a, c, g, or t
  misc_feature (172)..(173): n is a, c, g, or t
  misc_feature (181)..(181): n is a, c, g, or t
  misc_feature (189)..(189): n is a, c, g, or t
  misc_feature (192)..(192): n is a, c, g, or t
  misc_feature (210)..(210): n is a, c, g, or t
  misc_feature (213)..(213): n is a, c, g, or t
  misc_feature (218)..(219): n is a, c, g, or t
  misc_feature (225)..(225): n is a, c, g, or t
  misc_feature (230)..(230): n is a, c, g, or t
  misc_feature (234)..(234): n is a, c, g, or t
  misc_feature (238)..(238): n is a, c, g, or t
  misc_feature (242)..(243): n is a, c, g, or t
  misc_feature (245)..(245): n is a, c, g, or t
  misc_feature (252)..(252): n is a, c, g, or t
  misc_feature (256)..(256): n is a, c, g, or t
  misc_feature (258)..(258): n is a, c, g, or t
  misc_feature (260)..(260): n is a, c, g, or t
  misc_feature (264)..(264): n is a, c, g, or t
  misc_feature (270)..(270): n is a, c, g, or t
  misc_feature (278)..(278): n is a, c, g, or t
  misc_feature (282)..(282): n is a, c, g, or t
  misc_feature (284)..(284): n is a, c, g, or t
  misc_feature (287)..(287): n is a, c, g, or t
  misc_feature (290)..(290): n is a, c, g, or t
  misc_feature (309)..(309): n is a, c, g, or t
  misc_feature (326)..(326): n is a, c, g, or t
  misc_feature (330)..(330): n is a, c, g, or t
  misc_feature (341)..(341): n is a, c, g, or t
  misc_feature (344)..(344): n is a, c, g, or t
acaactaagccttgatcctcctcttgctcgtccttaatctacctagggcgaaggngaagnantgggnnagatgaggngtccttgtgaattattaaatagncgtatgggngagnggnngntttgngataggngtnaagaaagaagtngagttgactcgggaaaagntgtangnnaatgttanggatgganaanagtgagttgggtggtcgnatnagtannaggtantgggngganaggngggnnantttgatntttngntnaaanaaattntgggtgangaananganagnaaattggtggtggtgggantttttggtgaataagtngganaaatagtggtnatnaatggacagcatcaagtcgtctaggatcagcaaaagaggctttggcatgcgtttgagcagctcttcaggaggaacacccgaataaacatcaacccccgatttttggagaatgggcacagcgggattcatttcaccaaaacagtaaagtgttgacacgggttttggcataattaattcatcggactcggcaacaaatttcaataggaattgggttttaccagaggaggagggaccggaaatgattagtccaaatggtagtttaaagcaaatgtctttattggagaatgaattaaacattataggttaacaaattaattctgaaaattaaattgtataaaacaatttatatagacaaattgttcgtcgctgcgttgacgctctcaaaaaattcgtcaagtgtcttgtcaatgtctcctagattctgtacctcttcggctgacttcttcattccgttggttttgccttttggagtcggttgctttcttttgagcggcgcctgctgcattgaagtgtccatcatcgtggtggccgcagaaatgctatcgtagaattgttgctcatcactttccatttttgatgatggtgggagtgttggcggaagtgggggcgttttcattttttcgagtggcggaagtggaagtgattcaattttttcggctggcgggagcgggagctccgcagtcttcttttccggaagtgaatcggccagcagcatgtttccaagaacgctgagtgcagttttggccttcttccaacgttgtccctcctcatgcagtgcatcgccagtcaagccggcatcaatcagatcgagtgcaacttttgccttccgctttagctcagccttctgcacttcatcttcacgcaacgaatcagccaacagtccactctccaccaagtccagcgccgtgttggccttttgtcgcaagtcgttctgctgctgctgctgcagcagttgttgctgttccatcagtgcttcttggtttgggtatgtgacggccggcaagtccccgtaggggatgttgaacacgcgtgccttgttctttacacggaagaaacagtggccgggcaagtcgtatatgatatcaaacgggacgaattgtactcgggcgattcgcgtacaccaaattgtgataccctctttggtgaccataatgtccacctccacttcagtccctttacaagacttgcatctgccgctctcatcaaatgggacaaaacggggagaggagaggcgaggaccgctaatcgttaggccactagtcgttactgttatgtcggcttctcccagaatttggttgagaagaccacgcttgtcctgcaggttgatagccatatttttttagaaatgattgtggaaattcttcaagtaaaggtgccgaaccaaaatttcaccgctatttatagggaa

SEQ ID NO: 24194 - DNA, 1997 bp, Heterodera glycines
ttttttgcttccataattttatgcattaaaatgaatgaaaaatgactcatcagcagcaatatcagaacagattttgtcggatgcttttgatagaaacgaaaaatgtggacaaattgtgaaaacggtggaaattccattgatggaaaaagagataaaaaaaggaataaattaattttataaataagcgaacaaaaaatagtcgattaaaaaagattgtacaaataaatgaataaaaacaaaattaaattttgagaagtaaattgaaggtgtaaaagtgcagagagtgaagtgttaatgatcaaaaactatagaggaggcaaatgcccaaaaaaggcactcgctccgctgcccttccgtccgcttctcaaccaatgcgctagcgcgagtgccactgtcgaaaaacacaaaaaattgtgcccgccctgctggcactgcactcgctccgctgccactctgtccacccgctcatttgtccgttccgtgccactccgtttttgccgcactgtccgatacaatttgacttttgttgtgccaatgttggaactgttgttcaaaaagtttcggattgtgcacttaatccctttgtaattttcaaaaaaaaaaattatggtgcccattttaaactaattaatggagtgtttcttggatcatcttttcttttttattaatccgtttttgttcctttccatgccatttgccacaaattttttcaaatacaccaaatctgatcagaaaggcaatcaaatggcattaattcgaaaccaaaaaaaatgttcatatttgattttaaaaaagagagaagaagaataatacaaaatgacataattaagcattttaatgaattctttttttatttattgagacgaaaattttatcaatttgtggcattttagtgccaaaataactgctctcgataaaaaattctttcgggatttaattttaatgtatttccctcaaactctttttacattatctcttccactttctcttttcaataaaatgcatttaaaataaaactattctaattatatttcgcacaattagtacaaatattatcacaaataaaaatatttttcgcttctttttttttttgctcattataaaaaactcattagcaattcattttcattttctgtcggtcgtttagcgccaccgccaccgaccgaccaccaccaacgatggaattgtacaaccaaaaatgaatcatcccctggggggcttttatcgctatagttcggggttaccccccccccccccccatcccatcccatcctccgtcctgcttatctggtggctttggcttgtgggctgtgtgcggtgcggccgtgcgctgccgcccattggccgcgccgcttcggtccgcagggaccgcccatttttgtacggccgaccaacgcatttaagcgctgatcggccagcgaaaaatcattcactttcataaaaatttttgagctccaatcaaaaagcattcaattaaaatagggggagaaataggaaaagccaaaaaagaaaaaactttttttaaatgggacagcaattaaaaatattaaatgatttatacaattttagtgcatttattaaatttcatttgaattaattccttcgctttaacataattttttgttttagggattttatttattatttttttcaatttataatcccgacaaaactcttcaaatcaaccaaccgccttctcattcaacatgaacaagtgtttagcacttgtgtaagtgctaattggggacaaattcataattaaatgaggcaatttaaagtctcccataaattttgatcaatcaccatcagatttctaaatgctttcaattggtccaaatattataaataaactaattaattaaacgttattaatcgggaaatccttgatctaatttgactttctcccctctcatttagtgtgttggtagccctgatccgcgcaggggacagcgctgttctgcggcaacggagattgggcaaagcggtatacgcactga

SEQ ID NO: 24195 - DNA, 1347 bp, Heterodera glycines
ataaaatttaaaaaattgaattacagtgcagcaaattgggacacatcacgaaatgaacagcagcagttgtgattgctttggacagtgaattcattgatcgctttttcgtcaacaacaataaattcatcaaagatttccatgtttttatttatttctgttgaaaaagtcaaaaatatttttaattattatttagaaattggcaatggatatttatttagcgaatttgttcaaaaattgtcaaaattgtattttaatgaatggataaactgtagtgaatgccccgtgaaaaaagggtcaaatgatataccaatcgattcgtctcgaggagctaagcacggaaaaatatgtctcgagttgcggaaatgccaaaaaaccgggttttgaaccggtttaaaactcgaaaatttgagtgaaaaggggggttcctgaccttttaaaacgctcaaattcggataaatttggtatcattcgaaagctcttgatgagctaagtctaaaaaacaaggtataaattcgaaccaatgccatctaagcacttggacaactgagtcccagtgaaaatgcacagggatgggaataatttaaataaaaaaatatttttaattaaaaataaacggaaaattacaaataaatttgtgaaaaaataataatttaatgaaaattaaaaaatttggaccgccatggcattttcaagtgtaatgccggcaaaggctttggacaaggacctgaacaagtgatagtcacttgtgggccatatccggattatatgtacggcggatctggcaaaacatccccagcccaactcttataaatagggatgcaatttatagttttttcactattttttcctgagctccctatagcctgaaatgcacgaaaaacatgtttttaaggggattgttaagctagttttcgagttattagcaactattttatagttttttatttttagcaactaaaaactaaaaatttttgaaaaaaactattttcaactattttggcgttttgcccaaaatttgttaacaaaaatgcaataaaaagaaaaaatacacccctaagaatcgacttaaatttttttttttttttcaaaaaatacacccataaaaatcgacccgaaaattttcaaaaatgcaccccctaagaaatgaaaattttccaaaaatgcatctccaaaattaatttaattattttaatgacgataatttttgattttgaaaattatgtatctcattaatggtttggcataatatttttgctttttgaagaaaattttcgatttacaccccctaatttgaaagtttttagcaactatttacctatttttagcaactattttgggggtttttta

SEQ ID NO: 24196 - DNA, 1944 bp, Heterodera glycines
ccccccccacaaattaaaaaaaacaaaattttattttttagcggtttttcaaagttttaaaaaccaaaatttttttcaaactttcttttaaaaaatccgaaagtcccgccgtaaaaccaaatcctcgattatttttttgtgaattttgcttttgccatgccttgaatcgttgaatttgctgctggagtacgtgcatctcctgttggttctgcaacaacttctccgccacctgaaatttttaaacgcaattcattcttttggttttttatttaaacattgtctatttgttcaattttcattcaaaaacaataaaaatttaaagaaatttgtggttccaaagcggaactttgaatttttaaaaaacgggtttcttgtttttttaacccaaaactaaagtgctgcctgagaaacaaaaaaagtgggaaaattttgcttaaaatcattgcgttttaaggattttttgcatttttcaaaaaaaatctaaaggaatttacatcggaaaatgtcaccgaagaaaaattcataaaaaattgacttaaaagcaaaaaaggttaaccatttgccttccctggcccaaaaatttcatgaaaaatgaaaatatttgaaaaaataaaccgaaaaatgccatgcctatgcttctgtgccattggcccacctttgtcgggtcgcccaactgcgggttttggctgtacgccacgtgcatcctctgcatgcccgcctgggactggtccttgatgttcaggtcggcctccaactcctccagcttctgttggatttttcggcaccgctgctgcggtggcaaattgccgtactcactgccgccgccggggatggcaccgccgccatttgtgccgccgccgcccacactgtacggaccaccgccggaaccattgctctgcgggggaattttttttttggttttgaaaatagtaaaaaaaatttttgttttgtttaataaaaaatgcgccaaaaaaaagaatacgaaaaaatataaaaaattccacgtttgaattaaaattggacaattaaagtattatttagtaattaaacttaaaaatgaaaaaaaattgaaagccccgtaggggtctcgatcccctgaccttgagattaaaagtctcacgctctaccaactgagctaacgaggccacattgaaatgcaatatccaaatcgacaaattgtatataaaaaatatttttcaggacataaaattttatgttaccatcttctgttgcatgaaaacttcgtaaaattggaattttctcgttgaaatttgggtatcctctcaaaaaaaaatattccaaaaaaagttgccataaatgggtccggtttataataatggtgctgggacgttagtcaaaaagcatcaaatggaaaatttttgacagaaaattattcataattccgtttaagattgatcaaattttataatcttgatatttttcgatgccctaattgttttctactatcctgcaaaattttaaaaaattctttaagtttaaaaaaagttgtgacctgagaagctcaaagaaaaatttttttgaacattttcagtcataactttcttgaaacttaacgaaactttttgaaattttgtaggctaatagaaaacacttaggcctatctaatgatatcaagaattaaaaatttagttgcttttgagcaaagttatatcaaaaaatattttcatttgatggtttttgactaacgtcatagcaccctcataaactgcacttgagccaaagaggtgggctctttactcattaagaaacccacgcacagaaaaagaagaaaattataatgctgcacactcccaaactcgggtggccattaaacaatgttttggcatttttaaaaacccttgcagatgcatgatgtataaatgcagattatcgccaggtattttgttagttaaatagcactgctaaaaataacttttaagaaaa

SEQ ID NO: 24197 - DNA, 919 bp, Heterodera glycines
  misc_feature (821)..(821): n is a, c, g, or t
  misc_feature (842)..(842): n is a, c, g, or t
  misc_feature (892)..(892): n is a, c, g, or t
  misc_feature (907)..(907): n is a, c, g, or t
atttccccaaatcaacaacaatttgttggccgaacagctccaacccctcggcccccgttcaccgccatatttgtcccattttttggccccctctggccaattcatttccatgcgcacctcccccatttccatgtgctcatttgtcctgtcccaattgccctcgctcacatccccttgttgtactgctccaacttcatgtcctccaattttggcccattttcaccatttcaattgcgattttttgtgtgatcagccaatagggccatttgcattcacattttattttgtggcctttggccggatttttcctcccccatttgtccgcccattgtccactttttcggtttaattacccaagtttgagataaaatttggtgtgaattttcctctgcacttgccccccgtttgactcccggcacattcccgtcccactttctgcttcctctcccgtcaatttcaacgcccgaactcctcgggctttgtcgacaccaccgcggcgacctgcaccgcactcaacgtcaagcgcacacggcgaactccaagcagctcaaaggagctcaactcaatcaatcaatcaatcaacgggtggtgatcggacaagtggcgacctgggcagggacaaaccctcgacagcaccagcacaactgagcgacttcaagcagtattggaactgcaactggtgggaattttttgaggaaaattccaaaaagtatcaagtttgcgctctccgtaaccaaacttgaatacatcaaaaaggggggatcaaaagtgggaaaatgtggaatactgcttggtctccgtgccagcagtagtttcacggnggaaacagtgacttactactntggtcttcgtgccattagtatttcactttcaaattacttattggtctttngtgcataagtaatcngtaaaattactg

SEQ ID NO: 24198 - DNA, 1129 bp, Heterodera glycines
tttcgggtcatttcaaaatttttagctcatctcactgatattttgctttatctctctctatctcaaccaacaacaacaactcaatgtctgacaaccgtggtgcctccgttgcttcgaccggtacgaccaacagtcaggagtctcaagtggcgtctccagtgaaagccggaaaagctactacgaagacgacggctagcggaaagggcggcaaagcgaaggcggacggaaaagtgaaggcgggcggaaaaggggcgaagaaggcgggcggaaagggtggaaaagtgaagattgctgcgagcggatcgaagaacacgcgctctgctcgtgctggcgttgcatttcccgtcggacgtatccatcgtttgctgcgccacggtacagtttttggagagagaggattttcaatggaattttctgaatttcctaatcacaggtcgccatgctcagcgcattggggccggagcgcctgtctatatggcatcggtgttggaatacctggcggccgaagtgctcgagctggccggcaacgcggcgagggagaacaaaaagttgcgaatcaccccgcgccatttgcaattggctgtgcgcaacgacgaggagttgaacaaggtcagatgcagtcggtggtttttgcattttttgaaaatccattgaaattttcagcttctcgcggaggtcaccatttctcgtggcggtgtgttgcccaacattcacacggaacttttgtcgaagatgcagcagaagaagcagcagaacgacgacagtcagtgaacggtggaagaagaaacggacggatagaaaatgaatgatacgcattatctctcctctctagtgttgtcgattttatgatcttctaccgatttttccgatgattgaatattcctcttttctgatatcatttttggaggtctatcgattggtaattagtttggaagactctcgattttttcccggaaacggacaaattttttggtctcagggggacatttgagtcctgggtccataactcgtctggggacggttttagactgaaaatgccttagaggaaaattgtatagctttttaagctctatcgaacggcgttcttcattttccgaccttttcaaaaatttatcgagctaggccccct

SEQ ID NO: 24199 - DNA, 1207 bp, Heterodera glycines
acaatttatttcaaaaagccaaaaagtccggaaccaattttaaaaactaaaatagtgcacaaaaggggagccgccgcacggcggggcttaaaagcattgtacagcataattaaaaccgaaaataattttcgtatatttttcacaatttatttcaaaaagccaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtactgcataattaaaagctaaaataattttcgtatatttttcacaatttatttcaaaaagccaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtactgcataattaaaagctaaaataattttcgtatatttttcacaatttatttcaaaaagccaaaaagtccggaaccaattttaaaaactaaaatagtgcacaaaaggggagccgccgcacggcggggcttaaaagcattgtacagcataattaaaaccgaaaataattttcgtatatttttcacaatttatttcaaaagacaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtactgcataattaaaagctaaaataattttcgtatatttttcacaat

SEQ ID NO: 24200 - DNA, 1714 bp, Heterodera glycines
aaaatcaatgatttttgcaaatcttatatcagattcgtgatcagaagccccgaaaacgcccgggttggtcttttcatagcagaaaaaatttttttggtgagcccagattctccactattacccgcaaattagccaaatctgattcaattttacgcgcgcttcaaccactcttcaggcccaaccccccgccccccacaccagaaccaaggcaatttgtcttggtccgttcccccatgtttcgtcgtccattgttgttgtcccacctcttttgacaagaatcgcagcgactgcttctcctccaacatcgcaagcacttccttcgtcatttgcgctggcacatccaaaagttgtttctccgtcacatgtccatcagcaaccgacttggcttcattgtaggaagcgcgcagctcaaagcttgcgtcagccggcggcaaatgttcctgcatttttgaccccgattaacaacaaaaattgatgcggctctcggttgggcagaagaagtggacgaatttaaattttgatgatagccccgccccccccccccacccacccgcccattccccggccctaaacatgattcgaaatgtgacacgaaaaaatgggcttttcgagtgacaagtgagaattttgagttttcaatttttgttcgaattcggggggtcagggattcgaaatggccaatattaatatgcatgattctatagaaaaatttattatgtatcaaagttgtcaattttatggtcatgtgaactgcaatagagccggggggggagtaagtggccacgaccatcaacgaccgcaataaacgccttttttataaatccatttcaacagcatttaaatcagtgttttatttcactgcttaccccaaattttgtcacagttttaatctctgctttttgctgcaggtcgccgctgacaattggaaattcaacatatgtcacttccagtgcgctaacatttttaatcttaaagtggggtaaaaaagtttaaaaaattaaaatggcaaattttgtaaagcggctaaaaggatggatgaacgaacggaacggaacactcaccagggctggccattggacgccagatccgcgcttcacccaaataacatcaccaattaaaaactgtgtgctcattttgtgcaaaaaaagacaataaaaaaaattgaatgctttttcccttaatttagacaaattataattgtggtcgataattaacggaaaatcggtaatggaaaattttgatttaaaaaccagtatttctactgattggttatgaacaaaaaaaaatttttaatgacatccctgcagccatcacacaaaccgagtcagaagagagtttccgcgtaacgccgcggactaacaacaccattttgatgtgttctgctgggtggaaaaagaaatcgatttgggtaaaattacggaaaacaattgagaatgacggatagcagcgatgggaccaggtcgttttggcgccgaggttttggcccagggtcgttttggcgccgaggttttggcccagggtcgttttggcaccgaggttttggcccagggtcgttttggcgccgaggttttggcccagggtcgttttggcgccaagccagaaaaataaaaaatttttcgcgaaggtaatactgccgttggttgccccccttttttgaaaatttttttttgctttcaacagtcatttaaacatgcttccaatggtcttcagggtc

SEQ ID NO: 24201 - DNA, 936 bp, Heterodera glycines
gagcccgtcgtagtcatctggccaccgcaacaacactttgccgaccatctgattgcgacaacaaatgcacattgtcgtccgcacgtcggacacttcgccaagaaaaaagcggcaaaaattttcactgaaaattcatttaaaaattgttttctcttaaaaaattcctaaattttttatcctccgggcggaggttaccaatccattcccaaaaaagtttaaaaaacaaacgaattttagtcgtttttttttgctgaaaaatcctgaaaatcgggaaaataaaaatgcagaaaaattacgacaatttttgagcgaataaacattgggtgcttcatcattcgtccagttaatttcaattaaaaatgcccaatttggacccaaaatcagctaaaaaaacacatggactttttgaggcgcctcggggcataaaattttgcagcgaatttcaaaaaaaaaacgaacgagtgtttgctgtccgagtatttgcccgcttttcttggccgctgactgtacaccaattcgccgggcaaaagcatgtcccggttgtgcgcactccaacgccaaaaccacaaaatgtcccatttgttcaggtcggggcgtaaatcgtctaaaaaattttaattgtaaatggacgctatttcaaaaatttgtatttttaaaaattatttaaaagggtgggggcacccttttggtttacaaaattcaataatcaaaaagcgttttttttaaatatgccgaaaatgtataaaattggtggctgtacgtgtaaaaaaaccaaaaaattcaatggttggtcgaaagatgcatttttgacattgaaattacacagcgtttaaagcgaaaaaactgtcaaatttcgtaaatttggcgaggctaagggagtcttaattttagagcccggacgggcccggcgggcttttactgggcgtcccggtcccg

SEQ ID NO: 24202 - DNA, 1261 bp, Heterodera glycines
ttttttgcttataactttgctctaaaaagaccaaatttttaatccttgctatcattcaatagatctaaatgttctttatgagcctttaaaatttcaaaaaattttatcaagtttaaaaaaagttatggacaaaaatgttcgaaaatcaaggttttttgagttctcgagctataatgtttttaaaacttaacgaaattttttgaaattttgcagaatgatagagaacactcagggcttatcaaatgatatcaagaattaaaaatttggttgctttcgagcaaagttataaataatttttcgactaaaattttcataatgatggtttttaagtaacgacccagcacctttcaattccctcccccccccccccttaaatggattttgtagcataaaatgacaaaacgaaaaaatatagaccattttctggtccacaaaaataaagcattttgaatgtttggcattgtgttgccatcgctttctgtcccaattcacctttctcatgcatacaatgaatgatcacatcgaatccactcactttcacctgtgtttttgcatttgaaaattaaacatgcagagccttacatcaatctcttgcggtccgaattggtgcacgtccaattccacttggaacttttgctttttttgagtgatcggaactgacaaagcaaagtgaaataagccaaatgattaatcaaaatgaatttagaaaagccaattattggccgtgtcaaaactcacacgacgaagcgggcacgtgtttgaccgggatgatgctttgtccaaaagtggtgccgtgggtggccaacaccgccgggggaggcggcggttggcccgtcgctttgttgccggccgcggtgaccgtcagacgacttccggtcgcgctcaaatgggccttcaccgtgcccgggtcgacgcccagcggcaggcggtactgacggtgcaactcgcgcttgtccgtgtgttggccaactgtttgttggaaaatataaaaacgaaaaagtgcaagaattattagcaattgcaatgccatttgtgttgactgtaatgcccaggcatatggttacagtaccctttgactcgtgcgcacaatggacgaccacgtcatcaccggacactttcacgtcaatttcgttgggcgcgaattggtgcacgtccaactccacctcgaagtcggccttgttgctgggcgaggagaacaacgaagggccggtgactgaagcgaaatgtttattttcactatgcccattcaaaccatttccga

SEQ ID NO: 24203 - DNA, 1297 bp, Heterodera glycines
  misc_feature (499)..(499): n is a, c, g, or t
  misc_feature (1229)..(1229): n is a, c, g, or t
cggactttgccaatcaccgcaattcgctgagttcgccctttgcgggacggtctccgttccgctggatcagtaccgggccgtgctgacacggcgtgagcccggtctcctgagccatcaacacaccgaaagtgggatgtcctgggaaagaaacgccatcagtcaacagtcttttgtgcgcaacaaattcactctcaccggccaattgcgtaaactgactgagcccgggagtcagttcagccaccggcgtcagctcaacctccgccccattcactccaaaatgtgtcaattccttcgacggagtgcccgccacaaagccctccctgtacaaagtgttcagctgcagagaggttggccggatgttcgaagcgtcaaacggctcaaatttgggccgtttggaaggcgagactgaagtggcgggctcgaaattgatgggttgggacagtgcggagacggaaatgactaaaaagtgactaattcaatcatttttattgggggaggngggggggagtcagtgataaaaaattaaatgaaatgacatcatcgagtccaaattaatataaaaaatgtaaaaacaatgttttcatgcggggatgtgagaagatcgcatattccgcaatggcacaacaacatttgatccatgttctgttctgcaaacattgcgaaatgctttgcggtattcagtgctaaaatatgaaaaaattaattaatttaattatttttttaaattgggaattaattaattataaaccacctgcacaggaaaagcacccggtgtacagctggaatatgccatcactaaaagaccattactaatggggccaaacaatgtattcaattgataaaatgttcaagccgagcaatggcattatgccattaaagaacacagtattcttaaacgggaactgtaatatacagtaacattgaatgtaatagtgagcaaagtaccagaaataaaaccaacaaacaaaaaatccaaaattcatataaaagaatgtaactcgattatattattcaatcatttgtattttggagataaatacaaataatttttttattttcgcaaagaagaattctgataattattaaattaagggttttttattagcaaaaatatttaaccaaaattttaaaatataaattaatattattacgccaataaagcagatgagactggttgacataataacactcagcgaaatcattaaacgtttgttcatttccgattctanatgagccaattaacaaagcaattaaaatttcattaggggtattaattttatcaacccagcaatgactg

SEQ ID NO: 24204 - DNA, 964 bp, Heterodera glycines
  misc_feature (932)..(932): n is a, c, g, or t
tcggcaagacgacggccaagtcttgggactcgaatggaatgcggagacagacgacctacgaatgaagtaccccgggagcgagcccggtactccgatcagcactacacgccgaacggtactgagcagcgtcgccagcctgttcgacccgctcggcttggtctgcccggcgaccctcaaggcgaagctgttcttccaaaagctgtgggacgacaaccacgaatgggacactcctttgtcccgggaggaagctcgagaatgggagcacattttggcaagttgggagggggaaagtaacgtgattcctcgaggcgtaactgcgggcaggggtcacccgcttcaactgcatgtgttcacggatgcatcggaaatcgcatatgcagcagcagcttacatacgaacgggaggagaaagcgggtgcagctcccgcctcatcatggccaaatcacgcctcaagccgaagaaagcggctaccacgttcacaataccaagaatggagctgatgggcattctgttgggggtccggctggcagcattcatcgagaagcaactccaccatccaatcgcggggcaacacatttggagcgactcaatgatcgctctccactgggtcagaacggcttcagcgcaaccacaattcgtggccaatcgactcttcgagatcagaaaagcgacagcaacgacgtttcactacattcgaactaacgaaaacccagcggatttggcaactcgaggggaagtgcccaccctcttacaacacaatgatcagtggtggaatggtcctcaatggttgcgcgggccgagaacggaatggccaagcgaattggagtttcagcctgatcaagagggcctaccctctccggcggggcaggaagaaggacaatcagcattcattgtccgaaagaagcatccacaggcctcgtgagtgaacattncccgagttcgttgcttacgaggtacagcaaat

SEQ ID NO: 24205 - DNA, 944 bp, Heterodera glycines
  misc_feature (914)..(914): n is a, c, g, or t
  misc_feature (925)..(925): n is a, c, g, or t
aagtgatttctatttttaaatgcccacaaaaatccttttatctaacaacaaagttttgataaattacgcacttcacaaagcttttgccatattgaccaattggttgtgccttctccgttcgccatgtgttactgaaaagactgtcctcgtttttggtgtctttggcttggttactgttgttgttgttggcattgtgttgttcatttttcaaatttgttgtattctgtcgccaaaatttgaatacatttcgaatggaaatggacgacggttcggcacgccatttgccctgggcgaccaattcgtggagcaactgttgccaattgtggtggcgcaacggcacaaccacttcgtcaatgtcgcaaataagaacaaaatgatgggtggcggaatacctgccgtgtgatttattttataaataatttattttatttaaatatatatataccataattggatgtccggacaatccgtcattaaatattgacataatcaaaaaactaatacgaaaatatttgttcgaatgatattccaaaaagttttgtatgaaaaaaaggttggaacttattataggcgtttcaacttagctatttaatggtttaattattattttttacttcagtgaaaatgttttgaattattcttaaaaattgtacaaattacaagaattcattgttacagtaatgcccacctgttaaagcagtcgttgtacggtataagttcatgacgtcttttttgctgtctgttcctctgtataaattgatgtcttctaaataaaaataattttcttaattaagttgagaaaaaaatgtcttacaaaaatggatgatttggcgaatttccgggcaaattcagctccacctttaatggatgaaattttatttaatttttaaatttattttaatttacatttgcanttgttttttgntggccatccgtcggagcgc

SEQ ID NO: 24206 - DNA, 2307 bp, Heterodera glycines
  misc_feature (2279)..(2279): n is a, c, g, or t
tttattattttttttattcatttttattaatattgattcttctaaattcttttcgatttatttatttatatctattcaagagaaaattaaaaaaaaatttattttgaatagtatgaattagtttattaatgtttttattttcgcatgtttttttcaacgtgttaatttaaattaggaagtaactgaagtgtccattttcactgggactcagttgtcccagtgttcagatggcatcggttcgactttatttcctgatttttagattaagctcgtcaagagctttcaaatgataccaaatttgtggggattcgatggtttaaaaaaagttagagtgcgaaatctctcaatttttcgagttttgaaccggttcaacaaccggttttttggcatttccgcaactcgagacatatttttccatgcttagctccttgagacgaatcgattggtatatcatttgacccttttttcacggggcgttcactacagttcacccaattttttttataaaaaaaaatatgctatatttattcaattaatttactttcttataaataaacaatctttatttttaatgaataacatttgtttttttcattattttaaaaattttatataggttatataatttaacgttttagtacggatgaaagatttttttcattattttaaaatttataaacttattttttgtattaaatgttaatattcattatcaaaataattatattgtaattaaatcattattttttgatacaatttatagttaatattcggcaataatttaatgttataaaaaacgaaaaattaaaaataatagttttctaaatacaaatattgataatttattcctgaattatttgtaataatagttaattttacattcttgccacaaaacagacgttttgggccgttgggatcctcgatattttttgattatttggttcgaaaattttttattttatttaatattaggtcttcattaagctttaattttttttaaaaacattaaaaatttttaataattttttcaataatatttttcttaaatttttattattttttaattttaatatgtgtttaattaaagtgtcggaaataatatatttttgaaatttttcaaccttgttacggtgctttctcatgcattaactttttttattttctaaatattttatattattctctaattttataaatttgaaacattgagttcgtgtttagattcttttgatttatattttccaattttaataaacttttctttgttaaagtatttactattgtctgttttccttacaaaataatagaaaataaattaaaattttataaatcagggaccgatagaaaccctgacataagtagataaaattaatagatttttcgaattttattcatatgaagtttttattgtatttattagtaatgcaaaaaatttctgttattatttatggtataattttttcagcttagtgtcaaacaattattcatttttattttttactctcatggtctgagaacgacgaacaacattccgatgtgtcattagctgatttcaattatttttatattcaaattgattttaatcattaatattatgcattattaaattatccatttaaaataagaatattttgtgaaacttctgtatttttgaatttatatattaattttcattttgcatatttaatgtgttccacttgcataagattattgataaattttcacttaaaacaaaataatttgtcatcatttaggataaaatgaatttattgaaaattaaaaattaatttttaaaagattatctgtgatttttaggccgctttgtggactcgaacgggcgctttgcgtccttattaaatttatggaattttaaaaaaattatcaaggatttttaggccgcttctcggcctcgaacgcccgtttttaattttttaagcttgtgaggccttttcacggcaatgggcgggcgcttcgagcccatttttaaagaggtacaacagtgagtatcttaaaattagagcttattaatcatacaatttacgataaaacaataaatataatagcaataaaaaattgaaaacttctggttcaatataaaagcgattgtaatatttaattattctttagcaaaaataaaataattttattttataaaaatattaaagtgatatatttgttttgcttgaaaaaagaagaattcgtttttaaatgattcgcattcaaaatttttctcaattttaaacttttatttgttagcgttttttccgagatttctaaangggtgaatgattcaattaattttaaaag

SEQ ID NO: 24207 - DNA, 827 bp, Heterodera glycines
aaattattaggggtttttagtccacatcgaggctcacgacgggcgcttcgcgcccgttttttagcttattagaccgtttcgcggcctcagtcgggcgcttcgcgcccgtttttcaaattttgttagccttggacgagcgcttcgcgcccgtttctaaattttgttgaacttggacgggcgcttcgcgcccgtatttaaatgttgttgagctcatacgaggtacaaaaattgttggaagatgtgttggaagaggtacaacagtgattagaagagtgattaaaaaaggtacaacagtaaatagaagaggtacaacagcgataagaagagtgattaaaagaggtacaacagtgatttgaagaggtacaacagtgaaaaagtgatagaaaagtgattagaagaggtgcaacagtgattagcagaggtacaacagtgattagaagaggtgcaaaagtgattagaagaggtgcaaaagtgattagaagagttataacagtgattagaagaggtgcaaaagtgattagaagaggtgcaaaagtgattagaagagttataacagtgattagaagaggtacaacagtgattaaaagatgtacaacagcgattaaaataaaaagcataaaatgcgccgtattttttctcattttttaattatttgattgtgaaaattcaccctccctaacccgagttacgaatttttgaaaattacaccaaattcccaggggccaaaaaatcctgaattttcaaaaaatttttaaacgaacccaaagtatctgaaactgaaaataaatgtcatatttgttatttgcgaccaaaattagcccagaaaa

SEQ ID NO: 24208 - DNA, 1359 bp, Heterodera glycines
  misc_feature (80)..(80): n is a, c, g, or t
cagctaatcatttgaaatacggtattttcccgtcaaaaaacaaccaaaaaaggcgcatttagcattttcgaaaaaatatngacataacagtgtttaaagcaatcaaattttgcattctttgtaccgttcaatagtccaggtttttgctctcttagcctgcaaaattccaaaaaaatttggtcaattttcggaaaaaattatatttaaattacaataatattttgtttgaaattttgcaggctaatagagaaaaaaatttgggctatcgataatttcaaaaaacaccgtaccccttgaaaaatatagtgccccttaattcatttgaaaaatacggtattttcctgccaaaaaacaaaacaaaccctcgtcgttgcacaaattgccgtcgtcgcattgacggcaccgctgccacccgttcagttccaccgttctgcaaccatcggcagcagctgcagcacaacccttgcggagcacttaatttaacaaaaaaaatttttttacataaataggtcctagctaagccaggattttttttttaattttagattgtttttattagaaatcgaatacgtgccggccggacccgtatacaacggatcttatggatccgtagcccgccaatatgagtttttacggactacgggttttacgagttatttagcccgtaaatccgtaccctgtataggtggtgtgcccagctcgtaacccttacccttatcttttcaatctttaattgcgggtcagggatactgtattgtggaaaaaaaacggttttctttattaataccatataagatttaacttttaattctaaaaaaacccaaaaattgtgccttgtccggtcaatgctgatttaacagtataacattgcccattttggatggcacatttttgcgttgtgtggccaatttggcaattgcatggcccatcacttaaaagatattaaattgaaattattatttaaaatgaattaaaattaaaaaaaaataaaataccatgaaaagcattccaataattgtttttcttgttcgccaaatgaattttgaagaacatttgggaaaaagaagcacaaaatggggaataaaattaatcgcattttaaaatttaactttttattttaattttctaaaaatttgtccgacaaaaaatgaccaaaaaagggcgcaaatatttatgggatggtcatcacaaaatggaggcaattattgtgagaatggctatttttagacgaaaagcgcaacgggaatgagcatatggttttgctttacatacacattcacaaattcaaacaaaaaatctgattaaataaataaaaatggaaataaaatttatgcattttaaaattttaaaaatgaattt

SEQ ID NO: 24209 - DNA, 2253 bp, Heterodera glycines
cagttttaagaaacgggtcagcactcttatattttctattttgaagaagaagcaaatgatttattcttctgctatttgttttggaatatttattttcaaccatttttcaattccgttttcaaatgcaattccatttgtgagttaattaaatgtgacaaaattgtggatgcatttttcttattaaaggcaggaatttataacttttttattaattaatatttcttataaataattttgaaagtgcaataaaacgaaagatacaccactaagaaatggccccaaaaatttcagaaaaatatacccttaagaaattaataattcacataaattcgtctccaaattttttcaatttttagcacctatttcttttttttgggcgttaattatattaatggaaacataagtctggggaaggtattaaaccgattggcgctgtcactcagagaaatcaatgaatgtgcaaatttccaattttccttaataaaaaatatatttataaattcgtaattaaatatataaaaaaatgatttaacttttgcaaaaaaaaagtaagacacaaaaaaaatttaaaaaacaaaaaaatatagcacagcattgaaacccaatgattttaaaattgatttggaactcttttatttttcttatagtttttacccaaaaatgtcaaaatatacgccaaacaaaagtagctgcttctttcggcataattagcagcaaaaaaatatgtaaaaatataaaaatcattgccctaataataattaacattaatttctcgagcccagaaatgttgtagtgcttcaatgagagagcttaatggtttataaaatcttacaggagattttgctctattgtttttttttctttattaattaaaaaatatagtagagaaatcgtttatcgcaatgaaaatgcccttttttctctcctaacatttacctaagcgatcttttctaatgaacgattggccatcctcgctacggtaattggcttcataattgacgcatttgtcatcatcgttgttcaagcaaatttctctaatcacccatttgccatcatcgtcgtcgctacagtaatagaaatctcgattaaaaaaggtataaagcggatccaaaggcggctgcctgcgcaacacttcgactgtcgctgcgcctaacacctaaaataataaacgatcaaatgaattttcattttttattgctagggttgtaattttgtgacttgaaatttctaggaaaagacggatttgtaaaaaaaaagatttataggtggataaagttttggaattttgaagcattgagttagatttatgccaatattttccgcaaagtttcaacatatttttgataaaattgaacagtgtttcttgaaaaactaaaccagacttgcaaaagttaaatttctttaccaaaaaatgatctattggccgcgaaaaagacaataaattaattaaatttccaaatgttctaagcgtaattgaagttttatggcatttctgcctattccgtttttgggctcaaatcttttttaatttttcatttaagtttttttgtaaccattttaagaagtaagtacatttttattacatattttttacgattttcttaaataaaaattacattccaagttatatatatatataacccttttaagaaagcaacattatttaggagaaaaataatagtgtgtttagaagctgttcaatagctatttataagcgattgaagaacttataaaaaatctgcaacatgaatacttcacaaaagacagaattttttcatgtttttacttataactattttacatgtcggtatatctttgtgttttttggaaaggcaatagagcttatggttaagagctttcgaatgataccaagtttgttggatttggtcaacaaagaaaaaagttatgatgctctaaacttgtcgcagactaaatctgccagactaaactttccgagtccgacaaatattagcccttaacattgggccaaaggataaaatggtcgtttaaataatttactttttaataattacattttatacctcattcccatctttgaaagtaatcatgccggcgtccaatccctcccaatgattaacattcatcttcacaaattgccatgtttcattgttaaatgcgtctgactgtgttgtagccgaacacaattcagcattgttctgatcaaatcctttaactgtgaacggatcagcatcatgttgaaaactactgtcacaatttggattttgagatttt

SEQ ID NO: 24210 - DNA, 2216 bp, Heterodera glycines
  misc_feature (44)..(44): n is a, c, g, or t
  misc_feature (173)..(173): n is a, c, g, or t
tcaaatcattcaagtgaaaaattttttccttcaatcatctttantaattatacaatataaaaattaatcttaaatacaattagtgggggttctttgtgtgtttgttatagatatcagtctgcatcatattgtactttacgcaccccggacacatcacttgggtaaagtgaacntcatcttcccccatcaacttgaactggtccttatgcttgtagttgattcgacgacaccctgggcagagaaagttgatcactgcaaactttggccgggccaatttccaaaaggatcgttgatgatcaagcaaattataaatggtttgggttggtttacgttcactcttttccgaatcattctcttttaggggtttcacactactttttatttctgcgtcttgttgaattacttgctccactacagattggagagtcttctttgaagaatttgaagacattataatttaccagattgaattacaaaaccctgactatttttctccttaaatacctttttattttgacctttaatattagtaatgacacattttttcaattttatttctgaataaacatttaaatgaaaaatacaaatgtaaaattgaggatagaaaaatgataaaaagaaagtatgcaactcttttaatagatttgaaggcatatcagaattcttagagttcccttaaatgtgagaaagcacacccagggaacggcttcacccttcggtccccaatccaacactcactcaccaggctgcgcattacaataatgaacagctcgtccaccttcatctcagatggatggcctggagtgttggagaggatcaaccaggggtcattccgtcccaacatgggttttataaatatagagagaagggaacaataagaaaactaatatacacagaaaaatttaattgagagtgcatgcttacttattttcgataaccaaattcgaggacttggaatgaatcattaataataccttttgtgaatatgggttgataatgctttgtgagggaatgagtaaacactttgccttggataagattaggacgaataaaatggggatatgtaacaattatggggtcagcggggtcatcggaaccataacgtaaaatttgctcttttactgtgtcgtagtgtattttttgtacagtctgttcgtcgagagtgaaccctcttattttcaagtcgaagcaaatttcaccattgtctttccgttgaagtttcagcccgtagtttttgcagccagcactgatgaattccaaaatgtcgtggtctggcttttcgtccgtcagctcaccgaggtgtccctttcctgttgggagtgggtcgttgtcctcgggatgaacgtagatgatgctgtccgtgtcaaagtagagaatttcacatccgggagtgtcggccacttttttcagagcttcgtagaggtagagacgcgccattgatgttgtgaagagggagatgactacattggagtacttattttcgtcgacaaactcctcctttggtttgtaagtgagcatgaatacgtcgttgtcctcatccatcatttccaagtcgattagctcaatctttttgtcttcggtatactgatgaataaggctttcgtcgttgtcaattattgcttttgagagaaggttccgcatggagaagcggccccagagtgagttgaggcagagcttggcgatgtagcgcttcccaggctccgacttcatcttttctttgtcaagtttaattgcaaatttcccccagcactcctcaatgtattcactcttctgctcttcgctctcgcaccatgacgggaagccagtggcgtggatttttagggccatcatttcactcacgtaggacttgaagacattgttactccactggtcgtattggaggatgtggaagactttgcgggcggtgtaaccggcctccagtgctgcatttaattcaagatgggtgcaggttgacacgaaggcgcggtcgttggggttgaagtgggggcaggagtattcgttatccttgaggccattgggatattttggcggtgatgtgtttggcgcacttctcacagagagggaagagaaggcgctcatcaaatttgattggcataacagtgacgtttatgttgttgtttggaggtagaagcaacactttgagaagtccttatgtaggggttgtcggatggagagcgccagatgaccggatgctgatttactgtaaaactgatgat

SEQ ID NO: 24211 - DNA, 1681 bp, Heterodera glycines
atcacctcggcaaataatcttcagtagtgatcactgaagaattgaccagctgagagtattcgatggagtgcaaatcgcccaataaatcggcgccccctccggcgttgtccgtctccgtcccgctgttgcttctggcggtgctgctgctagcgccatttccctcctccctttgtgccgtcccctctgatgccaatgtttgtctgctcctcctccgccgtggcgtttttaaagttgtcgccggcttttctcccgcggctttttgtggtttcgctttttggggtggcgaatgaattgtgagcagtccgttggcgttgttggaggaggcggtggaagcaatcggttgggaggggaaggcggagacggaagagcacagcaaagacggagtggaggaggaggaacagcctgaggaagacgacgaggaggacgaagcggtggacacgctcaacgcctcgcaattctccaagctaatggcggtggaggcaagctgagacacaatctgcgaaaatgggggaagggattagcgaaagaattcagggccaagccaaaagcggatacaatgccattttcagcggtaataccaatgccaaataccaattaagcactcccccgccccactcacctgttgtggcgacgattgtgccatttcgaatgctaaagtggacgttgtctttgtcggcaattgcaccaatgaccgcatcagctgctgctgttggcttacctggccatcgttttttccgttttttggccttggcaaaatcggcggcattccgttggaagtgccggaggcaaaaatttgctgcggccgtcgagctactccatttgatgttatcgaattggtgttgaacaatgcggagccgcatcgggaaaatactgctcgaccatccttgacaggcagtccctttttggtgccgttgtctgaagaaggggacgacgaagacgaagttggcacaatttgaatggtggacggacctgcggtgagcgcggcgattggcaatacgccggggggaggagccgactgaaagcattgggggaaatgacgacatgacaaaatggcatcacaactgtgccgggatcattcctttcttttgcctccccccattaattccaattcatccatcaatcattccctttttcccttgattttcctcatttgccttcgcttcgctcattccatttttatgcccaaatgtttgctaattccgtgccatttccaacctttcgtcctctctgtcaccacaattctcatcggcttaacagctttgtgccaccaaaaatgggctgtgtgtgtgctagctgcttacttttttcgccacttccttccccgcaggcgcttctcccccccccccccggcgaatgttacattatgccattcactcaaacgcaatttggcccttttcccacccgtccaaatgagtcggcaccagagaagcgaatgccactttccctttacactttggccctcctatttagctggtctccacctcatcagtcccctcggccaattggtaatatggccaaggctgtgaaggctctctctctctgtctctcaaattgcgactgccgtcgtacgcttttcatcctctggagggactcccccggggggacccccccccccgctttattgttgacagcctccgcttctattattcgaccccataaacatttaccgccgcttattaac

SEQ ID NO: 24212 - DNA, 1378 bp, Heterodera glycines
  misc_feature (107)..(107): n is a, c, g, or t
  misc_feature (122)..(122): n is a, c, g, or t
  misc_feature (1353)..(1353): n is a, c, g, or t
caaattttaattaaaaaaaaattcataaattttttgaccaactgtttagggtatttgaatggtccaatgcaaggctgattactgtgtatgcgttgacccatccaccnggtaaattcacattntcataaatttttaaatttaaaatcgtaaattgttaattgtatacttaatgttagagtttattcattttaaataattgtaattaatctgtttttaggtaattaattattcatttttatcaggtgccgaagcgaccgcaaccaaaacgacgtcaaacaaaatccggcctcagtgtggccgttgccattttcagctttcccgttattaccgggagtccaagaatttcattttccgcccaatttgcgatgccaaaacaggtgaacaacgcaacattttaacatcttaattttttttttgtatttcaatggatatagaaagtgatccaagtcattaaataaaaatatgaattaattagtctaattatttaattagttggaagcccaaatcaattatttttatatcttttttgtcaacttttccatcacctttttaggcaactatcagcctcagcagtgtcgggatgagaaacattgtaaaaattttaataacctttttttatagcttttaaattcccaggcttctgcgttaattacctaactggagtacggcaaaacaaaaaggaagtgccaaccaacgaaattttgcattgtgaaggcggccaagtcgatttttccatcgatgatagccatgtgaacaaattatattaaaaaaaatgatcattaattcaacagcaaaaattaaaaaatccacaaaaaaaaattgtcaattaaattaaattaatatttggtttaattaattattgaattttggtaatgtatttcacattaaagatcattaaatcggagaaaggtgagggagaaaaaggcgacgaggagctgatcccgatcggatcgccggtctgcaagaagccgagagatgcgggccacagatgccatggccgagctggcggaccaatcgcggccaaaaaccttaaggtacttactgtaagaaagctaatcaaagggaataaatactgtacaaattttattctagattattatatgtgatagattattagtaactttaacttaagagagagggcgagagaatgagagaaaaaggtgagagaggaaagagagagagaaaaagagacagaacaaagtaaaagagaaagtaaaaataactttatttaacaatttaaaaattatatattttcagtggtattttgacacggagacttttgaatgtttggcattttcgtacaacggctgtggcggcaacggaaatcatttcgactcgcccgcagattgttgngacaaatgcaaacttggtaaagctg

SEQ ID NO: 24213 - DNA, 2145 bp, Heterodera glycines
atacttttttacggtcacgctcaatgatgtaatcttcaaattgggttggcactttggagagaccgtcgacatcgagaaattcttggatctaaagacaaggaatagcaaacaatgccgaaatgactcatcgccaatatgggcacaaccttctcttcgagggatgagattgacccggttgagcagctgccgctcaatttggacgtcagtgcggcagaagcagtggccccgttggacagagacaagttcatataagtggtggcaccactaaataaaaagtggaaaatcaaatcacagaacaagggcatgtttcacgggcgaaaatcgttatagaaaagtttgctgacccacccatgcgacgcgtggactgatgacgggccgttctgctccagcgagtggagacttgcggccgactgagagcgcgacaaagtgttgtttgtcttctcagaagagatgtcctgtgtgctgcaggtgccgttgttgtggtgaagggacagtgagtcgtcggagttgtttatgcgcgactgtgtgggcgtacagcaataggcgtcccgccacggctccaactcctggatgagtttcgggtagcgcaacagcgacgacctcttcttcttgttgtaggccgggttttcgaatcttaatccgagtttcggttttttccatgttcaaaaactcagacggactctgcgttatgagcgcccaaatattgccaaacttggtagcactgttgcggcttcgcctcttcgtcagtgtccacgtttactcctccatgttcagccgcttctttcaaagaattgaatataaacgtgccgaagagaccggagaaagtgtgttgtacaagtttcatctgccaaatgagagccataaaagggataaaaaagcaacacaaaacaacaaccagatatcgtcggttgaattggaattggtccgggtttttggtccacaactgatagacacaatccagaaattgcaagaaaactggcgatttctcattgtcgtcgccattcaaaacgccgcctctgtccgagaatttatgtccaaactcaacccattggcgttgaacaagcatttcaaagctaaatttggaagaaaatactaagataaatacaatatttaagaagccagttcaattaaattgctgttcccgtctttaaaagtgtttaaaaaggcattacccttcgaaagtccgataaaaagggtcagcgataatcatacacaacgaaacaatttgcgtcgttcggtcccaaccgtcggaacaatggacaagcacagaaacgcctaaacgaatgcaacataatttcaaacatcgctcatagaaattagaaaagaaaatgtcaccttcctgcagcagcgaatgcaaacaccgctccgtcgcagaaaacaattggcaaatgtactgcagccaaagggtcgactgcaaactttggaagtaattgttcgggtcgcccccgcaagcgttcatcaaagagcgcaattggtagaaactgtagcgaatgttgtgaatgttggccaggcccatgaagacgacttcggcattggcataggaatctgaaaacagtgggaactttagacggaaaaagacattttcaatataaaaacggtggctttaatttaaaaaagtgaccagctccttcaaagcctccgccttttgcacggttagcccacgccgcggtgtacgaacgagcatcgacaatcagaaatttcatattgacatctgaaaaaatagaaaattaagagaccgtaaaatggaaaagggaccatttgaaatggccgctcgaatcctctcgtagagatgcatgtctttgctttaaattaaaagtatataaaaaagggaaaataaatgtactcgttggacatcccgaaaaaaccaatggacggttggctgcttctgagcagaactgcgccattctttggacaacgccacaccaaagtgggaaagcggtaataaattctgccaagtcgcatttgcttcagttcatcgtcagacacagaagcgggaacaatcaaatattgagggtatgacgaacagattctcaagtgaaaatgcaaaaaatatcgaggcatttgttaattggacttactcaaatcgtttgttagccgacgaaattttccacgtgttgaaattttgagacgactaaacaaaagtaa

SEQ ID NO: 24214 - DNA, 1027 bp, Heterodera glycines
  misc_feature (65)..(65): n is a, c, g, or t
  misc_feature (106)..(106): n is a, c, g, or t
ggggggggtccccccaaaaaaaaaaaaatgattttttcaagtttccgttgggggtactcaaacanttatggggagctaaaatccagcgcagaattaaagtacagcntataggaagctattccgaaggattcggtctccccataaatctgggcgcatcgttcggggagactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggaatgccccgaaaacaaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattcccgaaggattcggtctccccataaatctgggcgcatcggttcgaggggaatgccccgaaaacaaaaaaaatcgattttttcaagt

SEQ ID NO: 24215 - DNA, 1635 bp, Heterodera glycines
  misc_feature (1389)..(1390): n is a, c, g, or t
  misc_feature (1413)..(1413): n is a, c, g, or t
  misc_feature (1425)..(1425): n is a, c, g, or t
  misc_feature (1427)..(1428): n is a, c, g, or t
  misc_feature (1446)..(1447): n is a, c, g, or t
  misc_feature (1461)..(1461): n is a, c, g, or t
  misc_feature (1467)..(1467): n is a, c, g, or t
  misc_feature (1470)..(1470): n is a, c, g, or t
  misc_feature (1477)..(1477): n is a, c, g, or t
  misc_feature (1480)..(1482): n is a, c, g, or t
  misc_feature (1487)..(1489): n is a, c, g, or t
  misc_feature (1507)..(1508): n is a, c, g, or t
  misc_feature (1511)..(1512): n is a, c, g, or t
  misc_feature (1514)..(1514): n is a, c, g, or t
  misc_feature (1517)..(1517): n is a, c, g, or t
  misc_feature (1519)..(1519): n is a, c, g, or t
  misc_feature (1525)..(1525): n is a, c, g, or t
  misc_feature (1532)..(1533): n is a, c, g, or t
  misc_feature (1535)..(1536): n is a, c, g, or t
  misc_feature (1540)..(1540): n is a, c, g, or t
  misc_feature (1549)..(1549): n is a, c, g, or t
  misc_feature (1558)..(1558): n is a, c, g, or t
  misc_feature (1560)..(1561): n is a, c, g, or t
  misc_feature (1568)..(1568): n is a, c, g, or t
  misc_feature (1579)..(1579): n is a, c, g, or t
  misc_feature (1581)..(1583): n is a, c, g, or t
  misc_feature (1588)..(1588): n is a, c, g, or t
  misc_feature (1591)..(1591): n is a, c, g, or t
  misc_feature (1596)..(1596): n is a, c, g, or t
  misc_feature (1598)..(1599): n is a, c, g, or t
  misc_feature (1606)..(1606): n is a, c, g, or t
  misc_feature (1615)..(1615): n is a, c, g, or t
  misc_feature (1622)..(1622): n is a, c, g, or t
  misc_feature (1629)..(1629): n is a, c, g, or t
ccgcttggatttgcctttgtctccgttcgttcgtttcttttcccctttttcctttttccccccttttttccttttttccattttcccatttgattcctttcagtgccattctcctttcgctgcccactcattgtcaaaactttctccttcatttgacggtgtacgaactttgcgaggaacaaatgccaaaaagtgcggcaaactttgggcacccccaggcgatgcttttgcattttccgcctgaattttgtgtgcgtcttctgctgttaattgaggacgacaaaatcttcagaaaaatgttgaacagactcactcaaaaaagcatcggccatttgattggccaagtgagtacggcactcgcctcagccgacgatcaccaaacggtgcctttcacaaagccttcctcgtaaatgtgctttttatcctcttaggcttcggttttgccaaggctttttgtccttatggctaaatcggaagacccggcacatttggagcgggcgagtcgaatgatggaagtgggccaaagccattggaaggcacttttaaaaggcgaagaattggtaagtgtgaagctaatcatttgccaaacattgcctaaagcaatgccaatttcaatttttcagtccgttcgaaagtgccgccaaaggccaaccgcaaaaagcttctcccaattgtcctccgacagtctcaacacttctcagttttatcaactcattgcgaaacatttctgtgaagggtttccccagcaaatctgcttggaggtgaattactcggacgaggactacctgatggagggtgccaacgactacgtggacacgtactttgacgacggcgacggatacgacgacgaaacaaacgcattggaggaggagggcacatactgacgggggggggggggggaagagacgaaaaatgatcaatcaaagagggaagaataaaggaacaattgaattaggtgtgacgaactgcaaatgatacgttaccatttgactttggtctttgccaagatactttaaaaatcattgtttgccaatcaattttaattgcaattagcggaaatgcatttgtacgtttggcctggcgaatttggtctgccatccgttgacatcgaatgtcatcaatttatggtaggcgattagcggatgaattaacagttttgatggctgatcccctgctaattgtatttttaccctttgaggcggctgccaaattctgtgctgctccgatcgcttttcacgcgtcgactcagccgtggaaatcgccaaagggtaaaaataatcaaaaataacaatcaaaacaaatgcttaacgaatacaccgctccaggggagttgccatttttcaataacaacggggaggagcaaataacggactttggcgagttcgtggnntttctgcgctccagtcgtctggncgtcgtgttggncnncgttttggtgccgagccnnttgtgcgagttcgnggcgtnctnttgcttnctnnncctgnnnctgctgcctgccctggtnncgnngnggngnctgtgntcttttnntnngggnttttttgtntgctttttngnnccttttnttttgggtcgncnnntgctnttncggcncnnttgtgcnccctctctntgccctnctggtcnccttcc

SEQ ID NO: 24216 - DNA, 1793 bp, Heterodera glycines
  misc_feature (1787)..(1787): n is a, c, g, or t
atgagacggaggacaaccgggtgccatcgttgtcattttcatccctcccgccgcaaggagctaatcaccaaaaccagtcatggaatctcttggaaagaccgatacaacattgtacaaccgtagtcggcccgtaatgttgccaaggggggcgggggggggcatttcccggcgattgggtgatcgtggtgaccaccgatcacgatcaccacagcattagtagtagcagatacagttagttacgcaatatcggaaagtcattctgtatgccagtctaacaaaaagtccgtccattcgtcgtcgatcactttgaaatggctgcttaactaacccacccggcaattgggaatggattcgtgcagcagcagcatcagcagagcagcaacttgttaaaactgaaaacggactccccaccccccgggggttatttgtgtttgtattcaattcgtcgagtctgccggtgtccagcagccaattcgagacgaaatgatgctccagctgttgtcgcatttgttcagagtccggcatcgtcttccaaagttgctcaagtcgccgccacacggaatgcagtgcctcatctcctgaaaaatcacaacttttaaaattgaacccccaaaaatgatatggtcccaccctgctcatccaaaaggcccaaaaatccgtgttggcgcgcaaacggaacaaagtggtgaagcagcaaatgggcctttgtcttttttgaaagaagcgttcgcaccattggttgttcgtcgagaaatgccttgaactggtaaactgccgtctccagtccatccaagctctttcaacgcctttttgcggtaaatagtaccgatggtatcacaccttttttgaaatttttttagaaaatttcaaaagtcataaaaatatttgttataaggttttcggggtcgctgagcacgaatatggcatccatttcacccaattccgaacccctgatccgaattcgaacaaaaatcgaaaactcaaatttttcgaaattcacatttatccaacaaaatcgctccaaacgcacgaaaaaagaaaaaaaacaaaaaaaattcaatgttcgcatggataaaactcagagacatgcagccaaaaattataaaaaacattttcacgatcaccgaaacgctgacgccaaattctgggaagtaggtgtcgtaagtttcagtcttgttcccaaattgctgtttgaaattcctcttcaattttttccacatggattcaacattttgggtatgggcaagacgatttgcgggattcacaaagttttgtgaatggttcacggtccaatgcacatagttttgcggaaggttcgggattccgcggtacggacgccattcatcgctgacaatcgttgtgccaggaagtatatattgctgaattagaggaagaaggcgagccgcaccacgggattctacaggaaccatgaaaacgcgctcccaatttgagtcgcgctcaacaccgccgaacagccagacttcttgtttctccaagacccggccaaccccgtacttccttttgacaactaatgtttcgtcaatttcgacgacgcggcctacaaaaaaaaatccataggaaaacatctcaatgatgaccttggcctccaatggcaattggctggcggacaaaaaactcagaacatatctcacgagaaaaactaaaccagtcgacgacacaatttctgttatgtccagtctcctgctggatgtccgaaatggttccatatttccgcgcccaaaaataagttaattccaaaacttgtttggttgacaattttgaccctnagtaca

SEQ ID NO: 24217 - DNA, 1769 bp, Heterodera glycines
ttaagtcactggctgacgtaaacgatcagtgttttggatggccgatcgaagcaactgacggtgcaatgaaattttccttcggttgaaaatgcggtgccattgcagttgcgggtttcgatgtgttggagagagtttgggttgacccaatttgatccacgttttgaagctgatgactgttgcttgggctccactgtctccattcatcttcaaatttgtgccattgatcgtgaccgggatcttccaccatcggccttgggttgtgccaatcaccatgcattgtgacttggccacgaccgtgtgaaatgatcggttctgaaatttgtgtgccgtgttggacgagcgctgacggcagacaatcgcaatgtggccttgccggttgcatttgttgcaaaatgcgttggcaaatttgcagtccgatcgccagtgatcgttgcttccgcatgatgcgcatggatgcgatggatggcctcggtttgctttgtcgtccgatttttgcttaggcgaaggcgcatgatgtggcgatttgggtgccggttcatgatgtggccatttgggtcccggttttgccttatgtttgcctttgctggtctctcgccattgctgaggtcgcaattggatggcgctggttgagaccggttgagtaagcagagaaagggcactttctttaacgatttgaatcgccttcaactcctcttccactttttggagagtgatgtccgtgcctgtcttttctgcgtcctccagcattttgagacacttttgcctcaggtcgtggtgctcgtcgttgagtgcaatgaccaggattatgcactttagctgttctttggtcggactcaaattggcattttcacaggacgcgttgatgtgtgcgaccagcgatgagatgtcctggcttggctgctgacgaattttgaaacattcgtagcgccggacgaataatgatcgcgtttcggcatataatcctttgagcttggtgatcgagtccacccaattgactttgtcgggctgggtcggactgatgctgtcgcggtatttgccgtactcctcgtcgccgagtttgccaaggaggagtctgactttggtcgactcggggaggtccttaccatcctcttcaatcagaactccaaaccttttgaaccactgttcgaaagtgttcccggtttcggcgtcataattgaattttgaaattcggccgtcgatggaactcgccaaatttgcgtggttaagactcgtggcgttttgtggtgcttggcccattagcagttgaatggcatccgattgcacacgcatggcctcgaggagttgcttaatttggtccgcgctcatgccgaagtgtttgccggtgccgaatttgagagtccaaagttgaaaaaccgcgtattgcggaaccgcaacctttctcaggtcttttggtttttcggcgaattaactgcaatatatgcagacctcacccgcctagggactattggttttgtcgatggcgaaaaactgcagaatttgcagacctcacccgtctagggactattggttttgttggtgtgcagtccgggtgtcttcttgttggttgaagacgactgctgactgcgccaaatttgttgtgtcttttgtccgagtgagaaagaccaacaaataaaataatttatttacgaagagtcaaataacaataaaataataaaaaatggcgaatggttggtggagagaataatgaataaaaataataaatagaaaacgggagaagaagtgaacatggggggaagagtccacgcctt

SEQ ID NO: 24218 - DNA, 1447 bp, Heterodera glycines
aaattttatttgcttttttattttggcagtttaattttcttttttggaagcctgtaaaattgtaaattttagattaaaaaaacttagaccaattcaattaaaatcaaaaaattggggcttgaaactccaccatttcccagctgacctacacggggttcttgcacttgaataaaacaaaacacttgttcatataaataaaatagaaatttcactcattaaattttaaattaattcgatttattatagctttttgctcaaagcaatttttttaaattatttttttgttgtgtttaaattttctcatagaagttttatcggtgtcctaattattctgttaattacccttaattagcaaatctcttcaccgtcatcatcgcgcccaaaacagtcattggagcatgcttatcgtcaacagtaccaacaaccggaatcatttagcacagaaacatcaaatgatgatgcacaatatgagcataaggacgagcagcagattgggaattcagcagggtaatgaaaatgaaaattaatttttaattatttaataataaattttgcatatttattgtgacggtttggtagccactttgtttacttggtttgtgcaaaatttagaaatttttggcatttctgctgaaagaaatggtggccatttactggataaataatatattaaaaataaaatattatttcggtataaaatggaattttttataaaatggaattttaaaaatattttaattttaactctcttttaagcctcaattttagcgtgtatgacacaaatctcgagtataacatgacacgcgttttgaacgcattaattgccagccatgatcggcgaattcggccggattttggcggtaatttatccgggtcataattaattattttaataataagccattaatactgtagtttaattatcatttaactttatttttagtatcattttatatttattttaatatttattaaggtgcaccaacaattgtgaatgtgactgcacatgttatcacaattagtgcaatttctgaagtttcaatggtaaatatgtacaaaaaataagaaaaataattattaattaatttaatgaattataaaagagaaaaggcacattaaagggaaaattcgaaaatattttaaaagagcattattttctcaacaaaattatattgcatttagcaggttcttcggagctcccttactaacggaatttccaaaattttttgcaaaaaattctcagaaatttcaattttttattgtttattttgcataatctacaaaaaaaaaagttttttaaatttttccggaagcgcctcatacgcttttaatcgaaaaaaatgaataccttgattatatttcatttttttaaatatcctttttttgcggggctttattaattcttatcactcattaaggattacacggtcgattttatttgcgtcaa

SEQ ID NO: 24219 - DNA, 1498 bp, Heterodera glycines
  misc_feature (1437)..(1437): n is a, c, g, or t
ggcaaaaccagtgattagaagagtacaaaaagatatttagtagggtacaaaaattgtaggaaaggtacaataaatagtttaaaagggtaaaatatggtttcaaaaattaaataaataaggaaatggttttataaaaaaatataattaaaaattgaatgtgttaataattttttaaaaattataaaataaattccttcttttatttaaaaataaataagaaattaattttatattaaaacattttaattaacaaacaatattaaatttaattaaaataaataaataattaattttaaaacaaaacatttatttataaaaaaaatttaattcaaataaaaaatgtaatttattattaataaaataaaaaatattttaaatgaataaaacaatgaaaaacactaaaaaaaatggtagctattaattaaaaacaacgttggaaattattaattgaatattcatttaatttgaaattaaattattttttttacaaattcaaaaaataaataatgaaattctttaataaaaaaaataaataaatttaaatattttataaaaaatatttgaaattaataaaacatgtaaaagtaatcaaaaatgcacagaaaaataatgtacaccgatcggatccgaacttcgcccccccccctcaaaatgatgcctcagaatccccaatcacacagggattctgagggcttaacgatgtcaaaagtaaaaactgattatgtattcatgatcagcggcgcaaattacccctaatgacatgtttttggaagatttttgtgaaaaaattttttcaatcaaaaatcctgtccaccccctttggtcccgaatgccaaaatcacttttatttttgtatctttttttaaaaatgtgataaaaatgtaaaataaaatttataaaatagagctaaaaattgcggatttttgtagcattttacttttcctgaatatcttttcagaagcgagttataaatttttttctgaaaatccgaatttttccagaatttctggaataacttttttcatatttatgatacaaaagccaaataaaacccataaaattctcctgatttttctccatttttaatgctttatttaatctaaattggtcaacccttcgatttgttatgaattttcaaatattaggccaaaatcccgagggccaaaaaattgccaaaaaataaagaatttttaaaaaattccaaaaattatgaaacttaaaaaaaacatcatattcgtattcagcacctcaaaatagcccagaaaaaaaattttcacccccattttggcccacaaaaaaaatttcgaaaatttctagggggcctagctcgaaaatttttgaaattttccagacttatagtacaccattcgatagagtttcgaaagctctacaaaaatgttctaagacaatttttcgctaaaatcaactcctgacgangtatgggccccgggactcaatgtcccgctcaggccaaaatttttttctatttcccggaaaa

SEQ ID NO: 24220 - DNA, 1555 bp, Heterodera glycines
  misc_feature (1394)..(1394): n is a, c, g, or t
atttatacaaacaaatgtattcggagtattttccgactttcaaagagcgaaattaccagccatgttcatttacttctattttcggactttcgagttggtccggacttttctaccgaaaattatgggccgaggtattattataaatcaaacaagccaattgtacgtttaagaagaatctactttatatttaataagatgcttgctttggatgtgcaccaaacttttgaaacggagggaaatgcagtcactgcggaccgattgaaggcggaatggcttaaccacggggcaacggaactgcaaagcgaactcttcaggagatttcaggttaatcaatcagaaaatatgcattttaaactcaaattctttagggccgcgaaccaaatatgggaggaatttgcgacttttatgaccctgagccttttgaggaaaggacagagcagaaaatagattgaacagattgaatcacttgctattctgaatttatcatttcgtttttgttattttgaaccctctgtatttgaaaggtaaaccgaatgatgcacaccaatttttttttaattggaatccggcggaagagaaattcaaaagccaccggtcgcgatacattaactaaggtccctttcgaagtgacaacattacagcttaagcaggctcaaagtgtgcctttccctcccccgttgaaaatcgctttaattattttgaccatcgttttaataaaatgcaaatgaaaacgaattaatttcatgctccagcacacaacaacagagagatcttcgcccgtcctcgtcattggattgtttggatcagcgtaatgttatcgcccttgagtaaaatgcggcccaacttgtgacggttcaacgatttgagttggacctcctccgcctcgtcaatgaccacgttcatatactcgtcaaaccctaaaccaacgaaaagcgattaaacaacaaaacagttttttttgttaccgataatataaccctcaatgcgcgaagaagcgttttcataaagccaaatttgaatgcgcgaacgactttggagacagcgaaagatgaggttgatcggctggaccatcaccttttgcactttgtttgtcggtggagccatttttgtaagtagcaaatataatttaagctgaatttatgaattaaaatcgatcactaccatttgtttattctgaaggatggcttcgatatttgtgagtttagcctcatttgggaaaaagcattactaattcagacaaacacaaattgtggtcaaatttaaaatatatgtacttggaaaagggtgtaccgatttttctgcaaaatgctaaacttgtgcttctaaattgatgcctgcctctaaatccgggtcgcagccgggggaatcccgtaaaccggggtaatactggccantctgcgctccacccaaaaaaattattttaatgctgtgaaaagttcaacccgggggtttccggagcttctgatcacgaatatgatatcagatttgtaaaaaatcattgatttttatcctgattttgaaaatattatatgtttcgaaattttgaccaagatga

SEQ ID NO: 24221 - DNA, 815 bp, Heterodera glycines
aaataaataataatttttttagcatttttagtgccaaattttttaaaaatagtgaaacattgccaattattcccgagagtgggtttgaaccgaaggacagtcagagcaacatagcgataaaatattttgaatggattatgcatcgggacggtgtgaaagcaagacatgccggaaatgggggagaaatatctatttttggtgacaaaaaattaaaaattgattgtataattggggcacaaaaaagaatcattgaatttcaggtgggaaaattttaaattttaaaaaatatttagcatttaggggtgcgcttttcacgggtgtaatacatgttataaaggttatatgatacaagcaaatggatttacggcggaacaaaattatgataggactcaacgaaaaatggaaaaattaagaattgcggggaaaaagatgagatatactgtagaggaagtttgggtaggtgtataaatacattttggtcaaaaaaatctaattttaggaatgtgatgtaagaaaaatgttttataaaaagagtgcattttatgacacgcaaatggtcaaattttttaacaccttactcgtaaataggacctattaacccaaggaaaggttttgcggttggtcgtaccggatggtttaatcgtcgattttctatactaacgagaaattttagccccttatggctatttgctgaagcttctgagaacatggaaattactgatttttgatatagccagtctttacccttgggtgaattattccaccccctatcagattggaatccctcaaatagtcattccaaaaccatatatagt

SEQ ID NO: 24222 - DNA, 848 bp, Heterodera glycines
  misc_feature (16)..(16): n is a, c, g, or t
  misc_feature (56)..(56): n is a, c, g, or t
  misc_feature (86)..(86): n is a, c, g, or t
tttgcaaaaaggacgnagtatattaaggagcataaatgctcaaaacgttatgatantcaatatggtaataaaataaaaatttatgngagaataaataattatttaggaccaccgcacccagcgcggcttaaattactcatacatggaacaaataaacaattcagaaaattgtaaattaatttacaaggatacaggtggaccaaaaaaataaaacatttttaaacataatttttagacagtgtgttttttatacatcccaaaggatcaggtccattaaggaactttttagggtatgaaaacaacccaaaatccttttaatttccaattttagtgaaatgtcaaaagaatatgcggactcagaaatcttagaagttgtctgtgcgggtaattaataaaaacgaaataaaaataaatgttagttttaggacctaaacaatacgctttaaaattgaaaaacaaaaatggagaactttggtataagacaaaaattagagggatgacacagaataagaacaataaaattgattacgaagaatttaaggacatggttttaaattatcaggaggaaaagaaaatactgtttaaacatccaaataaattcgggtatttttactaatttttttagaaaataaacaatttctttagaccaacgagagaaggttatgtgataagtcgtaacgttacaaaggattataggccgattcaaaagaaggggttagtttgacagtttttattaacgaaataatatataaatttaggattattttgaacgatgaaaatttaagtgttttgccttttggttgttggtgattttttttttgaataaattttttaaaatgttgtctttt

SEQ ID NO: 24223 - DNA, 531 bp, Heterodera glycines
  misc_feature (14)..(14): n is a, c, g, or t
  misc_feature (499)..(499): n is a, c, g, or t
tttattatttattntggaattttatatatatcaatttatattttttgggacaagaaaaagaagaatatttcatgactgagtacagatctaaaacttttaatttctcagcgtaatcataaaaatcacaattttttttggcgctttttcaaccagatttttatttaaaaagaaagaaaaaacttttaaaatgatcattttcaaattttcaaaaatgaatcaaataaaaaattgcggcaatttttgatttaaaattttagtgtttaaactttcccccattagtctccctcaattgacccctttttgtcccccattccccccactccctcctcacccattaacacgctctttctgttaaagatatctcccctctccccaagcacaagtgcactcacaatgcacccaaaataatcaaatccataatccccccccccccctttcccattaatgtcaattggatgagcaaaattatttagcaaaatttactaattataacccccanccttttgcaggtatgaacggctcaaaatctga

SEQ ID NO: 24224 - DNA, 2221 bp, Heterodera glycines
taaatcttttacctttcaaaatagaaacaaaataaattactaacaccattgcttttgatgaattatataatgggagagtaaaaaaaatactattgaaagtgacaataaataaataatttaattaaattaaaatctgaattattttaaatataacttggcgtattgtacgataaagaactaaaaatgataaacattacaatagttttccattttataaaatacataaattagttttgttatttattttgttaaaaaaagctggtaaaataatttaatctaaaaactttatttaatattattatatatgtgaactaatacaattcaaataaattattttaaacaattatacaaattgcaagtgcaaaatggaataaactccataatgttttatcgattaaatataatttatatttaactaataaaagaattttaatttgactcgcaattgttgtgtgaattcttttaataaaaaatacaataatatttacttttcaatgaaaaatagaacatttttatttatgtaaatggcaaccacatgaaaccaaccctggcctactctacagaacaagaaaaaaagaaatttataaaataaactgactgaaatgtcaaatatcgttaaaatatttaaaaaatttaatttctaagaaataataattttttttcaaaagaaatttataataaaaaattgataaaaaataaaatcacagaataaagtttaaaaaattacagctcaaattttaaagttccgtctaataaattgatcaaattctcgttggtgtgtattaagtttaacgttttggttctttttctgacttttggtgccttttttcatactttttgctaataaaaaaaaagttaatgtaaattttcgctttaggccaaatttttgatataatgccagaaaataaatttgaaataatatactcttttacttgttaaatggccttatataatataaaaggaattttttttacaattcacacccaaaggaagaaaaaataggaaaagtaaataattttataaataatattaaataatttatgttaaaaaatgaaatttattttggaaaaatcattaattattcaatataaataatttaataaaaattgaattaatttcggatagtttaacatttcctaaaaaacttttaatcaagaggttggattaaacacaaaatatgcctgaccacaagaatcgaaacgatgatgcgacatttgaatgaataaatgacaaaatatagaatttagtaaactaattaacaacataaataatgatgcaattagaagttgattattgattaactttttataattaattgtaattattcaataaaatatctcataaaaaataccaaatttgttaatcaaattaacataaaattaatatttatatatttttaaaaaagcgaaatataaaattttcaaaatttacgttgaaaatggcaaatattagaagattaaacagaaaacaaatacaataaaatattgctaatttatttgttattgggacactataaaaagaatttactagaaattattgaaaacatttaaaaacactaaaatataatattaaaattttaaaatgaaataaaaaaatcgaagaaaagaaagaagcaacgataaaaaacattaatgaaataatgtagagttaagccccgagccctcggggggcgacatgtcgggggtcgggtcggggggagctcaattgtcgggggtcggggacccctatcgggtagtgatcaacaaaattttttaacgaaaaactcaatttttatttttaaatgctcgtaaaacttcctttttcactttaatcatctgatttcgttagcgccaacaagagtgcgttatttataagaatgttctgattttggggtagcgacgaaaattgttcagatttcttaaatatatttataattttgaaattttatggcataatgtcattaagcagggttcgtaaatgtccgtattccttctttctaagatttttcatattttcaggcttcatctaaacttttcaaattttttctgattaatgttttatttcgctggtttttgagaaaaaaaactttaaaatggccatttttatgtaaaaaatgctaccaaaaactcccaattttcaatttttttacggcggcacctatcggcaccgccagtccgcaaaattgttcttaaaaattttctcacaaagcgcgcaaaaattgtcatttgggaaaatctgtggg

SEQ ID NO: 24225 - DNA, 1177 bp, Heterodera glycines
  misc_feature (1108)..(1108): n is a, c, g, or t
gggggaataggaaaatggggaaataggaaaaaattttttggaaaacggaaaggaaaattctggaaattaatcgatgaatgaacaaaccgcccggtgaccagcccaacgtcgccaaaatggagacggaaatcgcgaaacttctggttggacaacgctttgattggcgaagtgtaaatgactctaaaaattttgaaattattggagaggggcgaagaattttggcaatttttaaccgaccaattcgttttttagaaattatattttatgtaggagtacagacagcgaaaagtcaggacataattcatatacatatttcggggtaaaaacgaattattgaagaattttctaaaattttaaatcactttttaattttcccggcaattaaaaaaaagtcgaaataattgtcaaaaaaaaacagaattgtgccaccccaccccaactcacctcgtccggtgcagtttgcacaatgccaccgcgtattccgccaccaccgttttgcccgcgctggtatgtgccgcgacaaaaacggaggcgccctgctccatgcggacaatcgcctgctgctggaacgggtccaactcgaaggggtactgaaacgggaaaaattaaaaacgtttaaaatggcattttgtttattcatcagagaagatgaacgcgtttttgacttttagatccactattccacttaattttaggggaaaactgtttttttttttttttggaaattttcttaatgagtttttttgccgtaggggaaaattggtaaattttggccatattttaaagattttttttttttgcggaaaattttaacgccttttttgaggaagaaataactaatatttttttcaatttgttaaatttccgtgaatcgtgtctgtctttaacctgcttggccatgttgtcccggagcgcgtcgaattctggcacttttttgttcacgtccagcatttgggcgaacgcaaatttgctctccggcacagttttggcggggatgggtgccaccgacggattttggcgcagtttcgccacttgcggcgacgccgggacggggtttggtcgggcgcagcggaagcgtctgcggcgacggaggcctcctaaaatgatntttcaaaaattaaaaaaaatggagaatcaaccccaagcttttggacgtctcgtccatgtgcgcagagca

SEQ ID NO: 24226 - DNA, 1103 bp, Heterodera glycines
aaaaattgtttataactcccattcagaagaaggggatagaaaaaaaattaaaaataggttttagagagcccgggaacagctgcatcggatgcaagtgcccacgttgctgtacacttaacagttggtgagcaatgacaaaataaaaattgaagcttaaaaaagaaaccaaacaaactcatcaattgttagctcccgttgacaaaccgaaaggtacattggggcaatggatgttgggctaccgtatcagttattaaaattgttgtttttcaaaaaggatactaaaactgggataacccattcagagactagtcaaaaaaaataataataggcttggactaccatactaattagaatttttagaatgtgtctgttaaatgcaaaactgttgtgaaaaattgttataactccattcagagaagagatagaaaaaaaataaaaataggtttagagagcccgtgaacagctgcatcggatgcaagtgccgccgttgctgtacgcctaacagttggtgagcaatgacggaaaattgcttaaaaaagaaaccaaacaaactcatcaattgttagctcccgttgacaaaccgaagggtacattggggcaatggatgttgggctaccgtatcagttattaaaatttttgtttttcaaaaaggatactaaaactgggataaccccattcagagacaagtcaaaaaaaaaaataataggcttggactaccatactaattagaaattttagaatgtgtctgttaaatgcaaaactgttgtgaaaaattgttataactccattcagagaagagatagaaaaaaaataaaaataggtttagagagcccgtgaacagctgcatcggatgcaagtgccgccgttgctgtacgcctaacatttggtgagcaatgagggaaaattgcttaaaaaagaaaccaaacaaactcatcaattgttagctcccgttgacaaaccgaagggtacattggggcaatggatgttgggctaccgtatcagttattaaaattgttgtttttcaaaaaggatactaaaactgggataacccattcagagactagtcaaaaaaataataataggcttggactaccatactaatt

SEQ ID NO: 24227 - DNA, 2020 bp, Heterodera glycines
  misc_feature (43)..(43): n is a, c, g, or t
gcatggtcattagtggcagcgattgcaccgacacgttaaatgnaaggcgaattgagttcagtgaccgaacggtgcctgtgatcagaaaagatgacgttagcagagtaattggttatcgctgttgaaaaccttaaaaatggggtggacaaatgcaattggtgttggaacggacgcaacttagtctccttgcgaatacaacttaaagcctggaagactcgtttttgaattatttgtggaagtgttggcacctgcaatcgttcaggagtggtcacttcgtaagaatcgaatgggaaaagcacagtcatatttgtctttgaaaaggaaaagaaaaatggcatccgaaaattaagccattttaataataccataagtggccgagtttgagctgcactcagcccaattgttgtcttttgggtgataagcatttcactgaacaagtcgaataattttgcaaatccgagcggaacagaaaggagcaacagcgaaacgccaaaaagagacgcgaaggagtacagcaaaggggtggacaaagagagggaaagggacaggagagagagcgaaatgtacgaaggctaaaagagagaaaacggactgacaaatggcaaaacattaaaatgaaatgacagacactcaattacctgtaaaaaaagatgagagtaaaacatgtcagcaattccgaccagtacaatgatgaccaatgcacagacaacgacagtttcgtaaaagcgcgcgatgagagggcgacgcactgacgcgggggcggaattgctgggaaagggctgaacgacttgaagatggtgaaaggcagcagtgctaaagccctgagactaaaaagagaaaagtaaaacacaaacaaaaggatggaaaaaaatttaaaaaaagctggtagcaccggatggtttcgatccatcgacctctgggttatgggcccagcacgcttccactgcgccacggtgcttacgaaaaaccagtcattaaattattaaaagaaccaaaaaataataggcgtgatgactattttaagaaaaaaaaggttgtagcccaaccacctggaaaatctatgcaaactttgatactatcattctatgtaacaagggttaattttttttttgtggttcaatttcgtattttagaagggaaaaaaggcacattcttaaaaaccaaactggaaaaattcaaaatttttctgtacctcaatgaaaaagtaagagaatggtagcagtgcaaaaagcgacacattgctgagcatgaacacgtaattccacagagaattgatcagcgatgcgttaagccatttcaagtagaaattgtcggggtatcgctccaaaacttccgagccgagcacagaaaaaggcaaaagtgtgacggcaccaatggacacggacagagaacagcagcaaatccaaacacggaaaatgcaaaaataacatttaaaaccagggctgccagattaaaattttcaaaagcctcatttttacaaaatttattcaaaacacgtttaaaatgttcaaatgttatatttttgattgtccatgatcaatttgagcattttttttgttagaaataagcattttttgggattctgaacatgaaaaacgaagttgcttttttgcggcgcttttcccaaaaaacttttgggggacagggggaccggcggtgccgataggcgccgcgccgggaaaaattttgtaattttcaatgcgatttgttaacagattttgtccgaaaaatgaccaaattttgcgattttgagcaaatttttgcttgtaaattaagatttttacgggtccggcggtgccgataggcgccgccgggggaaaaattaaagaattttgaccatatttttagcatattttcattaaaaaaaatttcgtatttttgtgatttttccgaaaaaaattggtatttttctagtttttatgaaaatatttaacaaaaaaaacttaaaaatttctccaaaaaacccacaaaaaagccccttttttgaaaatttaaccctccttggacctatcaaaaaacc

SEQ ID NO: 24228 - DNA, 1712 bp, Heterodera glycines
  misc_feature (33)..(33): n is a, c, g, or t
  misc_feature (47)..(47): n is a, c, g, or t
  misc_feature (572)..(572): n is a, c, g, or t
gtcttgtaaaaatgcattttcatcgtcacgctntaaacagtcaattntatgactgactgattatgaattaattggtgttacattttttaccatggaaaatcgtcatcttgggatagacacacacacccaatcattttttcttgctatattctgtcacaatattgtttgtgtaggaaaaatatgtactctgtttgtgtgtctggtattacatttagacacaaatcaccctgaaaatgcgaattttttttttcaaatttagaatttctcattcaattttttgggtgatcaaaagccatccatccttcctctaccactctgctgatcagttagcctcatttgtccatttttatgtgtaaatacaacaacatttttctgttttatgacggggcatccaatgaaattcctcaattttcaaacactcagctctcttctctcccttttctctgtgctgccctcccattttccaaattcgtctcctcatttgtacataaatttttttttatgaattttcatcggattttcgcattttggcgcttttctttttttcaatgctatgtacataaatattgacntttattctccgttacagtgtgtgttattaatttgggtaaaattgcggaatacggtatcgactcaaaatcgcacaaaaacacgtacatatgggttttcttaggcgctggaacgatggaacagctaaaattcggcgcggaaaagcatttataccggtttaaaactcgaaaatttgagtgaaaatggagacttctgacctcttgaaagcgtcaaactcggacaacgtgctgattgtaatatttttcataatttctcagtaaagataaagcgtacgaaatgcagaattggaaaaatcacatttttaaaattggtcgaaattgaagccgaatccgtgctcagcgccacagattacccctaaaaataatttttcataatttattaaaaaattctcaggaccaataatcttaacattccccaagtttttattaagtcacgtgaactgtaaaatgaacaaagaaacagaaaaattaattcttaatttaatcatctcaaagaggaaaccaaagaaaagtgtataaattcgagatcaataatgcacaatgtgaagaggtggatcgttgaccaaggcaacaaagtgcaggaagctgtctgtcattgggcggccagccgcgcatgccaatcatgaaaaggcaacgcgatatgttctgcatcagaattacccgcgcttgaacagttgaactaaataagaaaataattgattgaaaaaaattgttgtcgattacgttgcggcggtcagatgagcctcagtgatgtccaaaatctgattgtttttctcagcaatcacacgaacacccgccaacaggtggtcctgaatgaaaggaaacagtgaacaggttaaaaaggcattttgattacagtctcgtctgatttgttggcgtcgtaccgcacacgatgccgaaaacgctcgaggaccacaaggatggactgaagaggtttgaagagcggcaatgctacaaaacaaattttcaaatgacaaactgtcgtctaactggcagaaaaagtttcgaagtcctcgcgcgactaacgccacgtccagttcgccttctcgaacttcgggctcgacagcgtgattcgcagaaatttcttcatgcatgaacaccgcggatgccgcaaaaatttcaacggcagcaaacgcggggcgc

SEQ ID NO: 24229 - DNA, 1741 bp, Heterodera glycines
cagcacagcgctggtctgggtgctgagctgggctctggtccgagaacgattttcaacgctcaaagtcataattggtaattaattaattgatatattttgttattttcgagttattctacccccccccccccctcctctccccctaatgatgctcaagaccgacaattttccgagactcgagacctagacttgaccccgagactcgagatcgggtcgggaccgagacctagagaaacccgagaccgaaaccaaaaaacccgagacttttctcgagtcgagaccgagactctcgtgcatcactgaccttccggacacgcttaaaaatttttcaaaatttgtacttgagcgcgtgctgatcgctagggctgcagtttggatttacttttacatattttgacatttcctcatactacataattacacatttttctacatttttggattcttccaactttttcatgttttcatgagttcagcgaaatgtttatgaatttgatgataattttgctccttatattacaaattttaaaaatttttagagggggcggctgggggtaggggggagtagcataaatgccgaaaacaccagctttgaaattttattatttttatttatttattttttgttgcacagtttgtcgccgttttggtggcaatgtttggtgttctgctggtcgcattggacaacgaattcgctgcgaatcgtctcggcatttgtcttgctattttcagtaccgtactcgcttctttttataaggtgtgagcagatgattacggtggttttcgcttccctgtcgagtacagtcattttgcagaggattttgagaaattgccaggaaaagaagtggatttttgaaaattgtgctgctggacagggaaacaagctgaaaatttttttttgaaaaaatggcaatattttttttgagaaaaaatgactcaatttactttttttgaaaaaatagctttttttagtcaacataacttagtaaattaattttccattaaaaaattaatttactattatatactcaaaattctgttttccaaaaaacaacgtacaaggttttgaaaaagttttatgttgtttatgttttttattaatttttaaacaaatctatgaccaaatgaccctcatttattaactagttttgaattttttatttaattgattgaccctgtggcattgattaatattttccgaaaaaatcaggactcttgtgaaaatcctgatttggtcatttttcttgaacatgttttttcgttttaaatttcctctctgccctaaaaggtgctgttcaaattgtgcattggcaatgccacgcttggccaagtgtcactgttcatgaccgttttgggtgtgcaaaatttgttgctgaacaccccactgtccgccctgcttgtccaccttggctgggaccgtgttgagtgggcccacgtcccatggtcaccgctggtcggttccgcactgcttggactcggtgaaaataattagggctgggaatttaagtcaaatgactcttttttttttgctgactaaatggctttaaatgacttaaaaatttttctaaaactttgtttgaagcttttaacagacagtatgacttttttttacacttttttgggaatcttttatgacttttttcgccttttgaagcaaaatttgaattcatcaaagaaaatgccgaaaaatacaaagaaaattccgaaaaataaaatttcgatcggtgaaaaggcaatgaaa

SEQ ID NO: 24230 - DNA, 744 bp, Heterodera glycines
ctgaaaaaacaattaaggtaattaccatggtacttgcaaatatgaattgttacatcgctttttccatttttttctcagcttctttccaattgtccgacatttttttgcttgtaatcaaataaaattttaaaaaattttccaaatttatgcgctctacagcaccaatgctgaggggaactcaacactggggatgctgaacctaaagttggtggtggtgttggtatacgagtgagtggcgtattgccatggttgacaagccctatgagttcgtggatcggaactccttgcctggggaccagtgtgcttgcattcgaaaaaacacgagacataagcgcccgaaggcctttggcctgaggaagtgtcctaaccgggaaatccggagtgctcgtgtgagtgcctgtgcactgccctcggagctgtgtccagcggcgagatggttcttcccaagtccgggaagctcggatgcctggccagcgctgtgtcattaccacttgctcggtctccttcgctgcccatgcgcacgcttgcgctgaacggagttgtttctgctgaaactatccgtctttacaagacggctgtaatagcggcgcttggcaacgctcgctagcagctatctggttgatcctgcctgaactgatgtgttcatttcaaagattaagccatgcatgtgtaagtttaacctgccagacagggaaactgcgtacggctcattacaccagctataatttacttgaccttgacttc

SEQ ID NO: 24231 - DNA, 482 bp, Heterodera glycines
  misc_feature (35)..(35): n is a, c, g, or t
  misc_feature (74)..(74): n is a, c, g, or t
gatatcaaaattgtatttggcaatgaaaaagtttnaatccaaaaatctgggctgacgctaaaaaaacccattcncactgattcagcaatcctgaaaatgtatgacgaattaaaagagttccctgcctatagtttttcatcgggtcaattaaactaaaaaatgccatttcattttccaaatttgcagactgaaatataaaccacaaataaaccgacaaaaacgaaatggctccacgaggaaacaacatggtttaccaataaacatttgtgtgatcaacttgcatttgcgcaccttttcagcttcccaatgcccacttccacaagcattggcagcgtcgtatcaaaacttggttcaaccaaccggcacgcaaggaacgtcgccgcgctgcacgttccgccaaggcggcccgattggcaccgcgtccggccggcggtctgctgcgccctgttgtgcgttgccacaagcgttcgctacaacaagaa

SEQ ID NO: 24232 - DNA, 1180 bp, Heterodera glycines
  misc_feature (1007)..(1007): n is a, c, g, or t
  misc_feature (1103)..(1103): n is a, c, g, or t
aaattttaattttaaaaaatatttcaacttttttctttcatgttaagcatcctaaaaacccaaaacttattggtcattttttacaaattctgttaacaaatcgcattaaaaattacaaaatttttcccggcggcgcctatcggcaccgccggccctccttgtcccccaaaagtcttggaaaaaacgtgccgcgtaaaaagcggtgttgaaagcaaaaaaaggtcattgatttacattaatttacatggccggagaccccttcgcaaaattggaaaattggccgctgattattcaaaaaaccgcatgtctctatgacttataccggctgaggtatgggcacttcaattttgacgtagtgtaaaatgcactattttcttaagaaatacagtactttttataggcaccgaaataaaagtcgacgtatctcagcgggcctaaatcgtagacccactattccaaaggcaattcggtagcaaattttgtgctctataaaatgggcctactcaaaatttccagaaaaattttcccaaccccctagaaattttttttgaaatttacccctcgttcccagccaaaatgggctgatcagatcaccatgaaggagtgatctgatcaacttggtgttgctaccttttttgatcagcatccaaagttatgcttacctgaatttttttagatttttttaatgctgatccagagaagcaatattttaaaaatgaaatgggacaacacttttgaccacctatattttgatcaaattttgaatatggtaaaataaatcaaataaatgtttatgtcacaaatgcaaatatggtatcattggaaagcccataaaaaatgctatccaatggtatgctacttatctgttgaaattggaaaatgacaattttatacgcaattatttttttcaaagcatgatgggacaacacttatgaccatgactgtaggtttattatttatttagtaatcagaacgccaaaactttgcaaaaacttaaattttccggngattttcccttgcaaaagcacaagagccgatctcgagttagaaatatactttcaaaaacaaaatagaatcgatagatggggtcaaaaactagcctnagcaaaatttcaagaaaatctgacccgaggaaaaattttttgaccctagtgtaaatttcaataaatttctatcattt

SEQ ID NO: 24233 - DNA, 1340 bp, Heterodera glycines
  misc_feature (1279)..(1279): n is a, c, g, or t
aattaaagaggaacggcgtaaaagcacacaattgagaattttgttcgatccaaatcgacgcttaattcaattgaccttcaagttgcaacgggtgagggtcatttccttggatttcatgaattttccccactatgtccttgaaaatcggcatacccgtccttggaaacggaggatggacgatgggagccctgtcttaaggcctatcatgttctttcaaatatttccttttctccactccaaaattttattaacaaatttaatcgatactgtaaattaaacggccttaaaatcgcttcaaataaatgtttaactttacatttaggacacaaaaaccaaaaaataaattattttattgatgattttccaattcctaaaaatcccggaaacgaaccagtcagagaccttggcatttattttactaatgatttgaaatgggcacaacatattgaaattatctcgaagaaagcattacgatctgcttttgctatattaaagtcaatcaaaactggtgatacgaaaatacttgtaaatttgtttaatatttattgcagaccaattttagaatttggatctccaattttcaatccttatttaaaaaaggatattgaaaaactggagaatgtccaaaaaacttttttgagagtaatatttagacgtaacaattatgctgctgatttacctaattatgctgaattgttaaacatttatgatcaaaagtcgcttgagagtcgtaggttaaaaatagacttaaaactttttcatgaaataattttaggtaaaataaatttacaaaataatgaatccttttctttttccaaaaacattgtaaaaaatgaatacactataacagggctcccatcgtccatcctccgtttccaaggacgggtatgccgattttcaaggacatagtggggaaaattcatgaaatccaaggacatttaaaatttttattatatgcaatgaaaaatggttaaaattacacacatggtaagcaaaagtgcctaaaaacaaatttttacacttaaaaaagattaaaaatgaccctcagccgttgcaacttgaaggtcaattgaattaagcgtcgatttggatcgaacaaaattctcaattgtgtgcttttacgccgttcctctttaatttgcttatgttctttgttttccgtgtgcgactttatggccgaaactcccatcgactcgacattgatgtcttttggcaaaaagcacaataaaaaatccattcccgtttcggctctcttgacaaaagtatattgcttttcccnatcgggatcgaaagaacatttgcgcttatttgggacattctacatataaattatgtcgcaa

SEQ ID NO: 24234 - DNA, 1703 bp, Heterodera glycines
acgatgagaagcggcgatgaggtcgcttttgaagtgctgttgttgttgcacaatgaacggacgacgatgataaacgcaaatagttctgttctaaaaaaagggaaaagggcataaaaacgtatcacctccaattgtgatcggactaaacgatatttaggcatatccggacaataaatttttgagtttttcggtttcggttttttaaccgaaaccgatcgaccgaaataatcaaaaaaccgaaacaaccgaccgacttttttaatgcgattttttaacagattttgtccaaaaatgaacaattttttttcaattttgagcaaatttttaaagaaaattaaggatttttgggtccggttgttcagataggcgccgctgggggaaattttgagaattttgcccatattttttgcagattaaacgttaaacccagggctcttatgaaaattttcaaaatcagcatttttgtggcgcacttttttaaatttagtcatttttggacaaattttcttaacaaatcgtattaaaaattgcaaatttttcccggcggcacctatcgacaccgccggttgcctgcccccccccccccctgttcaccaaaattctttataaatattaaagagcatttttctgttaataaaaacggtttattgctttttttggaaaaaaataaataaaatcaaaaaaaaaaccgaaaaaccgtaaatttttcttcggttttttaaccgaaaccgaccttcttgtccggtctctagttttaagcgatcattaaaagtaaccgttatcagaaaaaaaagttttaacggctctccattcgaatccttattttttaaaaaagcataaatttctaaaaaaaataataatgccatagttggacagagaatatttgttattcagtatttacaaatatacattaataacatatatggtatgtacaaatcacaacaaaattcacacaaaatcgtatggcattttaacttcgttttgctcatttttctcctccgtccgtccgttcctttctttttccgtcgccgtccgtcacttacagcagcagcagttaatgcatttgaccaaacaaatcacgaggcgaacaaccaggcaaaaggcgagcagcaacaccaggacaaggaaccacgatttcattctgaggcaacaatctgaaaaatggagaggggatggcattcgaaaatggcacttttcatttcaaaatggcacttttccattcaaaatggcacttttcatttcaaaatggcacttttccattcgaaaatggcacttttccatttacgatccaatttttttgaaaaaaacgaatcctgaaaaattcgaatttttaactttttttcgagttcgggtagttgaaatgggcctaaataaatgccatattcatgttcaaggcacaaagaagccgaaaagtgccacaaaacatttgtcatgtgccaatttcgtgtgccgacctgcgccattgtctccacagcactcgaaataatgcgcaacggatggttcaccgcctgaaaaagcaaacaaaatgcagaatttggtaaatgaatttgtgtggaaatctcacagattttggcgatatcggaggagacacaaggagaagaaggaggcgccaaataaaaagacgaacatccgggcaaaaatgggacgaataggaaaaggacgacgaacagcgaaaaaggcatcggagaggacggcattttgga

SEQ ID NO: 24235 - DNA, 1528 bp, Heterodera glycines
cctatttatcctgaacctgtattttctcggtcaaaattttggtaaagagagaaacgaagaattcctgggctagacccaaatcgatcaaattaaatgagaaaaacaatgaaacgggaatgatttccttcagagttaatctcccataacaatcggatgatttcatccgtaatataagcatcgattgctatcagattattattcatgtccaaaaaagaagcattttaagtcccgcagaagttcttttgccccgcattttgtcgccgtcaaatgttttctgtgctgtctgtcgcccatccgtccaaaagaccgccgaattgactcaaaaagtgaatgggacgaaggaagagagaggggagagattaacgggtggcacatggcaggggaaacagctgtgccaaaatgggtccaaaacgaattggcccgaggggcgaagaagaagcatttgcccccctcacaaattgtccactttcctctccccatttcctccaaagctctcattatttttccatgaatttcctccaaaatgagtgcccttctgctccaaattggctgttgatggcaatgccaatttcggcaccttcgctctctttttctctttgtcggtaaacttttagtgcttttcacttcaccgttttaacaaataattctttggtttgccatcttttgcaatggcttattggcattattggctaatgttccgccccccccccccccccccacagttcgcccgttccgctcattttgctgctaatttgtgtggttttggcccacaaagactggaccaattcggcctatcccgacctgcgcggtccgacctttcacgtgagaaagggaatggacagattggacaaaacaaaatgattaattaattaattgtgtattagttaattgccagaaattcatcgcctttagcaatgtgccagccgaatgccggacaataagccgttgtttatttgtgaccccgaccgcattttcaacgccacacaatgtaactgttgcggaattagcatctttcaattgcaaatataattctgcccagtgattcggatcaacaacgaacttgccaaggtggccattggcaccccgtgcccgtgccagcggcggtcgcaatgttcgagtaaagccaaagggcgaaattggggggcaatcgccactcactcggcgccaattcaggcggctacagtctcaacgggaacactttccacggatttattgtgtccatcgctttggtggacaatttgcagatgaatttccactcgccctccgagcagtaattttcatttcttttctccgtctgttgtcctctttaatcccacccttgggatttcactgaatttttaattgttatttaaaaatgtcttattgcaaagatcaaataataattagtaattagggatttaactaacgttttaaatgtgccgcccctcccaaccgaccattttaattttttggtctccgctttttcagtccctttttttcatttcccattcccccaaggcaactgattgaccgcgcagagagtttttgc

SEQ ID NO: 24236 - DNA, 2040 bp, Heterodera glycines
  misc_feature (1213)..(1213): n is a, c, g, or t
tgattatggtgttatcgtaccttgattaagcccaccacagaaagtacaatacgtggaataatatcctttattccgatggtacatgtttaacaatggtgagctttcccgattcggagcggggagggagggggtcgggatccgaatccaacggccaggtggagtgatgtgtgtatggacaaaggaaaagcatatacaagcacattgggggaggagacaaagggaaggaccgcccaggcaaattgtcatatggctataagcaaagaagagggagagaagaaaaagagtagaggcaatgagaaaaagagtaaatgattagatattagtcaccctattgtgcctctcatccatgtaacacaggggtgaaatttgtcaacgttttttaaaatgtattattttgtgacgcacactattgtgcctctcatgctttagagagagcacatgtgctgaatttgtcaaatcgaattgtttgttattgtattgttatgagatgaccctgattatggtgttatcgtacctttgataagcccaccacagaaagtacaatacgtggaataatatcctttattccgatggtacatgtttaacaatggtgagctttcccgattcggagcggggagggagggggtcgggatccgaatccaacggccaggtggagtgatgtgtgtatggacaaaggaaaagcatatacaagcacattgggggaggagacaaagggaaggaccgcccaggcaaattgtcatatggctataagcaaagaagagggagagaagaaaaagagtagagacaatgagaaaaagagtaaatgattagatattagtcaccctattgtgcctctcatccatgtaacacaggggtgaaatttgtcaaagtttttaaaatgtattgttttgcgatgcatactattgtagctgtcatgttttagagatagcacatgtgctgaatttgtcaaatcgaattgtttgttattgtgcattattaacgtgtgaataaattttgatgcgattttattaattacaagtaataatgaatttatgaaataatcaattagtttaattcatttgtcttttgccctccctttttgccagaaatcaaatattttgttgtcagaaattttgccaatttgaaaataatccaagcaaatattcccaacagtgccgcaatggacagaatgatgtcgacgctataataggccaatgtgccgagctcttcttcncagggcaagttcaactcgttcaggtcggggaattcggccgcgaattccacccatcggatcagcttttcctttgccccaaaaggggttgaagcgaacttttgtttcaataatttgacattttgtatgtatgaggggtcatttagcacctgcaaagcaataaagtcattaaatgcataatcagttcatgctaattagccttgtcaagtccatcgaccagcagctgttcggccccgtccccgttgagttgaccaacatccaattggacagcaatgcctttcacacgtgccataatggcattgtacagttggtcggcaagcaacggaatggccaaaattggaactccaaattggacagcctcgttgacactgttgaaaccgcagtgggagacgaaggcgcgcattttgggatgcactttgaaatgaaatttcaaattagaaaaggaaatttattaggcaattaagggtaattaactgtagtgcatttgatatgtattaattgatcaaatgttaacagaattttcggctctattcagtttattcgtccaatcagtaactatcgttttagtttcttgggccacaatattttcaatgcctatattgttgattcttggtatcaaacgatttctcagtctctggaatttagaaactcaagaaaacatcaaaatcttgacatagaaaatagcaatgagaaatgcggaattcagaattttatagtaaattcaagaataattttttgtctgttgcatttagccgagaatttagctatacaaaaacttctgtagactttgatctttcgtttgataccaagaatctaagcattgacgaagt

SEQ ID NO: 24237 - DNA, 1182 bp, Heterodera glycines
gggaacggatttatatgtgctaaaaaacaccaaatatgtacatatatatgtgccaaaaacccccaaaatatgtcctaaaaacccccaaaaaggtcaaaatattagggatgtgcgagagtctcggttcccgattcggggaatttctcgggtttttcgcttcccggtttcggtcccggtctcaagtttttagtccggaaaacgagaatttacactgttaagaatggccttttcggggagtgggtcgccggtaaagggagaaacaggaaaaattattgaaatttttaataaattttcttaataaaactctaaaaattccaaaaaaaaatttccggcggcacctatcggcgccgtcggcccataaatctctacaatttcaaaatttgaatataaattgctcatttttcagtgaaccccgaagaaaaatattcaaaaaattccgtttttttctaatgcggcgcctatcgcggtaaggggtgaactctatgttacaaccaatttttttaccgctggcgcctgtcggcgcccgccgccggtgaatttcttaaaaactggcttaaaaacaaaaaattggtcaattttagacaaaatctgttaacaatttacacttaaattgtcaaaaaatttttccggcggcgcctacggcaccatctttccgcaagagaattaaggaaaaagagcaccgcaaaaaagcggtttttaaaagcaaaaaattcgttaaattcggtgttgaaagtcgctcacaaaattggccgattggccgttgacctcctcacgcccagggcgtaggcaggggcggggggaacgggctgcgccggctaaagacccccccccccccttaagcctaaaaaagaaaaaattttctgcaatttttttggaattttatgcagtgtcgatacaaatggcattaaaattttcaaaaattttcccgtctgccctaacggcaccaccggaccccattttattatatttttggaaaattaagacgaaaatggtaaaaatagtaattttttggtaaaaaaaaacagctaaaaaattttaaatttctcggttctcgattctcgagtcgagaaatttctcgggtttttggggtctcggttcctctgttctcgtatcgtttctcgggggtcatttctcggtctcgtttctcggttcccgataaaaatcacttctcgcatatcccta

SEQ ID NO: 24238 - DNA, 1932 bp, Heterodera glycines
agcaaacggcactcagccaaaggcggcttcgtcatcatttgccacccaatcggcgatcaaaaaggacaattatcaggcccacgagttggtgctgaaccgtcccaaggccgaggtggacaaatggatggcggacaacgaagtgaaactgagtggccatagtttgacaggaccagtgaccagtttccaggagtcgacattcccaggtttgcatttggtgatttggggcacctttttggggtgatttgtccctcttttattggcactgaccaatagcaaaaccgaaaaataatatttgattttcaaaaattattgattttttgagccatgcccaacacatccacggcacaatgcggacgaggcatttttgtgtatggatgaattgggatatggataaattgtgtgggataagttggtttaatccccgatttctaaatttattcttgtctcaagttgaataagtgccaaaatttattgtgtttggtgattcgtaaaatgcggagaataaattttttacaaaaaattttcctaaaattgcattgacacagtctcgtgtcatctaaaattttatacagaaaatactcattttttttctttcagcaccaattgttgcccaactgtccagcgtgttctccgcgcccactgccatccaggcaatttcgtggcccgtcgcgctggccggaaaggacttgatctccatcgcaaaaacgggcagtggcaaaacgctgggcttcactttgccaggtttggatttccttcccccgatttttagtgctgataaatgtgccccgccggtggtaagcgttattcaacaaatttcaagtttcaccctgttgtttggtttacaaaacaaccatcatttaaataaaataaattttcatccaaattcatggtatatgtttctgattttgtcaaaattggtggtcatgttcggtgatcagtcaaactcaaaaccaacccagacaacatgttcataaacaaacttttaggacaacaaatttttgttttcttcgaaaatgggagagaagagagctatgggtttcattacccattatataaaaaatatattttcaatgaaactaagaaaaatgaagaattttgaattgatcataaaccggtcaaaatttcgccgagcaggttggcatttaatacaaccggttccatggcccgacctttccaaaaccagtcaacccggattcttcaaaaagtggcggtccggttttgccgggcccgataaaaacatgtaccgggcatggccagggtttcgcatccacttacaattagcaggaactctctgtcccgggttttttgtgaaaaatactgggcacataagttttaattgacccaatttttctttctttgattaccatttcattttcagccattgtccacgtgctgaacaaccaacgaccgcagcagcagcgtcgtcctggcgaaggtccggctgttgttgtgctgttgccaacccgtgagctggcccaacaggtggagacggttgcccgtgaatatggccaactgatgcggctcaatgtggtcgcgtgttatggcggtgcatcaaagtggccccaaatgggtgcgctgaagcgcggtacgttcgacatttaagaaaaaatttgttgcttggtagtgcggaacccccccccccccccccaaaaaaaaattattttgtttgaaatgtaattcttccgaagggagtcgggccaacataacccgaaatttcgtcactaaactttccaaaatttaggcgtggacatctgcattgcaacgcccggtcgactcaacgatttcatcagttccaacgctgtgtcaatggaccggtgcagtttcctggtgctggacgaggcggaccgcatgttggacatgggttttgagccccaaattcggcaaatcatctcgaaaattcgggtttgttttttcgcgactatgaatagcaat

SEQ ID NO: 24239 - DNA, 1643 bp, Heterodera glycines
aaatttctttaacatattcataacaacaatttcaacggcgtaaatcattttcaaaatggagagaataaatttgatcactttaacttgtcaaaagcaaaacatgcaatgatcaaaaacatttatatattcaatgttttatcaaatttgacttccattttcatttttgcttattcataaatattttaaataaaaataataatcatttatttttggtaaatgctttacaaatattttttgttggcattttgtttgctgcttgtgcaacgaataaatgcttaccaatgcggcacatttcaagaaaagatcaaatattatcataaatcagcacatttgcccaaacaagaccttcaacctcaagtaaaattgtttattcgttaatatcagcaatcatcacaaatcctaaatttgaaaatattaatatttttattagaagaggagaaaaatatttcacatttgccatgttttgagaaaaatggcttaattggtgggcaatttttttttgaaattgcctattaaacatttatcagtcgcctcttttaaactacttttagaattttgaaaatttaagaaaataaaaagattctggcatttttgagaattttattacatataaaaacgcttcataatatacgaaagcataagaaagcataataatttgattaagcagactccgatcgaaaaattactatatttttaccatagttgaattaactctgtcccacccttatttttctcccattaagatcagccacggtaatccggtaaagtcaaacaacaaatggccatggttggtggcactgtttgcccgcgaggccggcatttgtggcgatggtggcaacaaattctgttgtacggcatcaatcattgggccgcagcatgtgctgaccgcggcacactgcttcatgtctttcaaaggcgaacagcgagaaaatatgcacgaagaggtaaatgaaatgatgcgactaatttttttatgttcctaattaggcaccctaattaatgattatgattttcaaatacatagaaaataggaggctgatttaaacaagtacctgggcagtggaaaacaaattttcaactttgaagtagggatgcctcccccattccagcggtgctatgtcgttataaaaaagccatgaaaagcccaaagtgttttccactagcctgtcaaatttcaaaaaatttcactatgttttaaaaaagttttagccaaaaattttgaaaaactggttccgggtgtattttttggccataactttgttcaaacctgattaaattttttgaaacttaggcgagcttatagcgaattgttagagatatcgaatgataccaagaataaaaatttagttgggtttaagcaaagttatggctagtttgttgttgaaaattttcatttgatggttttttataaggccctttttgatggctttttaccaattgaaataaaatattgggaatttatcaagtttgaactgtccagtgctgacgaaatttaacggattttttttaaaacaaggcattcaaaaattgaatgtcgtccaaaagagggctaatcgccacattggcatttgaaatttttttatccttttataaatattattattatttttttgttgagaagttaaaaaagaattaatgttagg

SEQ ID NO: 24240 - DNA, 1947 bp, Heterodera glycines
  misc_feature (448)..(448): n is a, c, g, or t
tccaattcaaagtccagcggctccgattccaacttcgtctttcgtgtttcaaatttcactttgcctaaaagccattttggggatgggattggctaaaatgacattttgcggattgtctcctcccttctccctttttggcatttcccttggacctgtgctcattttcagttggttctcccgctgcacagtgatttcgtagtacagctgcactttctccgcccccacaaatacgtcgtgttcgaatagcacctcgggcgatgtttcctcttccgttggatattcttccgcactttcgctcatgtcaattagcagcgatgccctgcacagccaaattccgctcttctgcttcgccacttgttctttgctctgaaatgtgagagtgaaagcgaatgcaaaaatgggatagaatttggcaaagtttgatcaatttgccatccatcgaaattgngcattttgaatcccccccccccgttgcgtttgattccgcccctcccattttttcttcgtttacttttcccgcgtttatccacaacaattggtttatgttcggcacgataaattggccttcgcaattctcttttttctgaagattattaatttatgcttctttccttttgcttgtttcttttaccgttacggggaacaaataaaagaggagaagctccgtcggtttcaacgccttccaataatcggacagccaaaactgttcaatgctgaccagcaaatcgggcattttgccattttgggtgagattgtatttggccttgggttttggcaatttgcgaattgctgcaatgaatggatcaacaatgctttatcaatgttctgtaattagttggtcaccggaggagaagcacaatttggaaatgccttcgtccgaatttggcctcagcgcacttttcaacgggcgcccttttgaggtggggagacggcactcaaatggggacgaagttttgtccaatgctttgctgggcactttttcgttgacaattcgaacattgggccccgaatgggcgcattcgcaaggcgacaaaatggggggagaagcggcgacggaaggcaaattcaaagggacgggcagaagacaaacgctaaattagcagcttaatgaacccaaacaaagcaattaactgagaatagcagatcaatgactttttaataaaaatggaaaaaacaaaaacaaagaaacgaaacgacggccgatgacccccgccccgccggtgagtacgagatacgccgcaacccccagttcaataccccctaattattggattggcttttcgtgttttttgcccccccctcaattaaaatgccggccaattcccccccccccccaatgttcttttctcacctgtacccattccgtgtgcactgctcgcatcgctcgcacttttctccttcctccaattcggccttctcaaaaagtcggagtgctgtgcccttttcttgcaacggacaaatcacttccacacaatccgaatgatcagattcaactgcttcaaggcaaaacaacagcgaaatgagaacaaagcgaagaagagaagaaacggtagtcaaatggagaggaaaagaagaggtacggtatttgtgagacattccaaaaaggagggacaaatgacaatgaatgagtattaattattaagtaagggcttcttcttgggttgatgatgacataaataagcagaacaattagtcttaattaatacaaaataaaaataagtgaaaaataaaaaatttaaattaattttgacggttaaatcggaaaataaaataaatcttaggaaaggggaaaaagggggggggaagcgattttgagggaaacgaatgcttagggataagtgggcaaaagcaacaaacagtgatgagaacagaagaaaaataaacaaagggaggcgaaagtggcgaagacaaaaatgacttaggaagcgattggagaagtgaaaacaa

SEQ ID NO: 24241 - DNA, 1971 bp, Heterodera glycines
  misc_feature (1942)..(1942): n is a, c, g, or t
tctgaccctctgaaaaaaacaaattatgcaaaaaatgatatttaattctaaagagattgaaaaagggaggcaggcaattgggatgaatcagcggacggttggccatcttggtgatgcgacatttgcggcgcagacatttgcggcgccgacacttgcggcgcagacatttgcggcgcccacccaaagtgacaaaaaaccgatttttttctgttccagatttgagaacgagactctcgaacatcactacaaaagggaccttcttcgaagtcagtcaaaaatgacaatggctggttgttttccatatggtttttcaaaattcgaaaagcccttgcatatgtgcttgaacgccgatttgccattaaaatatacgcagctggtattgaaacatgttcaaccagcgtgtttatagtatataattgaaggaaatttggtgggctaactgaattaacgggaccaaaaagttttattttctattttttcaaaaacctttgaatgtcccatctcctgaccattttttataagaaattagacgctctaacccgcgatctgtacaaaaaaaaaaacagcctctactggttctgccgttcgagaatcatataacaaaaaaagatttccatcttcgtccaatgtaaatgatcccttaaattatgctaaatttacaacagtacccctttttaatacttcaaggactatattttgtaattcctttctatcgactccaatagccccagggatttcccgttgccttagtatggtgcgttggtccgcagaataagatggcaaagccaaaagcgctgagtcgtccaagtttgagcgcatttggccaattatctcacgaggtgggaggagtttgttggaaatggcaacttctttcgcttcttcaattttttgcctgacctatataaaaaaatatcaaaaattctttccccgaaattgaatgaccactgtcttatctgcattcggcaaatgattatgtgccgtaatctcacggagatctgttgtcccagctggagcatgtgctcttccggcgcaacttcgttttacacaaacccaaacctgctcaaattatttttattttttttcgtaagaattttagtacttgagtcatccccgtattaatcagctcctttttgcgcatttaaacccattgaagaagactaaatctttgttttttgttgttcgtgaatttggtggcggagaatggacacatgataataatattaaaaaaatagttaagcaaagcattgatctgttggaaaggattagcattaacaaaattttgaactgttctaagtgaagatgatggaaaattcagcggtttgaggaaattgagaatgataaaatttgtggacggatcaaattgccgcagaagttcgagaacaactgataaaaaatttgtggaccgatcaaattgccgcaggaatttgagaacaactgataaaaaaatttgtggaccgatcaaattgccgcaggaattcgagaacaactgataaaaaatttgtggaccgatcaaattgccgcaggaattcgagaacaactgataaaaaaatttgtggaccgatcaaattgccgcaggaattcgagaacaactgataaaaaaatttgtggaccgatcaaagtgccgcaggaattcgagaacaattaaggcaaaggtgaaacttggcaaaaaataatttgaaaaaaatcaaattcaactttggaaagacattaaaaaagaaaaaactagagaaaaatttatagaaacctttattcagtcttcactgatcaaaaaattcctgtttcctgtgaagtcacccctaaaaaaaatattgactttttcacaatgacacttaatgaaatttatttggctcttaataaactagaaaacaataataatacttccattgacagcatcccgaatatttttctcaaaaattgtaaagaaaatttggtttatccgctnatttcattattttttgtttttcaatgatg

SEQ ID NO: 24242 - DNA, 1790 bp, Heterodera glycines
cgtcacaatcgcaagccgcaaaggtagtgatgcaagtgtgtttcgtgaacggcacgcacgtggtgccgtatgaggcggtggagcgcacgctgcgcgacgcggacacggtggagggcatcgacgggtttgaagaggtgggcaaggggaagcagtactttacaaagcaggaaaagcattcgagagttgggaggttatctcattttcaattttaaaagaaatttaaaaaaatttatttttgcttaaatataatttttttattagataaatgttttaaatcccattttatatttaaattattttaaaattttaatttaatttaaatttatatgtttgttaaacattattttaattttatttctttatatttacaaagattcactttttaattgctttaattatcattgtggaaaaacacgattatattccttaatttattagtttattataattttttttgcatatattaaataaattcccaaacataattaaattttataatttgcctattcttagtactaattttagatttttttaaagatttttatgttatttaaatttgtaaatttaaaatttggcgcacattcttttttcttcccaaaaacagaatttgtttgtggcttcttcgtcttgggcaaagggcggcgccgaatttttgggcgctaatcgcccaacaaaattggcccaacggcggcgtcgcgtccaacgacatttggccaacttttgctctctttggcactgatctttggcgcactgtttttcgccgtcggcacaaccgttggcgttttgttgtgccaatgccggcgccgctttgaggcggagaagcgattggcactggcggctggcaccatccgtgccgcttctgcccatgccgagtcagtcgggtgatgattcgttcgggtttcatgccttttttggcccaatcccatctggtctaatatttttttgacccgaaattcatcctgaatttttttttgccaaactttctcttgactttttcggcattttctggcccgaattctaagcttctttgccgccccgacttttttttgttagacccgatgggttatttgtaatccaagcaacattttcgacccatgtgccaactctggtcctaatttcgcgaaattttatcctatctttcgaggctgtcgagcttttactatggcatttttgccggcatttctatgccattttccgctgattttccaccattttccccaagctgctgttgctcgtcgtccattgacaatttgcatttgtccgctggtgccgccaccgttgacgagaagcactacacattggcaccgtaccatcagaaccatttcatcacttcggcagccgccgcttttccttcgcctccaccgccttcctcctcacacaactcacagaaaagcgttgccaaaatttggtaatatttttcaaaaatcatagaattttttttaatttcatgaaaaatttttgaaatttcctaacgattactaaaaaattttatgatggattactaagttttaaaaaaaaatatgatggcaaaagaaaaaggatggattttaatttccctttcgattaaacggtaataaaatttctttgtcagttgccccattaattaattaattaattgcctaattaggcgacgacctttgcctccggcgcctctttgcccccatcggcggacggaaccttttaccaccagcaccaaacggcgccggcacaccattattactcagtgcaggagatgaaaatcaatttgtgaacaccaagacacacaaccgggaagagattggcactttgga

SEQ ID NO: 24243 - DNA, 1399 bp, Heterodera glycines
ctttttaaactctatcgaatggtgtgccatatggccggaaattttcaaatttttcgagctaggccccctagaaattttcggaaatttttttcggagaaaaatgggggtgaaaaatatttttctggggtaaaataaggtgctgagtacgaatatgatgtctattttaagtttcataatttttggaattttttaaaaattctttattttttggcaattttttggccctcgggattttggcctaatatttgaaaattcataacaaatcgaagggtggatcaattttcgtgcaattatattataaaaatagagaaaaatcaggagaattttatgggatttatttgggatttctatcttaaaaagaaaacaagttattccagaatttctgaaaattttcgatttttcagaaaaaaattcataacccccttctgaaaagaaatttttgaaaattaaaatactacaaaaatccgcaatttttttctttataatataaattttattttacatttttatcactttcttacgaattgttacaaaaataaaaccgattttgggattatggaccaaaggggtgagcataggatttttgggttgaaaaattttttcaccaaaaatcttcaaaaaatatgtctttaggggttatttgggccgctgatcacgaatacgtgatcagattttacttttgacatcgtcaagacctcagaatccctgtgtgattggggattctgaggcacccttatgaggagggggggggcggcaggttcggacccggacggtgtacattatttttctatgcatttttgggttattttcactgtttataattaatttgaagatttgttttaaattatttaaatttatttttttttttaattaaagaaattattttttgttttattattattaacaaaattattttaattaaatttaatttttcttttgaaaaatagatttatttttaagcaaaattagatttaaaaatttggatgcataataattcatttcaaaataaagtaaaataaattattccgtttattaattaaaaaataaacttttacattttttattattttgtttttttaaaattttaaaataaacctaattctataaaattatatttaaaattatgaaattatttttgtacatctcataacaagttagacttttgtacctcttctaatcacagttgtacctctttaaatcactgtttacctcttttagtcactgttgtacctcttctaatcactgttgtacctctcttaatcactgtttacctcttttagtcactgatgtacctcttctaatcactggtgtacctcttctaatcactgttgtacttcttctgatcactgttgtagcacttttaatcaccattgtacctctcctaatcacagttgtacct

SEQ ID NO: 24244 - DNA, 2410 bp, Heterodera glycines
  misc_feature (2405)..(2405): n is a, c, g, or t
ccacctgctgatttcatttttataacaattccaacaaacaaataaataattatagtcattaaattgaggtaaaagtaaattgctatttgatgattaggatgcttaaaggaatttttgttttaattttatgacaaaagattgttttgaaaaaccatgaaaaaatcaatgtaatttccagtgatcatctgatcaccatacaattcaatattctgataaaaagtgtaacataaatctatacagaaaatagagcaaataaatattatcgtagtcaaatacagtcggattttgcgcttgttttggctgtaacaaatttaatgtaaaggcgaatattttttatcgtttttttacatttcaccaaaaattaagacaattagtcggtcaatgccagtgaacaacattgccgaattaattccgcctgcatttaaatatatttttaatatataatatttatacaattttagctttatgaattacctaatccaatcacaggaatgaataaaatcattgctgccaaacgatactcaacgaaattttgtccagacaaagcgttgtacacaaacagaaaatggccagttaggtgaagcaactcaaaaaaggagcaaagtgccaaaaggtaattaacggtgccattcagtgatcaaaaaattaaattttaaaattaccaaaataatgataattaattatcactttgttttgatggtgacaaaaatcacggacaaatgaaacaggattccaaatgaagcagtgattccaaaaattgctgcacatccaatcagagaccagctgggatgggcatctttgaaggccaaataaaactgcaaaatgattgtaaaaatattaaaataacactttaccaattaattaccgtatcattatcgtagttgtccaatttggccataaataaggttaaaaaatgtaagtaatttttaaagtttttatctttaagtataatattttagaaaaaagcattttaaattaattctttattttttaattgcttttgcatcagtggagcaaattattatttttaaatatctattttctaattagttagtaaaaatgtgatatgcgattctctcaatctaatgaagagagctttctttttattgtattttattacaataattgtgaaaaaaatgaatagctactttattcaattaagagttaatttgccatttattaaatattggaattgaaagaatgtaataaaaagttcatttactagtttaatttaatttgtttcagattgtcaaatatttatcagttttttgtctgcctttcatttcagcaaacaatttattatttcaacagttaattaattttaatgccaaatgatggcaatgaaaacaattcgggtaatttcaacaattcacatgcctattaattaatgaaattacacgttgttcaccgataattacatttacatggcaaaaatgagcttttttttctaataatatatggtaattttaagatattttacacgtttttcgccgataattacatggcaatttttttttttttgattttacgaattgtcatacattatgtatatgatgcgaacaaatgaactctaaaaagattttgtatgacaataattgtttaaaaaaattaaagaattcataaatattttgtatttttttttgtaaaatgtgccgaagtgcgccttttggaaacctattgaggcaaaacggcatttttccaaaaaaaaaagtcaaaattttcacagaaataatataattaaggaatcacggttttaatagcattaacttttctatgggcattttttgcaaaataacaccaaaattttttcaaaaaaagaaattggtaaaaaaaaaaagatttctgcaccaaatttttatgtatatatatattatatgttgagacaatttttaaaaatagaattcatttcaagctggaattcagggacaagatggaccgcaaggctgaaagcaagctgtttttgtcccatatcgattctgttctgattttttgtttgttcgaaaaatgtttaaaagtaatatcataacatatttattaatgtatttccaacgaaaaaaaaaattacaaaacactgaaaaatggttacgggcacatttcttcgagaaataacaaattaacattggcatggaaattgtgatcatattggtgagcgggttaatgttgttgatggcattataataaccctgtaagagagaagaaatctctcatcggctgcacgatatttgagcgactttggaggagggattttcaccagcgacgcttcgtgcgatgtctgcgttaattggcttttgctcatatcgaatggctcccggacatttcgacagcaaaggacatttcgacagtaaacacaaaaataatggactttttgacagtaaacataaaaacaaattttcttattaaaacanaatta

SEQ ID NO: 24245 - DNA, 1732 bp, Heterodera glycines
  misc_feature (154)..(154): n is a, c, g, or t
tagtcgcgcatgacaaaaaaagcgtctgagggactttcagctgaataatattaaacattatgtgccttcatttttaactcaccagttatgtcgaagacgcgttcggcacggcataagtcattgtaaacggcacgcaatagtcgcggacccaacncaatgcgccggtaagttggtggaaccagaatttgtgcgatgcgcactcgttccttgtccggatggtggtaaaaacggtacaaattgacgtaaccggcgaatcgatggacggaagaaccatcgccatcggaagatggacgcacggcaaacagaaaataattgaaataacgatggtcatcattgtcagtgtaagagacctgaaaagagggaacaaatggatgagcggaaaatgggaaaatgaaagagcgaaaacactgaccgcatcgatgtaccaatgggccaacgcttgcactcgctccagaaatttatagccctggtcaaattgagcatcgttttgctgttttttctcgaatttataaagtataaagttatgttcaatctctgaatctgaaattagtatttgaattataaaacgaaaaaattaagaaaaaactgagtttgatgagttcagacggtgtgtcaccattcccttcactttccccacctttaaggcaaaactttgtgatgagttctccgaaaggaacaaagttcttttgctcgctgagtttctgcctgaatttctcaattgtcaaataggcgttgagttgagtttgcgggagcgcgtctttgattctgtattcaatatcgtcgcactaaatgacggcaaattagctaattaatgagtcattactgtttgaccaacaacgaaccttcgtagagtcatcctctttctgttcgcattcataaagggaagtcagaaaaagggttggatccgaataaagcacggacactttcaggtttttatatccgacaattttttcactaaaaacgaatttgtttagaaaacgaatgagatggaagggacctctcgaagtgttgatgcgcaaattcgggcgcaaaaacaggggccgtttcaagttcatcctcagtgccaactaaagaaaaaaacaattcctttgatgaagataaatgggctaaaaattaccaaatgttaatccaatcgtttccaatgcgtccgaaacaaacgcatcatcagcactgagaaaaatttccctcggttcatcgatgtcgtgcattgaaaacaaagaggaagagagtaatgaatgattaatgaatgtggatgtacaacttgcaattggagataaataaaaataacaatttaaaaaagcacaaatatgacaagaaaaattttttgagcaaaaccaaatgagaaaattaataaccgaatggaaaacgcgccaaaatttaaaaatggaagcggtgctattctatgagcgcgtctgttcccggtgggcgtgggggaggggtggggtcaaatccctctggctatccgtccgagttatgtacttatgcctaaattgtaagctagtgctaattgtaagcaaataagagcaacagagaaaaggttattctcgaatacaccggcaattatggaggttcaaaccgagaataaaaaaaagcagaaatttgtttgatatttaataaatataagaatcattaaatcatataatgattatgactaaaaaaagaaacaaacgaatgaatgaaaaaaaaaaatttgcactttataaaataatacattaaatcactggatcttttt

SEQ ID NO: 24246 - DNA, 1357 bp, Heterodera glycines
ttcattcgatccagtgtgccccaatgcctcatcaaaaaaggagctcagcgtactttccacccaacaggcatctaagacgagcacacagctgtttcaatgttaactttgaagcccaagacgaaaaggtaacagcatcaaagccaccttctgaagtgagagtcaccttaaaatattttcctttatgactttcataaaagtggattaaatgcctcgtaaaacacaaagggatagaacaaaatattaatggccgttaaaaagcttagcaatggattttaaataattttagacataatagatatcggagttttttttaatagcaaaacccaaattgaaaaactttattgaacaaaaggtgcatttcagttagctaatacaatgtgcttttcgcaaaaaaaatttcttgtaagaaaataattatcactatttttaagttctgaaatttttttttttttgctttatccttgaactcattcctagccatttgctattcaaaatctccttttgttaaaaaagaaattttacaatagggttataaacctaaaataattcaatattaagcccaacgatgcattgaaaattcatctgttgcttttaacataccgatgtaaattcacccgcatattgtaaaaaccaatagcatatgatatggcctgattcatgtacgctgtcgcggcacgtgccattcgaatgttggtttttttccaaatccattgcctcgctgaactgtttgttgttgttccatcgcctgttaactgcacatcttgtccgtcccgttttttccaattttctctgaattaaaactatttttatctaataatcatatggaatagtgaatgaaataaacttggttcggagcgtgattgtgtggtgcggtttcatgaagcgttctcgatcgaccttgagactcagctctcccttcacaatttggagtcatacacgtccatacctgctcaaattgttttttaaacaaatgcttcatattcaaattgttttttaaatatttaactacttgaatattcccatttatttttctcttgttttgcattctgtatccattaaaatgggttattcttggattgtaagaaatgacatctgtcacttccaaaatagaattattatgaaaaaaaagccaagtccggtgctcaggtgcgtgatcgaatggcttggagccggacgatttcggtgcaaaaatacttgggccatagtgccaaaatagatttattgatttaacctatatttacaaagatgggatcagtaattttgtcaaaacttgttattagtttaaacataaaatttcggattggaaaaaattctccagtttattctaaaaaaactcggcctaaataatttgcaaagg

SEQ ID NO: 24247 - DNA, 1155 bp, Heterodera glycines
aattgtttgaggtcccccaaacgggccccttgaaaaaaattgatttttttttttttggggccagtccccccgaaaccgatgcgcccagatttatggggagaccgaatcctttggggaatagcttccctatagcctgtacttttattcttgcgttggatttttgctccccataattgtttgagtaccccaaacggacacttgaaaaaatgttttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgattttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgaaggcgcccagatttatggggagaccgaatccttcgggaatagcttccctatagcctgtactttaattctgcgttggatttttgctcccca

SEQ ID NO: 24248 - DNA, 995 bp, Heterodera glycines
aacgaaattttggggaattaggtgcgaaggttgaggcgattcgcaaaacaatgctgaaattgaaaagctaaatttgaaaaaattcaaaatctttcttgacttgccaaaagcatgcccccccccccctccttattttacaaaatgccattaaattaattttttgtccattttttgtcattctctcccgtcccacttaaaaatgtagcgaagaagcgtcagcacatgccaattctgcatcagccaagccttgtggattataattggcatcaaactcaatcgaccaattggtgaaagagcatccgacgacgaacggcggaaggagacgaagaaaatcaaggacagacggaccaatttaggctgttatacatacatacgcatcatgggtgcaactttccggcacattttggctccggaatgccgcgtttaaaagcaatcgcattttgccggaaagcgataatagtgcctatggtaccccccccccgccttgttcccccataaattcaatgtctaaaaggttgtctagtttaatttaaattttggacgaaaagaagcatttaaaacccctcgttccggcctcgcaccggaattccgcgttccaaatccaaaaattatcagcatttttttgcattgtatgcggctgcacccctgatagatggatattccattcataacatcaattttgtttttaatgttcgacatatataaataagaaaaaaaattgctgtcacaaaggcgcttcattattaattaaggctcataatttatgcacgtgcatatttttatcggaaagggtttgaaaagcgtgttaacaaggctttgtaccaaataattttatgctgtattatttgtttttgtttttattaattgcaatagttgaaataagaaaataaattgtatttttagaattaattataataatcatggatgggaattttaggcaaatgcctagaaaattttgcgtgcatgtaacgttgagataagcacaaaaaaaggag

SEQ ID NO: 24249 - DNA, 1911 bp, Heterodera glycines
aagaagcaatgagtgtgggatgatggtggtggtgggtgtttgttatattaggaacaagctttttgatttgttaaaatttcttttttcaaataaaaaataaaatccttaataatttattatttgtaacaattatttttatgattaagatcaattttttgaaattctattcaatttttattgtataaacacacgcataatttatatatgtttaaaaaataataagaattgatatgtcatatgaatatataaataattttttacaatattttttgacctttatctttttaaataaaaattttttatgtaataatattttgataaaatgatttttatatgtaaattttcatgattatgtgaaatgtgatcaagtaataattttattatgtaagtaaaaaatttttatagtatgttaagaataatagaattgatatacatatgtataaaaatactctttttgatttttgaaattaaaaaaataatttttggtattattttagatatagattattacacttaaaactcaaaatggcaccaataattatcaaccattttttgtttgaccgcctcctcctttatgaatggtcaacatctcctacatcattcatgtccagttactttattatccaattcaatcctaaaaatgacgcttataatttttactcacatatttttttccttaattatatttttataataatttttattttaccattatttatttttttacttttgtgcacttttatggatttatttttcgtggattcacattttatgtcattttggtggtgttggtgcgcattattgccaggaacccagacacattattattattatcctagtaaacatattttttccaattttcgccctcatatttttacaaattcccttcatcatttttctattgattataacaaaagttaaattcatttaaattttaatataattttttttaaattaaattaatacattaataaatgttacaaataataaacactttagtgtagtgaaatgttttaaaataatttttttatgttttaattatataaaaatttctttaataatcataattgatcaaccagtttattaatacatcataattggtcaaatcagtttatgtaatacatcataattgatcaatcagtttatttttaaacgaatttttcaaaatatcaaaaaagtattacattccatgattattcatacaatttttaatacaataaagaaaaggtttcattacagaaggtcaaattagtcatcaaaagaataaaataattctttttttttgtctgtgagcgctttgtgattttctttcccgcttttcattgctaagcaaatttcaaattagcgtaatttgtaatcgatttttcttttattataatatattaagctttactttaaaataataatttttaatgtaaaattatttctctaattttagataaaattaattccaacaaaatatgatgctccaatgaaaatcgccttaattgcattgttgaaagctttttctcccgcttaattaaaacaatgttggctaacaaccgatcagcactgcttaatttgttgatcggtgtgttaattggatttgtgttgtcattagcgcttttcccatccactgattttccaagtgtcaaattgcctacatattccagaccagtggtgttgattaaggtggataaagaatatttttattagaaataaaattttaaaaaacagaaaataatttataaaaaatagaaatttatattttgtatctaatagagatatgttttcttgtttctacctaatttttgggctattaactttttttttatttacatagaaaaaaaacataaaaaataggaaattatcgcaaatgaacaaaaaaaaaatgaatgatagaaatatgaaagctatgcaaaacatattttg

SEQ ID NO: 24250 - DNA, 2028 bp, Heterodera glycines
catttttacccaataacaattatgaagcattattttatcaaaaaataatagttgttgcatgaattagagcttttacccaaaaaaaaaaatctaatcttgaaattttttttttcaatttttgttcgaaagcgggtcaggggttcggaattgggcaaatccgagttcaaatgcgtaatcagcacccttgaaaacccctaaaaacttgttttagcccaaaattaaaaaaaaataaaaattagggacccccattcttcaggattgcccaatttgctaccattcaattaattttcgtacattatttacacttccattttctgttttttcagattccccactttgtttttacattttgtgatcagctcacatgcattttgctgacctgtccctaagtgaacgggaaaaagcgctgagtgttcgctatttgcaggagcgtgatgcgatgtttgaggtttggaatcaaatcggggcggggcattattaaccgggtcttaaagccagggctgccgaatgtgaggcttagcctcattttgtacttttttaagaggccgatgaggcaaaattaccaaaaaactttgaggcttttgtattttttttgagtttttcttaggcgcttcgtgttttttgggaaaaatccttcaaaagtgtcattatttggtcgaattccatttaacaaatcgtctaaaaacgcaaaaagaaactttttttttgcataaaaattgttacatagtcagtcaacttaatgtttagaaattcaatatttttgaaaataatttgacaaaaaaagagccaatttttttttaactatgtgttttgagtcccccccccccccgaattttgtgatgaattttttctttaaagctaacaatgcatacgtattacatcagttacctgaaaatgtgaagaaattaaaattagaaatcaatgattaggattaatgagttataatctgtgaccgaaatgaatatgagaaaagacgtaaaacgaacaataacattgatcggtgaattgtcatcataatacacatttgaatattgcaaagttaacctttcggaccaaaagctctttaaaaagcgataaaaagggctctcaaattttaactttttttattttacctaatctttgattattaatttatttcatatcttttcgttgtttatgtaactcatttaacatgcattgtttgcttaaaagaaacttcagattcggtgtttatctcttaaaattaccgcagaaaaatttaaaaaacaaaaattcaagggccggatctaaacagaacaaaactgttgcatacatttacatgcacttttcggtttgatgttgcatcccatttaaaaagaacggtgaacaaagggcgatcgatacgcataaaaatcgatgtaatttttatgcatttggggaaagtttggcgacgaaatttattgtgtttaagccttcagaataagattgtttttttggtcaaatttattttctttttgcattgttccatttacataaatccatttgaggaaatcttggctcaaattgcggcattcatgcccattatataattcttgcgcctagttttgcaattcttccatttgttgattaaaaaaaaaatttaggccccaaaacggaaaagtacctattactattccccccaccccaaaccccgtaacattttttaagtttctcgtaatattttttataattttatctctgtattttattacaatctaaaaacattgcctataattcggactccaataattcaacccccgtttatttcaactctaaaaagtgtttttcccgttgcagcgtttttcggagtggacggagcaggaccagacggacttctgcaaacaccttctgcagcgcatgtgtcaccaccaacacggccaaattgaccaatttttgggcccaatgcttcggcgggacttcattgcgttgttaccaagtttgtttttgttttgtctgggtttttcccatttttagtgccaataaacggtggagagtccgccgctgtcaaaacgtacacatacaattaattaa

SEQ ID NO: 24251 - DNA, 1306 bp, Heterodera glycines
gggatacggtaaagggacagagtttatataagtaaacccatcgatacggtaacagcaccaaaaatgggcgaaaaatggggaagagaaaggaaaacagagcatgagcacaccatacacattcaaataataatgcaagaataagggcaagaaaacgaccgtataaattaattacagtacaccaccgtaaataaattaattaaaaatagtcttcgcacatttcaggatgtgaatcaaagatttatttttttttgtatataggtaattctttcctatttgttgggcctttgaaacagaaacacggtaatggattgtgcgtactgtaaatggacacagtaagaaaaataataataatatcgacacatttttaaaccaatttaaatagaaagcaaaataatggtgaggatgacaattgcttttaagtaaataagtacaaaatcaaacaatacataaaaataaaatggaaatagtaaaatttatttgtttttgggttttacaatttaattcaatttattagcacccaaaaatgtttgggagaaaatgtgcgaaaaaatttaacattgcccataaattagggaattcaaaaattccttgtccagaaacctgtcggggtcgtcaaaagtctgtaagtcggcgagaattgccgggaaaaaatgcctgaatcccggaaatatatgaccatgaatgttccaaaaattttcgggtcagtttcccaatttttgaaatattttgtgcctcggatacatcacaaaaacacacacaaaccaatgtcctcaaaaacgagaattcggtagagaccggaaatttcaaatttgcggatcctgttgcaggattggaattcaaaattttttacaggacaggatccggcaggattaatcctgcaattaaaatctgcaggatcctgcgcaggattgcggattttaggaaatttcaaaaaattctgtattaataaaaaagtctttcaaagtataaaaaagtattaaagaccgatttgccaaattgggtggctcataataatagcttaaattaaagtaaaataatttttatttaaatttctttgcaaaaaagccataattcattatgtatagggatgggatttttaggcacaaaaagtcgcgaaataagcactttaaaagggagaaaaatcctaaaataggcacgaaaatagtaaaaaaaaattttattaacgcttttttagggtaccaaaaacataaaaaaattcatttgtataaacttttttttcaataaaagataaaatttttaaaccgaaaaacttttatttaaaaaaaaaattttttggaaaaagaaa

SEQ ID NO: 24252 - DNA, 952 bp, Heterodera glycines
attgcgccaaagacaaacttttaatttaaaaaagagttaaatggcacgccacaaaaaaagttggaaacaaaagaaaaaaaagataaaatgatgataaaaaattaagtagtcatcaaaaggtcagccagcacacacagaaaaaatacaattaagagagaaaaagggaggagtcaaatcaaagggaaagagccgccactaattaatataaattaatgtgttttgttttgattttgctgttggattggcgccatatattatcaataaatattctttcttccgtctctccatttaatgatgatgatggtgttgatggggcaagttgttgaagtcgaacttgcggaacagttccgtgtccgcctccgtcaccgcccgcttcgcttttgcgcacgaaaagcgcggctgctcccgcgtgaatctgaaaagggaaaacggaggaaaaattaaaatttttagtctttaaaaaacgaattttaaaaataatttgggctctcagttgtatggggaatttgaatttttgcatttaattgataaatttctgtagattcttgaaatcttccggcgacaacaaaggcacaattaaacccatttttttgtgaatttgacggtaaaattcataaattattacaaagggcccaaaatgtgagactatttcgcatcgaggggggggggggggtcgcagcgaagggtaaaagaggggaatttctgaaaaatttggctatttgcttaaaaaattgcattaaaaatcccatctttgaatacattttgttgatcaaatttttagttttttttgttgcattttacgcgaattacgtcattctttcgtcatttttcggcaattcgcagagatatttcggcacttggcacaaaaattcagacccctccactctccctcactttgctcatgtgtatgatttagtggttgtttgttactcactcctcgtcaaagtggaca

SEQ ID NO: 24253 - DNA, 2281 bp, Heterodera glycines
  misc_feature (399)..(399): n is a, c, g, or t
  misc_feature (1124)..(1124): n is a, c, g, or t
aaaattaaaagaaaaaattccaaaaaaattggggaccaaatcaaattaaaattttccaaatggaaaaagagaatttggaaggaagaaggacaaaaaatttttcagttgaagaaaaaagaataatggtaaaagcaatttgatcaaatatatggcaaattaaaaatgaaattcaatgaaaaattggagggaaaaagagaaaaatgcaaaaaaataatagcaaaacatttggacacaaatatttgaacaattttttaattgaaagaaacaataaaaagttgggaaaatggtgaaaaagcaaaaaaactgatgatgaaaaaagagaaattgttgaaaaatatttaaattaaaaaatgaatttatgcaaaatgagaaacattcacgaaaagaatggaaagaatntaatgcaaaaattaaacaaatgtttggaatttattatagaacaattgaaaaatgggacaagaaaattggcttaaatcaaattctttcaaagggtgaaatttttaaacaaattgttatttattaattaaatttaaaaatttttattatttaatatattacagggcagaagcattatacatttgcggaaaaaacggaaaaaataaaacaatattatcaattgaaaaaccaaaacccaaagctcaacgatcgccaaattgcggaaattttaaatattacaaaaagatctttagaaagatataaatctgaattcaagagaaaaagtgaaggtgtcacggattgactgagaatatttttaagctttcagggccattcattgttaggttttgataaatttaaatttcttaaaaatttatatattattcggcatttcattcattttccaatttgttgcttatgtaagagttaaaagtattatgcataatgtttgaaggttgttttttttgttctattttttgttgtaattgccagggaacggatttatatgtgccaaaaaacctccaaaatatgtgctaaaaagctcaaaaaaggccaacaacatatgtgccaaaaattgaaaaaaaactgtcaaaaaataagtgaatttatcaaaaagatcacatttttttatccatttcgctagtacaattctaatcaaaaacatttcaattctttgtgacgtaaatatntttctcgctctccaagatttacttatttttctgtttttcatcgataaaattcaaattttgccttaaaaatgaaaaaagtcattaaaaaatatcaaaaagtgaaaaagaaaaaaaaagaaaatttttgatcatttttggatatcttgccaagaatttgagtgcaaaaaagctactttcgtaaaaaataaaaataaaatttccaaaaaatccccaaaatatgtgctaaaaaaaattagtgaattaatgacatcagatgagaacgaaaatgtgatatttgtgatagttaccttaaaaacctccataattatagttatctcatattaattactacccaattcgctgataaaaggaaaatttaataattgaattattataaaaatgttgtatcaaattaatgaaataatgattaaatgtggttaatattgattgaagaaaaattaagccatgctataaaattaataattacaaaattcattgcgaaaaatatttttataaaaataattcattatatttttacaaaaaaatgaaaatattattaatatttttattattatgcgcattaatattcaaaaaagcaattaaccaaattgaggctggcaaaataatccaagaaaaaagttttgctgaaatatttggccaaagatgggacgacggagcagaagaaaacatctgtcaaaatgatcaaataattcatggagaaattgctgatcagaataaccaatttggacaaaatgttcgacaatttgatcagatttttgataaaaatgtggaagtgaaagaagaggagagtgaagaaatgtccacggattatgatgaattgggcgaccaattgccaatgccaacaaataatggacaaatttatgatcaaattcgaattttaaatgacaaacagaagagagaaattgtggaaaaatttcataaaattaaggagaaagttaagcaaatgggaaaaaaatattcaacaaaagaatggaaaaaaattgaaagaaaaattacaaaaaaattgggcgtcagtcaaaagaaaatttacaaatggaagagagaatttggattaatcaaaaacagatattcggatgaggaaagacgtaaaatgttaaagcaatttgatcaaatatatggccaaataaaaaagaaattaaatggaaaattggaaggaa

SEQ ID NO: 24254 - DNA, 628 bp, Heterodera glycines
tggcaatttcagtcaacgcgcgaacgctttggtgacgagcacaacgcggagaagctcttccggggcatcagttggcgagcgacgaatgaaactcacgaagaataatgccaatgacaacagcggaggacgaagcagcggcagaagaacgacgagggaacggagagaggtgccggagagagtgacgagacggaaatattcactgccatgacacatttaaatgccaataaaacaatttttgaagggaatttgaaggagtacagagagagtcaacccaagttgcgtttttaaggaccgccgtaattaaactctaattaccgtcgaattggccttccgtttgggttcgagatcgacctttttgacctgctgatggatctgttctctgtctgatccacattcaaatgatccttctctttccccaattcactaattgctctgctcggctaattctgctgtgaatcccgtctcttctgacgtgagtgatcggcgccggatgtgtgccccttgctgctccctttcgccgcctttccttctccgctttggtcgatctctgatcgatttgaccccaacaccaaaacagcgccccccggccgtcccgacgaccccggccaactgcttcccttccctccct

SEQ ID NO: 24255 - DNA, 948 bp, Heterodera glycines
gagaagcgaaatgccaaagaacgaaggccaaagggcgcggaacagttcaatccgcgcgtcggtgcacagcgcggcaaacagtgcgcgacatcagcagcagctgaacagcgccaaaagcttttttgccaaagtaccgcaaatggacaaaacgtcgaaaactaaaaaagggggaagacaattggtttatcacctcatttggggtcgtttcacgcgcactttgtccacttttgtcagctccaatttttctacgaacattcgcccctccggcacttcgcccctttccttttgctcatcgcttacgcccttctcggcgcattgctcttttttgtgctcgaaagcgaaaatgaacgccaattgttggcggatgagcagcgccaattggaagtgttgcggagccgaacccttcagagattggacggcacattgagggcatcggcaagggaccggtggagcaaatcgaagttggcacaaaagggaggggagacaaagggagggggaagggagagtggaaaatagagagaaaacaagaacagggagagagagaggggaaaagagagagagagagataaaaagggaaagaaaaagagagaggaagatagagagagagagagagagagagagagagaggaacagagagacaaaaagggagagaaagggggggagagagagagtgaataaaatgggaaaaaagcatttcagcattttagaaaagtcttgacggactacgaacgagattttgcgaggttaaaagtgccggaaggaacactcggtgcgtgccaatggaatttaatgcagtcgattggcttaaaatggcattatttttgttcagaatggacctatttgggtgctctgttttacggtaagcgcagagagtgggaagaggcggttacggtcgcttttcaagttggcactgtctttacgaccattggctacggtaacatcactccg

SEQ ID NO: 24256 - DNA, 1164 bp, Heterodera glycines
aataaacgcgaaagtgaaccaaaaagtcgcgaagccttctaaaataaacttgcgtataattatgtccttgaataaatcaaccaaatatattttttaaacctctattttgctacaattttcaaatattagggtaaaaaataaattttcatagatcattgtagacttagtgcatggccctggagccgataaagcttacacatttatcagtgttaaatgcacatttaattcttttgagggaatttacacgtatgaatgtctataaagtattgtaaggatattatttagaatatgcggctagagaaatagttgaaaatagaaaacagtacaacacagggcaataaattttctatagtgtttaatgttttcgaatatttctaagttaattaattaaataaacgcgaaagtgaaccaaaaagtcgcgaagcattctaaaataaacttgcgtataattatgtccttgaataaatcaaccaaatatattttttaaacctctttttgctacaattttcaaatattgggtaaaaaataaattttcatagatcattgtagacttagtgcatggccctggagccgataaagcttacacatttatcactgttaaatgcacatttaattcttttgagggaatttacgcgtatgaatgtctataaagtattgtaaggatattatttagaatatgctgctagagaaatagttgaaaatagaaaacagtacaacaatggacaataaattttctatatgtttaatgttttcgaatatttctaagttaattaattaaataaacgcgaaagggaaccaaaaagtcgcgaagcattctaaaataaacttgcgtataattatgtccttgaataaatcaaccaaatatattttttaaacctctttttgctacaattttcaaatattgggtaaaaaataaattttcatagatcattgtagacttagtgcatggccctggagccgataaagcttacacatttatcagtgttaaatgcacatttaattcttttgagggaatttacgcgtatgaatgtctataaagtattgtaaggatattatttagaatatgctgctagagaaatagttgaaaatagaaaacagtacaacactgggcaataaattttctatagtgtttaatgttttcgaatatttctaagttaattaatt

SEQ ID NO: 24257 - DNA, 2140 bp, Heterodera glycines
aaaataattgggcaactttaaaagcctataaccttttataacttgacaacaattttaaaaaattaattgaaaatttgttacaaatttcagttttgggagatcatttgaaagcaattttggagagaattggtgaaatggagaagcagcaacaacagcagacaaaaggcgaggagaaattaaaatgaaaaaatatttaatcgaattaaatgtttccattttaaatttaaaaattaatccgatttttaagctactgcggggcaattgtcaaagattttggaaaaaattgctgaaatggaaaaacagaacgaaaacacggacaaaggcgagggaattttagcgaagaataaattatcacttattaaaaattcttttttttttgaataagtttcttatgaattaagaatttcatttaaataaattataacatttttaatttttgaaaattaattttaggaactttggagcaattttcaaagatggaaaatgatcagaagaacattttggaaagaatcttcagtgaattggagaagcagacacagaaaaaggtgaatgaattggaagagaaaataaaaataaataaatttaacggtaaaaatattttaaattaaataaattatacaaatatttatttaaaaatatcgaattatttactttcaggggttttttaaattccaagaaaattgttgggatgccttcgcttgtcacgaggacatccaaatcagtggtgacaaaagtctcattgtccagcataagggaaatgatcatggtatttttaaaatttacataaaaattcaatttcccttaaaaaggttggcgctccgtcttcgctaaatatccgattttgctgaataagcatttgtccgactttttttactacgaaatttcagttatgaaagaaatcgggtaagcgaattttatataaaaagtgaaatattttaatatttttttttctttattcagttggggcatcttcggattcgctgttaaacagcagacaaaattggatggatcaattcgatgtgaaaagggcatttatgcatatgaaagcgatggcgatattcggattaacggaaaaggaaagggaacaaatgccgaatattcctacggtgttggtgatactgtaggaatgggcgttcatttggccagtcgacagctctttttcatcaaaaatggacttcgtttgggttagcaaataataaataatataattttacgattttaaattacaatttggttaattgtctattttatctaatttattttatgtttaaaataatcaaaaaccccttaactttttcacagataactctgattttttcgttgatccatcttttgctgatggttcatttcatccattcgtttctttgcgcgcatttggtgacaaaattgaggcgaattttgggcccaatttcaaattcgatttggcaactctctgaaggaagaattaattatttactaatgttttcgatcaatttgctcgtttttatcatttttatgtttttcttcttcaattaaaatttggttttttgcattaatcggaaaattttgtcgtttcccgggtatttaagactaaaagatgaaaatttgcaaaaaaatagggttttttccaattatatgctaagattcatattaaatatctgctcatatgctatgaagaaatgggctcaaaaaagcatttctacgttaaaattttgatttgatgaggttttttagtccatataaatccatatttagcgtttttagtttatatttcggccatttttaggaaagtttcacaaaattcaaatgcatcgctaagattaaaattcgcaaaacaaatcgtccttccagtgtttatgtatagcttataagcagggttgcgatttttttaaagatgatcctttaaaggaaaagaaaacattttctgatttattaaaattagacttattttgttgcaatttccaaaatgacatgaaaagtgccgatgccgtcgctcggatggcatttcgaattccgtcgcctttcgccgtcgccgcgttgcaaaagtcgccgaagcaccagcaggtggactcctcgacggagctgaactcgtccagacagaccaacgcgcgttgcgtgtgtttgcattcggtgttgattttcaatttccagacagaggaat

SEQ ID NO: 24258 - DNA, 1546 bp, Heterodera glycines
ctctctctccctgatcactcttattttctctcctccacatctctttctctctcatttttctatgacttctctgtcctctctctctctctccctccctccctctctctcggtctgatttttatcttattctcttccattttcatgtttaatgccccatgcaccagtattccccgacaaaaaaatattattttttctgcactccccccttgccagactttccccatgtcttatccccccccccccggtgacaaatggcgccaaaatgatctagaaaccggatcagccacagcaaaaatgtccccgggcgatttggccccaaagaattggaacgaaattttcagcactcatcaccttaatttgtactttttgttattttaaacagtcaattcattagtttaggtaactaattccatctgtttttattctttttttacgaaaatatttggtcgagaatttattacttttgaaaatatctgaaaaaaataaaatatattttttcgattttttatttaataaaatttaaaattaagccaaagactcgaaaattaataaaattcaatagttcaatccgtttttatgaaagccaaacaatcctttaactaaatttaatcgttcagataaattaaattaaaaaataataaaaatattaatttatacatcgcaaatttttaacccattttaaattttttggcaaaaaaaaacatacacttaaaatattttttcattttttgattaattaaagttatttttcaattttaaagacatcataattttttttctcgctttttaataaaaataatcagttttcgacttattccctcggctaaatgtatcttgtttttcatccttccaccaattcactttttggagtttgttctttcttcatcttttgagtgtgcaaagattaaaatttgcacttttagtgctgttctttataaatcgccggaaattcgccgaatgaacggacggactgtgccctccggcgccgttggcgttgtgtcatttgggcgcgcccttttccatcacacatcacataacgccaaactgtttttttgttttcctccaatttcattcatccaagttcataggcttatcccttactatatattaagtgaggcgaagctccgcccacttttgcccttttaaatttgcgcctaaagtggtgttttgtttcatagagaaaaagaaacataaatgagaggatgggaaagagagtagagagagcgaagggatagagagaaagagagagagaggtgagaggatgagaaagagagcagagagagagagagatcagcgagaaaaaagagagaagggagaaagcagtgagagagagtagagagtgagagagagagaggtgagaggatgggggagagagagcagagaggatgggagagagagcagagagagagaaagtaagagattggggagagagaggtgagaggatggtgagagagagcagagagagagagaaagatatcagagagagaaaaagaaagagagaataaagaaaaaagtgagaagggagaaagcagtgagagagagcgaa

SEQ ID NO: 24259 - DNA, 1817 bp, Heterodera glycines
tggaggcgttgcgcaagaaccgcacggagcaggtggtgtccatccggaaggagaagcgggatgacatcatgtccaaacggcgcaacattccgaccgaagagtgggttaattaatctggaaggggggggggcgtgagaaggctgatttcggaacaagaacttagccgcacttacaattagcgtgtggtcttatacgagaaaattttttgtaaacacatggaaatggtggtaaccgccagcttttagcgccactgaggacgcttcgacaagcaatgtcactggcgttgcggtgccttacgatcgtaccaatttgcaggtctccgtgtcaatttcctaacaattcatcactacatcctttgattgttttttaggagattgtggtccaagcgcaaagtgctgacccggaagtgcagatgctggccgttacccaggctcgaaaattgctctcctccgaccgcaatccgcccatagacgacctcatctccagtggcattctgcccatcctcgtcaactgtttggagtcgccaaagtataaattacaaaaggggtgtactacttctcccctgaaattttaaacaaactttaattattaaaaaaattcaagaagaaatgatgtgggaaaagctggggtcgggaaaacgagctaatcctttaaagaatattaattaaattcatttcttttaattctgatttatttaagtgccacgcttcaatttgaggccgcctgggccctgacaaacatcgccagcggcacttcagaccaaacacgcgctgtcgttcaggctggagctgtgccacactttttgaagctgcttgagtcccccaacatgaacgtgtgtgaacaagcagtgtgggcacttggcaacatcattggtatgaaaaatggggccaaattaaattaatgaaaattgtgggtaatgactattttgatttttatcattctttccaattttccttttagcacattaattttgcgtttttggttcaggcgatggacctcactttcgtgactattgcattgagttgggaattgtgcaacctctgctgaaatttgtcgctcctgaaatccctttgaactttctacgcaacgtcacttgggttggttttttggattttattgctgtcatattccatttcttttcaggtgatggtcaatctttgccgtagcaaagacccgcctccgaaccgtcaaattgttcaaatgcttttgccgatgttggccattctcatccatcaccaggacaccagcattctcgtggacactgtgtgggccctgtcctatctgaccgatggtggaaacgatcaaattcaattggtcatcgactcgggggttcgttttttattaaaattgacaacagcaaatatttggttaaaaacaggttgtccaatatttggtccctctgcttggccatccggaagtcaaagtgcaaacggccgcactgcgtgcagttggcaacattgtgaccgggacggacgatcagacgcaattggtgttggactgtggggccctccaaatgatgccggcacttctctctcaccaaaaggaaaagatcaacaaggtgggcggacaataaaaatccatttttgtttctctgtttgactttaaccctttaaatgctaatgctaacaataaggaggccgtctggtttttgtccaacatcactgctggcaacgaaaatcaggtccaatcggtcattgacgctggccttgttccgatggtcatccatctgctggacaagggcgatttccaaactcagaaggcgagaaaaaaaactatgagttttcacatttatccatccgccatctctttaggaggct

SEQ ID NO: 24260 - DNA, 1291 bp, Heterodera glycines
  misc_feature (52)..(52): n is a, c, g, or t
cacgcttttgtataatcctatggtcgagtttgttttatcatatggtcacttntaatttaccgttcatatacttcttccgtcggatttggtttgcacaacgaaccgttgaattgcattttcggatcggatagctcaagggaatgcgacgcttggacaaactttaaaggaattaaatttgtgaccgaaataattaaaaatagaaaaatagtttctaaatatatcatttccataaagcccataaaataaaataggaaaatctttaccctaaaatttggtccttttttgtcgggttgcctttcttttacccatgcttccatggaacagttgcagctgcggtggatcgacgattggacaaacttaaaggaattaaatttgatcaaataattaaaatgggaaaacaattgttaaatatatcatttccagatagaccagaaaaagaaaacaaaattgttaggtaaatccctaaaaaacgggtcccttctgatcgagttgtttttctacccatgcttccatgaagcatttggagctgcggctgatgaacagctccatcttaagctgttctctttgttctgtttggtgtgccatcggcagcatgtcaagtccaagaagccaaaggtcggcataatccgacaaaaaagacggaccatttgaacggaggaaatcattttgaatggcacggccatcgaagtctgagaatggcattttgggaaagccgagaatgccaatttaaaatatataaaataataatattctcaccattttcttccaaagaaaagcgagtgaatggctcagcaatttgattcgatgcaaaaagcacagaaaaattgcgttgtcctgcactcaaattatatcttaaaattattttaaaaattattttaatacaaattttattttataaacgtgtaatattaaaattttaaaataaattcaatttcgcacttttgcttaaaataattaaaaacattcaactgtttctgtgaagcaattgatgactcaaaaataataatgcttccaatgttttggtccttttgcattggcactgtgcgcaatttgaggccacgccaaatcattgtgctatttttgtggacattttttgccatttttttaacacattcttctgcaatagaattgccctggggagggggttaattatgtacttaataattagccagaaattgtggtgagagagagcattttaccatattaacagcaacgatgaattttcttttaactttataatttctgttcgtgtccaaatgatcgcctcgttgaagcattgccgggtagcaga

SEQ ID NO: 24261 - DNA, 314 bp, Heterodera glycines
ctgaagacctttttttttgctatttacccaataaaaaatactttttttcccgctgctgggtaaaaattccacttttttcactaaaaaggacccaattttggccgttttacggcaaaaaacttgaaaaaaatagtggaaaatggaggtccggcggtgccgatatgcgccgccgggaaaaaatttggaaatttgagtgctatttgttacgaaaattgcctattaaatttttaaattttcgtttggggggaattggaaaaaattttccattatttgctggaaaatttttaaaaattttcattttggggggggggatt

SEQ ID NO: 24262 - DNA, 900 bp, Heterodera glycines
gtgattagcgctaaaactttaacaagtctttgccaacttttaaatgggatcgacccttgggagagacttttgatttggttaatattctctcgaaacatttttcagttaaagtctcttcttatggtggacaatgctcagcaggacatggacattatggccacgaaaaggcattccattgctttgctgctcaaaattgtgtcctctttctcccaggccattaaagttcatttgtggttaattatgctataattgacaacattttctcccttacaatagccctacggccaaactctgctcgaattggtccaaaccgtcactccgttcgtgtcgatgatgcaacgggccaacctcgtcccgattttggccgcccttagcaatttagcatattccgtagacgcacaagccacttttctcagcacttcaattcgcgcggacatcgaattcattgaaaatgagcctttctccgccagtccgtccaacttcctcatgcacagcggactcacctcaatgccggaccaagtggcggtgctgaaccagcagtgtcctttctatcagaatcggctaaatgtcttttggcttttcataaaattaaaaatgtttgaaattttagctaaaagcgagtttgacagctttggaaggcgttctcaaccaaataaatatttcgtcggatgaatcatcttcgaaaatattcgctctttttcggcctgttatcccaaaattttttcagttttgcgagtaagtttttgtttaaaatatctaatttcgcgtttattatttgtctttttggtgtctgaatttgatttatgaacaacaaaattcgtctttgattcactccgtttatgggccatcagtgctcgaaatgggctcttcggagaggctaatgcttgtctgtgagtttgg

SEQ ID NO: 24263 - DNA, 1748 bp, Heterodera glycines
cagttaggcacgaaaattgcgaaaagtggaaattttggaaggttcttcttaataaaatttttacaggcttgaaaaacttttcgtctttgataaggctaatagagcatgttaagagctttcgaatgataccaagattgttagatttagatgccaaagaaaaaagcttaagtggaaaaacgagctggcgccgaaacgggagccccgaaacacgagcgccgaaacgggagcgccgaaacgcgaacgccgaaacacgagcgccgaaacgggagcgccgaaaagcggcggtggctccattaataaagtttataccggatcgtttgaactggtgttaattgaggccattttttggccaattgtttgtgccaataatttaaaaattgaattcacaatttctgattggaatctcttttttttcactttaaaggctaccgaaaaaattttctaaattcaatttgctgaatcagtttaaatatgtgcctcctcctaattgttatcaaatttattatctgatttttcctttttgtttcgttaagtttcacttactgaagttgcaatttaattattcgggtttcgcttgaaatttatttccaattaaattatatttacttttgtgacataataaaaattaattaggctgccgtttgtgcgcgaaattttcccgcccaaactacgcaccggggcggttaactacttttctgactaattttctctcaaaaaagcgacagttattagtgattatttatagcctttttctgttaaagtgctcccatttgctttccaaaatgcgggaaagaatggcgtgcaatttaataaattaattgataaaatgaactttaattcacacacttaattgaatttgcttaaataaatcgtaccaatttattggaaaataagtgatcaaataaattaatttaaaaaatatttgcttagaagaataagacaattttcatgagtaaaaaggacaattttatgtaaaaaattagaatttttttagctttcgaaattaaaaataaaattctcttacttttataattacttaacccattttgtaccaaattggagacaaaataattgccaagaaattgggaattggaagtgcaactctgaaaagatggaaaaggaatttgcttctatttcgaaaaatgtgattttttacggtacaaaatgggtaagataatcataaaagtaagataatttttaattttatttttaatttctatatttaagagactcaaaatttagtgaagaaaaattgcgaatttgaaaaacccgaaaaattttacatattttctctatatctatttcacactattgcaaaaatggtttacatactaaaaaaagtgggcgccggacttttcgacagcaaaggacatttcggcaaaaatattataaattttaattaaaggtttttcgacagtaaaaagtaattcagtttcaaatttagtggggtgttaaatcttaaaattttctccaaaataagaaacttaagccaattcagtattgagcataaacaattaattttggagatgaatttttgagaaactttttcattcttcttattggtgtatttttgaaaattttaggcggcccattcttaagggatatttttctgaattttcctaatggtttagcaatacataaaatttaataaaattgacaaacaaatataatttattttaataagaattttttgtttttatgtttactgtcgtaaagtccattattttttgtttttctatcgaaaagtc

SEQ ID NO: 24264 - DNA, 997 bp, Heterodera glycines
tttcgtccccaagtcctctaatcattcgctttaccgagtataactgcttaacgagctccagctatcctgggggaaacttcggagggaaccagctactagatggttcgattagtctttcgcccctatacccaagtcagacgatcgatttgcacgtcagaatcgcttcggacttccaccagagtttcctctggcttcatcctgctcaggaatagttcaccatctttcgggtctcagcgcatacgctctgtctccgccccatcgcatgcgatcgagacgggactatgttgcgccccaacaccgcagtgccagggatcacacatcagctccgtaagaagccttcactttcattgcgcctttgggttttgaacacccaatgacttgcgcatacgctaaactccttggtccgtgtttcaagacgggtcgaacagatgaccggcttttacaccgagaacgcacaactgagagcccgagctggaccgaactggttgctggtacgtgtcgcacgcgaccgccaccgacccccagctcgagtcaacacggacccgaaaccattgcacaattcacccagagtaaacagcactcccccgatccgggtaccagaccccgaaaggctggcctcaagaccgagctcacgcagctactccgagcatctcagcgcactccgcctgcaaatgccccattcgccactgaacagaaggacagcaaaccccagtctggaggctagcaggccaacgtacagcaacaaacgggtgaatgcagaccagatacgccagctctgtccgtttccacctcatcggtttcacgtcctctttaactctctcttcaaagtgctttgcaactttccctcacggtacttgttcgctatcggactcgtggccgtatttagtcttagatgaagttaccacctgatttgggctgcgatcccaaacacccgactccagacacgtaaagatgggtaggcacccccagtggacaggcctgcacttctctggagccc

SEQ ID NO: 24265 - DNA, 1900 bp, Heterodera glycines
tcgaaacgaggcgaaatcagtgccaatttgaggccgagttgggcatggtcaaaaaatgctaaaatgtccatcaaaacatcagtacaaatccaactgaaatgagaaaaaaatataggataaatttttaatttataaatttcataccgtcggttcatttttgctgcaattagcacacactttgccctttttccaattgattagtgtcacagagggcaaacaatgtgaaacttaaaatagagacactttaggaaaaatactagagcaagaacagaacccaaaaataggtataccggtttccaaggacataagaagaaagggactgggtcgttttggcgccgacgttttggcgccagcctcagtttttttattttaactttttttcttgttgaccaaatctaacaatcttggtatcattcgaaagcccttcacaagctctattagccttacaaaaaacaaacaaaaattttagcttctaaaaaagttattaagaaaaaaactcaaaaatttcgacttttttggaatttcatgttataacttttttgataattgtctaatcgcgaagcaatagcttagaaatatcttctaaacatgttaagctttcgattgataccaagattgctggatttggttaacaacaaaaaaagttataacccaaaaacttgggctggcgccaaaacgtcggcgccaaaacgatacggacccggaaaattgtgagataaaaataaacaaaaataagtttcttattgattgaagtgtgctctttcttctgataccaaaataaaaaatttatcttaatgctaagtatttttaaaaccactttttacaaaggtagtcaaaactcgacaaaaaaaattttagagagaaaaataattttatgaaaataacaaagaattaactaaaaagacctctataaaattatttttctcaataatcaattgtggtaattttttgagccaatttaaacatttttcaaaattctttaaaataaattaattttaaaataattctatccctctaatagtgccacgtaacaaaaattatcccataaatagaagagaaaaacaaaatttttatgtgaatttacccaaaaattgtctggggtcaaataaccggtagaataagatcatagttcatggtcgtttgacggagggtggtagtcaaaacggcacttcgtggtcattttcttattctacgggttaccaccaacttcatggtcatttgaccaggtcatttaaccatggtcgtttgaccccgtcatccgattaatccaaagtcatttttatcaatgttgcttctttttttttacttgatcattgtgactggcgattcgtgcaaatccatcggatgaggcacttcaaaacagggatatctgaaagaaagaaattatttaaataactttgaaattaatttaaataacttttttttaaattcgggttcgctcaaataaaatacataatcaattaattataatgtaattaatttatttctttatttaaatgtaattaatttttattattaattgccattttgtacccttgggcttgcatgtccacaaccagcaggtcgttgcgcaacagcacagccatggcgtgcggatgttgtgctgcgctggcgtagggcgacgcgtgcagcggcaacatggacacgattgggtggtccatctgaaataaaattaaaaattaattaattaatgatctaattgatgagcccacctccagcacagtgagcgaccctttggcacgcatcaccgtcaccgatggcaatgcgccctcgtccattggcatgcctaaaacggcacattttttcaaaatttttcaaatttcatggacgactttttgagtgttggtgatgatgctttttcatagccgaaaaatttcaataaaatttaaaaaagggctca

SEQ ID NO: 24266 - DNA, 1590 bp, Heterodera glycines
  misc_feature (1524)..(1524): n is a, c, g, or t
atttaaaatcaaatagggtttttaattttaatttttcattaattttgtgaagtgccattgtggagcgcggtctgtcttctgtctcggcacaaatgtgcaattggatgatgcgaaacggtaggccaaaatgcgcggcatccaaaaacccttcaggcacattctcttttttacgcttttggcacttttaaaatggcactaaattttgtttaatcaggacaataaaatgcaaaatttgtgaaggatgacacagagagattctccgctgcttaaatccaaaagcccataaacccgtggaggagattggatattagggcacccatcttttaaaattggatttaaaggaatttcgatccaaaatatcggttcggaaagtgatgaattctctcgttttggaagcgacttgcttggtccttaaaaacaagcacagtcctgaaaaccaaaaatcattgcaatccatggccgggggggggggggggggagtgaccccgggaccggtaaattggacaccggaaaattggacaccagaaaattggacaccaagcggaaaaatggacaccgccggaattttggacactaaaggaaaattggacactaagatttcctttttaaaaaaaatcaagaattaggtgaaaataaatttgagtagaataaatgggttaatgcattaaggcacttagagtggatcaggcattcgataggcaattgccctcaaatattggaggggatgacgatcggcacgcgttgcaaatatttcccgaagattttcatcttgctcaatataaagctgtttgcgtttcattcctttccctctaacgtaacgattgatcaatgggccaaaaaatgcaccagaaatgagggatgattgatcaatgggccaaaaaatgaaccaaaaatgggtgacgcttgatcaatgggccaaaaaattaaccaaaaatgggtgacgattgatcaatgggccaaaaaatgaaccaaaaatgggtgacgattgatcaatgggccaaaaaatgaaccaaaaatgggtgacgcttgatcaatgggccaaaaaatgaaccaaaaatgggtgacgattgatcaatgggccaaaaaatgcaccagaaatgggtgacgattgatcaatgggccaaaaaatgaaccaaaaatgggtgacgattgatcaatgggccaaaaaatgaaccaaaaatgggtgacgtttgatcaatgggccaaaaaatgaaccaaaaatgggtgacgattgatcaatgggccaaaaaatgcaccaaaaatgggtgacgcttgatcaatgggccaaaaaatgaaccaaaaatgggtgacgattgatcaatgggccaaaaaatgcaccagaaatgggtgacgattgatcaatgggccaaaaaatgaaccaaaaatgggtgacgattgatcaatgggccaaaaaatgaaccaaaaatgggtgacgcttgatcaatgggccaaaaaatgaaccaaaaatgggtgacgatttgatcatgggccaaaaaatgcaccagaaatgggtgacgattgatncatgggccaaaaatgaaccaaaatgggtgacgattgatcaatgggccaaaaaatgcaccagaaatg

SEQ ID NO: 24267 - DNA, 1059 bp, Heterodera glycines
actgcgctgcctaacggcggtgcttaaagtgcgctacccccccccgaatgattatcaatttttatttttcttaattccaattcgaattcgaaacgcaaaaatttaatcataattcatgtggtaaaaaatgcatttaaaaataaaaaaaattcttgaatttgcttctgaattttttaattttaaatagaaaattactttttcgaaaattttgcacaaataagaggcggagaaattcaactaaatttttattaggattttgatttaaaatgttgagaggtttaacaaatttgtacactgaatgttggatcgtcaacaccaatgagaaatgactaacagaaaagagggagaaaagggcgttggcttaggaaaatagcttataataaaggagagacgagcagacgatgagtgagagaaaaatagtggtaaaaatggtcaactgctgcattggcagagtcagagaggggtcacaaagagttcgcacagcatcgaatatttccttcattttgggcgtcattcttccccactgcacttctttcttcggtttaattacccaagtttgaggtacttggcgtgtcctgcccataatatctgtggcatggaataaattttggaactgcgctgcctaacggcggtgcttaaagtgcgctaaaaatgatcaaatgattatcaatttttatttttcttaattccaaaatgaattcgaaacgcaaaaatttaatcataattcatgtggtaaaaaatgcatttaaaaataaaaaaattcttgaatttgcttctgaattttttaattttaaatagaaaattactttttcgaaaattttgcacaaataagaggcgaagaaattcaacgaaatttttattaggattttgatttaaaatgttgagaggtttaacaaatttgtacactgaatgttggatcgtcaacaccaatgagaaatgactaacagaaaagagggagaaaagggcgttggcttaggaaaatagcttataataaaggagagacgagcagacgatgagtgagagaaaaatagtggaaaaaatggtcaactgctgcattgg

SEQ ID NO: 24268 - DNA, 2253 bp, Heterodera glycines
ctacagaagtttggaaccctaacttaaaaaaagatatagataaacttgaacgcgttcaaaagtttttcacgagaaaagcacttagaaaatgtggctttgtgtacaaaaaatatggggaaagactaaaaatcactgatttacacaaattagaagaaagaagaaaaatcaatgatttaacaacagcttttaaaataattaaagggttcaccagccttgaggctgagcaaaattgctttttctcggaaaggcccaggaggcctttacttttgcgagtaaagcgccacacggccaaaactcaaaataattttttcaatagaatagtaaaaaactggaataatcttccactggtagcggtgcaaattaataaggcaaaggaattcaggggtttactaaaagcaatgagttctgagtaggattttccatgttgccatatttacactatatttttatcacctgtgaattcaacatttgattgaattattttattcatttttattacggtattcattttgtattttttatttgatcaaatttatttgtttgttttcatttttgcaccatgtaagagcactaatgtgccgtgccgttggtttgctcgataaataaataaataaattcgtgctctttcagatgggcttaatcattttttcacgaaaatcttttttcaacccacgaggaatttatcaaaaactttctcgatttcaagccattttcaggttttcagatcaccattgaaggagtgatctattttgtgttaccaaaaccaaaatagaaaatttttttattaagaaatctcattttttggcattctgcattgctttgcacaatataaataattaatttgcgaaaaattttatcacattgtttagatgggctctgcgcaaattcgggcgattgtcccaacaaatttctttgtgcaacatttgcggattcgaaattgagtgccaattcgtccaaaactggttactgtatcccgggaataattattggcaaaattgtgaaaaacaatggcaattttcaacccgattgttcaccggcaccgcaaggagcacaaaaatgtagcgggcttaacggaatttattatgtggacaattaatgatgacggatttattttgaacatttttgatggcatttaatgagattttgaaatagttttaattcaatcctaagcttttttttttgcctttttgaaagtcgaaaattcgtttcgttttttaatttacatatttataaaagtttttgaattttattattaatattattattttctggcgtaaaccctgctgccaacaacaaattgagttttgactcccactgaaaaacgcagtaaaaatccaacgctattgtttatattaattatatatatatatatatatatcaaatgtttaaaccttaccaaacatttgaacattccaaaaattagaaaattttccaacaaccactctaaattgtccaaataaaaattacatatttttaaaaagttttataatagtccaaaaaataaaaataataataattcaaaaattgcttcaattgcccgcggctgcctgagggcaagaatttttagaacagcacaacatttaaactttatacaacatttaaagattacaaaaattaaattttcattttttacatttaaattatccaaattaaaaaaagaatccatatttttataaagttttaattagccccaaaaattttttaaaaaatcgcttcaattggcccggcgggtgccttctttctttctccctcatcagcgcacggcatttttctatttgccaacaatgcgcacaatgttcgcgctgcacagtccgcaggtcaatttacagacggccatcatccgaagtatcagaaatctgttcaagcattgtccggcatttttgatgcgattacagaaagtgtttggcatagcgtcacgacaatttgcttgaccggcactgaacaaaacaaacaaataaaaattaaaaaaaaaaattattcgcatgagtaaaaattaattaagtggtaaaattgatgttagaaaatttgccaaattttcctttcgacttttcagatttaactgatatgtggattatacatagtataaccaaataaccaccagcgcgggcggaaaattagaaccccaaagaatttatttttctttaattataaccaggactgcaaaagaccaaaaaattgcccaatatgcatcaaatatgcacaaaaatcgcaaaatatgcaccaaatatgcacaaaaaaatttgatttaatttt

SEQ ID NO: 24269 - DNA, 1546 bp, Heterodera glycines
tttcctcttcccaaattggctgttcttctcccactggtttcccctgctccattatcattaattaatattaattaattaattaatggtccgtttaacaccaaatgagtgtcattgttatcgctttaaaacaaagacactaacccaaatgccaaaaggatgttgcgaagaatattttgcggaaaatcaaagaaacattcgcattttgacactttggcgaagcgaaaagagaacaaataaaaaagaataattaatgaagcaataaaaagttattagtccaattcacaaacatttgtatgttttgttaagcatttgcaataattatgcactgattaatgaaagtaatgctcgagaatggaatgaaaaaggaaattcccgagttgggctcggaatccccgagcattttcaattaatgaacgcttaattgaattgtcggtctctgccgttatcagactgattattctcaacaatttgtcaacttatctttcgcttttctctctctctcttcataactttagctgtctctctcaccgtctctctctctctctctttcttttgtttgtttgtctgtctgtctgtccattcatttactgtctcataccctcttttttttgtttttaattctgctgattgacctcgctttaattacgtcaattagctgcccaattagtgatgggtctccgccgtcaccgctttgctttgacgtcacttttcgcttgtgtttccccgtgcgccctcaatttctcgtaaaatgttacaaattccaattaggaaaataaaatgcgatggttatttttagatttaaaatgttttttaaattattatatgctaaaaaccaaaaatgaaagaagtgccaaaatgtgtattaaaattgccataaaaattcaattgtttttaatgagttaaccatttgactttaatttcgacagcctaacctctttctttcttatgggtctggattttctggattgaatggtgctatgaagttagtcaaaaaaccatcaaatgaaaatattttctgatataactttacacaaaagcaaccaatttttaattttgatataattcgatagccctaagtattttttattatcctgcaaaatttcaaaaagtttcataaataattaaatctcatttctctcctcctaaatttgtcgaaaagttcgatttaatttaattattctttaggtcgtgtatactaaaatagagccaaatatatttattattaaaagattgttattcaattataaatgaattaattaatttaattatttaaattaattttctgtactgaaatgacccgcctctttcgatcacccatcatcgatacttttgacacttcgactcaccacgagaaaaactttgtttagaagaaagcggacaatgttatttcataatgtacatttacgtagttaaacttttacgatttttgacaattaccatgattatatttatagtctgttcaaaacctgagaaatatccaatgaattatttttaattgaattcatttcgaaattattactaaatttggtcacttaaattatatttc

SEQ ID NO: 24270 - DNA, 1408 bp, Heterodera glycines
  misc_feature (15)..(16): n is a, c, g, or t
  misc_feature (76)..(76): n is a, c, g, or t
  misc_feature (112)..(112): n is a, c, g, or t
acgaatgctcatcgnncaattaaatgtttagttcgattttgtaaaataaatttggcaattttttttttgtaaatgnaataaaatttgccaaaaaattgcttttttgttttgnatcgccttccatccgcaacaaaccgtgctcaatttacgtgcatggtcacgctccacgtcgtccaactcgcgttcgttgcttttgtgatgcgttttcgtgaggagaagcatccgacccaccaaatccttaataatcgttgattgcaattaatttgccagccaatttttatttaaattattttttaagtcatacacccaaatgaatactctcttaattaccgttgttgaaacccccggggttcggctgcattctctgtaacgccctgcttccttcacttcggcataagtgtcctttccatcggcggtcaaagttatgtcatctaatggacaaaattggaaggggttaaggaatttttacaaaaaataaataaataccgccatgcacacaaaagtcacaattattctcatccaaagttttcaaggtggtcacatatggagctgcttccacaatctgaaaaaagtcagaaataatagtttctaagttaaaagataagggtgaaaaagatattgtttttgtctgaaagttcctaagtgagtgggcattttagccaagtgccaccaaatgtccaaatttacttcgtcgacccatttgatgccgcggaccattcggtaccgttctttctcgttgaaaaccggagggcctttgtgctttccaatttcttcgtcattgtgaacctgaccaaaaagtaaaaatgatgatataatacatggaaatagaaatgagttcaaaaacgaaccccaaccaccaaataggcgcccatttgtttggcttgacgaagttgattagcatggccgaaatggaccatgtcgtaactaaatgtcatatgaaaaagacaaattgggcaaacaactcaccatccatcacaccacactcgatagttgtgcttcaccacttgctctttaggtccaccaaattccgtggtaccattagcattagcagttgatttaaccattataaatatcttaaaaaaaaaacattttagtttaatttaaaaaacaaatgaaaaacgaatttttaaataactatttgtgattaatttaatcatgtgacatacattttaaacaaaaatgaaatttaaattacaaaggaatgtttgaggggtcgtcgtttgaatgaaaggcaaaggaaacgaaaaatgagaaagggacaacagacaaacagagtataaataacggacgatgggccgattgataaaattggggcggggcgaccctttcttaaatcagcagtgatttcttaatcatttaacgtgtaaatataaatatcaacaaaaaggagaaaacaaatttttacaat

SEQ ID NO: 24271 - DNA, 1722 bp, Heterodera glycines
aggtccccccacgaagccgatgatgaccagtatattatgggagagacacgaatccattcgtggaatagcgttccctatagcctgtactttaattctgcgttggatttttgctccccataagtgtttgagtaccccaaacggacacttgaaaaaatcgatttttttgattcataaatatttttttcagaaagacatgcgcacccgtccgatctggcaagttaagcaacgattgatgactacccaaaaggttcggtgccgtgatgaaacaaaccagcactgcttaccccgcggcacccggtacggtcccccgaaagaaaggagttaattaaattctctccttcggtatatttttttccattatgtcgaccgctaacgatcgattgctctagtcaatttttctaaatttttgctgaaatatttgtcgtgctctgaagggagtggaatggtgaggatatattgtattgcttacaaattatttaaactaaataaaacatcactttttatatttttattaaatacgtatttaatgactttttgattttgttctgtatggtccgagcattcatcgattcaataaacaaattaaataataatttcttatttcttttaattaacgatttaaaatattagcgcgtaattatcttggtcttatttggttattatgttgtatatttattatcaaatgattatgttcgggccaggccgttttcgcgttgctggggacgttttcgcgtgagggcctgtttaggactgaagttctactaataatacctgcagagcattagaccgtgaacaaattattagaatatatatttgtcagtcttaatttagtttctaaaattcactttttcatttaaaatatatattgaattaagcacccgaagtaaaatgggagtgaaacaaattttcaaaatataaaaaagtaaaaaattctcttatatgcaaccacacgaaaacggcccacgcgaaaacgaccctgaccggattatgttatgtcctcttgctgtacacagacgctaataatttacatacttaaatgaataatttgctttatgtcaaattcaaaaaaattcatgaatttattttttattatacagaatatttataaaatgaattgcaaaataaattattaaaagttttctttaaataaatatttatatatttaatttttaattaaatccatatctaggagagttttaaagatttttattattttttctttagaatgtatacaattataaaacatatttgaatatagtggtattatgacttattctctataatttatatgtctgatagtcatgaaacttgaattatttaaaaaaaagagaatattcggtttaaaataccttggtgtaaatcatgaatgtacgttccgtttttattttaattattaatgtctttaagttataagaattatatttattcgttttaatttctttgtttaaagcaaaatatttttatctaacatttatatttcatctttttttataaaatttcagattctttttcagcacaaaaaaaaattcattaaggtaaattcaccttgacaatatatgtttttttatgaataaaaatacctttttaatttgttatatttatttatttttactcatggactttgttaatctttattatatttggttttaagtttttaaggttttatttttgttgtgtgtatagaggtaccttatatcggtttaatatttattgtgcatttat

SEQ ID NO: 24272 - DNA, 2018 bp, Heterodera glycines
taattaattacatgccgacaaatcaagcacaattgtgtcgccttcgcaactccgctgatgttactgttgttttcactgacgatccgtctattgaaggagtgccacccgtaacagtgccagcgccggcgccagcggggagaaagcggttgacaaatgaggactaaattaattaattaattaataataattgttcttgcctgattcgcagattgaaaataaaagattttaccacgaaaaaatttttaatagcagtatgaaactgactggaccaatcaaatcgaatgatttaaaatgtttaaataatttaattttgaggtttaatagtgaaaataaattttccggcatttggtcgcgcaaataaaaaaataataaattagcattttcgacctataagccaaaaaaaaaacgagggaaaaaattgccaaaagccagaaaaaaaatcgaatttactttaataattttcggtataacaataaataattgtcgtaacatggctaacaatagatttttgaaattttcattttttacacatttacattttcccgataccagacccaaccacccacccacacaccttcttccccccaacagcaatttgctggtgcttctgcttggttttgctgctacttttcgtgttcatctcctgctgctgctcgtgctctgtctgctgttgttgttcttcctcgtcgctggccatctccacatcggactcttcagtacggtggcggtgtcgcgcctcgggcgacgaccccgacgacgaatggggcgacgtcatgttctgctgctgcggttggtgctgcttcggcttcagctgctgctgttgcttcccgtactgcttcaccttcttcttggacgaacatcgatgttgttgatgatcacggtgcctgtccttgtcctttttgccctttttcagccttttgagcacagctttttttgattttttcaacggcggtggcgtcggggaatgcgacagctcgcgctgcttttgctccttgcgctgaaatttttgcgattttttttctgtaaaaattttgaataatttttttaaatttattttttttgtttaaaaatttattttaattcaaaaatcggtttttgttttacatatttccattttccatcataatacctcactctaaataattattaaataaaaatattagctcagaattttgtgtttacctcacccttgaaatcggggctttatttcataggggggttctatctaatacaggggagagttctcattgcgtaaatacggtattttcataccgtacccccgcccacccacgcgctgtgctaccgtagtgacaatatcgctgtagtccaatgacttctcacgctcgagcgacgagcgatcgtcaccagcaccggcgccgccacccaatgacgaatttgtggcgaccgattggctgctgctgctgcgcgagcggcgccgcgaccccgccgagcgcgaacgaccagcgctggagctgcgccgcgagttggccgagccggaccgtgcccggcgcggcgatgcgggcgagcccgtgcgactgttggtgtcaacggagcgcgagcgtgaggccgaccttattgcgcgaaatatgggcataattagggctgagaaaaattttgtttttatagccacggctgggacaattaagggatactttagttttcaatagcagcaaaaaattatttctgctggggtaattaatttttggctattatctgtgattgttttaaggcttttttgggtttgtttaccaaattaattattttgcttttgcaggaaagcaatttcaaaaaattaaagtgttacgaatttttttcctcagaatttttgtgcatacagaccggaacctgggttaaaatatcaaggaacctgcgttttttaggaaatttgtagaacataaaaggtaactcgcccggtggggctcgaacccacgaccccagcaatccgtgccgtgctctaaccaactgagctacgggcgctacttatagaggttctctcaggtcctttatcccactttctc

SEQ ID NO: 24273 - DNA, 1395 bp, Heterodera glycines
ttttttttaattaaatgaaaaatttgcgttatcgggattaaattgatcaacagattcgattcgtgcgatttcgaagtcgcagtctctcgctcgcttctcgtcaaattgcccccatcttcaacgatgaaggacgaaatttgaaaggatggcgaactaggtcaaccatcatctttatacaccgtttgggaggagcaatgggcgaatgggagggaaaaagagggggaggagaagatggagggggaaagagagaaagggggggggggaagagggtcccgaaccgcgacaacaaatcggactgagtcaaaaaacgaacattgcggtttattttttgttaatccaacattgaagaaattggacggagaagcgatcggaaaaggatttactgcacatttgcaatgattcatgggcttataaagggaaggatttgactttgattgaagaaataatggcgacagaagcacagaggacgatcttacaacaaaaggaaaagtgaaaaggaaatgaaaaactaaggcatttaaagagggggaggagaagggggaggggatgataggagaaggaaaatgtgaaatcaaaaatatgatcaaatcaaattaaatctgaataattggcatcggcaaatattcctgcgctgagacaatcacttggtttagccactgaaacggacatttcggaagcatttacaacttttccaagcaaagtaagtgcccattggcccacctgaagtcgttgaatttcgtctttgaatgccacacaaaagccggggaatttccccttgcaaaaagtcgcccttttctctcttccgtatacgaaaaaggtcaatgggtgcgggtagggacagcgccggtcggactcggcaccgacaaaccaaagcacttcgtcgactttccattggcactgccttttcattccgcgtgaataatggcacacgtgcactccgtcctcaatgcgaagtgaggccgtcttgaaagtgcgcgagccgggctcagccaacttcaaatcctcagcaaaggcacggccactctcaaaagggacagaacgattggcaagtgagagaagggcgactgatcagttttttatgattagactcattagctaattgagtttatggccgagtgatcagctggccgggaatcacttgtggttggaagggatgcggatccttcttcagcaagaggaagttgtccttctgctgctcttccactccgtccgtcatccatcgccccaatacaatcgatttcagcgattcatttgcgccaattcgtctctccaattgcccttttttgatcatttcgaaaagcgcataattttcgcaaggcgacacaaaagccaatttttgaactttgaattggaccacgtgtgaagctgtccattcctgattggacattaaaacat

SEQ ID NO: 24274 - DNA, 1448 bp, Heterodera glycines
ccccctttcccttcccctccatttcccgagcgccgcgaatgccgctgctgcctcctccttatgaggaacgctaccggattggcgaaacaggtcagtgcgtctggacggacctcggctggagcccgatttaaaaaatatataaaataaataaaaagcaaaaaaaaaaaaaaaaaaaaaaccttttagttaagtgccttggttttgcttttatttattatttttatgtgctcacttacatttttttatgtatgtttctacaatgttgttttgcgctttcttttgatttttctctctctccctcttcatctttctttttctatttataatttttgataacctatttccacatttatccctttagttaattctgttatggcttatttaatcgttctattttttatctttctatttgttctctatttttattcattttgtcatatcctttttaatcgtttttcttcttattttatttttttttggccaaaaagaagaaaagaccagggacggtcttctggtcggccgggaggcgtaacgtacagtacccctgtcccccccccgtacacacagtaacaaaagaaggcgcgtattaaggaacaaccaagaaaaataaaaaacaagaaaataagtgaggcatttaaactatggccaaagcagccaaactttttttctttttcattggggcgcaaatgagcactcaccgcccaaggagtgcccgtttctcctgtattcgctggtgcatttgctttacttttcactttgatcctccccttgtctcctcaaatccctttaggtcggacaatccctctctctatatctctctctttctccatctctgtccctcttcctctctctctccctccccttccttctacatttttctctcccctcttcctctctctctcttccctttgtccctcttcttctccctctctctccctttcgccctctcccactctctctctccgtccctccctccctctcccccgtcggcgaacttggcttgtctgaactgctcctcagaaggaaacagcaaaaaggggtcgcggaatgaccaggataactgaaagaacaaattgcttagaggggaaactttccaagcagtaaactgagcctggcaatggttccatttgtgccgatgcaaaactaaaagagcgaagagaagagaatggcattttggaaacttttgaaggaaattattttgcataaattccacaaaaaaaaaattaaaaaaacgaccaaccaaatcgtttggcaatttgatgccttcttttgagatttgtggaggaacaaagagaagaatgagcaagaaatgacaggccaaatagcgaaatgagaataaatgggggactaatcagaaatggagggaaaggcatggcgaaacagagaaagagaaatgggaaaagggagagagaaaaggaggaagaggaacggatgatggggagatcaaa

SEQ ID NO: 24275 - DNA, 2495 bp, Heterodera glycines
  misc_feature (2372)..(2372): n is a, c, g, or t
  misc_feature (2413)..(2413): n is a, c, g, or t
  misc_feature (2459)..(2459): n is a, c, g, or t
aagtgaaaaaacaaattattccacgaagaattaaatgaaaggaacgaacaaaaaacaaactgcacctgattgcccccgtcctgcagctgctccatgtccaaaacatttgcccgggaagtgggcgaccgatccgtgcctttcttctttcctccgctgtgccctccgtcgtgtcgtcgtcgtcgcgtgattgtattttcatataaatttttcgttattgtttaagagctcccccttttttttgatgttttctggatggaaagatatcgatttgggtaaaaagactatgaaaaacaatacgaataaatcgcaaaatatgcgcataaaatatgcacaagaaattgcaaaatattcacataaaaagtgaaaaatatgcacatatatttttccatattgaggacaaattttcaaatttcttcatgttgttaaatttaagcataaaaatcccgaaaatagctaaaatagtatgaatgattattttagaaccaaaaaagtaatatatttatttattttgaagataattgagcatgaatggagaattttcaattttctgactatttttgggataaagcttcaattttttaataagttatctttttatcagaaaatataccctaaaatatgatatttttgaataattttcggtcattagagcccaaatggccgctttaaagccgggtgccgtttaatagaagatctattgagacaatggccaaatatgcatgaaattccgaaaatatgcacaaatatgcaaatacgcacataaatcgcgaaatatgcatatggaaatcaattcttcttctagaagcttctaatcaagttaaaaacatgtttttcatgcgtttcaggcctcccgcagttcaggaaaaaaatatgcatgtgcatataattaccagccctagtaataattgtgcgaataatcgaacacctaattcttcacacgttctctacgataaaaagcaaatatttcattgaagaaatttttgagcctttttgtagttctttggggaaaatcactcaaaatttctttaaatcctgctacatagcaaaaccgcaatgaaaattccaaaaattttctgaagtcgttggccaaaatcaaaatatcgagcttcgaatttgaaaaatgttcgtttctgacaaaaaaaggctttatttaaagggcgtaatcagaccttttgcttcggggggggggctgaattaaaaaaaatttgattttagaggttatttttcagttttcttaaatcctgaattaggggggtgtattttaccggaatttttaacggttttcgcaaaaaaaaatccctccgctcgctcgggctccccactcttgcttcgtcatcgcatgctcgctaagagggcttttttttggatttttttataaatcctagtcatatttccgtatttttttaaaataaatccattttagcttttcatagataaaatcatatgatgaaaagcatagatttttgcagttttgacgccaaattcttgattaatgcataaaattaccccagaaaagtgcgtgctttcctttgttgggatcacgacatttttatgggcggggggcataacggaaaattaccaaatctcgaacatttattttctgtcgacataagcacaataatacatacatatcaatcaggaggaaattgggagtgtgttcagtatacaataagtgccgaaatgaatgcgtgggggtgaaaggacaaatggtgaattatatacaatataacgagcaaatagatcaacgtcatcggcacgatacaatataatgagcaaatagatcagcgtcctcgcggcacgtcactcggttcatcaccagcgttcagttatcggtcatcccccgcggcatgccagtcgcgcgcatctgagcaaaatggacaacgtgctgaagtgcagtcaaaaggggaacaaaatgaagaaggagacagacgcttattatgtcagtaaaggacaaatgaagaatgattgtttctgctcttaaatcgtcccttttatacaaatattttcatacccgtcaattttcgtgtaaaaattctctataaaaagggatgaaattcgcgagatccactcattcttcgcatcggcgacgttcactctctgctgaacaatttcttctctcgacgacactttgcgcattcaatccgagcacacttcttcacccatcagttgatcccatgtctcttcaatacgtcggcatcgctgcgttaatcctcggaagtaagccgggacgagcagttaatccatgttaatttgctgctaattaatccccatttttcagctgccatcgctctgttccaaactgtgtcgctcagcaccagacgacaaatcgccgaaaaaaaatggcagaagtagcagcagcgacagcaaacgtncaagcaagtcgccgtcgtccgcgaaaaccttggcacacaanatcgctgcgacggtcatcgctgagaaagagctgagctccatccccngacacgaaatcgtgcagctgatggacaccgctttca

SEQ ID NO: 24276 - DNA, 2871 bp, Heterodera glycines
atgaggatttaaatgataatgcatcagagatggaattcctaggcccaaaaaatttaatctaaatttctgggcctaaaaaaattcgggactcggaacccgagcttttaagtaggatttaaatgagttaggcttctgctcattttggtcattaaccctttaatttgacttattaatatgaaattaattgaccaatttctctaattaattgaaaatgaaaatatgatggaataaattttttggttgttttacacttttactgcagaaatccattccatcggacggagccaaaaaacgggaaaaaacaaatgaatgaatgaatgggtaaataaatggagtgagcatattagcacaaaatgtaaattaatcatcataatttggtttggtttattttattccgtcaaatgatttttctgtgattcattgggaaagcgatagttttgagcttctgtttattttgtataatggaaaatgtaaaaaaaatagttatgtttacgaatatcgtaaagtcaaaagtattggatcttaattaagttaaaaatattgggtcttaattaagaaagaagtgttccatttggtgctcgatcgaacctaaaaaaattatcaaaaaataattgaaaaaatttacaaaatttaaaataatcatacccaaaagtttgaaaacccaagactcaaaattgtgatctaaattcttattccagatttttattaatatttacaataattatttgagacgttcattgaattaattcccttacatttgtctcttttgtaaaattgatttatatttggggtaaatttgtaataactaataaatgtgatccggggtatgtattttaactagtttagcattaagtattgtagtacaaaaggtcaagactgtataagaattcgtttgaatttgtcaattcaatctaatgagaggttcaaaatttgggactccgttttcatgtctgattagaaagcatttaattttttatgtagaaaagtaaaaattttgccaaatattaccactacatatgtttttttaatattttccttaaaaattttgccaaattttttaaaaattccaaaatctaacctaatggatttcaaaaatttctgtttttccataaaattcttagattttttgaactttttttatggccagaaaacaaacacatttaatataagtaaatttatatatttttaattataagttttttgtcaattcttattgccttcgcgtgttttttagtcaatttaaaaatttaaaggaaattgtggggcgccgctgttactaaaagtgccgccaggcaaaaacttgaaattttggctaaatttctaagagattttcacctaaaattgcctttttggatcaaaaatttaaataacgaattgctaggaaaaattgtaattttcaagctttttctcgtcacccgctttttttgcagtacgctttttttaatttctagggaacaagggggtccgcaggaaattttttttattgatttgccgagataaacctggaacccgtttcttttttcctctaattatgcaattgtataaaaattgtcatattttggattgtttgtaatgggttctaaatccggaataaaggataattatcccaatttttctgtttaactcattgggacaataacaaatgctacttgattttagggatgagattatggtaaccatacccaattattaaactaccattcaaaactatttttgcgtaatttgaaaaactcgtagccatgaactctgctgaccacggattccaaaaatgccaaaaataattattaaaattgttttgagaacaataacatttgcgtataaaacaaaaggatcattaaaactgtggaaaatgatcaaatgaactcgaatcaattaatagatttaaaattttcaataaaatggtggaaaatgatcaaataaactcgaatcaattaatagatttaaaattttcaataaaatggtggaaaatgatcaaataaactcggatcaattaatagatttaaaattttcaataaaatggtggaaaatgatcaaataaactcgaatcaattaatagatttaaaattttcaataaaatggtggaaaatgatcaaataaactcggatcaattaatagatttaaaattttcaataaaatggtggaaaatgatcaaataaactcgaatcaattaatagatttaaaattttcaataaaatggtggaaaatgatcaaataaactcggatcaattaatagaaaaaaccgcgagtaatctttggggatcctgaaatttagagacacgacagttggggatcctgaatttggggacccgacacttagggattccgacatttggagacaaaacgacgattggagattttaatgaaaaagacatttaaatattcaagtatttagccaaaaattgagcgaaattcaacacattttttgttcaaaatagtttttttgttgaacgtaaaaatcagggtcaaattaatgaaattttaaagatttttttattttaactctgaaattctttaaagagagacaaaaatttcaatttttttcatttgagaatctaacaaaaaatttaagaaaattcaagcgttttctttttttttggcatcacaattgcctaattaatcgatttaattttggggtttaaagcaaaaaatttttccgttgaattttgagccacccaaaaatcatcaaaatttcaattttttcattgagaattgcacaaaaaatttgaagaaaattcaagcaagttttcaattttaaaaaaagtttaatttttacaaaaattttataaaaattccgatttgatgtgttcaacccaaaattggatactggggccagcaaaaccctattatcagcaaaaaaaaaattttgtattt

SEQ ID NO: 24277 - DNA, 969 bp, Heterodera glycines
gggggggtcgcaaattttgaaaattttcttatcaaattcattaaaaagtccaaaaattttccccggcggcgcctatcggcaccgccgaaccccaaaattcctatttttcttaaaaaattggctcaaaatcgcaaaaattggccattttttggtgaaaatctggtaacaaatcacacccaaagattgaaaagtttttcccggcggcgcctatcggcaccgccggcccccctgttcccgaaaagttttttggaaaaagcgcgccgaaaaaacggtttttgaaaagcaaaaaaggtcatcgccgaccctccttcgcaaaaaattttaccgacccacccccttttttaatatatgatattgttttaaacttttaattggttttgaaagttatgttcagtcagaatatttttggtaaaaaaaaacaattcctatgttttttaagcgcaaggacaacaacctgaacacgccggaggaacgaattgcgaagagttcggccgacataaatttgggagttggtcgagcaattccggtgaagcaggactatctttacaaaaagtcaaagaatgggctgaaccgggagtggaagaaaaagtacgtctgcctgtactcggacggacgcatttgctaccaccagaacttgaaggtgtgcttgacaacaaatcagggaggaggtcctaggggtcggagcagatcgtttccgccatcccgcttctttcctctctatcccgaatttcttaaaaaaatttcaaggaaatttttttttcaaaattttgttatgaattaataaatggaaaaaaaaaattttttttgcttgaaattttttaaattagattgaaagttactaatttttagattttttaaaatttcggtggggaaacgaaggagggggaataaagtgcaccacccaggagttcctttggattttgtttttgttggcagttgggagggatgggttcacggaggaacaattat

SEQ ID NO: 24278 - DNA, 1335 bp, Heterodera glycines
tcggtctgatcgaacacattttcaaatgtaatggataagcttgagaataatgagggaatgaatttggcgctttttgttgttttttaaaaatcttggtgtgcgacctcaaaacaggaaataatatattaggtaaattgcaagagttagaaaaaacaaacggcgcgcttcgagagtgaaataaaggcatccgagaaaatgagagagagtgttttaaaattgcataatgcaatgcttttatactatgagtctagtacacaaagacattcgttatccattaattgcatccggtggtaccttttttcggttcattttcttgtgaattaattgattttgactttcattcgctttcctttaattaattaagactgattatgttagacttttcgcagcgcagcggccaattcttcgacggtaatactgacttttactggtcccataaaaaaaggaaataaaaagacggccttttacgattattcgttctattcgagggttatcgaggccgctgatcacgaatatgatatcataattgtcatatgatatcatctaatctttgatttttttgtcaagtctttgattttcttcaagtatttttttcattttttagaattataggcataaaatatgttttgtggagttatcggggtcgctaatcacgaatatgtcatctatttcgaccaactcccaagctctgacccgaactcgaacaaaaaatcgaaacttgacatttttacgaattacgaatttttcgtcttaaaatgcttacatgactttttattacaggaatgatggctttcggtttgtttcagtgcatttaaaccattttcgaaacataaatccaaatttcgaaaatttgaactttcgattttctgttcgaattcgggtccgggtttagaattggtcgaaatggatgtcatattcgtgatcagcggccccgataacccccgggtggaaagaagaaccgtagaaaaacagcctttttattcttttttttatgggaccagtaaaagtcagtattaccaaagaaccttattttcctgacgatgtatatttgcattgtttttaaacatctaattttgatgtcgcattttccggcgcccttcccagcagacgatcgtatggctgttcaaattaattttacgaattcgttctgctgatgatatgatacatacgacgagtgcacacaatcagtaaaaaatacggtataattaaaagaattttgcttaagtatagcctaagtaataatccatttgcattttttacaatattttatgaattctatttgattttttaaaattggcaaattaattaactttatacataatattaaatgggaaa

SEQ ID NO: 24279 - DNA, 1615 bp, Heterodera glycines
ccgtgatttagggtcaatgaaactcattttgcgaggtatgtattccactgacacaaaaaattttgcgcagggacaaaaaaataaaataacgttctcaaacatttcttcctgattatttgcagcctaatccaaactttaattttcaatagaatttaatgacattcatatttatggttgtcaattatatacaaatgtatactttttcctggactgtgggaggtctgaaacgcaagaaaagcatgtttttagcttggtttaagcttctaggacgtatttctatatgatagttgtacatatttcgcgagttatatacatatttgttcatattttagcatttcaagcatattttatgtacacatttgggcattttttcacaaaatcttttattgaagcagcccttttgattcaaagtaccaaaaatttttaaaaaatttaatttattgaatatttttttgaaaataaataaaaaatgtaatttttttgaaaattggaaattcgtgccaaaataagtccaaaattaaagaattttcgatttttttactcaaattttatcaaaattatcttgattttatatctaatattttaagcatcaaagcactcgagaagtaatcgaatttttaatatgagctattgcagaacaaataactaattatgcacatatgaaacggaaaattaaaaaaaaattccaaatatataaagaaaatacgattacaatttaatttcttaatccatcgattatctagtaaaaaattttaaaatttttttaaaataatttaaaaatatatttcctagtaaaaaaaatttaaaaaaaaaaatttaaaaatattttttgctaatttatatgaaaaaacaaatttatgaaaatttctataaaatgaaatttgttattatatttaaaactattttctacttgtaagcttaaaaacatgccgaacattaactaattaaattttaaaaaagttatttaaaatagaagcctaacaccaagggtagtgaatcaacttgtgaccacttgaaaaaaatacttacaaagaaatatttcttttatagcaggaatattatgctcccagaacgactgttataagaaatttgtaatttagaagatttaaatataatttaaaccatcacaagagttatttattttttggtattttattcttaagtcatcaaacaatacagaaataataataattaactctaaagtttatatttaaaagctcaccaaaaataataatttcaaattaaaaactatataaactataaaaagaggaaaatttttgatattcatagagaaaattaattctaagcaaaagccaatgaggaaattcaatcccaaatatataatcatctgtctgttattgtattccagagaattcgatcagttgttcgaattccagaatttccaccgattaaagatttattaataaaacaaaataattttaaatatttcttagaaacaataaaagtgctattttaaaatattaattaaaaatttgaaaaagggaaataatagcttaaataataaacataatatgataaagttacaaatttttaaaattatatgatggatgtaacgaaaggttcgagttcaagaaggaccaaatgaaggctaaaa

SEQ ID NO: 24280 - DNA, 962 bp, Heterodera glycines
  misc_feature (898)..(898): n is a, c, g, or t
  misc_feature (935)..(935): n is a, c, g, or t
agtgaccttccgcggatgaagatcggcatgcacaggacggtctgcgtgtggtacccggtcatcgaatcgatctcgcggctgaaacgttcgtcttcgtatgcattttgaatgttcagactctctcccgtcagtgccacatggccggcgatgcctttgccaattgggaatctgtaccgaattggcacaattatttgcaaaaaaatgcccaaactttcgtccacccaccgaatttcctttcgaccgtcctgctgaatgttcaggtcgtttagtgatggactaatttcgccgttgttcgcctcgaattggctgtgctcgtccaattcgggctgacttatgtcgaaaatgcgcgcgtatatttcctgcgatttattatccacgagaaaaagcgacgcgcggtccgcgtcaaccaatttttgggcgaaattctgtcaaattggaagaaaatgaataagttgcaaaaaaagataatcaaaccgaccatcactttcattatgaccgtgtccattgtgatgatatcttggaagatggacctgaaaaatgcgcgagatgattttggcactatcaatgggtgccatttacccttggcacattcattgagtcaacttactcttggcactatcagtgagtgtcatttacccttggcacattcaactcttggcactatcagtgagtgtcaattacccttggcacattcattgagtcaatttactcttgggcactatcagtgactgccatttacccttggcacattcaactcttggcactatcagtgagtgtcatttacccttggcacattcaactcttggcactatcagtgagtgtcatttacccttggcacattcaactcttggaactatcagtgagtgtcaattaccttggcacattcattgagtcattnactctttggcactatcagtgactgccatttacccttnggcactatcagtgagtgccatttactc

SEQ ID NO: 24281 - DNA, 730 bp, Heterodera glycines
ttggcttagccaatcccccaatctctctcccctcctcccactaattatcccgagaccgaactgggagtcccttccccatcccacatttactcatcatttactcatcatatataattgtattgtgcgcacattactgaaataaagagcatattcaaatgccgccgctgggatttttggggagggacccgtcgcctatttcatggaggtcccgcctctcgggatatctacgaaattgtaaaataaaaaaataaaaataaaaataaataaatgtatttggccaggatcggattagtaattttattattataaattaaaaaaggcgaaaattattaattaatttaaaatgaaaatgcaagaaatggaagagattaagtggaagtggcaaagagcggccggaaaagctcagaggaaaagttcagattgattgacacaaggtggcgttaacggcgactgaaataatgaaaagaaaaataaatgaaagtcagaaaatttaaattaaaaaaaaaaaataaggacaattaaaagtgtgaaatgtggaattcccacccgagaatgtgtttttggtgatgatcaaacggccgaaacggaaacagacgacaaattagccctgaggggtgacgaggcaaaatatgatgaaatgttcacattgaacttacggaatgagcgaagggccgactgaatggaagaccaaccaaggaggcgacgagccacccacttttggtgtttgacg

SEQ ID NO: 24282 - DNA, 665 bp, Heterodera glycines
gaatgaacagcaaaagggggacgaagttggccggaactttggctgacgaaaacggcttggccagctgtttggtgtcaagagctgattggacgagaaagaaaaggaagaagggacataagcacagaaaaatgtgataattaatttggcaattaaagttgcaaatcgggatcccgagattaagagaaaagagtagtcagttgatcaacaaaagaattcgcattaatcgccggcaagagaataaataaaacaaattcttggaaagtaagcagagaaacaattggcaacaattgctcgtgatcattgggtcctaggccaggagaatccctctctccatcccgcattcattcgcttaacctgccaattaagcacaaaattttgttttcgttttgcatttatttctcgaccttaattacttagctgaaaaacaattcaattaacaatccttttaaacttttcccggttaattaaagcaaaagtaaaagcttattattctgatcatcaaaacggttcaatcgtgactggagaaatttgaaaagttgttgtcacggtataatcagcatttacagttggagaccaaattttccaagggaattaacagctattcagtttgaatttggccgtctgcgtgtggaaccggttggaaaaggcgaagaagcgcaagaaag

SEQ ID NO: 24283 - DNA, 2186 bp, Heterodera glycines
caaagcggatcaaatttgatggacattttgccgaatcttttcgatcgttcgaattgtgtctgacctgaatcggtgtcgaggtggacgcgatgcgagtgaagccgcggatgtcggaaaacaaaacggtcgaatttgagtagtattgaggaagcaccggacgacccgccttcaggtcctcggcaattgacctttgagttgggtatatttacattgggtaattaataattaattatgctaatgcgctatttaatatttccaaaataaaattggccactgactgtggcaacatattcttcaacagtcggtccgcctgctgctgcgcttcctccaacagttgcgtccgctctttgaccaattgttcgagatttgttgtgtactgacaaattaatgcattttaggccccaaaattgtgggccaacccatctcatccaattaattcaaattaattgtaacgaatgagtttggtggcaactgaatttccttcccatcgcttcttcgcgaatttgggcctctaatttcggtttatggcgtttcgctttttgctcttacgtcctccatcattttcatcatctgatccaccagactgccgctgcccgtcgacttcagatttgagttgaccattgtcttcatccgcttgatgttcgggcgcatttccgggatttccagccaacatgcctccagcgcctgtgcaaacaattggtcattaccgtaatcggcacaactacagtatataaattggccaaaccgatagaagttggaaattgtatgcttcttcgatggcagaaacttgctgttttgggaaggtcgggcgtatgatttggtcgtcttcgttggccaatgcgattcgttccattatttctaagacaaatttcaaaaaattaagtattttttttgtcaattttggcactttttggctgcatattccgctcatagaatggctccaacttgaacaggatttggtacagcaccatgccaaggcttcaatggagaagttgttaaattactttcttaatagcatggggccgggaattttccgtccatttaatgaaaccatgaaaagtctaagaaaaaaaatgctaacagattcaaaaattctttgggtcgatttgtgctcccccatcattctccacctgtacatgtccgatgccgggctgcccggtggcaaatgttttgtggagatgaactcgcggatgatctccggtgcctgctgaatgtattctgaagggggcggaggatttttaaaacaaacttatttaaattatattactttaattaagaataaatgaatttagaaaagacaaactcttcaggtgcgacttctcataaattttcttggactgctccaactcctcgtccgtcgcgcttcggctgtcctccgtactgtccgcgccgctcctttccttgtcacgggtccggcgccgcttctcgcgttctctgtcctttcgaattgataaagaattaattttctcgcccttttataccgtatttacggtattagaacccccgggggttctatttttcaccccctcaaaaggggggttgtaattcagggggggggggggttctaataccgtaaataccggtatttttccatattctttttttctcgattttattctccttcttcctcccactcttttctcctttcctcccactctctcactttttccctcgcttttttccttttcccacccactctcactttttctctttcacctcccactctctcactttttctcctgttcccaccactctctcattttttctcctttcccctcccactctctcactttttctcctttcccctcccactctctcactttttctcctttcccctcccactctctcactttttctcggtctttgtctttttctctctcttctttgtcgtctctccgcccacccgccgtttttttctcatcatccttgaccactttctttgcctttttgtgcgattttaatcttgattccgtcatgtatttaagctcgttgtgtctcagtttgtccccaatgatttgttccgtcacaaaatttgtcaatttcacattccttaatttatacattaaattttgaaattaaaaaatttttaccaatttgagtcgaccaaacaattttgaagacacaaaaacccatggtatttgatgagcgaaagtatgcagaaaatagaggccctaagtgttaaatga

SEQ ID NO: 24284 - DNA, 1180 bp, Heterodera glycines
  misc_feature (94)..(94): n is a, c, g, or t
aaatgagagaaaaagaaaaaactttgcccagtcgtaaaattttttccaaagttgcgattttcttgaaaatttgcataggcccatatttgacctncctctatcgaatcacagtttattttttagctgtctagtttttaactcgagatcggctcttctttttttgcaagggaaaatccccggaaaattttaagttttgcaaagttttggcgttctgattactaaataaaaaataagcataattgtactgggagcccaaaattgggccgctgtgtatagctacaaactaaattacattaacagtttagaagtaaacaaactctgctgaaattcatagaaagtaattaaacgaccctaattaaggaaaatgagtacctaaattaaatttaagaggatgaaaagggaagaaaaacaaagaaggaagaaacagaactcatttacatatttattgcttctccttctcattttcttttcatttttaaaataatttttagcgctttttggtttatcgttatggaactcacttgggccctcacgtttgggccccagcatgttttaagtagatatcggaccggtcggttttttttcggtatttttcgattttcggtttcggtttttaaccgaaaccgttcgaccgaaataatcaaaaaaccgaaacaatcgaccgacttttatgaaaaatcagttggccattttttaacaaaattcattaaaaattaaagaggaatttggtgtccaaaattccgacggtgtccaatttaccggcccctcccccttatatgataagtaatttaaacttctaattgatgatttgtttaaattcccctttttcactaattaatcaaattaaatttattatccttttgattaccgaaagtaattgattaagaaatcaatagaaaacatccgttcagtgatcaaatgtgaacgaaatgataggaaattaaatcatcatcaaattattacatgttaatatcacttgaacaataatattctgtttcataaaataagaacagccaatttggtaatagtagggtttgtcccccccccctttttaaaaaaaaattttttttttttgaaattcatcaaaacgtctttcctgaggttttgaggtcgctgatcacgaatacgacattcatttcgaccaatttcgaaccccggacccgaattcgaaacaaaagtc

SEQ ID NO: 24285 - DNA, 1524 bp, Heterodera glycines
acaaatttaaatgacactaaaatagcctaaccgatttttttttctttcaatttgaacacttacgcgccgatgaattgaagaggtcagccgatccgttaccccgtctgggagatgatgagtcgaacccgatcagcacggaacaatcatcatcgttggcaaattggtcggacaatggcaaaggccgtgccgtcgtcgacgccgcggtgtcagtatctaaaaaaaattggcggcgtaagattaaaaataattttcagagagtctgtgtggcacatgttgggggggggtgactccgcaagccaaaaaatttttttgcaggaaattcaggcactaaaaaaattgccggaaatagggcacccccgcccctttatgagatagttttctttttactccataattccaccaactcacccatctgtccgacaatgtccgcaaatgcgttgcgcaatcctttgcccatctgtgaacagcgcgtgtccatcgctcgctgcagttgggccacaaagcgtcgcttgtacgcctccaaattgtcctccaacaatttgtgcttctcaaacagttgattgcgctcatcctccttaaaaatgaaatggaagttcacgaatttttttaagtgcatcgaatgaatgagggcgtggaaattggaaattttattccaatattttttttgcaaatttttttagatttcaaggggaaacgactcgggggaaatgaagcacccaaaaccaggttcacaatttttaaaaggccatatctctagaaattaatacacattttcagctgaactactaacccccaatttaaaaattgaaaattcatccgcgaattctgcccaccaatttccgatgagtttccgccgcctttttcagcatttctgtcaaccgcatttgcgcgttgtttgcctccgtctgcacttggtccaattccgccgcattctgtgcacccaattcatccacaattttggccctctgttcgtcctgaaaagcaggggcaaaccgttttctgtttttgaaaccttttaacaccgaaaattaaacaatttcagtcaaatttgtaaaattctaggttttccgctagattattcatcaactgaccagttgccgctgcgtgtcgcgttcccacgcctccgccgcctgccggtgttccgcctgcaattgctccgtctgctggagcagttcgtcgtacgcgcgcgcgtactgcgtcgcgcgtgcctcagcctcgtcacgctcgtgcgcacactggtgcactcgctgctgcagttggtccacttgcgcctccttggcatgcatcaggcgcgcctgcacgtccgcctcgtggcgcgtccggtcggcggtcagccgaagcgcgtggcattcattttggcattccaacaaatttcgggcgccgtcggacttcgcctgaaacagttataggggttcaaacccgcgtggcagcatacggattttttgaaaataaaatttttctggtttttcaaaaattgaacgttggctatacccccttagcccacctggatgagttcgttgattt

SEQ ID NO: 24286 - DNA, 1922 bp, Heterodera glycines
  misc_feature (696)..(696): n is a, c, g, or t
atgaagtgtgtctgtccctctccctctctctaattttcgaacaaattttggggaagggaacaacaaatcactcctttttctctgttgttaattgtgttcggccgtttcagtctcttattagagggcacaattttttatttacatattttttcctcaaaagtttgacatttgattccgttgggttgaaatgtgtaagggaaagagattcaaatgtgaatgaataataacagagaaacagacatatggcggcacatttttgtgtttgtgtgcgttttattgttttagttttatgttggggaaccgcgttttttttttgtgattatgacaaacaaaacagaaactcagaggaactgaggtgaagaaaagactgatgagagtgacaaagaaagcgatcggaaacgaaaatcatgggaaggaagtgagagaaagtgagagaaagagaaatagagaaagagagagagacgagaagtgatatagagaggaagggcgaagagatgaagcgtgagagagagagagtgagagagatagagagaaagcgatcggtgagcagcacaaaagccgagcgctgaaaagaaaaaaccgctcttcaaacagttgatggaacagcagttcagcacagaagatgaaattgagtaatgctgatggtgacgctttttgaggaggagtgaaaataactgcaactaccgtattttctanatttaaaggccctcggggatttagggagtatacggtaatggttgtttttgagagaagtcatccgagaaggagggggacggacacattaggtcaattatttatgatagcatttacctaattggattacgttcccacccctccccccccttatcgtttcctctgctctaaaaatttttaaaaaacctaaagaatttttcaaaaaaaaatttaaaacattttttatgagattttaaaaaaaattcaataaaatcaatcaaataaatgttgtcgagtgcaaccgaccaaattctgagacgtcatttgttgcccgttaagccggagagtgagatgagcccggaggagcgcgcggagaagaaaaaggcggagattgaagcggaatttgcgcgatacaagctggtaaatttagggggaaaatggaagaaaaaaataaattgaaaaaattcatttttttaaatttaaggcccggaaattgcgcgtcaaacaacagcaagtgagttcaatgattgttatgtgtacaaagagtgtagaattttgtcggtgtaatttttcccgaaaaatgccggtgggcctcgaaaaacaacctacccgacccggattttcgccgaccgcgcctgggttttttgagggcctaaattttttttcatgaaaattctcagttcacaatcagcatttgttcaaaaatgtcgatttccattatcaaaaaataattgctttttcctccaggaaagtggtggcgccggcgatgaagcggctgctgcccaaggtgggtggtggtggacaattaaaaatttaattaaatgcccaattaataataataattattgttgttattattattaatattatttatgttttgtttgattcgtttacaaaaatttatttttattttttacataatttgatttgttagttacaaaaccaaaaaagaatgttgttgcttgtttgtttgctccattttttgtgtacatattcatccccgagtgttgctttttgttgtccacgacacatcggctaaacaaactctgatttggctaatacccttcccgagactgggcctccctaaaagccccgattctcgagtcggggactcgagaccgccgcgacttgccctcaagaccgaggcaaatagaaaaacaaaaaagaaaaccgagactgttccgctcttttggcactgtgcttttcatgagaatggtgtgccgccgtcagcatcagcgaattttcgtcta

SEQ ID NO: 24287 - DNA, 1526 bp, Heterodera glycines
tttgcgaatttatagaaatttcttgtgaaaaattaaattttttttttgaaaatgtttttctaaaaaatcgttttttttaaaggataaaaaattaatttttaaaatacgaaaatgtggatataagcctatttaagtcaattttatggcattttatgcctattaatcctttatgaagaatttttttaacaaaaaaaaacaagcattttaaatttcatatttataaattttaaactactttttgtacatatttttgtcgtccctactaaccgagctttcgaataatgtcaagttagtaaaattcggcttgattcattgcgaaaagttatggaagcgacgcatcacaattttatggatttcggtttacgtattttttccgtaattttgacccgtaactggaatgtttttcgagacattcttagtggatatggatggcaaacaactttctggcctttgaaattagcctttttatattaagttgtttaaattttgcaaaatttttgataatttcttaatattatagttaaatttttcatttctttcaaattagcatatgattacggttttccgtaaattaaaaattcacttaatgcatactgtatttcccagaattaaacaatatccatttgtgtaaagcaactaatcgaagcaaataacagaattattattcactttccatttttattttcaattttttcaaattttgtttagccctttgatcagccgcttccgccactcgactgcattttctgtccaatgccaaagattaagtaagtcatttttttctgtgccattttcagtgctttttttgctgtaggcaattgaatcggcaaatgccgaacagatagagatggacgaacagatcgacacatctaatgactgaaacagcagaaggcaacagaggaaaatgtgccattgagtaaaaggcaaatagaaaatgccgacaaacatttgacattataccttagttgttgataaataatttatcatgttctgtccagtcccattaaattttgtgattctatacaattaacgcagtaattaattattccaaaaaatttaattactatgtagttaattcaagaaattattttcaaatttattaattagataaattttttattgtgatttgattttcaaattttaaattgtcttttgaatgttttttgctatttaaaatgatgacaataatgcattaattaataatttccaaaaatcattaaatcattaattatctttcctaagtttaaatattagtttttttttgacaaaaatccttgtgatgtgatgataaattatttatgtgttacataaataaaattttttaatattaaagattttcattaaattgttaaagtatttaactattttgaggaattaaaaaaaaattgttttattaattaattctttttaaaaatcattatttatttctatcccatttttaatttatcaatttttggccaattcaaaaacaaaacatttttttgaatgtggtttatcttcggccacaatcttttgcttttatttgg

SEQ ID NO: 24288 - DNA, 997 bp, Heterodera glycines
tgccgataggcgtcgccaggaaatttttaagaatttcaattgaatttattaacagaaattgtacaaaaattactaatttttgaaaaaaaaatttaaaaaaatttccgtcttttttatcaaaaatttcggaattcggtgccatccctgctttggcactacatattgccattaaatgtcgtcattcagttggatttgcaacgacatttggatggatattctgccatttttttgtcgtcctcaacttggcctagaattggcactgatttcgccccatttcgatgttttggtggacacgcatttcgactgccaatccgaattgaaaatttggagatccttcaaaatttacaagcgacaacaatttgtttatgaaggaattcacacttcgacaaggaaaagaaaaatgattgatgttgaaggagcgcctcaccttttggtaacaattttggtatttccccccccccccccctccattttgtgaaaaaaaattttttgtttaaatcagtgtaaatgccttttcctgggttttcgaggtcgctggtcataaattttgacaaatagcgaatcctgaatttcgaacaaacgtagaaaattcaaatttccgaaaagcccaggaacgacgttttacatggcataaattttattagttttttcgaaaaattgggcgacaaccataataattaccaatgtttccgtgcaggtcggtcgccacaataagcagtttccgtgccacgagatgcccaacaaaatccgcttctgtttcctccaaattaagtaatttaataataaattttctgtggccaatggcggaaaacttttgctccgaattttttttaaattttaagaaaacggcgatcataaagaatgggtggtcccatatgttacttttttattttgggataaaaatttggaacataaaaatttgcttaaatccgccgatggataagaattttctgagggttatattttggttgggatcgaaaaagttaggcctctaatg

SEQ ID NO: 24289 - DNA, 1628 bp, Heterodera glycines
ccggctccccaaattgggccgggtcattgagtcgcgcaaggcgcgcctctaaatcgccccactcagaagctgcaaaacgtaagaggtcatcaaatagaaccttgtaaaaatgtgccaccaaatcaattccaattaaaaaaagcacacgccttttgccactccaccgcctccgcttttgcccgcgttggccgtgccgtacaacgagcgcagcgacgggggcggcaaccgatcagtgccccatgcgttttgctcgaagggcacgccaatcggtggcaaatcgcgcgacttttcagccccgaggcgactcgcctgcagacactgccgttttgggtcctcaaagcatgtcaaaaagtcagagatagagaaaggggacggtgagagagtgcgaagagtatgcggtcagacagtcagaaaccggagtgagacaaaggcaatggcattcaatccgtttttacttccatttttaatacccgtgccgttttgaacttatttgtccattgtttttggcgtgctaatgtcccccccccgcccggcactccaaaaaagacgcactgtcaacaatgtgtagcaattgttgcacaccggcaccggtttggtcggggacactgatggcactgcgcacttttggctaacgcatcgctcgcaaaagccgaaacgacaaacggcacacccgatctgatttgggtggcattttttcccattttggatcataacaaagttctcccacttcttttctgcgtcgtgtgtattccgccatacaatttgtgcacggcattttgcgtcctcctttctgcctagtgccaaaacaaacgaacaaagccgaaggggacatagagaaaattggaaattttacaaatcaaaaaattagtgcataaattggcaatctggtatttattttgttaaaaaatgcttttacatttttattggaatccttaaaagtcaaggacaggcggaagggaatggtcggtgttgtgtaagcatataggtacttatattttatggattggaattgcgcaacctcaagagcagaggaagggacaaaaaaattagagaacgaagcactctcgagggtatgggaaagaaagaaagcacaacagaaggggaggaagaaagaaagattgatcgagacaattgacagaaaggcgctgattcatcgcattggtgaagaaaaagggccaaaaatggaaaaaagtataaataaatggacatcagcagcagagaaagggtatcatcatcaatcaagtcaatgtgatcatttgggttaatccaaaatgggaaatggtcatcgctttaaggagaaacagtaataaaaaaagtcatttggacaaaagaaacagcaaaagatggggtaagtgatcactgatcagagaaagagaatgtcgtgccatcgtttatagccccacacattcacatcgtggccaagacgttcattggtcgaagaagctgaacaggtcgggctgccgcttcggctcaccgccgttgtccatgccgtcgtcccccgcggagggagtgcgcccggcggaaagaattgaggacgcactgatgccagcagaggggccaccagcgccaaagccaccgccacggagacgcgaacgacgacggaccaaaatgggcggtgccctcttgct

SEQ ID NO: 24290 - DNA, 1382 bp, Heterodera glycines
cttcatcaatgcgtagccgtgtgtatgaagcaaaacaaaatgccaaaaaaaatagtgggaagtaaggctgtaagttttatgcacaaaaatttccaaatatatgcatatacggggttcggatcggacaaactccattcccaaggacgggtataccggtttccaatgacataaagggaaaattccattaaattaaaatcaatgacatttaaaatttttatcacaataaaaaatgtttaaattttatccaatcgttccaagcgcgggttgatgccgactgtccttcattccaagcgcgcgttgccgctgactatccttcattccaaggacgtcgaatcgctctacaatcccgggcgaagtgccctacttcattacatctaaagcactttacgcctccgatggtaggcaaccccgctgttttgtattcttcttcctcttcttctcgtgaatttcccatcttttccatccacttttgcacctccttagatgccttttgtgcctcatctcccaaaatcagtgccctttttctgatttggaggagcatggagagcaccgttcgcgcttccttcgtcttctgatcctgttcaatgcttttccgcattttttccccgaatttcgtggcggcttcatttgccagagttggcgggtcgacttcgtttatcgttcgttttctggagcttacaacaatagcttggcctgttttttaaggctttctctttgtcctctcgcaaatccttttttgcctcattgttcaaagtcgactcccaaaatgcagtcgctcgtttgtcggcttcggcgggttttcgaaggcatccctttctctttcttcagaatccacaatcgagatttcatcgtctttcgttgttccgacgctgaggcttcgtttggtttccgtctcgtccttctgcttcatctcttccttcttcttttccgtctctttttcttttccctctcttcctttcttctcctcctctttttccttcatttcttcgccctttttcgtcgtttcttccttcattttcttcccactcctgtggtcccactggatatccgacgttccggatttccatttttcgctttcggtcagactttgctggaccctcagaagttgatgttcgagctttctcttcaacctcttcagagattcttcctcctctttcgataacaattccatctttaaaaatgaatggctttcgtaaattttcccgttcttttctttgggctcgtttaatctgcctttcttgttcatgttctcgattaggcctaaaagctgcttattttgctcactagcggggtcagcgccttcggcgcatcccccgctaggcagtacgattgtgttatagaattatgaatgataaaatcgactggctcggccacttcgcggc

SEQ ID NO: 24291 - DNA, 1027 bp, Heterodera glycines
  misc_feature (64)..(64): n is a, c, g, or t
  misc_feature (1009)..(1009): n is a, c, g, or t
aggggtatacaatattaattattaaaacaagtaaaatggggtttagtatttaaaatgttgaatntaaaatcactagcaaagaataaaaacaatgtaaatttctaatttatttaaggctttctcagaggttatttccgatctttaccattatgttcatccgaaaaataagcgccaaatgcctatggtcagcaaaaaaacgtacgacattgtgatggcaaatgcacaggtgaattatatggcattttaaattgtttattccattttatttaaggcccttaattcagcaattatttacgaccgggacttcagctacacatattttgggtttaagacacttgaacgttcttatttgttgaaaattgacgggaaagttgttgagcgtccccaacacatgctaatgcgagttgccattggaattcattacgaagacatcacggcggcaattaatgtgttgtatagttaattataattggaaatgtatgtgtgtgcttcattaatcgcctcatttttacagacgtacaatttgatgtccgagcgatggtttacccatgccacacccactctgttcaatgccggcacctgccgtccccaactctcttcctgcttcctcctgacaatggtcgacgattccatagaaggcatttgcacgactttggatcgctgtgctctcatttccaaatccgcgggtgggattgggttgaacgtgcactgcattcgagcccaaggatcatacattgctggggttctttcccgtctttttttcttttggtttaaatggatttgcagactaatggcacttccaatggtctcgtgccgatgttgcgagtgtttaacgccatggcaaaatatgtggaccaaggggggaacaaagttaaccttgcaacagtgttggaaattgttcatctttatttttaagcggcctggcgccttttccatttatttggagccatggcatgctgacgtcatcgatttcctggagttgcgcaaaacaccgggtctgaggacgacngagcccgtgatcttttta

SEQ ID NO: 24292 - DNA, 1555 bp, Heterodera glycines
acattgattattttctttttcgtgcatttgaaacgatttttagcaataaatgtgaattttgttaaaaaatcaattttttaattttgttcgaatccgggtcaggggttcggaatcggtcgaaatggatgtcggattcgtgatcagcgaccccgaaaacccctagaaacatgtttttatgattttttgaaagttaaaaaaaaattttaaaaaagggggggtaccatctaaactattaccaaaagtcatttgacttaattcacatccctatttataactcgtgcatttttggtgctaattttcgacccaataaaagacgccccaaatgcgtgcggcttaagcttacatacacacatatgacatcaacaaaaagccttgtgcttttcaccctcacagtggtaaaatggggaagggaacgagagacagcagcagcacagcagagagggcggcaaaagaaaaagagaaaagcgaagactgactgacaatgtgtgctcaattcttttgacggagagggggaaaaagggagagaaattgtgaggaaaaaaagacgaaagacacctcgcgacaaatgaaaaacgacgaaccaacacagccaccccaccaccgaacaaacgaacgcgctgctgctgctttcttttctcctcattttatcatttctttacgcacgacggggcgcgcccccacttaacccattcattcattcattatcaattgcacacaaatgaatgaaaatgaatagcaagcagtaccagcacaaccagcaccaacattattattttattagtgtagaaataggtacataatacataattgttggggcgtgtgctctttttcctcttctgctgctactgtgtgatgtttggtgtttttcaccatacaatcattggacagcagcagcagagcacacaaaacactgggtcttctgaagaggaggaggaggaggtggggattgataggacgacaatgtcatcattattattatgatgtgtgtgctgcgtatgttattttttgcaaaatacttagtaaagcacaattcaataacagcacagcattagcagcatctgattgtgagtttttcgatgaattgacaaattttgtcatgatacaataattttgttattttcggattggaaagcaattagggtaccaaatgattcgtcgtcagttttgttcccttttcattttctccaaaaaaaaaaattgaccaaaaaagatgtacacacaccatcccagaaatgagctcctgtaccagaaaagatttgcatgtgtggctcagtggtttttgtaagatagtaaagggacaaagggtggtggttcgagtccgttgtgcaacatgaatatttttatttatttttgtgcaaaatattaaaaaatcacgatatttgggaattatttttgaagctttttggtaaccaaattggacaatcttggtatcattcgaaagctcttgatgaggaaaagctttttctaagcaaatgctaagcaatttgatgaatcagaaaaaagatatgcctgtgaggaacttgtaacttttgagtttgaccatagacaaaaatga

SEQ ID NO: 24293 - DNA, 1216 bp, Heterodera glycines
gctgctggaatatcatcattagcgtccctccaaataattgcacaaacttcatttctttttggtatattgtatcttcttaaatccactccttctcggatgccaaacaacatcataatatcaggaatgtcttcagattgttcagcagcctcttcagaaacatctttcatcattttataagattgtgaataaatataattttcacgtagatataattcgatataagaaattattgcaataatattgttatttttgtcagaactaattttgttactaatagcatttgttcgaatatcaattgcctgttcagtatctacaaaatacaactgaccattcgttggcaattcatcataattatttggttgagcaaaagtgttatacgaatggtatatattcccttgtattttaaagattgggatatttttatctgggaatttaaaccgcatgcaacccaacgaagcacaggaaaaagaagagttcaaaattcttatgttttttataaaatctttatggaaattcctcatgttcgtagaatcaatttggtcaaattctggttgaaacaaaagccttaattccattggataatcaagtaacatatcttccaaattacttgattttccgtagttacaacagcctaaaaattcattaactcctttggtattattttgttcttcataaaaatgaatggcggggcagtggttgcattttaatttaaaatcactaagtctaaagacttcaacattggaaaccatatattcacctgcttttaaataaattggaccttcactacatttcattcgttctctatgtgattgaacagcatttgcagttattattctttcaattactttttcttcctcactcattattgcacgtggttttttacgatttcgatcatattcaagataaatttcagttttttcttttgtcattttaatacgtgacaattgtttacgaatggccacttgctcaaactcagaaatctctattttgttctcggttaattcataatcacgatcaaaaaaaaagctatctatctgttacttcgtctaaattaattattctttcaagatcagatgactttcgtttgcatgtttttctatcattttcaactttgtctgaccgctttttaagggagctttcaaccctatcattacaccgctttttttctcgggagctttgaacccgtcatttgtttgttggttgtttgtcgatgtag

SEQ ID NO: 24294 - DNA, 1452 bp, Heterodera glycines
tatttacatttttttttctaattttttttgttattgctttacagacagcccgatggcttaccactgtccaaagtcttgagaaggaattagcaactgtggagcttgccatgttgctaactttgcccagttcattgaaaaataaagttaaatgtttgaaagatttgcatcggaaaaataatttgtacagtgatactgttaaaaatgaattcttgtcacaattcaaatcgccatggacaaacccatggcggcaaccagattttatgcattcaattagagcaaaaacaggtgggtgattgataaggttaatatttttagttttttaacattttttcctgagaccctcgtgacctgtaacgctcgaaaaacatgttttctttttggaaattttaaaaaaatatgctcaaagaaccgacaataaattttcaaaataggtacactcctaataataaaaaattttctcaaaattttatcgccaaaatttatttaatttctttttgctaacaatttttatttaaaaattatgtatttctctgtcaatatgatttggcttaattttgatacttttttgtataaattttttattttacgccccctaaatttgaaggtttttagcaactattttcccattttagcacctattttgaggtttttttaaatcaaaaaactattttggcagtttttagcacctaaaattgcatccctattcatcaatatttatgtaacttaactgtaagtgtctttttttagggagaaatgttctctcaaatgttgtgatcaatttgaagaatattttcaccgaagaaatgatcaatctgaaaattgaaaacaatgatcaattgggtccggacgaaaatagaatagtgcacagaaaagtgttcttctccttatatttggcaatgaacaaaagggagtttgacgaaattcgcaatcaaaaattggacgaagcaagaaacaaagccaccagttatctgattgaatgcttaagcgcactccattcataggaggatgaagcatgagatgaacaaatcggtaaatggcaactcgtacaatggacaactcgttaaaatttttatttaaaaaaacctaactaaaaatttgagttgaaaagttttttaaatttatttttgaaaagtttttggataatttctcaattttcgtaaaaaagtacaaaaaaattttaaaaacttgataatttgtttattgatgaatattgatatttaaatgaaaaaataaattttttttgagctccttaaatgcatttaagcacaaagaatatttaaataattaaattccaatccttaattattagggattcgttttcttaggcaaatgcctaaaatttctgcgcacataatacgcacagataagcacgaaataagcgtttccgcttggtctggggtgtctacgatgacttttataatgcctattttttgtgcctaattcaagaaaaat

SEQ ID NO: 24295 - DNA, 2316 bp, Heterodera glycines
tttgtttttagtaaaaataaatgatcgaatttgcctgataaaaatgaagggatttgatcggaaaagatcaagtgatcggctttgctttttaaaaattaagtatctgattttcttggtaaataaagtaatagatttgcttttcgtatcggatttgcttaataaaatgaagtgatcttgtttgcctacgaattagtgaaataaatgactgatcgagtttatctggcaaattaagtggtcggattagcttggtaaaatggattgattggctttgcttttagtatcgaattagcttagtaaaatgaacttatcgaatttgcctggaaatggattgatcgactcaaacattgattagatcaatagcttatcatttagcagattgaaatttcttttccaaaattaaaatcattgctttaatcaaatggtaatccatttaatcaaaataatataattaattttgcatatttttttgcaaccgcccacctctgctgaacatccgggtagttgagcatgtacagcaccgcccaattcagcgtggccaccagcgtctccaaaccgccggcccacaaatcgccggcgcacagtgccaacgacaatttgctaaataaaatagacattttttggtggaggaaggggggcgaataattgaaatttttcccacgaattttacacgcaaattaggcggccccttttattaggcaattaattgtgttaatttggtgtaaaattccgtttttaatgcatgtttgtgccaaggatgtaagcccattctgaattctggcccttctttgatatcctaattttttggcatcaccaaatcagactttcgggaaattcgttgacaccgactgacatttctgatcggaaattctctacataaatccgatttaaaaaataattttttattggaactgttgatcaaagaggggctgtccttgaataaggaaagcctgtctaagggtatcatgtccttgtaaataaggacgacgaatcccaaaaaagggacaaaaatctccacgcacaatgccggctcgtcccaatcattttgctgtgtgccgagcagaaaggcggcaatgaaattctcctgatgctccaacaatggcacttcttcagctgaccgctgtgccattggacttcctttcacttcgggcactttttatgaaaaaattaaaaatttaaatgattaattttggaaatctctttttttctctgatttacatgattaattaataaggccggcatttatatttatgaaaaatatcaaaatatttaaatgaattacgaatgaaactacaaaatatttatcaaatatggataaaatattaataaaaatattttccataaattaatattttatttatgaaagctccaaacatttaatttatattatggatattaaagtttcaaatgaaacatttacggcaaaaaatgaagtaattttcttgcatttttcatcaaataaacctggcagaaaaaagtttaaataaataaatttccgccctattaattacacaaataaattcaaaaaataaataaattaattaattgtcttaaaaaagtaattgccgcttacaaataaaagaaacttttcgagtcataaaggacactctgtgacagcaccagggctggacgcaattgcggattgcggattgcggattacggaaattgcggggtttttggacccccgtaattgcggattgcgggttgcgtatttttgggatttatccgaaattttgatccgtaatttgactattggattatttttcgagacgatttcttgtaagattattttttataaaatgaatttttttctatttttatttaaagaaaatatgtacatttgtttaaattcttatttctttagcaatttaaaaatgtcaaacttaaatcctggtaattggtggtattattttgagcgtcaaggcaaagcaactgctaaatgtaaagccgatggatgttcctactcaaaggcattaaatgcttctctcagtacaactgtgctgacttttcacctcaaaaatcaccaccctgaactttacaaacaacgtgaagattttgttcaagcagagaagcaaaaaacagaaaagaagggacaaagtggaataattttcttgataaaaagtgcggcgcggaacgggatcccgcgcgggattttgcgggaccccagtgaaaatcctgaaaaagcatgaaaaaatgcatttaaaatgttttttattaaagatttttcgtgagcagaacatgaaataaccaaaaatttaattttggtcatttaaatgatcattaaataaattattttataattttttcgtttaatgaaaa

SEQ ID NO: 24296 - DNA, 2040 bp, Heterodera glycines
  misc_feature (796)..(796): n is a, c, g, or t
  misc_feature (830)..(830): n is a, c, g, or t
ttggcttggatggctgaaacgaaaggaccaaaaagcgcttgatcgaaacgacggactgaaatagatggcctcttcggcggtcacccccatcagcacgggtttgctggctcctcgcacttcccgcaccaaagcggggatgtcacgggggaggaagtcgccgtcgatgcacgggccccacaccaaaagattggggtccgcgcgggtggtgcccttaaaaaaagctcatttggtgtttttacattttgctttttcgaccattgcttttgcaatttgcacaatttgttcggcagtcagtgccttcagcttttgcttcgcttcctccttttttccctttggcatttgccacttttgctctttgccgtttctctctccgccattctccgcttttcctctgccgccgctttctctccttttgatgtccatcgctcttcccacaaactctctgctcgcctcctccgttcggccactcgccgaccattcagccaacgccgtcccactcatttcaacgcttccgcaaattaaatctgacaatgaggaacccatttaataaattgattgtttcccaattaatggaagtcatttctcaatcgatggaatgaaacattccaaaaccccagcaaaaaaagagtcggtcgatgcttcctaatgctttccacctctgctgtgcggtgacagtgccataaatgccgcggcggcccctccggcgctgagaccgacggcggtgacgcggcccgggtcgccgccaaaggcgcggatttcgttgtgtacaaagcgcaaagcctgacaaatgtcccanaggcccaaattgccgggcaaaacacttccacggncaaaggataaaaaacctaaataagcaaattcaaactaaagcgggagaaaaaggcggaagactcagcagaaccgaatgggcccagccgatattggacggtgaccaccaaaattccctgcggcgcgaaattctcggcccatccgtcgtagccgtattggcgagcggagccttcggcaaagccaccgccgtgaatataaaacatgacgggcaaaggagcagaagcagagagcgcgggacggaaaatgttcaactgcagacaatcctcagagaagggaattgactctgaattctctgggtttagcggaatggcagccggaccaaaagcgaatgcccgcaacggagaggaaagccacggagagggcggcacgggcttctgaaacgatcattccgtagagaaaacccttaggaaatgctgctgattttaagtgatgatgattggttagtgtgatcaattttgactgatcacctcaaatcgcagttggccaattggaggctttgcaaagggaatgccgagaaaaacttcgacttggacgccgctgtccaaacgccgcagaatgccaatgacatcgccgtacgaagtgcggacgaccggcggagcactgggcgacgaacagtgactatttgtgaggcaaacgacggcggaacaattgcaatcggacatcgcttctttgggtgagttaattgtgacgacagaccgaaccaacaattaattaatgaccaaaaaaacgattatcccttcatcagagcctaagaaaagtcagcggaatgaattttaatgtccttttgctctttcgtgtttaattaaggcctttattcctccgacttcgcaaattattctctctgaattgaattaccaatttgccatttttaattaacgctttgttttaattttctttgtcctttcaattcttttttcttcagccattcgctttttaatgagatgcaaaagaacaattcttgagcttcgatggcatagtcaaattgaaaaaagaatcgaaagaatggccttaacatcggacagacaaaaaatgtcagtcatattttattatttctcatttgtcagccacgggagggggagagagaggagagagggaggggcgatgggatcgataggccaaagacaaattggggagggagggaaaagaaaaggaatgataacgcaaaaataaatatttaataaaaaacgaaaaaataataatttaccaataaat

SEQ ID NO: 24297 - DNA, 887 bp, Heterodera glycines
ttggttagccgagagcttaaatttttatcagtcatgccaaacaatttaattaacaaacaaaaactaaaaatagttctatctttttcacaaacattgtccgtaatttgctgttataaaactatggatacaaaattaaaaacgagcaactacatactatatttatcaattgaaactaaacttcttaaaaataaaatcgttttattactttcgatgtttattgcttaagttgatccgaatgctctttaagggcgatgttcaagatgaaaaatcaaaactaaaactaattaatatgctcaaatatattaaaaaaaaaattatttttgtgaaacttaacgaagctggtaagaaagacaagtgttaaatttaaaaaaatagtttattcttaacaaagattaaaaaatattttagtttatttaatgttaattttttattaattatatttcaatttttataattattctgaattgtcagtcagccgagttttcctcagctgattggtcctgacgcgacatattccgtttcagttatttgattacctaataaattagtcatttgctataatataatcaatcggtgcaaccattaaacattcactgattaccattcattaaatcattatcattattcacctctctcccctccagcagagacaggggaggggcggcccggcaatttttaatgcgacttgttaacagactttgtcaaaaaaatgacaaaatttgcattttttttaacaggttttcatctaaaatttgttagattttcggaaaaattttgcgaaatttttaaaacattttggtaaggtaatggagagggaccaacaagaaaaaatggaaaatttacagcaaaaaataatatttttacttaaaaatttcggggttgggggg

SEQ ID NO: 24298 - DNA, 1547 bp, Heterodera glycines
cctattaatctctttggtttttgaaaaagcattcatttattatacaatatttcttcaatcctgtgttgtcaaatggcttttccatatttagtcaatgtcccattaatagaagaggtatgttttgtacatatttattctcatctccatttaagctcactttccttttcaattcccccccctcccgcccccaaaattgcttaattgtccccatggatcacctattggtaaagcatcgttctctcccagccgaactcttcgacgaaatgtcccgtttcgttcccggccttttttgccgtaaaactttgagcaaaacaaactcaatattttaccttttgtttcgattcacaaaacgcgcaaaacggtggaaaatcgaagtacaataatttaaattataattttgaaagtaattgctctaattttttgccagtgggaaataaattgcagaattgttttaggtttatagaaattaaaagaaattttggccaccttaatattttttacttttttctgagccccatgagcttacaaattatcgctacgttgttgctaatgagagacgattcattatctctcttctgccaccgcatggccacgggtttaagccatttaaataaataaataatattcaattatttattattctatcctcggaattaaataattacataaaatttttgaaaattgattcagaaagcggccattcgcgagcacttcactgagggcgttttgaatgaacttgaaatgcgcttcaatgttggcctgactttccatccgttgccgcttcatattgtaagcataatgaattgattttgtgggtcaattcttatgataagcccactaaatttagcacaaattatccttaaacaagtttttatttaatttttatttttttgccttttgataatgtttttgtgggttaatttcttttaattaaatattttaaaatcaaacagcaatgggacgtttgtatggtcacctttttcgccactttggatgcctgggacgggttcatgagtgaagtcagcgacctgctaaatgaagtaagctaacgtatcaaacaaaattaaatgcaattttcaaatgcccataaaaacctataataaaaaagagctgttttgtttatttttatttaaaattaatccattgatttttttagtgattcattaaaacatattttcttgcacttttcaaattatagctttatgcgcctagtccaccgccgccggctgattccccttctgaaatggagtaagaatgatcgacagaaatgctcttcgtcttacctttttttggtgccattcgtcaagtgcctctcattcatccgcctctctttttgccacctttttcctccaattttctcgtccaaatctcatttggtccgacattttttctacagttatgtttgtgcattacgtccatctctcacatcatccataacctaacgaaaaacgctcacttttttttaacatatacatgtccaacaatatattccgtcaaagggtttaaaaaatgattttgcatataaaatttaaatttaaaaaaatttg

SEQ ID NO: 24299 - DNA, 1621 bp, Heterodera glycines
aatccaataatgccgaatccgatgttcccaaatccaatggtgcctaacccgatgagccctaatccatcaaatccaatggtgccgaatccgatgtttccaaatccatcaaatccaatggtgccgaacccgttcttcccaaatccgtcaaatccaatggtgccgaatccgatgttcccaaatccatcaaatccaataatgccgaatccgatgttcccaaatccaatggtgcctaacccgatgagccctaatccatcaaatccaatggtgccgaacccgatgtttccaaatccatcaaatccaatggtgccgaatccgatgttcccaaattcatcaaatccaatgatgccgaatccgatgttcccaaatccaatggtgccgaacccgatgagcccaaatccaatggtgccgaacccgatgagccctaatccgtcaaatccaatggtgccgaacccgatgatcccgaatccgtcaaatccaatggtgccgaatccgatattcccaaatccaatggtgccgaattcggtgttcctaaatccaatggtgccgaacccaatgattcagaatccgttaaatccaatggtgccgaacccgattctcccgaatccttcaaatccaatggtgccgaatccggtgttcacaaatccaatggtgccgaacccaatgattccgagtccatcaaatccagtggtgccgaacccgatgttcccaaatcaaatggtgccgaacccgatgatcccgaattcgatgtcgaacgcaatgcctccaaatcaatggatggtaccaaatcagatgatatcaatgatgccgaatccttttaccagtttaattcacttttgatgtgcgaatttatgttctaaattcctcatttggtaccaaataattaaaaacataaaattctttattttatttcaaattgatttttaaataaatctctaaaaacaaaataaaaaataccgaaactttttgcccaatgcccgttcacacatctccggataaggctcatggcaatgcttgtcacgataaattgttggccatcttcgcctcaaaagcacccaacatttgccaagcataattgatgttgacatggccatcaatgaaacatgaataatcaattaaagaagataaatagaagaaatgaattattttactgagacataataatttataatattttttagattcaaaaaataaaattcataattaaaaaactttgattttttgaaaatttttggttggcgaaatattcgaaaaattttcttgtaaatttctcaaacaaaacataaagtttctaattgaaattgtaaaaaacccttcaattacaataataattaaaaaattaacttcaacaatttttcattaaaacaacattaattatatttacaaaataattaatttaatttaaaatgaaatattcttacatgttaaagcaacattcattaaaaggcccggaccaatccctaaaaaattaattattattattattatatttttctgaattttatttttacctgatttgattattgctgttggtaaagccacaatgccagcaccagccatttgggcgacaatgaaaaatgccgccacaaagaagtttatgccgtgccgttttcgatgaatttca

SEQ ID NO: 24300 - DNA, 174 bp, Heterodera glycines
tagaaacggaaggccaggccatcgaccgcgtccatccgggcctgccaggccgccagccaggacgtcagggcggattcgatgaatgccgcctgatcgcgcgcctgcgccgtgatgtccgcggcgcggtcgcacgccttggtccaccacgacagcaacgccaggatgacggacagg

SEQ ID NO: 24301 - DNA, 1643 bp, Heterodera glycines
acaaaatcatcattcccacattttttgaaatttcgggattttgaaggataaatgtgacgagatccaatcccgtgaaaattgaatttttatttcctcatccatgaaaaactatacatatgtttaaattgggcatcattaaaacccacgctcactcgtcactatgcatcataatttggccgctggcagacagcgcaaagaatgaatggttgtagccccatccgttccatttcaactgggaatccctgaaaaaagttaaaattcagaaatgaggtccttgacttcaaggacgcccttaaacacaccgagtcaatttttggcactcagttcaaaattgcatgtgccccacaaaccctcaagtttcatgtttttatcccaaaataacaaaggagaatatgggaccccccattcttcacgattgccgaatttacaaaattttctgggttttgaattgggccgcagggtccaaacaattgccacctccccccccccccctcctcttgttgctaattcgaataaaacagcacagatgaacgcagccaagcaacaacagcagttgaccgccagtgggagcagcagcaccagttgtgcgtgacaattccgtaccgcgaccgatggacggaattgcaggtgcaattattgttgcataaaatgtcgagtcaatttggtttcctcacaccgaaaaaaatgctaaatgtggaggggggtagagaaaggcaaaacaacttatttattagtttattcgggcgaacaaccttcacgttgttatttaattattaacaatgtttcattttgccaacaacgtataaaacaacttatttttaaaatttcggtcaatttttgaaaatttatttcagcgggaaatatcagttgggagagagataacgcaaaatgagagagctaaaaaaattcagtactgctcatacaaaagcatttttgatgaaaaaacagagaaaaaattttaatagtaccagtgccctatgggcactgaaagtactgattttaattttttttttttttttaaattgaaatagcttcgctatttaacactgtctctagagggcgctacgcgccaaaaactttcaatatgaccttatattaaaattgtttcctcttccccttcatctttttcccttctattcccatttctatattgtctcctcttcctttctgtttctctttctcttccactttatcttccactttctctttctgttcctcttccactttctgttcctattccactttatcttccactttctctttctgttcctcttccactttctgttcctattccactttctcttccactttctgttcctcttccactttatctttctgttcctcttccactttctgttcctcttccactttctgttcctcttccactttatctttctgttcctcttccactttctctttctgttcctcttccactttctgttcctcttccactttctgttcctattccactttctcttccactttctgttcctcttccactttatctttctgttcctcttccactttctctttctgttcctcttccactttctgttcctcttccactttctgttcctattccactttctcttccactttctgttcctcttccactttatctttctgttcctcttccactttct

SEQ ID NO: 24302 - DNA, 2439 bp, Heterodera glycines
atcagatggagtttgattcggtaaaaggcattttaacatttcgtaatcattaggattacatgtgaaagtaataaacaaatcaggtttgcctgtttcgttaactatagctaaagcatccataaaattttcatgcatactccttggtcctcctgtaaaagtagacggtagaattaccttttttttaatttctgcgcctgttttagaagctctattcttaagaaaatcttcaacatttaaataattactgctacacaattccatctgatgcgtccttatatattctaagcgatcccattcaattttagctgcttgatccaccagccattgttgaaagagtttttttgcgtaaaaatgagggaaaaaaataccattttctcgaaaaaataataaaaatttggtatagtcacacaaagaaattttttttccatttaaatctttgatatttacattaaatccttcgctactcattggatataataaaggataacacatttggtctacacatttgtctaacggataaatattttttaattgtttttcacctttcgggtaaaccactattcttgcaggcggaatttcatcattggcatcacaaactacaattgctccaacttcattacaccttggaatattgtaccgccttttatcacaattttcttttagactgaaaactaaatttatatttggcatttttaacccattttctttacagttattttcttctctttcataaacctctttcatcattaaaaaggattgtgcaaaagggttcaattttcttaataaattttcaagaaactcaattatatctgagcggcattctttattattttcagaacgaatatctatagcttcttcagaatctataaaatataactgtccgtttgtaggaatttcattatcttttggcatagcgttttgattaaatttgtggtatatttgtccttgtattttatagcatggagggccaggactttgaaatttaaaccgaaagcaactaattgaagcacaggcgaacatactattataacgacgtatatttgtaataaaattactataaaaaggattttcctcaaaaaataatgctttcatttcttccggatatttcgaaacacattctaaaagatttaaaagcctaccacctttacaacaactaaaaaaaatgcaatccttaactacagatttttcctcaggaaactgcaaactgtcacatttcgtacatttaaaattaaaatcaccgaggagataaagattagcttttttagggtctgcggcagcaagataatataaaccatcaaaattcctttcgcgttttcttgaaaaaacatgcgaaactgaatttgatattttctcgttttcaatttcttctaaaaacatctcactccgttttgacgccattcgaaccttactcatttctctttccaatttcatttcttcaacagtcatttggtttcgttttgctgtcattttttctttattcaaaattctttcaaattctatctcttcaacagtcatttggtttcgttttgttgtcattctttctttgttcaaacttctttctaattctatctcttcaacggtcatttggtttcgttttgttgccattctttggcgatttaaatgtctttctaattctgttttttcaacagttctttcatttctttctttattttttcgcattgctgattgtgaagttgattgtcggaaaaaatcatcatcaacttcatccaaacataataaattggttggcattctttcaaccgttttttttgggagctttgaacccggcaaatgattttttctgatgggttcattgaacccaatatttaataccggacgaacatcggaaaaggttggtggtgttgaagagggagtctgaacatcaacagaaaatatttgtttttttcgaaccatctgaaaagtaattataaatcatttcaattaaaaaaatgttcctggtgaagataaacgaaggaaaattgtgctcttattcttgaaaaattatttttaacataaaacccaatttttcaaaaaaagaattgaaaaaaacaatttaaaaaataaaaagaaacatttcttggtatataggactacaacaaaaattgaaaattagaaatcaacagcttttgtttaaataacaaatttatataaaactcaatttttggttaagtaattgagaaaaaaataatgataaaaatttgtttttttaaagggttttaaaactttgataaagcaatttagaaataagtaagtatgtctgaatgcgacattaaaaaatatattacgtatttcatcaactaaatattttttgttgtttacatgaaaggatgaggaaagaaagaaaagacaatgttttcgtgtcgaaaaatatttcaaaaatccatgaaaaaagtgtgacacacacacacacgaacggacagaccaaattagtatagttaa

SEQ ID NO: 24303 - DNA, 1461 bp, Heterodera glycines
ataagcaaattaaaacttttcaaaacattagctaaccaagcagacttttttgtctaaataaaatttcttttagcgccagtcgaattcctctttgacagtgttagagaaagtaaatgatgtgatcaaagcggagacaatggttcgcatttatctaataaaaatttatgaggccagtaaccaaaaaaagaatttcatgtgggacaacagctccttgccccctggttatgggcctgaaatttattgaagaattcccattggccgtcaaaaatgcatatttttattttttttagacgggtacaattttggcgctcggacgacatttggtccagtttggcaaggtgtctaagtccgtttttgacactttcgacactctgaccgagtcaacggatgaggaattttcgaagcaaattaaaatgatgcgaaagctctgttccgatcttgttgaagggtggaccaggctcaaggtttggcgctcagccacaaaaaattgccatcaaaggctaatgtttggtctgtcagagatggtccaatttaggactaaatttggaactcaaaggggaaaggggcgcccagaaagggggacaattgagcgacagtttagctttttaagtaatttctttcctaattacctttgaatcaagcaataatcgaaactatatattttttattaactctgaaaaaattcctaaggatcaaaaaaagtgacttgaaagccaggtttctaaaaattgccggtcccgatttagactttttcatatgtctggtcacaatcgctaccccacagtttcttagctaaaatttaatttagtataaaaactcaaaatttgtcgtccaaacaaacgtggtaccatctctaaatgacaagtcgtcattttctattctgaaacttttaaaataaacaattttcaatgacgaaaatataggtgttgagaaaaacaatacgctcacaattggatttgcctttaaaaagttttcccgacctaggtcaacgttgcaaaggatgcctcggtcaagcaggcattttgtttttttgctggacgtctgaaaaaactcgaactccatgccgtggccgaattggaaaaacttgccatggaactgaatgatgagtcgaaatcggctgcagagtcactgcgagagagcttttttgtgctgagcaccgcgttcaacaacgcattggccaaggcatgggacctgtgggaaatggttgggcaatgactgactatcaatgggaccacagatccgggatatgatgaaagttttgaaattttggaaaaaggaaaaaataatgaaaatacatttgagttctctaaagcttaattgcatattacagtttgctgttcccagccgtgagatgagcccagttctggtatggataagtttacagggtcaaaatttgctcaaaatcatgtcccgacatttgcgcctttgtccaaaaccgggttcaaaattaagttttttcaa

SEQ ID NO: 24304 - DNA, 2387 bp, Heterodera glycines
  misc_feature (272)..(272): n is a, c, g, or t
  misc_feature (2353)..(2353): n is a, c, g, or t
  misc_feature (2373)..(2373): n is a, c, g, or t
aaaaaattttgcttaaaaaatcattttttttttttggagttttttttttaaccattttttttaaaaatccattaaggtacatattatagctccaaaaccacaaaacaaagaaattgtaagttttttctctcccataaattgaatttttcactgccgtattggtgcgccggtggcccctatcatggctcggcgatttttttaattctttttgtgaagggattttgggggttcggtggtgccgttagcgtcgccggggaaaattttgaaaattngaacgtactgaataggttttcaccaaaaagtgacaaaattttcgattttgatcatgtctttaagaaaaaatttggggttttaggcgtcgccgggtgaaaggaattttgggggttcggtggtgccgttagcgtcgccggggaaaattttgaaaatttgaacgtactgaataggttttcaccaaaaagtgacaaaattttcgattttgatcatgtctttaagaaaaaatttggggttttaggcgtcgccgggtgaaaaaagtgcaaatcaaattttattaaatttaaaaagttaccaaaaatgtgttaaatttaagtttatcaaaagccaatcattagggaagtaaaaaaatctcttttcggtctcgagtctcgaaaatcgagaccgagactgaaaataccgagagcgagaccgagaccaaaaaaaacccgagacttttctagagccgagaccgagactctcgagcatcagccccggcttttaccatttacgggattttaaaaatactttcattcatgctcaatggatttaaatttcaaccgatccttgttttgtaataaatttataaatttcgttgatggtaagcaaaagttttcccgttccaaatcacatttatcacatttactttctgatcaattcaagattcaaattctcagtctctccgggtttaagcctaagccaaggcctagcctaaagcttctaagcaattgtacgagttgtctgtgtacaagttgtcacgacacccgaaagaaactgttaaattaaaaaaaatttaatagtttattttgaaccaagataaatattttagtttatttgtttcattatttttcaatttttatagtttttgtaaattctcgtaaagctgagttgtcctcagctgactgatcctgtcgcgtccatattattttctaggcttttatttttagcgcctaaaaaacctaaaaatttttgaaagagcctatttttgcctattttggcgttttgcccaaaatttgttaataaaaatgcaataaaaacgaaaaatacacccctaagaagcgattttttgaaaattttcaaaaatatagcctaagaatcgactcaaaaatttgtagaattttttacttttttgaataaatttttgttattttacacccctaaatttgaggatttttagtgcctattttccatttttaatgcctattttggggttttttagagcctaaggcctacctattttggcggtttttagtgcctataaatgtaatccctagtaataaaatatgattccgatatttaatttgattaaaattaggtaattgtaatttatattaaatcagaaacctaggagacggttcacgacttttttatttttgcagtgttatgtatcagggatggcacggaattccgacttccgaagttccgacatttttggggtcggaattccgacttccgaaaatttttggggcctcggaactccatccctggtgccgataggcgacgctggaaaaattttgcaatttcgtttggcttgttaacagattttcaccaaaatccgagctaaataatgaattaaataattaattaatttttaaacctaaaattttttatcatgaaaaaaaaaaaattaaattttggtgattaatttttgataaaattttaaattcttaggggtgcattttctaaaatttttcggtagtcatttcttaggagtgtattatcccgattttattgcatggaatttttcggaaaaaacgcaaaaaaggcacgaaaatcccaaaattcaaaaaaagcataataaaagtcaacgtataagcttaaaaccaagttgaaaatgtgctttttatgctcaatatatcggaattaatgcgaagaataaaggcatataaaatcacctaaatttcaaaaaatttggtcaagattgagcaaagttatggccaaaagtacccaagggaccggcttttcaaacatttttggccatattttttttgaaacctaacgaaattttttgaaattttgcaggctaatagaagacacgtagggctatcgaaagatagcaagatcactttattttgttcgttttgtaagaatgttttgatcaaantaatttttgaagatcaaaantaatttaattttta

SEQ ID NO: 24305 - DNA, 2142 bp, Heterodera glycines
ctagcggcaggagacaaaaataaaagccagtttttatacactcaaacttttttcagtgtgtgtcgaaaatgtaatgcggttcattttgtgaagaacaatctaaaacagttaaatcaaacaccttctttaattgttgtaaagatggacgtttaagtccattgcaaaattttattgaggaatatcctgaagaattaaaaaatttatttttacaagggaatcctaaaaacaaaattttttaaaaaaatattcggcaatataataatgcgttgcattggcttcgcttagttgttttcgtttttcatttccgactcctggtccgccttgctttaaaattcagggacaaatataccataaattcaactcaaatgcaatgccgtctaatgaaaatgagatgccaactaatggccaattatattttgttggcactgaggaagcaaatgaaaatcgttataaatttaacaatgaacttggtggctggacatttcgacaatgactgtttcgccaatgaccgtttcgacaataccttttcgacaatgccgtttcgacaatgaccatttacgactatatcatatcgccaaaatttaaaatatcaaattaaatataataaaatgaatataaaaaataataaataaatttaaaaaaatatcaatgaaatttaaagagaaaaaggtagttatattttttaaatttaatgaatgcattatctatcgcctattgtgtatgattattaatagtgaaaaaagaagacaaaatgagacggacctataatataaatccaaaatgaaaccatttatttaaattattgtagtgtcctctttttacccaggcggcaatcctgaagaatggttgtccctaatttttaattttttttaaattttgtgctcaaaaccagtttttaggcgtttttgagggtgctgataacggatcttaactcgggtttgcccaattccgaactccggacccgaattcgaacaaaaaaaattgagtttttttaatcaagaataattttttcagggtaaaagcttctaattcattatcaactatttaggtgtaaaacaatgtttcaatttttaattaaataaaaaataagcaatttgcgccgaaaattgacaaactaaagccattctcataatgttattttgaaaaaaaacgaaaaaaaaacttttttatattgatcccaaatccgcaccgtccatataattttgcagaaatttgaattttatttaaaaaaatatatttaattttattgtcgaaacggcattgtcgaaaaggtattgtcgaaacggtcattggcgaaacggtcattgtcgaaatgtccgggagcctttaaaaatggctaatatggtattaaaaatcattttaaagaagaaaataataaaactaatttactaatttttagcgaaaaatcaacccaaaaacaaattttattaaaaatttaaataaaaatttaaataaatcaacattcacgagaaagttttttaaaaaatgatttttttcgggaatttttccggtcttttctctttctatttcctcttttctttcagttcctctttctctccacctctctcttctctctccccccttctctctctcccttctctctctctcccttctctctctctcccttctctctctctatctcctctctctctccctgctctttctcttctctctctccctcatctcactcttctctctctcccttctctcactctctaccctttttctctcccatctctcgctccccctctctttttttcgcttgccccactcactttcctttactctctcgctcactttcaattttttctttttcatacactccctctttctttcaccctctctcgcccttctctctctctctcccttgtctctgtttctcttatcactctgtctctcttctcgctctctctctctccctcctctaactcccttctctctatctcgagtctatctcgtctctctcttctctcggtctctcttcgctctatctcaccttctctcactttcttcatctctatctcctttctcgcatgtctctccccctctgactgtctctctctatctccgttctatatctctcgttttcttctcaatgtgcattctctctcctcccctctctctctctatgtctcatcccct

SEQ ID NO: 24306 - DNA, 951 bp, Heterodera glycines
agatatgcacgccataaccctcgaaacgaaagccgaggacagagggaggagacggcgtactgagattagcgaagggaaagggagagactgatcgtagcggagggagggactgattggcgcttgttttgtttttttgaactgttaaagttatgggagttttaaattctttcgcatcgtcagtacttgtcccattgtttgtatgtaacaaaagtctaaaaaccaaaaatttatttatttatgtaattcaaatacaagcgtaagcccaaaagaatgccaaattagaagtaataattagagtagagcgggaccgggaattttgggcaaaaccgggaccgggacttgccgggacctgagaagccgggaccgggacctcgatttttcttcgggaccgggaaccgggaccaaccgggaatttttaaaaattcaaaaaaattcaaaaaatttaaaaaattaaaaaaaaaatcaaattttaatttatttcaagtgaaaatattaaataattaaatttttatttagttttttatttaataaaacccaaaagttaaagctaataaattaatgaaaattttcaaatcaaattttcttcatttctttcaaacaattaatcattcggatgtccggccccacaaacggtgtaaaggccctgaagggtggaggatttgtggaaatcgaagaacagaaaacctggacaaagtccaatgatggggcgccattagccaccgaatttggcattggatgcggtttccaccgcatttgatttggattgggggcaaattgagagaaatcattcgtgaagctttaaagcgtcgaacaaaagtggagggaacggcatgactcaccgtccgttgccctccaaacggcggaaaggcctgtggaggacggacggccggacgcggtacagccaactgaaccggttggagcagcgcggagcggtgaacgcagtgccggaga

SEQ ID NO: 24307 - DNA, 1459 bp, Heterodera glycines
gagacatcacgagactctcgagcatccatcatgttcaagtctgtgaagcaccgatagggaaaataaatacttttaaaaatgtttaaactatatatttcatgagacgggtcaacattgggactcggcattagagctcggcggcatggggacggcgcacgattttgctggggtccatgcccgaaatgtcgtgtttttttttggaaattgctggattgccggattttgtggattagttcagcgggatcatgtttcgcataaaatgttagtgccagtccagggctgggaccgcaacgcgatgtgcgatctgcgattcgcggcactttttttctgcgcgatccgcggaatttgggactccgcggcaattttggaccaatttaaaaaaaaattattcatcgaagcgattgttttttattttaatattatttaaaaaagtattttttttatgtaaaaagtaagataattttgaaattttatgtcagaatatcactattttgcgaagaaaatataagatttttcgaaaaacgtgccgcaaaaaaaagcatttttaaaggcgaaatagtcatcgcttggcttttatttgcgaattggcctttttggtgaaaatctttcaacaaaacagaacgaaattacaaaaaaaattttccggcggcgcctatcgccaccgcccgaccctctccccctagcccatttcccaaaactttttggaaacatgcgccgtaaaaaattgttaaaaatctgattttctgatcccaaatgcgctgaaagttacgaattgcttatttcttcctcccccccaaaaaaatttaaatggtttaaaaattggaaaaaaattttaataatgcgcgatccgcggtccgcggcaatttgaatgcgcgatgcgcggccggccgcggttttttttgcgcgatccgcggtcgcggcaatttgaatgcgcgatgcgcggccgcggtttttttctgtgtgcgtcccacccctggcgcgaacgccatgtgtaagggtcgggggatctttataatgagatatcttctttcaaatgattaatttttattctcttgacttcgtattttcctgagggatttttccaagaatagaagattttgcttaatttttaatcataaattattatatcttataatgtgtcggaattagacgatctactaaataaattaatagtaacccaatgatattcatttatatattttaagttaaattactttggaattatttattaaatgctttaaaatcattaaaaaaatctatgaattaaaaattgatccatgtgtaaataaccaagaattgcagaatgagagagaattattgaaatattcttctcaacacgattaaattataaatacattattaaattctggacttttcatactggaaaattcaaaccaactaattcatatgcactaaatcaaattgggaaaaaatagatgacattacaaattttttaaat

SEQ ID NO: 24308 - DNA, 1888 bp, Heterodera glycines
  misc_feature (15)..(16): n is a, c, g, or t
  misc_feature (80)..(80): n is a, c, g, or t
acgtcgaaaattttnntatttgacgatggggcgggacttatatggcctaggtgaattaaattaaaattgaatatgttatntaattccataagctaatataaatatattttaaactttgcatttttaatgaatttttatatttcaaaataggaatcccccggccttttctatttgccttcacctcgtcaatctattatcctctgtatatttctcatattggtctaattgttcaaactgttcgaatgtattggaatttttaatgtttttacatcttgatttgaaatagaaatatcgtctgttgttattttaggtcctaatttagacttttaaattaggatttttaaaaattcttattagattagaagattttataaattttcataaccacttacttgattcctaataattatgggtatgttatgaatatcgtaacagtccatatttgaatttatttttttatttgttattcaaatatgttgttgtttcttctttaatttttttacatttattatgccaattatttactatttaattccaataatactttttctttactgctttcaattggaaattgttttttttttgtttacaactcgatagccctaagaagtctcaatttacctttaataagttaaaattcacgaatcagaatattataaaatcaaatttttaattatcataataaactcagaagcaacaacctcaaattgatttaagtttaaagacctgaatatgaaaaagctaaatcagtgttggctgttacgttttgggatatggatatacgatagtagcccgcaagttaaatgaaaaataaaaaatttattaaatatctctaaaattctgatgaaatgaaaattgtaaaaaagcatttacaaaaccattttaaaaattatatgtttaattaaaagtcgattgatacaaatatatttaaagctaatttaattagacatcattaaaaatataagtaaagaatataattattttaataacatataaatatacaacatgcactaacaattaaaattttaatcgattaataaaagttgtatttaaaacttggttaattcattattttttatttgttatttaaaattaaactgatcaattcaatcttttttaattatttatacaatatatttttttttgttttaaccagcgtgggagtaaactcgtttatttattattcaagataatagtaaacgtacagaaaagatttcaactccacagttcgctcctgcgtcatcaggaagatatgtgtcactgttaaatcgaatcgcaaacaattatgtatattgaataaaaaatatgaaatagatataaattaaaattgaaaagaaatattttaataaaataatttaacaattttgagttatcttaattacattcaatgcacaaaataataaataatcaattcttaaacaaaataaattgaccaacctaagataacgcagaaccaaagtcttgcacatgatgatgaaatggataaaaagaacataattttcacaaaataaaaaatattaatcttatttttttaatatgcaatgaaaagattaaaaagaattgcttgtatttaaaatttgcagattcaaacaaactatttcgaaataaatctattttgaatgtgattccgacagaaaaaacgaacataaaatgtgacatggaaatcagtgctttaaattattgaaatgtttgtttcagctaatatttttataataaattattgtttctaattgttaagatgataacggaaaaattcaatgttaattgcatttggaaagttatccaacagtgttaaaaaatatgaaaagaatgtacatatattaaaaaatcatatttattttaattaattacatcaatatgaatttatatactaaaatatattgataat

SEQ ID NO: 24309 - DNA, 1489 bp, Heterodera glycines
  misc_feature (1404)..(1404): n is a, c, g, or t
  misc_feature (1409)..(1409): n is a, c, g, or t
tttccaagaagggtgcatttgtttccgtcgtggtacttcgcttcaacattgcatggactcagcttcggttttccgatcccttcatgagtctcttcattgatcactacaacctcagcacctgagtccagcgcgaattccacagaattgccattcattttaatagggcattcaatcagccgtttcggttggttcaccgaattgatcagcacacctccaagcttgaggttgccttgcttacggctttgcattttcccttgccttgtcagccacgtttggtgttggttgcactgcgcttccaaatgtcatttaagaaattgtattaaatgattaaaaatatctaaaaattgccacatagtaattttaacctcaaagtgtgtgtgcttctcttccgtcagcaactaataatagttaaaataataatttcgaataaaaataatttactttacattgaattgttacgctatatttaaaatatcaccaaggcttaattttttatttcatttatgcaacgagaatataattttttatattatgattggtttaataattattagaaaataaacattctatgatataatgataagccattgacatttttagacattttttactttgcagggactttttaaaaagtaaagtgataatttaaagaacataatgtaacaatatagctataatatggtgaatagaaaatcaatgaacttaaaaagttttttattttaccaatatttgctaaaattgtaaaaattaaattttcaaatctgaaaaatcaaagcctttattgacaactttgtccaagcccgtgcacgttataattaaaaaggatatatatctgtcacatgctcggtatgtgggcgacagggacaccgaagaggtgccaagatttggtctcataataaagcattttaaaataaattagcgaataaaaaattaaaataattttaaaatcataacaaagaacaaatgtaataactattcaaatataaaaaaggtaattcaagataaaagtggaccaaatatggatatattatacaacatattaccaaaacgtctttttatactctgaatttgcgaattgcgaaattatatacgaagtaaatttaaatagtaaacattaaaaattaaatataactagtcaaaaagataaaacaaatgagcagacgagacaaagatgtataaacaaattttttaaattatatacatctaaattacatagaaaaatcaaaattttaaaaataataaattctttgttaaataaaaaaattatgttcatcaatttaaattttgatgattaagaacatagagtggccgaaaaatcatgtgataattaatcaaaaataactattatatataattttaaattaattgcattagtcactgaaaataaaatacatacaattttanaatanattcagcgaggaagtgcatgtgaaataaaaagaaagtcgtttttcaagatgaaaaaaaataaaaataacccaaaaacata

SEQ ID NO: 24310 - DNA, 1514 bp, Heterodera glycines
tttggcatcctttctctcgctatttgccacgcattttttgtcattatggctaacttattttatgaaatatatgctaggaacctgatcagactacggcagggtttccgggacctgttaattttgagaacgaataaatgaattttcgcttatccaaaaatcacaccagaaaacatttggaaatgaaaaccggtttcatacccgaaggtttgtaacgctaattttcgaatttggatttttaataaaaatgaacaaatatctaaaaaatattttgtttaaggcaaaatgaatattattcagagattttctctgcagtttgtttggctttttgtgagttttttttaaacgaagaaaagcaattttgaatattttttatttttgcaataggttgctgtgatttttacggaatttatgctttaaattttgaatgtgtgtttagtttcttttatggcactactgctggcaaggggaatgctcgctttcaaaagcaatttgctattgcgcaggagaaaatccatgcacgtcaaacagcgataattccacgtatataaattgtaatgccaatgattcaaatagagggtgggcttttccatgctttacgtctgaatgtcacagtttggccagcatctgtaggctaattcattcactagcgaaatcagtagaatacccattgattcagcccccggctttattattgcaaaattttatacagaaacaatcagttagtttatcattaatagagcccggaattttgaaatggccgtgaccgggacttggaaaatggaccgggacgggatcccgggaccgggactcccggtcccggtttgtccaaaaaaacgggaccgggagttccggcaaaattccggcgggatcctggttccgtccgggctctactcattatggtgccgggtcgttactcaaaaaaaacttggtttttcggacatttttggctataacttttttaaatattacgaatttttttgaaattttacaggcgaatatagaacatttaaggctatttattgatacaaaagattaaaaacattgttgtttttaaccaaagtcataagcaaaatttttattgatggctttttcaaaaacgccaattttgatggtttttaaggaacgtcataacaccttcattatgggcagattgtgatatttttatcattgtctttattcggtggtcggaatggtcgaagtttcagtggtgccgcaatttcttccacagcttacctaaattttaaaaaaatatttgaatttatttttattttaaatttcaatttccaccttttccacttggatcactcggttggggtagccgtcgacgccggttttactccaaactctttgcccataagaattccacgcgcattgcaaattgaccgttattttgttgaacggtggctgagttgaggtgacaattgttttttcttcgtcattgagcttaagtttaaaaaatatattgtacaaaattctctaagattgctttctaaaaaaagttctaatatattttt

SEQ ID NO: 24311 - DNA, 1558 bp, Heterodera glycines
aaaacaaaggcatttgtgtcccattgcgggatgaccctttttggagagcgttttccacggagtgccaatcgtttgcgtgccgttcatcatggaccaatattacaacgcggaattgatggcatttgggcacattgggctggcagttgacagggaaaatgaccagcaaacagtgcaaaatgaactgatcagcgcattgtcagaggcattgggacggcggcagcggaaaaagtgacaaaaattgaaaataaaaaatgccttttaaaggacaattagcaatgattcggccacgcacttcgatttggccaaattcaaagccgtaagcgcggcatttcgccaaaagaatgtggcaaaaacaatcgctgacgcaatgaaagaaattgaaaaagaaattgggaagcagaaaaaataagattgaaattaacatgaaaaatgaatagaattgaatttatgtattgtagaaaaatatctcattctttgcccttcttattgttagttacgctaatcccccagcagaattgtcatttttgattcaaagataaagccagggctcccaactcaattttaaaaaatcagcatttgaccgacaaaaaatctgcattttggaaaattttatttcaaatgaaaataataaaagatgttttttgccggttcggtggcgccgataggagcggccgaagaatatttggaatttctttaccatctttaacagattttcactgaaaattggcaatttttaaggtcaaattttgaaaattttaggggaaatgttgggagccctgaactgaagtcattaaaattaaaaaataaaagttgttttaaaattaaattttaatttattctttcaatttcagattttatgcacaattttcgtgaattaattttcaccaagaaattttacaatagtgaaaaacttgtgctcagaccgccccaaattgacgcattttgggtgcattttacgcgtcattataaggggagggacaaaccggtgcaattgtccactgattacctgaccattttgcatctttcaaaggatgtaattaaaataattttgaattattaaaaaaagatggaattttctttatgacagatcgaagcaaattcaacaaaaggatacaatgacaaattgctaacacaatttgatggacaattgggcaacggaagtgcttttctgaacgactcgaagataataaaggtacagaaatgataaccaaaaacccaaactgaatggaaaattatgaatacaatataaaaatttttaactcgaattatttaaaattacccaattaaaatgtataaaataccaaaaaattatttaatcatgtattcaaagtgactggaaaaaacaattttgagatagttagttccttgtatatcaatatactttattatacaaataaaacataaaaaatatatgtattcaaagaaaagaaatctcttttttattatcgaattcaaatggctctttcaattcggcctcactgtggcccaactcatttggagaagggcaaagtgccgttccggatgaaccatggtcggcataatttggccactgatcagg

SEQ ID NO: 24312 - DNA, 1469 bp, Heterodera glycines
ttttaaaaattcaaaaaaattttaaaaattaaaaaaaaaaattcaaattttaatttatatcaagtgaaaataatacaaaattatttggttttttatttaataaattaaattaatgaaaattttcaattatttcaaacaattaatcatttttggactaaatcatcgaatattaatagaaattcagatttgattttcacatcactttttttcggagcgctttttcaaaaaacttttgggaaagaaggggtccggcggtgccgataggcgccgccgggggaaattttaaaaatttgggtgcaatttgttaacagattttcaacaaaaaaaggttggtttttgcgattattaagctcaatcttacatttggcataagaagaattgtgaattttgtcaaaataaaaccaagtagagtctttttcgttggtcatttggtctaaattacaaagaggaaaattgtctataaaatgaacgatgaatgtataaatattttctgattgcatattccatttaaatgcgcgagaaaattggaattttggtcgttttcaaaattttataccttcaaatctaaatattcaaaaaagaaaatcgcttcaataaattttctttataaaaattttgccctaaaaaatgcgcggcgcgccgcgcacagaaaaatcccgcggtcgcggatcgcgcatcgcggattcaaattgccgcggtcgcggatcgcgcaaaaaaaacgccgcgaatcgcggatcgcgcatcgcggatcgcggtcgcgtcccagccctctctccacctaaccaactttcatttggaaatcccacggtcacacggtcatctggggaccttcctttgtaagagtcgtattttccgatcctgaatgaaaattaggtatctcgaaaagttttgatttttcgaaaaaggtttaatattaccgatttcggtatgcgagtaaaatctaggggaaaagggattaggtaggtataaatgtttgacaaaactttgtcacaaattgcaaattgctgttgtgttgttttcattggataacgtttttatttgttccactattgtgttttaaccacattcccacccctcctagcattaaacctcaacgaacaaaatgtctgaagcgaatcttcagcagcaaacgcacggcccaattgctggcactgactacgattcggcagatgaatatgtggtgattgaacaggaggaagaaaccgacttggaaaagaactcaactttgccggagacggtggctacgaacactaattcgactcccagtgacgtgcaaagtgtggcagcatcagtcggcacttttggacgcggtcgctgacattggcaatggcctcgacggagcaaaactcagtggtttcgtctgttttcccacagaatgcaatgagcggctcgaactattcgcaaaatggcttcaatcttccatttttggatccttcgggtgcttatgactttctcttctttttacttat

SEQ ID NO: 24313 - DNA, 1041 bp, Heterodera glycines
aaaaaaatcatggagcgtcttgctgacaagccattttctatatcaatcgatgcatcaaattttgggaatgaaaaactttttccccttgttgtacggttttttacaaaagataatggtattgaaacccgtgtgattgacttgaagtcacttccgggcgaaacgtcatttgaagtgggatcaattttttgcatttttaattgcaataaaaggtgcaccaatggatcaagaaaataatggcaaaatacgatttgaatgtatcaaatttgacggcactttcggcggacaacacaaaagccaatttcggtggagaagagcgcgcaggagagaacaatgtatttttccgtctaagacaacaaaatgaacgattgattggtgtgggatgtgtgtgccatgttttgcacaatgcggcaaaaaaaggcaacggacaatttgagaattgaaggaagagcaatggacattgaggcagtgatttttaaaatggccgggaattttaaaaattcaaccaacgaattgaggagctgaaaggattttgtgaggaattggaggtgcggaattaaggaatgaaaaattctaagctgttaatttaggttgaatttgaacgcttaaatcgtcatgggccgaaaagatagacatcaatgcacagtgtgttgggtaaaattattcggatggaatctgtcttaatcgcctacttttcaaaacctgacaaatgtccggcacttctttacgacttttttccgttttttctgaacaatcgtttgcgatcattcattttttacaccacgtgctaggcctatttaacaagacaattgactcttttcaggttgttttagtaatttaaatgaaacttctgtttaaatttagaaagaaaaagccattttgcccaaacttttgcttaaaatggacaaatttagagcaaaaattgagcaacgaaaacaagaacggttttatggtgccggtttggcaatggacaaagtcggggagagcacacgcgaagcgttggaggaacaatttcaagtaaaaattgtcggttgcttattttaa

SEQ ID NO: 24314 - DNA, 1487 bp, Heterodera glycines
agagcctcatatcgtatccataaaaaaataatatattaaattaaataactttggaatttccaaaatggattaaaataatttgaaagaaataattcgtaattaaaataacagtaacactcattgaattaaaaaagcattttttgtgccgtgccgccttttggtacacgaattcttttttttttgtatatctactattcatagatcagcgatggcacctatacatatttagttttgaacaacaatcccattaagctcgactggagtttgtggttcactgaccgattcgcggatgagccgcgcggtcactgggaatgccgccacgggtaaccacgggctgtccggcgccaagtcgggctcccccgccggtactcccaggctgaaattgttcggcgtaaacacagtcggtgccgggtcgaccgcgcgtttgatggccaacagtcggtcgtattgcgctttggtgtggtattggtgccacacattgcccattcgtcggtcgccgtacgactccagcagcaatttcggagcattttcgggtgccaaatcactaaagtgccctccgcttgggccaaaagcgcctttcatcgtctcgtcctgccaaccgagcaccgtctgatgcgccttcggattcgccgtcgtgttgaaaaaagcgtcaaaggtgccggcaatggtcatgtcacgccagctgaacgccgtcaaattgcgcccgtcgcggtccgtgcgcagtccgttacggtagaaagcggacgcggggccaccagaattctgcagttgtgagaccatatcaaaactggcccactggttttgctgctggtcctgttgaaaaagcctaatttggggaaagccgaaattgtctttttatataaacacaatgatgatagattatttcgaaagttttctttcattaaatactacacttaaaaattacattttttaaaatgtttatttttaattttatatattgttcatcattagggcgaggatttttagtggcaaaaaaccccaaaataattaagtaaatagttacaaaaaaatggcaaaatagtggcaaaaatagtggcgaaaaagttctaaatttaggggtgtaattttttaaatagctattttttaatttgaaaataatttaaaattaaggcaaacaattttattcactgattgcgttacaaaacattttcttagcaaatattgaacaagaaaaaaaaattggggaagaatttttgagaaaattttccaattcttaggggtgtaattttgaaaatttttagttcgattcttaggggtgtattttttgaattttttaggtcgattcttggggtatatttttcatttttattacattttttgggaaattttccaaaaaatgccaaaatagtggcaaaaatagtgaagaagcgccaaaatagtggcaaaaaactattttagtggccaacttccgaaatagttttttttagtggcaaagctccaaaaatagtgattgctagtgatgaata

SEQ ID NO: 24315 - DNA, 898 bp, Heterodera glycines
cgtcctgctgactcatactgtttgtgtcaatgttcgctttgttgagcgagtccttaccgacctagaattgctatactattaatggtgttcccaaaatatccaacggcaatattcggatcgaggcttaaagcccgacaaaagagaatccccgcgcaaacctttcaggtaccgtctgtcgcttcaccttcacacaccatgtattcggttccacaaacgtccgtcactttgacacctccatccgacataacagtgattgtgatctgaggttgcttctcatcgcttgacgtgttcattaagccttgcccatcggttgattgatgctgctccactccgtccccatcgtccatttcggttgaaaactccatttccgtcaaataaaaacgattttgagaatttttgtggtgatacctaagggcatacccgaatgaaatattgttgaaaaaaacataacaaataacgatttggcaagggcccaccaactcaaacatggaaatttcaaactgcagctgttccaggtctaatcaaatacatgaagaatccaagtaaaagatcaaacaatgcgattggaatacagaaagaacaaacaaacagcggtttataatattctcttcagcaattaatatgtaaaagtcagacgccgtaattgaccatcaaaatcatcctttcattggtcacggtcacgttcactgagtggcacatcgcaccgcttgcggttctccgttgcttgcctcttcgtcgtgcgctcgccggcgtaacatttcttcagagatgggcaccaatttgatagcgttctgcgcgttcgctccgattgtttccggctcaggctcaatctcgtgatctttcagcaattctcgcagcaagtccatgtttttcatttgaagagggaagttgtctggga

SEQ ID NO: 24316 - DNA, 1285 bp, Heterodera glycines
  misc_feature (1163)..(1163): n is a, c, g, or t
gaaattacaattcgatgaatcagaaaaaggtagggatatccaattcatcgcagtttggagatcatcccttcttttagcacttctttccattgtcaagcgcaatgttgaccgtcttcatcaattatgcaatgaatggataaataccggacacttctcatctattcccgaccattaccggttattgtacgcattttgctgtgccgttcgtgccaaactcagttatttacttaaggattatttcgtaagtttttagaatgaattataaaataacagttcgatcagttgtctctccgacattgtgacgatgggttgctgaagggcaatgatttggaggatgaaagtctgtccaaattcgcttctttcttgtgccgcaaatttcttcccccgccctcagaagtgccggaacatcagaccgatgtgttttatccagaataacaattaaatcaacatttaaactaagatttagtcaaaaaaagcgcctaatttactgccgaattctgtccaaatttcgtcttcagaattgccttcgctcgaatatttcttcaacaatttttataagcttcaagtccccgtcatcattcgtggaatggtcttttttcatttataaagtttatatacatataattaaacatttatttaggtgaatgggtggccggcatttgaaaaatggagcttttcttatttgaactcgatttgtgggcatcgtttggtccctgttgaattgggtagtaaatacacggtccatatcgaatatttttggcctttttaacgaaatttttgttcaaaaattaggatgacgactggcgccagcagatgatgagtttcaaccaatatttggacgattttgtttttcccactaccaatgtgagttataatcaaagcatttttttgcaaattctttttcctttttgtttgatttttcaagaaaaatgggtaaatttttttgaaaattatgcacagttttcttaacatattttaataaaagttacaaaaaaaattaagattctagtctaacaaaaaaaaatttttcaggaatgttttcggttacacctaggttcaaaaaaagctttgaaacattcttaaattttatattttgcgcagatgttatatcccggctgacttttcggcggccatgttttgggctataccctccccctccctanaaaagttttaacaaaattttttaagaattttttaaatcgtttagccgtcccagtccggctacatggcccagcaccgactgctcgaccaattcccgacctgctcgcggatgtgctgtgcctga

SEQ ID NO: 24317 - DNA, 1889 bp, Heterodera glycines
tttgcatttgaccatcgttgctggcaatggacgcgcgtcggtgttgttacaacggttaactgaagaatgaagcccaggcacggaagcaaaaagtgctcgagcagttcaagcgtgaccatttttataaagtcgagttcaaaaataattgatgccatagtattagccaaaaaacgctatgctattttatttttcagtgctgaaaatgtttacagcaattttttgtagtttaataatattaacatgcataaaaactacgaaatctcggggttttgttttttccatgtgtacaggtagttgagacattttttgaaacaaaaaacttcaaaaattttaaatctccgagttttgctttgaatcctaaatgaatcagattccccctaaaatttcctaaaagatgcttttaaagaacgtattaaattttttgagattatttttttgactgagaggttaaaattgactcggtgggttgacattagagaccggaaatttcaaatttgcggatctcgctgcgggattagaactcaaaattttttgcgggacgggatcccgcgggattaatcccgcatttaaaatttgcgggatcccgcgcgggattgtgggattttgcaaagttcgaaaaagtttcgattaaatttcaaaaaatttccaaaaatcaaaaaatatctgaaatttttaaaaaataatttttaggggctggcgggatccattaaaaggggttgatgggtcgactaagattttttgaatggatgagacggtaaaaagagatcaaaatcaaacctgttaatggtccttaaatttgattattttgttgcttttcaaaaccgctttttttgcgcgaaattttttcaaaaaactgagaactgaggggttctgctgtgccgataggcaccaggggtggggcgcgcacataaaaatcccgcggtcgcggattcaatttgccgcggtcgcggatttaaaaactcaaaattttcaactttttaaacatacatttttttaaacttttttaaaaatttccttattataaaaaatcaattaaatctcggtgcatatgtgtaagatttgcgatgggactggagaaaggggtgggggggggggcgcgtcagtgtccaaatgacacgcaaatcctgtgatttgttatattttcagaccgcttttttcggcgcgctttttctaaaaaacttttgagaactgatgggggcatggtggatccggcaaaatttttgaaaattagtgcaatttggtaaaagattttgtaaagaataacctattttgtgatttactagccattttttttaaagaaaattaaagttttgtcagcttcgacgtggaaaaattggaatttttgaaacgaaaaggatttgtcagctctgacggggtaaatatggaatttttaaactaattttcgagaaaaataatccaagttttcaaataattttcatttaaactttggatattcaaaaaagaaaatcgcttcaaaaaaattttctttataaaaattctgccccaaaaatgcgcggcgcgccgcgcataaaaaaatcccgcggtcacgcatcgcggattcaaattttcgcggtcgcggatcgcgcaaaaaagacgccgcgattcgcggatcgcgcaaaaaaaaacgccgcgattcgcggatcgcggtcgcgtcccagccctgataggcacagctggagaaatttttgaaaatttaatgcgatttgttaacagattttgtctaaaattgaccaattttgtaattttgagttaattttttaaaagaaaaaatagggtgaaggccatccggcggtgccgataggcgccgccgggaaaatttcacaaatttgaatgaaatttgcgataattttaatatttatttattcaaaatatttgcattttgccataaa

SEQ ID NO: 24318 - DNA, 762 bp, Heterodera glycines
ttgaccaagcggacgagatcagcatccccgaatctccttagaaatatgtttttacgactttttgcttccgaaaatatcagcccggtccggtatttttgagaatccgatctctaatgtgtatccttctttcagtttattgttaattaaaaaaaatgacacaaatactttaatgccaataggccatcaatcaaaaatggcataattcaatcaatgttccctcagctgcttagtcttcgccacttcgaagaaaattctaaaaattttttttcaatgagggaagaataacatgatcaactcactcatggctatatttgcggaaaacagtgtccaagtccggataatgctgtttacgttcgatgatcatccgattgagacgccacatcagcggttcaatctgaatggaagcaatcggcaataatagtttggcgaaggagggttggaatggcaaagtatggaaaatcgaatgaaatgtcaccaaaaaactcacatcagaatgtttgaagccggtgtacttgtgcaaaacgggtccctgaatgtttaaaaggcataacaattgcagtagtgaggatgcgattctcgaaccgaaaattcaaatcgtttttggtaatccttcggaattggtgaaccgacgggaaaaagagataaaaattttcttttatctttttctagggtaaaaaaatgcaatgatcacgaatccgaacctcggattttgggcaaatcattgattttatctatgctttttcatcaagtacttgttttttt

SEQ ID NO: 24319 - DNA, 1753 bp, Heterodera glycines
  misc_feature (54)..(54): n is a, c, g, or t
ttcaaaaagaaaaaagttattccagattctgggaattttcgattttcagaaaanaattcgtagctgcttctgaaaagctattcgggaaaagtaaaatactacaaaaatccgccaattttttgctctattaaataaattttatctggcatttttatcacttttttgcgaattgttataaaaataaaagtgattttgagattcgggaccaaagggggtggacaggatttttgactggaaaattttttttcacaaaaatcttccaaaaacatgtctttaggggttatttgggccgctgatcacgaatacgtgatcagattttacttttgacatcgtttagacctcagaatccctgtgtgattggggattctgaggcatcatttttgggggggggggggcgaagttcgagtccggacggtgtaaattattttctttgtatttttgatttatttttcaatgcttttaattaatttgaagataagttgtaaattttaaatttttttaataaataatttcattattattttttatctgtaaaaaataatatcatttcaaatttcttaaatattcaatgcattcgatttttattctttaataaaaaacttttccttatttatataattttaaaccatgttgaacctcttcttatcacttttgtatctcttcttgtcactgtagtacctcttctaatcactattgtaacttttataaattaataaaaaaataatttttaatttaaataaaataatttttgataaatgctttgtattaaaattaattatttatttgttctaattaattaaatattgtttgtttgatttatgtttaatttttttgatgaataaaagttttattttatttgacttttcgacaaataatttcctttcaatttcaataaatatttcatattatgcatttaaaaattataataaagctttaaaaatagagaaaaagcgcgaagcgcccgtcctgaggccgcgaagcggccgatatccaccacaaaatttaaaaacgggtgcggagcgcccgtcctgaagccgcggagcggccgaatatcccccaaaaaattaaaaaacgggctcgaagcgccagtctgaggccgcgaagcggccgaatatcccccaaaaaattaaaaaacgggctcgaagcgccagtctgaggccgcgaagcggccgaacgtctcacaaaaaattaaaaaacgggcgcgaagcgcccgtcctgaggccgcgaagcggccgaatatcccccaaaaaattaaaaaacggctcgaagcgccagtctgaggccgcgaagcggccgaatgtcccccaaaaaattttaaaacgggcgcgaagcgcccgtcctgaggccgcgaagcggccgaacgtctcacaaaaaatttaaaaacggacgcaaagcgaccggaactgacgacgaaaaaaatatggaagtctaaattaccagcagttgcatatttttattgcaaaatttgattaaaattaaaagaaacattaatagaatattaaattcttctctttttatattttattaaacgaatttataaattattttcaaatgaatgcaaggttgttctggttcattttgatgcacacgaccttaaaagcggagaaaattgcgtttgtttaatgaaaatatgctcaaaatatggtcaagattcttaatttttcccccggtggcgcctatcggcaccgccggaccgtaaaaatcccttaatttacaagcaaaaatttgctcaaaatcgcaaaatttggccatt

SEQ ID NO: 24320 - DNA, 1805 bp, Heterodera glycines
tctaaattatcccgatgaaaatatatagtgacagtcgttttgaattccaagcaggaaaaatgaaaaaatattttgaggaaaaattcatcatcaaaaatgtaatgtatagtcctgatctgcacgccggagtcgttgaaagggcaaatcggacaataaaggagcgcttgtacagatattttacaaagaaagacactcttcgatgggtcgacgtaatagacaaaataataacaaacattaacaacagtgtgaatagaacattgggagccaaaccgtcttcaattaattttgaaaatgcccgtgcgctctgggaaaaattatataaggagaaggaatttaaaatttcgaaaaagaaaaaatttaaaatcggtgatatcgttcgtattaccaaggaaaagggaaaattttcaaagggatacctcccaaactttaccgaagaattgtttaaaatcgttgttgccaattcgacgacacccgattcatacaggatcgaagatttggaaggaaatttaataaaaggcatattttataaccaggaattagtgaaaacagatggatgatttttacattgtactaccttcgaacacaccggggcaggagaacactacgtcaaaattcacagttcgactccccgagactttggaattgggcacaaattgggcagtagctctctcatcaattatttacccctactcattcaccgcactcggtataaacggtcaagagtttattaaagtatgggaaaacgacatcagtgtccctactcaagtttatttaccggacatgaattttaaaaccgccgggggcctgggaaataaaattaatgaggcattcacacatcattacaaaatcaaaaaacaacgtggaaagagagaagccaaggctgaagataccaaagattcaaaaattgatgtcgcaaagagggccgcagaacgcgccgggagagacgtagaaagacattttaatcagatcaacaatatatcgaattccatccaaacccaactaaacacactacgagaaacaaatcctcaaattttagaagagcctgatataaaaatttggtttgacaaaatggttgagatgggaaccgaaattcaaacatcccgaaatgaacttaaatcttttcaagaagaagtagataaagccaaaaacataacattggagcatgtggaaaagaatgacttgaaaaaagcaaagaaatcagccgacgtcgcaaagggaatcgccagacaggcaaagaccaaatatacatcaactctcgaggaatataatgataaatcggaaaagggttttagcgggatggtggttaggcttaacgaggcgctcggtgagcattttaaacataaggaaattgaaaataaagaagtttcagaagctgaaaaagggccgcaaaaaagagagagattagccaatgaggatgttcaatttaactacgacagtattgatcaaaaatttattgtctatctttcctctgccgtcacccatatagatttgtcaaaacacctcgcatatgttctggggtttaagaatacaaggctatttcacgcggaagaggcgacttatatgccggatttgacgggaggtgtaaggcagctatacatttatgcaccaaatttaatcgaaaacacaattatcggcaaccagatggccccactcttaagaatagttaacgtcgtcgatgacccgggatcaattagtgaagttatatatagcaccgagtattttcatcgtctacaatcgaaacgaatttcagaaattacaattgaaattcacacaccgtttggtgaattcgttaaatttcactgggg

SEQ ID NO: 24321 - DNA, 1964 bp, Heterodera glycines
  misc_feature (1812)..(1812): n is a, c, g, or t
  misc_feature (1847)..(1847): n is a, c, g, or t
  misc_feature (1853)..(1853): n is a, c, g, or t
  misc_feature (1871)..(1871): n is a, c, g, or t
tttcaatccattaataagcgggatcggggttttcccgggtacggcagaggtaataaaagccaaaaggcctaaaaaattagggattaaaaaataagattttgaaattagccgttcaaaacgtccggcgtttagggcaaaataagtgcggtttcataattggtaaaagcaggtaaaatccactccacaaaatcctgggtcggctcatgtccctccgcctcgctccaatccttgatcctctcctccccacaaattttgcaattcgtcctgtttttgtcatcacagcattccgtacacgtaactctcaccgaaatataattaataacatgctccttctggtcccccttgtaaatagaatcctgcgaagtctccgaatcctgaaagttaggtcttattttgtctttttctttattaaatctacccaaacgacaattcggtagacgtccttgtcttccttctcctcgatcggcataatataacatccccgcttggggtcatggctcacactacaaagttggcaataagtctctccacattcatggtcctttttcgggttaaatcgataagtcttgtcacagataacgcaacgcctccataatttacaagtctgatgtccctgatgataggtgtagcattcccaattataaaagtaacgtcgacacttcgggcattcaatcttcactccactctccttttgacacggcattcctccagctctattgcagtaataacatctcgcccggcaatccatcgtatgataaacatcctgatcgtaaaaacattcacattcaacgcagaacttcctcccacggttgaaaaagcaaacatatttctttaatccatcccagtgaccattctccaaaaatatcggtacgaccttctctcgtcccatagggcccttccacaaaacacggatcgatttccgcggatccgcagacttctcaaacgcaacaacccggtactttccggggtaaatctcatcctgaaaaatttattaattttgcattttttcatttaaaccccacccaataattctgaacccccgataagtgctccactccatagctatattcgttaatatcaattccacaatttcttaaaagtccgtatgctgcctcacgttgtctcacgatgttattcataaatcgattaaaaatattccggtgcacttccaaataaagctttgacgccaccaacgcataaaacaaacaaaatttatccacattcgaaatccttaataaataattataattttttcttttttctttttttctattttctattttatttttttttcaaaaaaaaaacttactttatccgttggtgttccttgaatccgaaatcaaatttatgtacattcctcggcccctctccactgggcatggtcacgcaagtaattttcatcataataggctccgacaacaaaagcgttttcttattttcatctccttccccgctctgccccaacttattaatctcctgcataataacatccgcattgttctgcgggtacgccctgtacggtacccaaaccggggaagcaagcccggcacccgttattgccactccaaacatccgcactttccgcttcatcctttcttccgtagtcttaaaagccgccttaatcattgtgtcgattgcgtccctcatcgtttcatccgggcgtctcacatccggattgatccgaaattccataatgttcttcgtgaatccaaatttttcgcaaatcgtcgaccgttcgtcaattaatttataattttccatttcctcagtaaaattgttcctgaaaaattattgattacacttgtctcttanatatattattaaaaattacttacccgattgatctnaaatcncattttttggtcgacggnccggcttggtccgtatttccatgtgcgttttgaagtcatttttaatttaatttatattttttaatgagagcgcacaatttttattttagcaaa

SEQ ID NO: 24322 - DNA, 1779 bp, Heterodera glycines
  misc_feature (58)..(58): n is a, c, g, or t
tagatgagctcccagatctgcctgatcctcaagcgccttctacgaggggagaggaggngataaaaaaggagtaactcctgtgtctgacaggatgaaaatgctcatgggtcatcagaaacagcaaaggaaagcagtagaatttcttttcaatgagataactcaaagattttacattaacataggtagtggagtacaacatgttgatgcgagtagccatcttgcatatgtactcggatttgagaacactcgattgtactataatcatccggccaaatacttaccagatctgtcgggtggtgtagggcaattgtatgtttatgcaccaaagttggtggaagatacaattattggagaccgtatggctccattgttgcgcgttgtcaacgtgtcaggcacagttcctctggacgtgccagaggttatatataccaatgagttttttaaaccgatacagaacaaacgaatttccgaaatcaaaatcgaaattcaaacagcgtttggacgttacattaaatttaactggggtaattgcgttctaacacttcattttaaacgaaaactattttaaaatgactcatgtctttttcaaccctgactccattgaatggtcaacatttctagcctcgcagcaagaaggaagaggcgaacagcagtattttgttggtacacgttaccaacgcggaggcggtcttctgcaaaatgtagcccgatttttgatgccagtggcatcaaatctactctccagtgcttcgaaggaaggaattgctgcaggaacacgcgttcttggcgatttgtcccaaggtaaagcattgaaagaatctcttgaaacgcatgctaagcaaggtttcgaaaacctggcaggaaaattacaacaatgtgggaaaggtggaaattatggtgccgatggtagaagaggacaacgagtgtcaaaggttaaaaaaattagtggcatcagctccagtgattctattattggcagaattgggactgttaaaggccgacggaacaaaatcatgcatcagttaagctccccttgacaccttgaacgcgaaagtctataaataggtaaagaattttgcaaaatcatacatttaggaactcattatcatcatatagcagtactaaatattccttattgattaatcatgagtattatcaaaaaaattgacaaagatagtgttgaaggtcttgaaggtagtctatcattgtttaaccttccaccgacaaatgtggctattaataaaacgagcgttcaggagcttttaccattgtccgctctcaaccagacaggaccctatctttttcgtctgttttccgatagtcaatattgtgatcttagcaaaacgtacatgtatttgctcacttcgatagagcgtaagaatgccgccggagaatgggtgccgaccgacgatgcgattgaagaggacaaacatgtaggtgttattcaaaattttggaagcagttttgttcgatcattgaaagtcaacatttctggtgtcgaagtgtttgatagctcaatatactatcactatcgtgcgtacataatgcaggagcttggctattcacatgagattcgcaaagcatttcacgaggctggctgctattatccggatgaaaacagtcaggataactactcaaacaaaggttttaccagccgagcacagagattctcaaacggaaaacagtgcgaaacaatggtaaaaactcaactttgatttggctcgtcaaaaaccacacctattgctgaaccaatcaagatgatgtgatcgcaatccatcg

SEQ ID NO: 24323 - DNA, 1863 bp, Heterodera glycines
  misc_feature (20)..(20): n is a, c, g, or t
  misc_feature (70)..(70): n is a, c, g, or t
  misc_feature (113)..(113): n is a, c, g, or t
  misc_feature (124)..(124): n is a, c, g, or t
  misc_feature (147)..(147): n is a, c, g, or t
  misc_feature (1847)..(1847): n is a, c, g, or t
tttaaataaatatgttattncatttaaatagggttgctgttattctgggtttttgatggtctaagtatancaaaatattattatagttatttaagagttatccacaataatanataatttttanaaattatattcaacaagtagatntaatactaatttttaaaatacactgattatacttaaaaaatattataaattaaatacaattaaatgtataaaaggaaaacattgtagtaaaatcaataaaatttttcataattatacttcctaacgaaaaaagcaatcttataaagaagaaaatttcaaacgcccaaatttaaatttgacgcaattatactaaatttatagtacatagtgcaaggagtcagaaaaacgcgagcctctcttatttttaattaaaataatgaattcaaatttattgtaaagaaaaagatttaattttggaacattaacaaaggaatattaacatttaaattttggagaagaaaggctatcaataatgcaaataggtcccaattttaaatcgattctaataataaataaataaattttgataaatattattttaaagtaggtgcaaaataagatgaaaattaaaggaaagaacatcgaattttactggagatgattaagataaattcataaaattcaagagctttttttaaagtcatggttgtgcagaaataaatttcaattgagtagaaaataattttaaaaagatgacttaaaaaaaaatttaagaacacgattactatgataaaataatcaaaaattaataaatatcttaaaatcaaaaagtaatttgaaatctcgataaaatttaaattaacaataaattatttctttacataaaaagttgttccgttcaatggttatgaagtaggagttgaaaatattttttttctaaaaaaatattccaaaagtttgaataatttcgatgaaaattaaaaattaatacacgaattaagataattaaatgcatttcgttagaaaaaaaaatgcattataaataattatttcaacttaattaatttaaaattaattaaataatacgcaaaaatccctgtaaataaaataattataataaagtaagacagtaactaattaatgcattattttattttattttttggaaaagccattagtagaagtcaacgatctccaaaagcacaaggaaagtacgaaaaaatgtaatgatgaataagaagctatttaattataataaagttttaattgttggtttattttgttattcttttttttgtatagttggtgaatgaaaataaaattttaaaaagtaatctttcagcattaaaatattttccattaagaaaattatttcggataaatggtttgaaattatcatttgctatataatttatttatcaaaaaaattaatgctattatataaaattatttcgcaaaattgctttttgaagtttggatatttaatcttaaggagtttgaatttgaatcttttttatgctaatactacaaacgatgatattttggtgattggttcataaatttttttaataccttcaaatttaaagaaaagaaaaaactaataaggttcaataactatttatattattttttcaattaattaattaattatgaaataaaatagttaattcaaatttaaaaagaatattttttgatttataattgcgaattttcgtttttagttcaatttaaacgcttttggattctttttttttaaattttattacaaagcatcgaattttataggtttttatcaactttatccagcaaatggaacatgactttatttttaaaatttttcccaatcgttatgctctattcacaaagtgagttgcctcagncgcacatttttcctcc

SEQ ID NO: 24324 - DNA, 805 bp, Heterodera glycines
gactcccgcgggattttacgggagttccgctcccgactcccgcttttttcggtgaacgggatttttaacgggagcgggatttttacgggaatcccgttcgggactcccgtcccggaaaatctgaactcccgggattttacccgagtcccgctcccggaaatttttacccaaaaacgggagtaaaaatgcactggtaagaattgatttttttggtaaaaataatgatttttcattgaaaatctgttaaatatatagccaaaatttcaaaaaaatttcccggcggcgcctatcggcaccgccggatccttaaaatccttaattttcttaaaaaacttgctcaatttgcaaaaattggtcatttttgaacagaatctaacaatgtattgtattaaaattttcaatttttttcccggcggcgctttttcaagaaatacaccgcaaaaaattttgtaaaattaataaagggagtcaaaaatataaagttaataaatgttttgttcgaattaattataaaaaataatttatttaagcaatttgaaaaaattttctgatttttgactcaaaaataagatttttttatttcaaatttctcctttataaatttttttatatatttttaatttaataaattgattgtcctttaaatttgtgcattaaaaatatatttgtgagtttttaattaaatttttaaaaatggacgggatttaatgggagcgggatttttacgggaatcccgttcgggactcccgtcccggaaatttttgaactcccgctcccggaaattttttttaccggactctaatat

SEQ ID NO: 24325 - DNA, 1486 bp, Heterodera glycines
agtgatcagaagaggtacaacagtgattagaagaggtacaacagtgattagaagaggtacaacagagattagagaggtttcaacagtgattagaagaggtacacaagagattagaagagtgattagaagaggttcaacagtgattagaagaggtacaacagagattagaagagtgattagaagaggttcaacagtgattagaagaggtacaacagagattagaagaggtacaacagagattagaagagtgattagaagaggttcaacagtgattagaagaggtacaacagtgattagaagaggtacaacagagattagaagaggttcaacagtgattagaagaggtacaacagagattagaagagtgattagaagaggttcaacagtgattagaagaggtacaacagagattagaagagtgattagaagaggttcaacagtgattagaagaggtacaacagagattagaagaggtacaacagagattagaagaggtacaagagtgattagaagaggtacaacagtgattagaaagtgggcattcaaatagagcatttatggtaattaaggaattgtttttaatcaaaatagataaaaaatcgatgtgttatatttttcattttttaaaatataatacactttttattaatgaaaaacaaattatgaaatgtataataattgaatagttatttaaattgaaatgaaaaaaattttacaattaaattttaaaataatagctgaaattctttaattaaatataataaataatttaatgaaaatcattattcatcaaaaaatttaattaaactaaaaaaatttattattaataaaaccaaacatttaaatttattaaaagtaatgaaaattaacccaaaaaatacaaagaaaaataatgtacaccgcccggcttcgaacttcgcccccccccaaaaaaatgatgcctcagaatccccaatcacacagggattctgaggtcttgacgatgtcaaaagtaaaatctgatcacgtattcgtgatcagcgtcataaaatacccctaatgacatgtttttgaaagatttttggtgaaaaaattttttcaatcaaaaatcatgtgctcacccctttggtcccgaatcccaaaatcacttttatttttgtatctttttttaaaaatgtgatagaaatgctaaataaaatttatataatagagcaaaaaattgcggatttttgtagtattttactcttccctaatgacttttcagaaccgagatataaatttttttctgaaaaatagaaaatttccagattttctggaataactttttttcttttagagatagaaatgccaaataaattccataaaattctcctgatttttctctattttagagcttaattcactaaattgaccaaacttcactgagaatgaatttcaattttaaccaaaattccaaggacaaaaaattaaaaaattttcgaatttttaaaaattccaaaaatctgaa

SEQ ID NO: 24326 - DNA, 1661 bp, Heterodera glycines
  misc_feature (26)..(26): n is a, c, g, or t
attttgatcctttaaaaaattcattntaataaacaattctttttgattttcataagaaatgctaaaaaaaatcagttaaaaattatttttaataaacaatttttttgatttttcataagaaattctaagaaaatttcaaaaaactacgagaaataaaacatgttcaaaatttgcaatatattcaaacactttattttctaaaaatatatgtaaagaaattcccaataaaataattttttcaaatttattgtttaccactcactcactctattttgatgattttgctcgaagaatgaaatctgaggattaggattcactaatccaatgaccaactgattaggatcaatctccatacaatttgtgtgatcaaaataatcagtcattgtttgaatagtggtgatttgctgctgatccgaataaacagaaacattcattggccgccaaaaacacactttcttttcccattcaaaattcaaagttggggggttagaagttgaaaaacgtaattcatgtactgtagcggtaccaatcacctgagaatattttaaaattttggattttttttgtgtgaataacataatttaataaaaatagatttttgaatgttttattttaaatgcccattttcaaaaacatccttggaaataaggactcgttctaagaattaaaaaaaattttattttagtgtgtattttttgaaatccattattaactgttatttatccattttaatttgttattctttttatctattgcatttttattagggaaaataaattcaaaacaattgattttctattgaaaataagaaaatttgaaaaacagaattttggcaaaacataaaaaaaaaattttttttttttaatttttccatttttcgtcggatttttaaatattttaggagaaaatttttggatcgcttctaagagtgaattaaaaaattgtaattgatttatttattaaattacttgtccactatcatttctgaactcaacaaatgcattggtatccattctattccaaattgttgactgaacgctcaaacattgttgttgtccatttggcaatggatttgtatattgccaaaactcacaattgccattatagaatacttgaactctgaactggctaccgtatcgaaaacacacagtatttattcccacggtatacacaaattggggaaactgtaccaacagaaaaaggcagcaaaatacgatcagaaaattgtttgtattcatcatatctgtaaacaatttttgaggaatattttatagggttttgaaatcgaatactgttcacttttttgacttagtgaaaaacgcatgaataaaattcattcaagagtttttacatgtaaggaaatcaaaatttcctatcattaaatttataagcaaaaaaatcagaaattcttttttaaaatgactctctctctctgtgataggacaataatatattttattttttattaaatgcctatgaaaaatgaggtttggaaaatataagattacgagccaatttgggcaatcaatttgccaacaaaataaggcaattgagcaggcaaatgccccccccccccttaaatttgcaggaaatgccattctaaagcctacgcttgtttaaaggtataatgccaaaaaatggcatttctgagttttcagttt

SEQ ID NO: 24327 - DNA, 2276 bp, Heterodera glycines
ttatcgaaattttaagagatttttaattgaatttttttctttgcgagactttacatttaaaatttgtaaatgtactaccctcgcagcagcattgttaattttctgtttcccattttaaggaatttgccgacattatgcggctcaccggcgcccaggagggcatcattgtgcgctgcatccaacggctggacgaggtgtgcaaggatgtgcgcaaggcggcacgcattgtgggcgatccggcactgttcgagaagatgggcgagacgagtgccgcaattcgaagaggtgggaggggagaagggggattctttttatttggaatggcatttttagcatgccaaagtcacacaaaaattaataatgcgaaaatacgcagtcgggaaaaaaaatttttggatgcgattttatgtttgggttgtctatctccaatccaggacaggtctaagtttcctatgatttcgatgtcgccgaccacgaaaacagcatctatttcggccaatttcgaaccccggacccgaattcgaacaaaaagtcgaaagtccaaatttgcgaatttcgcatttttggtttaaaaacggctttaatgatcctttattgcagaattgatggtttcagtttgtttccgtgtaattaactctttttttgaaccaaaaatacgaaatttcgaaaacttggggattccgattttttgttcgaattctgttccggagttctgaattggccgaaatatttgccggattcctgatcagcgaccattttttttttgaaaaaggggggaacaaagcacagtatttatacccaaatctaaaaaatcggaacattgtagaaatttttgttgaagtatttttcaaattttattttcgaatattgcattattcaaagctattttaatttatttaaattaaagcaattaaattttcagacattgtgttcgccgcttcgctgtacacaaccgaggaggaatgaacgagctgtttttaatgggccttttttctcaatatcatttttctattcatttttgtttatttttctatcccaaagatttgtttttgtttttttttttgcttataaattattaaatgggaaaatttattggaaattttattgcaagagaaagtgaaacaatatcaaaattttcagtcccaaaaaaactttttaattaattttttgccaatattgctctattttatgaacctgttaacaaaatagagatttccgacatcgactgcttaaaacatttttaaaaaatcgcaaaattcgggctttttgacaatttattatgaaaaatttttcattaaaaaactggctcaaaagcgcaaatttgttgattttttactgttaacaaatcacaattaaattccctaaaaatctcctcgacgaaaaagttttttgaaaaacaaaataaattcgatatgcttatttcgtctccaagaatgttaaaattaaaaacgggagtctgaaaaaataatattttacatttttgattggataaataatacaattgcaaaaaattctgattttttacccaaaaatctgattttttttccgcccgaaattctgatttgcagtttttcgatgacacctcggattataccatccatatcaatgaaaatatttttcattaaccgaaggcttttcggctctagaaataaacacttcgaaaaggctctaataactcgaaaaatagcttaacaaccaccaaaaaagcagccactggaaactcagaaaaaacaggaaaaccctaaaaatatcatccctaataataaggctccaaaattactttacatttgtgaattttttgttttacactcattggcgcatttctttataattcattcattggcactttggttaaagggaaggatcacttacagtgagcagaaagtagaattgtgccgtagaaagtgatcacctagattggcaaatatacctatataattttttgagtagaattttcaccataaaagccgtcccttgacagtgggtgaagtaacagtccccccacatccctaacattaagaaattttatccactcccacccatttcctttaaattctcagcaaatctctcccaatgaaaaagcattttggcaatgccctgttctccgctggcatttcagctgggctagtgacaatgtttatgctgctgataatgccatcatccactgatggcatgaaaattaatgtggaatatggtgacataaagttccgcattgaggtgaagaaaataaacaaagtaaaagagttgaagtggaagattgagtcttatactaagaa

SEQ ID NO: 24328 - DNA, 2671 bp, Heterodera glycines
ttggcccatcggaccggcgccgcttgcggccgcaacaccttccaccatcgccgggtccaactcctcctcgttgtaaatgttgtccgccatctgccaaatctgtgaacgagacaaataaaattacaaaaaatttgttttgttccagacccacctgcattatgttgtcctccgacactgaacagatcacccacggctcgttggggttccacgaaaagtcgctgattttggccgtgtgcccgccatggatgaacaacagttctttaaaaagatccattttagtccgttttgcctccactcacccggtggtccgtcctccgcgtcctctggcgactgttcgtcgccaattttgctcagatcccaaatgtgcagacggcgatcggtgcccgagctggccaaaatggtctcattgtggggcgaccattggaccttggaaaaatgtttttttttgtttaaatttattgaaaaatgcacaaattcacttgaaatatttcatctctgtgcgattcaaatgaatgcagcttcaatttcaaattacgaaggtcccacaacgcaacagtcttaaacagatttgcttaaaaatgctagcagatgcgtccaaactttgtctgccgatccggtggccaaaatgaattccgagtacgggttgaaggagagacaattcacctgggaagtaacaaaaattaatgaataattcagagacaaacaaaaaacatcacacattggcatagaataaagaaaatttggtaccgatcgaaggaccgaatcaaaatgcgtttttgtctatttctcaagatttacaattttaattttttctaagtattttgggagggaaacccatacaaattttcattaacttatctttcaaaaaatttttttttaaaatttagtgagatggggagggggcagtttcatccttataccactggttaagtgcctgatttttagcacacacatttatggactgatttttgctgtcccaatttctagcattttcggctacgagtaagatataatttccttttttccaataaaaaaatgttctttctacccttttttaacatcaatctccccccccccccccggtctccgcttgcctcggccgagtgtgcctccacaacatgggttggctttgtggagctgttcgtgcgcgtgtcccacaccatcagtttgtgatcgtcgccgaccgaaccaaagactgtgtcatgtaaaacgtgccttaatttgaaaattattctcaaaattcagttcgtaattccatgtttactaccatgccacgtccctcacaaccgcagtgtgtgctgtgaaaatggattttgcgtccaaaaagttggcattcgcagtcgccgcttgaatgtcccacaggcacacggtcatgtcgtcggaggcactcaacaaatgaccaggcaaattgttgttccaggataagcctgatttgattaaatttgttattatggatgaaaaagaacgcattaactaaaaaattttagaaaaattaagaaaattgtggtaatttactatttttgaaatgatctatatttattaataataacagaaccgcccaaatttgtttttgcgagcttttactagtgggtgcaacgaacaaatagaatgtcatcacaagacagaaacatggaactgtcctcctcccccccccctttggtttgaatgccaaaaaaccggaccgtatccctccttggtgtggccacgcagtcgcaactgcggcttgcactccacgtcagccggcgtggacggatgctaaatggacaaagtgcattaattatgctgataattgtaccgttaattaatcaacagacagaccttcgtgtagtcaaagacgtacacctccgaggagggtgatttggtgccaatcagaaccggattctgtggcatgtatcgggcccggttcacctcgccctcgtggttcattttgatttccacctcaattttgccggtcactgtgccaaagccaccaaattcgccctggaatatgattggattttagggtaaaattaatatggttgggcactcggtcagtgtcgtagcgagacgcgtcaaactgtgcgtcgtcgttgggcagtaacagtttggcgatgaccaaatgattctaaaattactcatttgcgtgcaattgtcacatcaagccaccacctttacctgctcgtccgacgtgtgcgtgcccaaaatgaggcgatggattgtgtagtcggcgccctcctgtcgttgcacgtcgggcagccattggacggtcaaactgggccattccaacgcatgagtcatcacctgaaaacgacagaataaagcaacaagacgtaccaaaaacaggaaatttgatggcttgttttaaaccccaccatgtcgtaaaggaacgggcagtttttcttccagattttgtactcctcgttgatcagccgctcctcggcgtcctcaccctgttgcggaggttgagagccaggcacagacatttgctgcaattcgttgtttatttctgttcaaattatataacagtgaaaaggctgttacaaattaatctcaaaaaatagttgaatggatttttaaaaccatttgaagctaaattcaaagtgcaagtgatcgccatttgttcacacatacaaaaaatgaatgaaaaataataataatcggcacgctttttgctacacatcattcacaacag

SEQ ID NO: 24329 - DNA, 1643 bp, Heterodera glycines
attatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgcatgtgatctaagcctagcaaaaaatggtataagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtaagtaaaaatcgtaattacgctcaaaaagcttctcaaacaattttagcgcatccaattccttctacaatcgcctttatacatcccattatgaacgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgcatgtgatctaagcctagcaaaaaatggtataagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtttaagtaaaaatcgtaattacgctcaaaaagcttctcaaactgttggagtgttaaagaatttgaatttggcgcgcatcgattattgattaatgttgtgacgtgtcaatccctcccccttattcattttgtttatttaaacactccttccttccccactttgttccttctccattcatttgctattttacattttatattttgtactgcatttctcctccgacataaattgtgtttattattttattgtgtgtccaaagttgagacacaacaattggcgcagtcagcagccgtgcttcacccattcgaagacacaccgaactgcaacccaacctcaacaaaacttggatgaggaatccaaacacctttgtggaataaacacccaccgtggcctcttccaatgccagcgcctcccatttggcgtcaaatctgcgccgtctattttccaacatttgatggaccaaatcgtctcaggcatcccaggcgcatttgcctacctcgatgacggcataatcgcctccaaaacgcttgacgagcacatttcttcgctctacaagcttttcaaacgaattcaggaatttggcctcaaaatccaatgggaaaagtgcaaattcctccagcccgaattgctatttctcggccacgtcatctcagcgaaaggaattcgccccgaccccggacgatcagaagcaattcgccaaatgccgccaccacatgatttgagcacccttcgctcgttcctcggcgcattgaattattatggaaggtttataaagtccatgcgcgaaatccgcgaaccactggaccagcttctgcgaaaggacgtgaaat

SEQ ID NO: 24330 - DNA, 1166 bp, Heterodera glycines
tgttttgaggcgctgataacgaattcggcctccatttcgattaattccgaatccctaacccgaattcgaacatttttcgagaattaatttttaaatttttgatgtttctaagcaaataattaattttttttcaaacagttttggtttttatccaaatctatttattcaaaaataaaaataaccaaaagaaggacatgtgccacttacacttttggcggaaatgaggtgaaatggaaagcagtgataaaagaattgaaattttgaatggagaagcagaaattagaaaagtcagacctccaacaaagggaaaagtggttgtttgttttttagggttgtaggagaaaaaaaaaaaattttttttttttttggaatgtgaagtactggaaaaaatgtatttttttttttgaggaaatgtttggaggtctgacagaactatttattgaaaagacgagggtattgtttttcgagtgattgaatttggtgaacaattttgtcgtttggtggtaatgattttaatgcttcataacatacgaggattgtttgctcaaaaacttccggcggtttggaaatgtcgtcgctggcctccttctggcttggtccattttctttgacgggagtcggaacatttgtctggcgaggttgcattgctggtgccacgggagcagggttttgttgacgtttttggacgcgcgcttcatattcttccttgagttgttctttggtcagcgctgggcggacgaacaggcggttcaggttttgtagagaacggagtcgagcacgctcgcgcttccatcctccgagtgccatgtgttggtgtgtggttgttggcatgaccaccttgagcgggcgtggtgttgttcgctgcgggtcgtaatgtccgagtcgaaagacggcggttggttgggcctcaacttcaagatggtccaggatttttgtggcggcttccctgtcttcctgaacacgttccgatgggcgaatggcattgctttccgggaggccaatgaagaccagggtgcgttgtcgttcttgttccgcgagtgcgacagtgtttgggtccaggtccagtgggggtgccattgaacgttttgcgcgaggcggagtgatgtttgatgcgttggttcgcttcatatcgaaaattagcgagaaataattgttttttgcgatct

SEQ ID NO: 24331 - DNA, 1461 bp, Heterodera glycines
ttaattggacaattacttgtcaacgaccacagtcgccttttggcctcttatggaacagaaaaggggaattatcagatggggtgcgtcccttcctaaaaattactctcgtcttctaccctccctctctttttgtgcactgtttcgtttaaaaaattggttccgaaattttttgactctaagaaattaaattgtaaaaattcaaaacttaaattctcctctgaagttttgaacttggctctatcctgcttttaagtcccaccgtgaggcgggacagttccaaaatttgtaccacattttactgtggaaagtacaagtaccttaattggacaattacttgtcaacgaacacagtcgcctctggcctcttatggaacagaaaagggtgaatatcagatggggtgcgtcccttcctaaaaatttctcttttcgtctaaccatccctccctttttgtgcactatttcattttcaaaattgggaacatttttttgtttgtttttttgaaaataaaatgtaaaaaatttactaaaattatttttgattttaaataatacttatgttccgaaattttttgactcataagaaattaaatctgtacaaattctatgtttaaattctcttaggaagttttgatcttgttcctaccatggctttcagtcccccggttcactattacccaatttttgtagcccaataaatttttttaaattttgcagactaatagagagaaaacattaaggcttggtactttttttgccgaaaaactttacgaatccggcggggcagtacgaatttagctgtttcgttgatttatgtctgctgtttgtcatggcattgtgttgcttttcacatctcataaaatgaattttgtaaaatttgaattttcgactttttgttagggtttccgaaattagtcgaaatgaattttgtaattttcgtgatcaacgaacccgatgattttttaatagtctgtaaacgacataagtacccgatttatcctttttagcccagccgagcagcagcagaaagctgaacatgtgctttcacattcacacaatattttttttgccctccccccccccccctccaatgtgtggtggttgtgggcttttgggtggtgaaaattagcgagcagaaacaaacgcgtgatgattattattttattatgatgatatacatatgatgatgatgattattcacaccaccataaccacaccacatctcccacaaatggcagtcacacaattcctcggcggttttggttcgccaaaacacacacatagcggcgtatattgattttgggagctgcttttgctgctgctggcttcaggaattaaatatttattggagggggaggggatattagattggttggtggagcctttcaaaatgttttgtcactgctgctgcgaaaattcctccaatatacacaccagggatggcacggaattccgatttccgaca

SEQ ID NO: 24332 - DNA, 1798 bp, Heterodera glycines
gtggatgtgtgggcaacgaattcatgggcgaaaaaagtcgtccacaaatgtcagtgtgccgtgccatcattcgcctcagtttcgggtcactccccccccccccccccccaacaaataaagggtccaattgtgcgttggcggacggcaaaaatttggtggaaggcgacttcacggtccaagaagtgcccagaaagtcggcgcgatcgcaactccaaaagtccgaaattgttgcttgtctgcacgaggaagggaacgtccgtttaaaatgcaccggtaaaaaaagcatttcgaaataagaaaagtgccggtaaacgctgcccccccccctcccgaaggatgcgtggcgaccaatggccaagaaatgacagtgagtcgcttcgccaatgtggcaggccaatggacccaatgccgccggttcagagagggctgtcgcatgatcaacgtgaccaacgactgtccgtccgatcactcgccgcccctcggcattctctgatccttttctgttcagacatcgattgccaattggacggcaccgaccacaagcacggggccaccttcgaaagtgcctccaaaaaatcactgttcatttgcagccatggacagatcatcaaacaaggccagcaggacggacccttttgttgcagtactttcccttggccattaaacatttaatcgtgtcattcattctccattaaaccatttaatagcgccattccttttcctttttattgtcgatcatttgccatttaatggctcattatgccttatttaggctgtttcatccaaaatcgtgagctcactttggtcggagatgtgaagtacatcgacggagtgaccccggcactttgcggggacagcgacaatttcactttatttgggggaatcggtcactcatttgcattgtgtgattgactaattttgcagttttttgcttcagttggctgcgatttgccggacggacgcttcaaaaggtttatggatgtgtggagggacggggacacgatgaaaaggtgggccatggcaggacaaagctcaaaagaggcgccgcttggcctttgaggtgttcgtgggcatttaattcggacggaagcattgcacgcgcggacattagcacttacggtcaaaagacaaaatgccaaacatttttaatacaaaaaatgtcaacatttgtttagcttgcctcgacggttccgacgtttttccactgaacaaaataattcaacgggagggcggacaatatatgaaatgtgtgcaaatggacgcaccaatggcggacgatgggagtgccaaaggggcgacaaatggggaaacattggggtggcgcaatttgacggacagcgaactgatcgaaatgagcacaaaaaaggcaagcgaaggacgggagaaaagcgactgatttaaaaatgaaatggcattccaatacggcacagttagcaaaacaaaatttggtggaatatttcggagtcgggcggagggcggcgccgcttttggcacgcggcacaaaaacagtcgacggaaaggaaaaagggaaaggtgggtttttgccaccttccagtttattgaaaacccctccagaaatgcccttccaaagacaacctgcggactgtgccgactttctgcccttttgcccgcgtctctccggctattgccattttatgagcggccctttggagcgcggactcgtgttggatgcgttttcggagttgcgcgagttgcaaaagcgatttgatcagtttgggggcagtgaggacgagctgaatggccgatgggatgcgaaagtaaaagtgatcggaattgt

SEQ ID NO: 24333 - DNA, 1179 bp, Heterodera glycines
  misc_feature (35)..(35): n is a, c, g, or t
ttttaatgctttacaaattaagttaataatttatntaggacactcctcgaatgaaacttttctaaactaatataataaatctaatacaattcataatataaaaagttaatgaaattaatttattaattatttaatagaactaacattataaaactacagatttaatttaaaatattcaaaaaataaatgataaatttaaatgcattttaaaaataaagattattatcgctactttttcaagattaagcttgactgggcggttgaaacgcggaaagcagggcataaaagaaagggcggatttgacccggtagcttgtaaagtttaaagcaatattaaaatttctgttggttttttttatataatagtgaaagtttatttcgccaatttttacttatttctacaaaaagataaaaaaaccaaaatatattcctaatcaattaacaaaagaaacgaaacaaagaaagaagatatcaacatttacttaaatattaaattttcaacagacatttttttttattaagaatgttctttatagttttttgggttttttatttttataattttattcattaattatcaatattaacctcaaaattttgcatttaaaataattaataaaaattattttaaaatatttaaaataattataacataagtatcaagagagtatgagaatataattgtacaaatttccaaaaataccttaagttgtcttaaatcttttaactaaagacattttgtcaaaaatttattaatttttttcaaattcggggtaatttcatggtgaaatttagtttagttttcgggcccaaatggccgggacctggaccgggatttgcaaattatgtaagtactatttttctaatattttattagcaaaaaatgactttttaaatcaaaaatttttcaagaattcgggggattatataattcaaaaccctaacagctatcaattagccttagttttttgttgaaaaaattccatttgatggtttttagtgatattacaattttatttctatccaaacagtttctggaaaaagcagcgccaaatttgacttatcgtgttgcaatactcatccccatcaaacggaagaaaaaacactgttggaggatgagcatttcttggatgaaacatctacggaatcggctaaaacaaacgcgctttacaacatcgag

SEQ ID NO: 24334 - DNA, 1974 bp, Heterodera glycines
  misc_feature (1932)..(1932): n is a, c, g, or t
  misc_feature (1944)..(1945): n is a, c, g, or t
  misc_feature (1963)..(1963): n is a, c, g, or t
caataaaattcattttatagcttttaatatattcttttttgttctatgggtaaaagaaatttaccacgcaagcttaattgcaaaaaggcgttgaaagagcgtgagaacaagcgggaggagagaaaagcgcagacggccaaggcgatgaaagcccggtgggctaagaaaagtgagttttttcagcaatttttatttcaaaaatcatttttttaaatttcagccgctccaccgccgaatcccaatgccgaaacgccacagcaggacgaagcagggccgtcaacatctgctgcaccgacagaagaagcgatggagccgcctccaccaactccagggctagtgccaacgccggacatggacgaggaaattttggaatatggcgttttgctgtcgtcgacaccggccacaccaatcggcgatttggtgccgttcccgtcaacaccaactgcgccaatggacaccggagagatgacaccgccaccactggccatcgacgagcgatcaccgcgcatcgaacagctggaaaagcaactgaaggaccgggatgacaccattcaatttctgcgcgagcaggtccgaaaccgagaagcgctgatcagtgatctgcgtcgtcagctggagcaatgtgcggcaccaccaacggcgacaccaaccaccagcaaaagtgagtgaaatttcgatgccttctcttttcacaattaattttctcaaaaattgatcattcattttttgtcaattttagcaacgccaaacagaggaagaccaaggaaggccatcgacgaactccaacgcagctcgcgaaaacggttgacggagcagattttggacgccattgatcgggaccgatcgagatcggcaagtcggtgttcactggagcgcatccaccgagaagtccggcacaaatacggccattatacaccaaaaaaaacaccagcgaagaagggcaaagatgaaatggaggccaatgacggcttgcttttgatgacccaacttggaacacagaaagcttatcagcggatgaaagcaacccttcgtctgatccacaaaaaattcgacattttaccgccattaaaaaaggtacatttgggttgatcagaaagtgcaatttggtgttttggttggtcaccctcaaacgccggatttgcgcgccattgcgctacgagcaaattgaaaccaatggaggtgttggctttgtgtgtgctgatgtcagatctgcgcttgagtcccgattttgtgcggccaaagacaatttgatcaattttggcaacaatatttttgtgaaaattagcggcgactacggtcaaagcttcaccaaaattactgtctcctttttccaagctgtgcggtcaaattcgccgtcaaacaattttattgttgctgtttttccggccaaagacagcagagaaaatttggagcggtatggagaggcactttgggggcaaattggtcaaattgaggcgttggcggggaaaacagtgaaatggtagagacgacaaagctaaaccacccacatttcaatttaaaggttcattggtggcgacatcagctttatttggtcattgatcggtcactgcggttcagccgttacaacttttccttccccaatttgcacgtgccgagctgatcagatgcttcatgagcaatgctgccaacacaggacaattgatcaaacagtggaactcgcggaacaataccgcgcagcattgcaaaatggcgacaaggcgactgcagcggttcgatcggcatcaatgggcatcacgaaaccgcctcttctccgttcaattaactttgatcggatcatccctgccccttttcacgtctttcaaggcattggaaatgccattgttcgagaacttgagaggcaggagggatgtgcgccgattgtttcacagttcttcagaaggatcgggggcccgagggaacatttcgaaaaangggattgaccgnncactcatagaaaaaattntggtcgcgcta

SEQ ID NO: 24335 - DNA, 1244 bp, Heterodera glycines
aataaaaatgactctaaataaatgcgggattatattcaaaatacatttatacagtaaatttgtttcattttgtattaacaaaataaatattaataataattaatatatttaaattcttaattttccttatttttatcaaaaacataaacttacattatataaatatatataataatcatatccttgtagaaaataaatatttgaagagaaaaagtaaatttcgagttctaaaaaaatactattaaactacaatttctgtaaataattcaaagagaaaaatttcattatatcattagaaaatgaatgctccaaaaaatggttttattttttaaaaacagaaaataatagggaaaatatacgtaagaatttttaatgaattttgttaagaaaatggccaactgatttttgataaaagtcggtttgtccataaaatttttcaaaaaaaaatcaataaaatcccgcagaatctcgcaaaaaatcaaatttgcggatcccgctgtgtgatttgaactcaaaattctttgcgggacgggatcccgcgggattaatcccgcaaaacccacattttccaaaaaatgcgggattgtggactgggatcccgcaaaactaattaattgttatttctattgaaatgaatttaagtttatattatcttttattattagaataaagcatttttcattgcataaattatttggcaaaatttattttccttatttattctagtcagccatgtgtcaaaatttttttttttaataaataattttaaaattaataaacttttgtatatttttaatgcaaaaaagttctgatttagtctaatttgatttagacttttcttaatattttaaacaaatttacttgtttatgcaactattattatttttgtattacgtattaaacatttatttctagggaaggagtagtaattttttatttatttaaattttataaactattagtgagcatgcataattaaagcaattcatctccaaattttggatcttggacatattaaatttgaatatatttacgtgttatgtatgtgatactaagtaatatgtaaacgtgctgagacgatcctaaaatagtatcaatgtgggcgttcctaaaatagtatcaatgataataattaattaaaataattattattcaattaaaattattaaatttaaattatttttaaataatgtcaaattacagtaaagaattttaacattttgttaaattttttgcataaattt

SEQ ID NO: 24336 - DNA, 1453 bp, Heterodera glycines
  misc_feature (68)..(68): n is a, c, g, or t
tggctggcgtgatctccgcccttctgatgtcttcgccacgatcatcgcctgcggcgttgccggcgttntaagcaaattgacaatgtgaaaataatcggacgacctcaaaaattactgaccagcggagatattttttattttctatcatttatataaaatttattaatattattattttttaattctcattatccatccgtccaaataaatgtcattaatttgcgccaatgccggcggaattcctcgcaacgattgtttccatcgcttttgggtccaacagtgcgtttcgcaatgcgttagtctccttgaaattgtggacaacgaattaaataacatgaaactcatccggattatctatgtgtcagcaaaatggaggcctatgaactaattgtcacagaaaatattcccttaaatatgcctctccccagttgagtgtactgctccaactccttgtgcatggagttggagccgtacagccaccaggagtaaattgaaaatgtataatatagtactagtaaaacacaaaaagattattcgaaaaggagccctaagaatgggtttgaaaaacaaattaaaataatgggcaaaaaagtaaaaaaaataccaaaaggacgtccgccatcatttcgtactgcgcccgctggtgggcggcgtccaacgcgcgcagggcgatgtccgcgtgtccgttgagcagtgcgaaattgactccgttgatggactcgacgagaaatggggacaccacacggatgcgagcctttctacagcaattgagaaggggtacataggaccgctccgtagaatttttaaaaatttaagccaaaaatccccaaaaaagcaattaattggaaaggcaaatcaatgatttttcgaaaaaacaactagtaaatccctactaacttgctgaagtcggcgaacacttcgacggacgctctctcgcgcattacgcgatggcgcagatcgctttcctgaaaggagaagccgctgcggcaaatgtacagcagagaacggcacaacgacggacaaatgacctcgggggccatgtgcgaaatgaaatgggtgacctggttgaggagggaaaacaatttgattgacatttaatttttgtcaatttgcaagaacaaccactcgcatcagccgggtgagcaccgtgaagcgattctcggcgatcatcgagtcaattgccgggtaaggacccaagcggacggtgctggcccttttgctcttaaaatgggggcaaacattggatgcaaatactttcaagactggtgataactatcaagatggcatgatttttgtgcccagtacaggaccataaatgaaaagaaccgggaaaagggagtttatttgccaaattttgaaattcttgaaaattcggactcggaaaattagtaaaattttatacaatacatccaagagaaattttgattaaaaaatggtcatgaattctgctcgc

SEQ ID NO: 24337 - DNA, 1721 bp, Heterodera glycines
ttttcttaattgatcaatccaaacagtcttggtatcaatcgaacaattaaagtttaggaaatttagaaatacaagaaaagagcaaatatttgcatgaacaaaaaaattgcagagaaaacccgaaatcaatcatttttcgagtatatttacgaataattttttgtctgttgtctttatcccagaattttgatatacaaaaacttttgtagtcttcaggctttcgattgataccaagaatgttaggattgatcaattacgaaaaaagttatgacttcttaaagttgtctcagactcagttggccggtcccgaaaaataaagcgtaattaaagctttttaaaaaaggtcgttaaaacatgaaagcatctttttgcatctaaacaccgttataaattcataaaggacttcttcacgttcaacatttacatataacaacacttttccgtgtcgttttgtcgttcacaacaatttacctcataagaaatagaacgccaaaaactgagtatataagcaagcaacttttctcctattttcattttcctcctgccatttcatctctttttcccctgcgtttttaacttccgtaccatgcttcagatgcacacttaatttgtattatatgttttagtttttgtaaacattaacgataatacgcaattattttggctgtatccgaaattctaaaacgtaaaacgtgaatctaaagcagagtttttgccttacaattaagtagtgtgcatctgttatgtccattttcgttaactcatttcattgctccgattccattaaactttaattcattttaattaaacttttaaacttttcaaaaataaaatatagataaactttatcattgttgaacatcggccatcggctaccccacccccagtccgtggacctcccgtggactcatcgatggatcgaccgacgtccggcccgcccttttcaacatttgccataacctttttcttacttgttaatgccacattcctggtatcaaatgaaagcctgattaacaatacaagaaaagaacaaaactgacattaaaagaaaaaaacttcaagctttcagttggtaccaagaatgtagtcattaacaaagtaagaaaaaagttataaccaaagaaactgaagatgtgatcactcctattttacctgttttcaatctttcgtcatcatttttccttcattctgatggaccccaaatttttttcgccacaaaaacggcgatatgtcagaaaaagtgatctgggtttggaaaaggtgtccagggttttagagttttggacatggtcaaccctggttttaggcaatcatggagtttactggttccattttttttgtttttaaaatattagaaacagtgtttgtatggctattttaaggtgctgagcacgaatacggccttatttttgaccaattctgaaccccgaacccggattcgaacatttggtaatagtgtacatggtagcccccccttttaaaaaaagaaaattaaaaatttttttcataaataaagttgtttataggttttcagggtcggaaaacccgattctgacttctaattcgataaaattcgaacccctgacccggattcgaacaaaaattctaaaattctattttcgaaaaaattccaaacatgaaaaataatgcaatgaaataaaacggaaaatctattcataaggaaagatataaatattccgagtatttgaactgtttttttt

SEQ ID NO: 24338 - DNA, 1820 bp, Heterodera glycines
ttttaattagggttcagccccgacatgtttcggggaattacgaaagtcgtaaattgtacttgaaataagatggaattatctttaaatgagtttttaagacttttttattctggactttttctttttgtgtttttttaggctttttatgaaaatttactccccgacgaaggtgttgttccccgacaatttgctccccgagggtcggggctgaaccctatttttaatcaccgatttggtttgttcaatttttgacgtcaaggtccacttcggcataccatgtgggtggaacgagaacagcaattagtgcacagcttggccatccgatgtattggcattgtcattggacggaagttcgacaaaagcaccgccggtacaacggaaaaggcggacacttcgagaacggaaagagcaaattggcgcataggcgaaaagcgaaggtggtcaaaaatggcaacggatcactgagcataggcaaatgtcgtgcaaataaaacccaaaattcgattagaaaatgcaaattaaaggatcaaaagtaaaaaaagaagttaaaatggcaaagtccaatatttcagtcatcaaatcaattaggtaattcattcatttctgttgctgaccatcggatcgggagaagcattgagatgatgaaaacaatattataagtattgtaattgtgatcaaattctcacccatcgtccaaacagatcagcagctgaaaacatttgaatggcattatgacagtttcaaatattccccagtcaattcaatgatcagatcaaatggcaaaacgagtcaatcgatcggagagtacggcggaaaacaaactgaaaagagaaaccaaaagttccactgataaatttaagcattaaaaattttcggcacattatccggacgaggcatatccaaccatttgacaatccgacacattggcattcatcaggctgaaattcggggaaagtgctcattgtgaagagagtaatttggaaagatggacaatcgttgagagtggacggggccaattggcgcataaatgcatcgagattgtgaaagttgccaaattcagttgaagaatggagcgcgaagcattgaccgaatgttgagcacaacgaattcccggaaatttgccatttccttgatgccatacaaccactttttccattaaaaataagacggaagggggaggggtggaaaagagttgaagacgaaaatttcgagagaatgaatggaagaggaggaaaaagtaatgttttatagaaaaaaaaatcataatttaatttttaccatttcattccaaatgatctttgtggttagttaaagcaccactttccattaaaaaattatttagctgctaaaaacgcctctgaggcgcgcaaaacttaaaaagaattagccttcgaattttttctttgttggtaattgtatataagttttttttctttaaagctttaacaataaaatgttagcattttatctgtacataatatgttaatgaaaaatgcacaaaacatttcacaaagtcgattgcaattttgtggcttttagggcattagagctacttcagtcctggtcctgattccataatttttccacaaacttcgagtagtgcattccagaccgagaaacgtcgaatatatatatatatatatatataactttattataggtgtttggttaattttaaaaattggaaatttatgccaaaaatggtcagaaaatataaaattctcccttccgtaattttaagcgctgaacacgaatgagtttaatttttatttatttattgaaaaattaaaaaattaatatttcatacactgacgttgact

SEQ ID NO: 24339 - DNA, 1522 bp, Heterodera glycines
atttcttcccggcattttcgtcccggtcccggtagggctaccgggacccggaaaaacaagcactggtaagaacgggggtctgatgagtgaaaattagaagctttttctaagatattgcttcacgattagacaattaccaaaaaagttttaccgaaaattgcaaaaagttcaaaaaagttgaaattttttcttaaaattttttatatgcaagtaatttttttttgcaatgctaatagaacagttaagagcttccgaatgataccaagattgttggctttggatgacaaattaaaaagttatagcggaaaaacatagggcgggtcgggaccggggcgggaattcccgctcctccgaggtcccgggttttgaaaatctcaggtcccggtcccggtagggcaaccgggaaccggaaaaacaagcactggtaagaatgggggggggggggggggtctgagtgaaaaattagtgatgaaaattggagtcaaaggaaaaaatttaaaaaaaaaaatattctttaaaagtaacattgccaattgtgcaaatggcctactgtttttttaattaacacatttttatcattttttgaagaaaattcgaacaaattgagcatagtaatcccaaaaactacccttttttgttgaaaatctgttaataaattaccctcaaattttcaaaatttcctccggcggcgcctatcggcaccgccggaccccttctttcccaaaaattttttttagaaaaagcgcgccgaaaaaaatgatgtgaaaagcaaatctggatttttaataatattcgatcatttaagtcaaaaagtgattaattgtttgaaataattgaagtaaattcgatttgaaaatttttattaatttagctttaacttttggttttattaaaaaaaacaaaattaaaatttaattttgtattattttcaattgaaataaaataaaattaaattttttttaattttttgaatttttaaaatttcccggttggtccccccggttcccggtcccgaagaaaaatcgaggtcccggtcccggctttgcctaaaattcccggtcccgcttcactctactaataatgatcaatatggattttgttttttataatttacctataattagatatattttttaaatcgttccaattcaaacatcccaaaaatcactgagagatatttaagtaaatccccaaaattgaatgttcagaggatatcgaaacaaactttctcgctctctcctcttcttaaatcattccggatttaaaaaaaaaatctttattaaataaacaattcatttacaacgcctagagaaatacgggcgttacttgcaaatttggctcctttgaattttatttaaatcgttgtcagcaactcagaaaattatcgaaaaaagaatttggtactttcccgtttttggtcgcacacaccaaacaaagtgtataaaaaggcgcacaaattcacacaactcactcatattctctagctaatccatttgactcattttgttcaacaattgttgca

SEQ ID NO: 24340 - DNA, 957 bp, Heterodera glycines
ttgagtaccccaaacggacacttgaaaaaatcgatttttttgttttcggggcagtccccccgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgattttttttgttttcggggcagtccccccgaaccgatgcgcccagatttatggggagaccgaatccttccggagtagcttccctatagcctgtactttaattctgcgttggatttttgctccccataattgtttgagtaccccaaacggacacttgaaaaaatcgatttttttgttttcggggcagtccccccgaaccgatgcgcccagaatttatggggaaaacgaatccttcgggatacctttcccatagtctggaatttaatt

SEQ ID NO: 24341 - DNA, 1412 bp, Heterodera glycines
tttcagagcagtttctgtaaaatacttatgaattaattttgtaaaaaaataaataaataatgaaccctcctccttaataattttcctgcgcccaaggtactcactcggccgcttcgcggcctcgtgggggaactaaagatttttataaagttattcttctccctgtttgatataataagcaacaaagtgcctaaactagcatgtaaatgaaatttggtgggaatcagagcattttctgagggaaatatgaatgaattaattatgcaaaaataaataaaaatttcgaaaaatttgatcgtccataaataatttgtaattgatcaggggctcaccaaattttgcagggatacgtatctggaacactacaaatgcttactaattttcctagattttttaaacccggtgaaaattttttgcagacaccaccacttttgcacttaaaaaaatttcaaaaaactttaaaaattcatagaaaatttaaattcataggtactactgctaaatcaacgcagagacgcctttccttgacctttttaggcccctgcaaaatctggttcgcttctgatcactactcgaaaaatgagtgattgaattttcactaaaaagttaagcctaaactttttggcctgtttaaaaaggaattaaaaatttttaaaaattttattcatctccctttttgatagaaaaagcataagagtgcctaaactaacatgtaaataaaatttggtgcgtttcagaaccctttctgaaaaaaatatttatgaattaattatgcaaaaaataaataaataatgaactctcttccttaataattttcctgcaccgaaggtactcactcggccgcttcgcgggctctcgtgctgatatattcttatatttcaacgaacacaaaaaatatttcgtctaattttttaaagtccaagtatatatatatatatcaggggtgggacaactctcgcctctcgtctctcgcctctcgccaactctcgccatttttggtactctcgcctctcgtctctcgcctctcgttttttgggacgagaggcgagagttgaaaatacacccctaaagattgaacttttgagcagccagaaaaattttcaaatttacgcgaaaaaaaaatcttaaatctctttctttccttccttaatgttttctctatttttggatagctccaattcaaatatggtctgctggctaaaccttctgcctttcattatttttctcttgggttcaattccccaacggtacagaatttttttaataatttctttaaattattttcaattgaaattttaattaataaaaaatatttcaatttaaaaattattattttttctttttttaaacagcctaaaactgcaaatttaaagaaaactttgatcattttttgacaagttctgttaatatat

SEQ ID NO: 24342 - DNA, 1081 bp, Heterodera glycines
tctgcagcccttccagtataggtagaggcctggaattttttttgaaaattagaaaacacttcaacttaaaatcctaccagcaagaattttccgctccctgtcctttaaaaaaagttacgggccttcaaacgcaagcaaaagtgagaaattagccgccgggactcagttggccaccggagcaaaaaacctatagttttcccagatgcgcctcaaaaagttgtaagacccttccactactttcagggcgctcccggccttcggccgggagccttaatttttttaatgagtccccctttttctctatatatatataaactagggtagccagttggctttaaagtagaaaaaatacttctggaaccacaatataatcggtattgacataagcgcttcgcgcaaaggacttcgttgctagttcttgcgcggacatgaggccagtttattaaccgtcattagcggttggacaattatttctcctaaatataaattgtccaacccccagggtccaccacgcggaggagcacggtggaaaactggcaaaaaccatggaccccactcgccgggggtgtgttattttttactgtaatttgttaatttatttttaatttttagtgcccccggcgaggagctaagctctgaagatttggcggcacttcccgcgttaccagggctcctcgcattttaagggtggcggcacttcctgcattaccggggctcctcgcactttaagggtggcggtacctcccgcgttaccggggctcctcgcactttaagggtggcggtacctcccgcgttaccggggctcctcgcactttaagggtggcggtacctcccgcattaccggggctcctcgcactttaaagggtggcggtacctcccgcattaccggggctcctcgcactttaagggtggcggtacctcccgcattaccggggctcctcgcactttaagggtggcggtacctcccgcattaccggggatcctcgcactttaagggtggcgttacctcccgcattaccggggctcctcgcacttttaggggggcggtacctcccgcgttaccggggctcctcgcacttta

SEQ ID NO: 24343 - DNA, 1900 bp, Heterodera glycines
ggctcggcatagggattgactttcgctggtgcccgtgatgatgttgtttggcctcatctattcaacaatcatcgtcacttccattcttggcaatttgcttgtgattatcagcgtgttccgttaccgatcactgcaatcagtgcgaaatatgtaagaattttaaaatttaattattttttaaaattattttttttcaattttaggtttatcgtgtctttgtctgtgtcggacattgttgtttccatagtgtccggcacaattactgtaagttgactaaaaattcatttatgtataaaatatgcaaaatatataagtaattaataaaataattaaaaaaataatatgatagcatctttaagccaattaatgccttctcaaaaatttggttgtttggcgaattgttatgcaaattagtgcccgtcattcaggtatttttttttttcttaaaagtataaattgctcatctcaaattagaatatgattttatttatgagatgcaaagaaattaaaaattattcataattatttatagaaaatcatttgaaaaaaaaacaaataaaaataggggtttttggaaaaaatattaatattcataaatttctttttttgagaaaaaattcatcccacaaataaaatttatttatatgtccaattttttttcttaatttaaaaattaattccaaataaactcttaagaatttaaatattttaaaagttaagccaaataaattcaacggcatgaattttaatgaatttaaattattttaaatttaatccaaattttagggtgtaagcctttgcttctccacgctgactctaagcgcaatctcaattgaccgttttcggcttattgtgacgccacttcgacaatcaattcagaagcgttgtgcatgccgtattgtggcacttaacactgccatttcactgatcatatcgtatgataattaaaaaaaaagtacggtatttttaattaatttattttttcttagacttccgatgctgttcacacaaaaattggacacctatcatcgtttttgtggccaattttgcagcgaatattggggcagcgaactcggcgcaatggcccgaagtgcatacggtaatatattcggcggatttttgtacttaccgtaactcagcagacaaaacattaaaatttttactattaattttcaaatgacgctaaaataaatggaaaattaagcatttgttttttgcatagaaataagacttatgataattatggaacccttgaatactgtaagaaaataccgtataacttttaaaccttttatcgtatttttgacataaatttcccaaatagcgaaatctaaataaaattatattcaaaattattgaaattaattcttaaggaacgtttgtgttttttgctcaatttgtgatcccgtttctgatcatttccacttgctacgtgatgatttcaattaaaataaacacggtaattttttttaataaattaattattttataattttaaatttataaataaattatttccataattaagggtgttctgacaaagcgcacatcaaccgacataacaaaattcaatgacatgagcacaagcggcagcaaaatgacaaatttaagtgaaatgaggtggtaaagaaaattattgcatcaaaaatattataaaaaaataaaaaaaatttttgttttaattaggcatttgaaatttattttttaaaaaaaaatcaattttaattaaaaaacaattaagaaccggtgcacggctttcatcagttggcaatgaggaatgcacaatgctgttgactattaatggcacaaatagtgccaatgacgcactacaaatagccatggagcagaagaaagccatactgaacagacggcttaggaccaaccgaatgctaataggtag

SEQ ID NO: 24344 - DNA, 1768 bp, Heterodera glycines
ttgataaggtaaaaagaatttaaataaaatggcaccgctcagattcggcaccaaatcttttaagccgagtatgcaaatgccgtgccgttgaataccactttggcacaattcactgacgagtctttgccaaagagtcattctccaatagggaatagaagattattaaattgaaaaatgtaattatttcttccaattaatcacctcgtgaatccaggggccaatgccttgtcaaaacatttcccagtaaaccctcccggcgctcccataaattcatttgcggccaaagtttgaataaaatattcatcacttgcgtaatcaaaactaaatgccgcagatatttataaaaatatttttttaaatttttacaaatttaatttgtcgagcataatcgaaacttccaaatcattcaaaagccattcgacaaattctcttgacaaactcatctcaaattgacctttgttctttttcagctttttgttggctttgtttttcgtctctaaagaaaataaatacaattaaattataaaaaacaaaacaattaaatattttaatgcggtgactcaccatttttgaacagtttcaaagtgctcaatgaccattcgtccccctcctcaaaacgaatgtgtgttgaaccaatgcgcgtgtactgaatgtcactgacgccgttcatccatttgaatatttggaccatttcgtcgtttgtcttcatttgtacgtcatcattctgagggggagggaatggcaaaagccaattttaaattgtaaaaataaaaaacgaataaaaagcggagtttgcgcctgtaaaaggatggcatatttccatttttccatttctttggccaccaaaagtttcatacattccatcgacgatttcatctcaaatggatgaatccatgagaacatcagcagcaaatgcgagcagtacaaatggacgaaactcacaagattatgccctttgctgtccatggcatattccttttcacttggaacgacaaaaacatttgggaaacaaattgccaatgcgtgaatttgccgatggaatgtttccgacgactttttgtcgatggcatagcaatagtaattttggggcgcatagcttgaagcgaattccatttcaatgaacaaatagtcctaaaggagagcaaacactgagaatataaaaaaatattctaacttcttaagtccaaatgccgatcgaataacttttttactaagagggaggggagaaacgggaatagtgcggggggggactaatagtttagcggagaactgatctgggaaagaaagccggtccgaatggaggggggggggcaaatgccaatgccgttgtgtctgttctgtccgtcggtccgttcaccttgtacactaatcggatgaatgccaatggaaagtccgtcttattccctttctcgtttttgtacttttgctccgcgaagtcaaagtaagggtaacgggaacggatggtcgcgcagtcgatcgccaaggtacttcccgcgttagcaaaggtcagcggctcggactgagtgcgctcctcaatgtaagcgctgtcattggccaacacgcggccacaatcgatgtccgacagtttgagccacttggattggccacgatcggggggctaatagacaaaaaaaccattatgccatcaaatcttccgactaatcaccactccccaaatttgcgtcattcgcaaacttcggtccgttttgctcaaatccaacggcgtttcaaaaatatattccaacgcgcggttttcgtagtcctccgt

SEQ ID NO: 24345 - DNA, 1925 bp, Heterodera glycines
tccttcaatcgactttcgtgaatttttcgccaccattcaagatactgaacagctcctcggggcgtgggagagggtattggtgtacatccaaccaaggatttaccgtgactttatagtcaaagcacaaccgcagcttgccatttgcctttggtaccatgaccagcgaagtggcccattcactggttgccactggctctatgattttctccgcctgccattggtccaaaactttttcaacttcattccgaagtgaaaatggcaccagtcttggcttgcatcgcttcggttggcatccctccttgaatttcaatgacgcaatctttttgcatcgtccgactccgtcctggaaaacctccggatattgggccaaacatgcttccaattcctttttgttttcaacggcacgaattgtcggaattccgaaagctcggttcagatcgattttcagtcccatgatcaaattgcggccgcacaaatttttgtgcttaccacttatgacatgaatattggactcaatccgctgtcatactcaaactccaactttccattgtgaatgttgagttgaatgaaaccaggatcggcagaaattcccttgatttcgtgaatgacgttgacatttgaacattcaatgttcttgatttgtcgtccgttggtctttgacatttgcaaaatgtcccggttttccgcaccaaaagcaacttctcgtgcttttcgtcggcgttcttggtcctctttgctgattgccaactttcgcgacctccggcattgcatttgagccaattgcttgggcatccaaattggactgctccaacaaaacggctgattcgactgcgtccttgaattttaggtccttgtcgccctttttgattaattcaacccgaattgcatcatttgagatgtcattgatgaacaactcggatcaaattcaagatgctgctgatcaactgtaatccgacttggatttacagtgatgtcaattgttatccgaaccggattaacaatgaaaattggtgctggtcaactgttattcaactcgaattaacagtgccactcagctttcagccttgtctaccaatcaaatttatcctcttgctctgttcggcctcgatcaaaattacaattgttatccgtctcggattaacaattcaattcctccaaattcggcgattcgtcgctggctgttatccgtcccggattaacaccagtaattgagaatgccaccacctgggtgaacagctattcaaactcggaattagcttactctccttcgacgatttttggaaaattgctattccgtcccggaattagtaatccaaatttggtgcttttttagcccgttcgccgctcagcttctcttcagtttgcctttgctctgccggctgcgccaaaatctgttgtgtccgagaacaacagatatgaataaaacaaatatttatttgaagcacaaatataataataaaatggtcaaggcgaagggaattgcaatgggaggaataaatgacagaatgaacgagggagggaaggaaagcatcgcttatatgtggggaggaacagtgcctaagggaaaggagtgaacaaagttcactccacttattgattggtctctcaacaccacaaaaaggtattgcaaatcttgcaggatccctcacaaaaataatacaattcaagtttttgaaaaacaaattttttatctggaaaaacatttaattaattttttttatttttttcgggatgggatttagggaaaacggtggagatgggtcaaatggacacccttttttcgtgtctttcgaaagctaaaggaataaaataaattctaagttttttagggaatttaccaacctattcgaacccgaaatgatgccaaatgagtcgaacttttagtaagaacttcgattgctccatgccaatgccaattcgactga

SEQ ID NO: 24346 - DNA, 1043 bp, Heterodera glycines
ctcgtttttcctcttaagcttttttctttgacttccaaatccaacaatcttggtatcattcgaaagctcttaacatgctctattagccttatcaaaaacgaaaagtttttcaagcctgtaaaaattttattaagaaaaaacttcaaaaattttgacttttcgcaattttcatgcataactgttttgataattgtctaatcgcaaagcaatagcttagaaaaagcttctaaatagattaagctttcgaacgacaccaacaatgttgaatttggtttacaaagaaaaaagttatagccaaaaagatgctggcgccgaaacgggagcgccgaaacgcagtggacccttaattacatcaacataacattatgccatcaacgtaatatcaacgctatttttaaaattggtatcattttttgaaaattaaaacaatttttaaaaaatgacttttggcggaaaaaatggggagagagataacgcaaaagtgagagggtgttaaattcagccccagccatacaaaaatattctagctgcagaacaaagacaccagcaataatttcgggttttttctttaaaaatgtcaaattttcttgacttatttaggtattcttgcaccgttttctgttcgtgattttctttccgagttgtcagaccatcctttctctgttgctggatatcatgagtcattttaaagtgaaaatcaaggaccgaatggagaaacaattttttggaattattactggtcaattgttgcgccgtctcccagaacaaaaagaacacatgttgaaaaatgctttcacggtagattgagcagaaatctttttaaatatacaaattttcagtcattctacaaaacaactttggattatgtcgccaaatggtttcgcaccgaacgttatccggatcatattcaatggcttttgcttacagatcggcaattagtccatgagaatctcattgaattggcatcgactttttgtcctgatttgtccgatactttattcgatgaaattagtcaagtcaaccacattttgaacaacaccgat

SEQ ID NO: 24347 - DNA, 1389 bp, Heterodera glycines
tcatcatcttttatacttaaaatgccaatttcaaatgaaaaacagagaaaggaaaccaaaggcatgccaaatgttcaactctttgtttctcaattattaacctaaaacgctttaatactctttttttgggctcatccttgtgctaagtttggttactttttctgccttttgtctcccaatttctctctttttctctttcattcgcttttttgcgcccaaatatttgcggggggggggaaatgaaaggcgcagccgacgaaactttgtgttggccaacagcagcagcaaatcgtaccgatttttgtgctccttttatcccatcctttcccaaaccgagtaaaagtgaaagttggccgaggaagggataaaatgaataaaaagcggagaattagaaaagaaagattcataggggggaaagggggaaaaaggggggagggaagggtgatcgatcggtgatcatccaattgagttggagggcgctgaaatttgaatttggtggaacgtttacagccaaaggaatgcttcgtgccttttcccttttccattcattgccatttttcattcggttcattaaggaaaaacaaatttcattcttcccacaatttgtcatcactttgagcagaaaagacggggatttttaatgacttaagcatttcattaattagacaaatacaataaaatgtattttggaaaacgaaaaaaagacctacatacattaaaaaaatatatatatatatataataaataatcatttttaggacctttccgatgtctcgggtttgcctcgtgcacaaaaacgaatcctttggattggaaatgagcaaatttcggccgggcattctttgccggtttccaaaagtctgaaaaaactgtttaaaaattatatttaattaaaaataatttatatattttttaatttatttttacagtcacctaacaatgcctgttgggccatgaggaatgactaaggtgaccgaaaccgcatcatgtgccttttcggcattcattgcagcaacaatgccaagcatttcacctgtgagttaaatggggtgaacagaggaggggggacatatttttctaattgattattttggggatattttggcatctctgaatcagtgacggtttcagtacgggatatcggcttggagaggcttaggagtacccgaatatgaccattttttttcttttgctcttcagaacgccaaattttcctctctatttttaaacttttttggggagtgaggtcagtgcattttgtacctcatcgcccatttttgaatttttcacaaatctggaaatcaggtttccgacagtttacgggatcactgaacatgaagttaacatcacacatttcgaccaattccggaccccgaaaagaatcaaaag

SEQ ID NO: 24348 - DNA, 1964 bp, Heterodera glycines
tttggctcgaatggcacttgtgctgcatggatctttgctgagggagagcgcgctttcctttaggatttggtatttgcggcactcttctcctagctcttgcagtgaggttaaccgtccgctcgttcgaatgtcttccaaacgctgaaggcatttttgcctcagatcggtgaattcgtcgtgcaatgcaatgatgagaatcatgcatttaagctcctctttgctcagcgaaagatctgcgttttcgcaggacgagttgatttgtgcaatcaaacttggaacgtcctgttgcgcttcttgacgaatttggaagcaatcaaaacgacggagaaacaatgatcgggtttctccaaaaaattgtttcaattttgcggtcgtctcatcccaattgaagtcgttctgcgtctttggtgcgatgctgtcgcagtaccgcttgtactccgcttcgcccaattttccaatcaatagttggacttttgactggtcgctgagtgcttgtccatcctgggcgatggtctgcccatagcgcttgagccaaacgtcgtatgtatgccctaactcagggtcatactcaaatgtcgaaaggcgcgcatcgattgatgtcgccaatgccgcagaattgttgacttgtccaaccgatgccttcaaaacagcctccaaaatcagtttaagctgattggggtccatcaaatttgtttagccaaccggcttttgaagaacttgtcgagccgacccggcttttgttgaattttgatgagccgacccggctttagaagaataagcagttcttttgcctgttttttttgacgaaattgacgagccaacccggcttttgtcgaatttttgctgagccgacccggcttttgacgaattttgatgagccgactcggctttaaacgctagcagtttcttttactgctttttgaaaaatggccgactcggctttaacaaaactcagagccaatcccggctttttgatgagttgttttgccgtatcggcttttggtccttaaacaaaatttgatgcctttttctcacccgaagatgtagagcaggtcctttgtttctgactgcgccaaattgttgtgtatttgctacaacaataaaaatgtttggtttttaaccaaagcaaatgttgtccaataaataaataaataatttattaaacaaataaatattgaggacagcagggaataaataaataaaataatgaaatggtggaatgaatgggagaatgccctgagtgagggaaaaggagacatatttatggggctggtcaaggggcggggcgagagacaataagagagggagtgaaagggaaaatataatcaatagggttgttcccttatccaacaggtcggtacttttagtgacggaaaatctcgaaatagttaactaaaatagtgagtaaaaatcccaaaaatagtgccaaaaagtccgaaatagtgacgaatagtgacataattttcagccaaaaataatttttattcactgattgcagttgcaaatgagtaggactggaatttttaagatcaaaaaacccaaaatagttacctaaaaaaattttttaaattaaaaatttttgccaagaaagtaaatttttgagaaaaattttttttcatttcataggagtatattttgaaaaattttagcttgattcttaggggtgtatttttttgaaaattttttagaccgattcttaggggtatattttttggttttattgcatttttgttaaggaattttccaaaaaatgtcgaaatagtgaaaaaaatagtgacaaaacgccaaaataatgatttttaactattttagtgacaaaaccccaaaatagtgatttctagtgactgataatgacatcagaatcgaaaaattttaatgcagaaatgcgttttttgagctcctttcttcaaatcaattgagcaaaaaatttagttaaaacctaaaattcccatccctactgatca

SEQ ID NO: 24349 - DNA, 2420 bp, Heterodera glycines
  misc_feature (19)..(19): n is a, c, g, or t
  misc_feature (2410)..(2411): n is a, c, g, or t
tattaattcattactaatntgagaataattagtaattgaaaattaaaaaataattagtaattgaaaatttaaaatattttaacttaaaattttttaaacatttaattaaaataaaaacttattacttaaaaactttcaaatttatttttaaaaacttttagtagcaattagcaacggcactaatggaatcactgcaacgccgcggggatcacgcgacgaaagtgcgacaacaaaacgcagacgaatagccgccagggatgactccgcggcacggaaagaggaacaactgcagcaacaatcacaacagcatacggtagcaacaagcgcagcgattgttacggctggtggcgacgctggcggcacggcgactacggtagcggcgttgcagcagcagacgaccattgtgtacggtagtgccatggaggccaagacgtcgctgaacgccacgcaacaacagcagcagcatacacagcaaaagccacaacaacaacaacaaatggtggtggacggtaagtcaagtttgcttactgtatcccagccgagactcttgagcattatttactattaaaagaactactgtttttgtatttttcggaataccgcagggttaaaaattgtatattacagtatgcctcgaacaaaaactattcaaaagcatttactgtacttgtagggctaccgtacaagcgaaagtactttaaattatctgtacagtgcgacagtatacctagacagacgtctcacaattagcattatttttcggggttacagtatacgaccataaaccaagttttgctcgtgttcagatctgcccactttgcgccgtgagctggaacgaccgccggcgattgtaaatgccgccgcagccgcaatggccgtcgccggcacggcgtcagtgccgtcctcctcctcctcgtcgtcgtcgtcgccatgcgttggccaagcagcgactgtgccatccacggcgaccacggcacaacagcagcacaatcatcaccaacaatcgctgccactgtcatcgctgcactcgcagcagcaacaacagcagcgagtgtcgtcctcgtcgacgtcgtcgctgtcgtcgctccgtgaactgctcgcccggccgcccattctgcacgtggtggtacaacagcaacaccaccaccaacaaacgcatgttgcctcaactggtgcagcagatgttgctgcttttgttgaagaacaaccgctgaatttgtgcgtgcgtgaccaatgaatgatgtggcaccgtaatgccaagaaaaaaaatgggtcacgccaaatttaaaaatgcctaacaaagtgccacaaattggcgatgactacaatgtgtcgattatggtagcaattggccccttcaaattgtggaatttgttttgtttatttaaattgtattgttttttggcatttcgtttgtttttttgtgtcttttcgaccttttcttttaatatttaggtgcattttttgtatatattatattaatattattatatttaacatatacataaatagcatatgttgtgatttattttttatttctatctttgtttactaaaaaagacaaataaaatttgaattggaattggagctggtggtgatcataacaaaatcatagaaaatgccgaaatttccctgtaaattcaattaaaaatttatccaaaaataccaaaaaagcgtaaaaatccaaaatagaaaaaaaaatatattgaaaaaatttcaaaagatacattttgtatggcaaaataacatcaaaatttgaaaacaaaaatgccaaaattatccttttagtaaatatttttaatgcaaatcaattgcattaaaaaatgtttttaatctaaagaaattgaaaaaaacattttatgaaaatgccaaaaaataaatttgatcaaactcggacccaatcggcagagtttaacaaattcattcatccacaaagtcggacggacaaagcccgcaaaaattctttgctgacaaccgaaaacaactgttcattgtttgccttaaaaaaggcacggaagttgtcgatattcaaattcaaaaaataattctaaaagtgggaatttaattaaaatttattttttaaatttaaagcttaagtggaaaaaagagctggcgccgaaacgggagcgccgaaacgcgtgggtccccaataataattaccccttctgaaaataaataattttaaccaaaaagaggaaaaacaaaacaattctctcataaaaaataggaaatgccaaaatcaatttgatcaaagccggaaccaatcagcagaatttaacaaattcatccacaaagtcggacggacaaaacacacaaaaattctttactgatcttaggaaaaaactgttcattgttcgcaacgaaaaaggcacggaattcgtcaacatcaaaatgcaaaaaataattctannagtggaaaa

SEQ ID NO: 24350 - DNA, 1458 bp, Heterodera glycines
agaggttcaatagtgatcagaagaggtacaactgtgataaaaagggtacaaaagtgatttgaagaggtacatcagtgattagtaaaggtacaacagtgatcagaagaggtacaactgtgataaaaagggtacaaaagtgatttgaagaggtacatcagtgattcgtaaaggtacatcagtgattcgtaaaggtacaacagtgattagaagaggtacaacagtgattagaagaggtacaaaagtgattaaaagaggtacaacagtgattaaaagaggtacaaaagtgattagaagaggtacaacagtgattagaagaggtacaaaagtgattaaaagaggtacaacagtgattaaaagaggtacaaaagtgattagaaaggtacaacagtgattagaagaggtacaaaagtctaacttgttatgagatgtacaaaaataatttcataattttaaatataattttatagaattaggtttatttaaaaattttaaaaaaacaaaataataaaaaatgtaaaagtttattttttaattaataaacggaataatttattttactttattttgaaatgaattattatgcatccaaatttttaaatctaattttgcttaaaaataaatctatttttcaaaagaaaaattaaatttaattaaaataattttgttaataataataaaacaaaaaataatttctttaattaaaaaaaaaaataaatttaaataatttaaaacaaatcttcaaattaattataaacagtgaaaataacccaaaaatgcatagaaaaataatgtacaccgtccgggtccgaacctgccgcccccccccctcctcataagggtgcctcagaatccccaatcacacagggattctgaggtcttgacgatgtcaaaagtaaaatctgatcacgtattcgtgatcagcggcccaaataacccctaaagacatattttttgaagatttttggtgaaaaaatttttcaactcaaaaatcctatgctcacccctttggtccataatcccaaaatcggttttatttttgtaacaattcgtaagaaagtgataaaaatgtaaaataaaatttatattataaagaaaaaaattgcggatttttgtagtattttaattttcaaaaatttcttttcagaagggggttatgaatttttttctgaaaaatcgaaaattttcagaaattctggaataacttgttttctttttaagatagaaatcccaaataaatcccataaaattctcctgatttttctctatttttataatataattgcacgaaaattgatccacccttcgatttgttatgaattttcaaatattaggccaaaatcccgagggccaaaaaattgccaaaaaataaagaatttttaaaaagttccaaaaattatgaaacttaaaatagacatcatataggagatcagcaccttattttaccccagaaaaatattt

SEQ ID NO: 24351 - DNA, 2071 bp, Heterodera glycines
attggcaatgaatgattggcaatttctgctgctgatgaagtgatcggacgttgtgtctttgggcaaaggaaaatgggcggacggatgacatttcaacggccactgctgttcaatcggatgatcagcagaggagggatcatcttcacccaactgcagcagaaggggcgataaatacgggtgcgatgggatggatttggcaacgaaaggggcgagcggcggaggaggcctatcaccccggggcatccatccatcgatgggttggccaattccgtctgccgatgatctcccatcaaaaatcatttaaattcctatggatggattgtcccatccctctcaaatgcccccccccctcccaaaataccataactttaatctctgtcctccttttccgacctccgttcccccttaggttcatccaatctctccccaatggcacttccgccggcgatttgacccttcttcgtttcgcttctcactttttgttttccgttcgttttctgtccgacttgaagccaaacacaaaatgaagcgaatgcttttcaccgccgccgccatcttcgccttcctcacgacgttcgcactgatcgctctgatcttctaccaattgttccgtccgatcagtcgtcggtcgtcccaatcggacgcagcggtcattggggtcagttggcttatgattgtcgagaatgggcttgctttttgggtgatcagtcggttcattcgcttttaaaccctgctgctgaccttccaactttgcagcattcggccggtctttcgtctttttccgattccccaccgcccacaaccgatgcatttccctccactttattgccctccgtcccttttccgtccccccatttgtcgcctcaacggaatttgtcaaatcttcgtaaggcgcgggacgacaaagaaagggcgcttcttttggtgcgaagtgtgaatttgaacccgaactcaacttggagcgcacagctaaacaaattcgccattgggtgggcatttctctaattgtgcccgaggcgaattgctggggatgaaaagcgcaatttggaattttgcaaatttctcagattgaaacccctcagcgaaatgctcaacttttcccataattttgacccactgaacaccacttttatgatggcacccaatcgtttgaatgcaattgaagagctcgtgttgaaggtgtccatttggctctcatttcgctgaccttcgtcctttccccaggagttccaaccattgtatgatcagcatctgatcggtttgaccaatcaattgaaagaccctttgccggtccgattcaattcggcacagcgttggccaaactgtgcccagtccattctgcgggttcgggaccaaggcggctgtggctcgtgttgggttagtaaagtgatggtgatcaaatgctaagtgcttgacttttttgcctctgaaggccgtagcagcggtgtcggtgatgtccgatcggatttgcattgcctccggcggccatttggtcgaaagtctgtcggcacagcaactgatcgaatgctgtgactattgtggagggtaatttagctattcaattatgtattatcgtcattcagccgatcgatcaatatgaaactctgatcagctgatcatctctttccttctcagctgcaccggtgcccccaactccttcttccccttcctctattggcaacagtacggcattttgtccgatcgctgctttccctacacaattgcgcgcgactgtggctacccgtgccctccgacagagtttgagcatccgcgcggagttggcaattgttcatgcggggcaaaacaatgtgtggacagacaaatgaagccgatcagacacaaaggtgggtggacgaagagaaagggagaaaaagggggagagagagagaaacagaaaaacagaggtaagagaaagggagagaaagggggagagagagagaaacagaggtaagagaaagggagagaaagttcagaaatgggtcggagaactgacccaaaatcatttaacttttgttaatgctttccaagtccatccatcaaaataatcctaatttatgctaataagattttt

SEQ ID NO: 24352 - DNA, 1669 bp, Heterodera glycines
  misc_feature (1658)..(1658): n is a, c, g, or t
cgtccaaccgtatgataaagctaagcgaactcaagtgcataaaatatacgtaaatgggttcataaattgagtttcatttttcgactcgctaaattttccctttggtgttggaatacgccgtagttctttgacatcagcaaaaaaggatgagttgaacattattaaagttaaaagcttagatatttgaaatggaaattttaaagcagaaaaaatgtacatggcttaaaccaagttttttcatgacacatttcaacaaaaaatttatttcattaataaggcggtgggtattctggaaaatcatcaaattcttctggttcttcttcttttgtccaataataccatgctgcacaaagagatattgaagataaaatagccaattgaaaagaattaaaaaaatatattttaaattcaccaaaaaaatttcaattttcgtcaatcaccgaaatcccggacaaccctaataaatacggtttaaatgctatacccaccagctggcgcaattgctccaggcgttgcacattttgttgctgctgatgctgctgctccaacgagcggcacgactcatggaggatttcagaaagctgctgcggcggttgctgctgcggcggtttctgctgctgcggtggttgctgctgcggcggttgctgctgctgcggtggttgctgctgctgcggtggttgctgctgctgcggtggttgctgctgctgcggttgctgctgctgctgcggttgctgctgctgctgcggttgctgctgctgctgcggttgctgctgctgcggtggttgctgctgcagttgctgctgctgccggaagcgcttctgccgcaagcgctcttgttgttccataaacagtagagtaagttcacattgtgtcagacactctcctttagcaaacttctgtcgcgcttcttcgagtctatgctgatgatgcggttgcagtccaatttcttttaactctttacacatgcgggcctcatagttaagtttcttctcaattttgtcaagcacatttgcttcactcatcaggtgatgctgctgctgctccaacgggaggcccgactcccggaggagttcaggtcctgaaggccgctgctgctgctgctgcgtctttcgcaattgaagatttattggttttctactatatactttgacaacgcagtgttcagcatgcaatttctaaatgcagacaaaaataataggcttaaattcacattttttcgccgcgcgggcttaatttttaaggaaaaattaggcggtgccgagatgcggctcctggaaatatttttgaaaaatttttgagaaaaaaatgaacaaattcatggtttttcaaatctcaaatacagcacaaatctgaagaatccgcctacttggaagcacttgatttcatcaaaaatagcaaaattttaccatttggggcgctttgtttggcccaatttctcaaaaattagaaaaagatggatcagcgactccgaaaaataggatttttgagtgaaaacagattgtaccaaaaagcattttccacttagtctgagattgtgtaaataagtctcgaacagtatcgaacaccgtgaccaaaagcccaagaccgacataaaaaataagaaacttttccccgagagtctcgagcatacaattgaccctcctcccacttgcgaaggngtctccccatt

SEQ ID NO: 24353 - DNA, 1125 bp, Heterodera glycines
tttttttttatagcagtctttacaggaaattaatcggattatgggaggcgccattcgacaaaagcgaatcgcacaaatataaggcatgaaaaaatttttcaaattcgtaatagttttttttaggattttccgaaaaaatcgcaaagggttgcattgatcgtttggcttatcggagcgaggaagtatttttacagggaattcgcatcatcattacgattaattaattcaacgcacagagacaaaattgtgggggtgaaaaataaaatttgaaaataattatttaaatttattagtttttatttattaagaatactttgttaattgactctgatcgaattgagcaatggaaggaagaaatgaatttggtgttttttgcagtcgaaatgacttttgccccgctaattggcggcaatgttttggatcgatcggaattgttgaagcaaacagcgcagcagcagaacatcgtgtgcctgatcaaggagaaggcggaaagactggacttgaagcaaattgtgtggctgaccaatgcaacaattgcgtcacggcaagtttaaagcttcaaagctaatctcacacatgcattttccaaatcgatcatcagattcggccaatcatttcaaatcagtgattttgtgaactctatggttttttagagaccgagccatgtcgattttcggggcccggcaaaccggttcgggaattttggaaaaatccagtttgaccaattttagaaagggatccgggatcagatttttttttgaaaatgtccgacccgaaaaattaaaaatcgccgaatcggttttgccgggcccggcttttccgggtccgactaggtctctaatttttttccaattttggcataacttttcgtaactttaattaagtaagctaaaattaaatttcgatggaacatttcgtcgaatatatcaaatatttgttttttgattagaaatttgctttttatttaatataaaaataatgaacaactaaattgctttattgtttttttcaccttgaagagtgagttatgccataacatttaaacaaataatgtccactgcactcgaagaattcagggcaagtattcggatcaaatatgtccgatttcatatttcatgccatatt

SEQ ID NO: 24354 - DNA, 994 bp, Heterodera glycines
tgtccgtttcccaaaatatccgatccctcctaggattttaagttggagggtgcctaagatagaaagaaatctagacttctatcaaacagacttaaatttcgccagtgaaactgcctcaaatttgaaaatataataattattttgcgaaatgcctttaatccaaagtttgcggttcgagatgttgcacaagcgtcagattgaaaaagaaaagcttcacaacaaatataccaaaatttaattttactttcacatataaatttgctatcgaaatttataaagttaacaaaaaatttatacagtttagaattttttccattcctttttcaccttgtaagttgaaaacataccgttattagattttcagggtcgctgatctcgaatccggcatccatttcaaacaatttgcgaccctggaccgatctcgaataaaaaccagaaattcacttttcactataattcagagcaacgactggtgaactcgattataggcatttggcggacgcttgttatattacacaaattttgaaaagtccggttccggcgggtgcccggcaaaattttgaaccgggacgcccggcaaatgggcgttttttgaacgggcggcccggctccggtcaattgtctgatcgcggttccggttccgctacttcggtctctgcttactatataagtatttatgaaaattaggttttcaaccaaatatttattcaaatatatagtttcaaaatctaaatcacgttagcaattatttaattgaaccgttaaaaaataccgaatccctaaaactcgaaccaagggttgaaactcctttgttgaattttacattcgaggttcatataaaattagggatgatatttttaaggtgcgaaaaactgccaaaattagttagtttttggttataaaaaacccccaaaataggtgctaaaaatgggaaaacaggtgtcataaagtccaaatttagtagagtgtaaaatcgtaaaatttatccaaaaag

SEQ ID NO: 24355 - DNA, 1066 bp, Heterodera glycines
attttagcactatgatgctttagtatcaaaaaggaagatggagaaaaaattttttaaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggaggggggggggggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttaggccgcgaagcggccgagtgagtaccttcggtgcaggaaaattattaaggaagagagttcattatttatttgttttttgcataattaattcataaatatttttttcagaaagggttctgaaacgcaccaaattttatttacatgttagtttaggcactctgatgctttttctatcaaaaagggagatgaataaaatttttaaaaatttttaattcctttttaaacaggccaaaaagtttagacttaactttttagtgaaattcaatcattcatttttcgagtagtgatcagaagcgcaccagattttgcaggggcctaaaaaggtcaaggaaaggcgtctctgcgttgatttagcagtagtacctatgaatttaaattttctatgaatttttaaagtttttt

SEQ ID NO: 24356 - DNA, 1803 bp, Heterodera glycines
  misc_feature (52)..(52): n is a, c, g, or t
  misc_feature (54)..(54): n is a, c, g, or t
tcctctctctgagtgccaatgtcccctccgcccctctccttaccaagacctncnccgtgccgaagtcgcgtggcagcacatacccctaaggaattagcctaaaatggaagaatttatgtgattttagaaatgttttttctacttttgagtggatggatcgcggcaaactcgcggaggaatagggctgacgcaataaaacgcccatttccgccgattgacgcaattcgtccaattcggccgccaactgacgagccaatggagaagtggcggcacggccgctgaatcaacaaacaaacgatcattcaatttggcaaaggagtggttgacctgcttgaagttgagggttgttctgcctgtggggggtgctcctgggggagtttttctgtggacaattgatggggcggaatggaaggcggaggtggcgaagaaacgcgccacagaggcggaggagggaccaacgcggacaacgaggaggagaaggaggtggacacgggaaagcactgctgtcgggcggaagttggcccggacgacggatggaaaggctgcggagtccgacgaggcgacgcggaacggaaggactgggcacaaagaccgggcggaaaggaggacgaatgagccatcatcgaatggtcggagccatccaaggacaggtcgtcctgctgcggcaaattaggaaagcaagttaattaattaattagcgaattaattagccaatggcgcaactgtaagcaaaatgcgtcggatttgttcattgatgtccaattggtggacggacacttcattttgctgctgcaaaaggctggcactgagcagacggcgctgctgctcctccagggcattgtggagggttttgatcagcgaattctgaatcaatcttctgatcattggtggacgatctttcgctttttttgaaaaaaaagtcgtccatccattggtcactcactaattaccattgatcactccccccgcccactcactttttgctcattgtccaccattagcctctgaacagccatttgcagttgttccaactcaccaactaattaaaaaatgattaatattaatcaaattcgccttcgcttccacaatttcctcaattccccgcctcccaaatttttatcgttcctttttctctttttttcatttactcactttttgcgtccctttgttccgtttcgttgtgctgaatggatgttcattttgttctttctcgttgatttttcacctgcaaatttcgttccccttctgtcttttccctttccaatgccaaaaatttgtgccgtaattcgtccaattgttctccaatttgctgctgtcgctgttggccctgtgctgctccccctcctcctccttctgctgtcccctggtgctggtactgcttgccattcgtcccattgcccaatgattcctccaaatcacggattttctccctttggagtgcgacttggcgagagagagccgccacttggagagacaaactgcgaaattatggaagataaatttgagagatggcatttgaataggcaaacaaaaaataatgggaattatgacaatggaacctgtcacgagtcgtttgacgactttgaaggcgttcatgggactccaggaaatcggagcatgaagcggacatggactgagaaggactctggggagagggaggggatgattctcttgtgagtcgtgagtggacaatcggacagtgggcgaaccgacagtgaggacaatccgtcagaggtggacgatcggacagtggacaatctgacagtaaaatacacaaaaaataagaaaatgccgtcgccgaag

SEQ ID NO: 24357 - DNA, 1787 bp, Heterodera glycines
  misc_feature (1780)..(1780): n is a, c, g, or t
ttcatccaattttaatttgctttttgacaggcgattatcgtttaagatgagccttctctgaacactttgcagcaattttccgttgttattggaacagaaaaatggttgacagaaaatgaaattccgacagaaaattatttgatggagactttgcacgcagagcgacaatcgggaaatattttgacactttgtgcggttaatggtgaaaattattataatggcagtaattccaattgcaacactttggattttcaggcaaagttgcggctgttatttcgattgtcgaccaggcaaagcgagaggcgcctttggcggtttgggcattgtatcaaatgggcatgaaagtggtgctgctgactggtgacaatgcaaagactgcggaggcgacggcgaaaagagtcggaattcgggaagtgtacgcggaagtgttgccgaaccaaaagaaggacaaaatcaaacagcttcaggttgttggcagtgaattggtagagagaaaacaatttgcatggcaattagcccaaaaaaagaaggttaatgaagaaggaaatgccaaagggttaaattcaaaatggatgtaagaaatttgatgatgggaataagaagcaatgaatgaatggcatggaaaatggagcagaaacacaattcgattgattgcttaaattcttttgttgaatgttccccaatcgacgcgacattttcatttgctgcgaatttgcaagccttgctcttctttattgcactgtcccttttatactgctccattcgtttttagttccaaaaccaagtagttgccatggtgggcgatggagtgaatgacagtccggctttggctgctgccaatgttggcattgcaattgctcgtgggtccgacgttgccattgagagtgccggaattgtgctggtcaaagttcgtcaattttctgtcttccgcccctcacccactttctttcagaataatcttgtcgacgtggtcagtgccatcaaattatctcgcaaagttgtccgccgtattcggctaaatctatttttcgccttcgtttacaatgccatcggtgttccgttggccgccggagttttttccccttggggggtgcacattcagccgtggatggccgccgccgcaatggcattgtcctccgtgtccgtcgtgagcagttcgttgctgttgcgaagattcaagtaatgtccactgccttttttgtttcatttcttaattcccggaaatcaaacacttaaggaaaccgacagaacattctctgtccagcacagagtttaagcgttaccggaggaatttgaatgaccaaaacggaattgaagttaatgtgtacaaagggctggacaaaagagaggggaaaaggaacactgagcaaacggatttgtcggcaatggaacgcttcgcttctggcactgaaatggacgacaaggcaaaacggacaattggtgctgtccgatggattaccaaaggcgtaaagaagagtcgttcaccgccccacttgtcggacgatgtgggaatgaagagttttgcggacaaatcggcctctgaacggtcgtatttcctcatttcttttttaatttattatttaaaatttagtttcctttcgtccggtagtgatttaagcgacgatgacggaccaaatttaagtgacagagcaaacgcccgtgcaaaactatttgaaaatgtctaataacggacagaagaacttgcccaaaaaacttacacacaacgtgtatctttctatgtttttcactataacgcatacctttctattttttacttcanttaattg

SEQ ID NO: 24358 - DNA, 1639 bp, Heterodera glycines
  misc_feature (1600)..(1600): n is a, c, g, or t
  misc_feature (1604)..(1606): n is a, c, g, or t
aatcgactgagtggcgcccataaaaaatcccaccaaattaggcgagtcgctatttattttcggttgtccagaatcagaccctcgacgtgatggattcgttaccatttttactgtgtcaagcaataacacttcattttgagctcgttcatttgtcgagaaaatgttaggattgtttttgaaacgagggtcaacgagagtggccatgcgcaaaaagcttaaactattataattagcaaatatgacaaataagaatccaaaatttacattttagattggtgttctcgcatacgggattctaatccatcttttatgacattttttaaactcagaatggactcattttcttcgccattaacacggagataattttgaaggcatttgtagaccgaaataactgatgaaagcgattcgtcacgttgtgataattgatttgtaaatataagaaagggttttaaaacctaaaaattagataaatcaataagactaattattataaaggacctggcaaatgttttttacaagctcaaaatcaggtaaagaaagatcattgtattcttcgttaataagcataagcgggcggctctgttcatacaaacgttcaagcataatgtatgatgaattccaacgcgtgcagacatccttgttataaaaaatggattaaataaaaatagttgacacctgcaacaaaacgtttgaagccatgccaagggctttttgttgttcacaaaaagactttcggaaattggcactccggttaaattcttattgttttgcagttaaaatcattaaattatttagaataactcaatactatcttcgttcatctattttttgattgaaattaattggatattcaaatttttaatattattattgaaatcgagtttaaaaatataaaaatgatataatagaaactaaatttactcaactggaatatagaaaaattaataaaatttcttaattgacatgtaaaaatgctaataattacaataaaaaattaattgtagttcatcatcagaatgttaaactatttatttaggggtttgtcgttaagaaaaaaataaagaatttttaaaaatttaaaacaaataatatatgcaattaaaattaaatagaaaaatatatacagaaataatataattatattataaaataatattggctaaacgaaattaaacaatatgaaaaaagcaattttattttggcggcgtcacgctttgcgtataaattattattattattattaaaaaattaatcttttaaagggtaccagcatcttcatgtgactgtcaagatagcatgaagatttaaggggttaatcagttattaagtgtttaatctattatactttggtttttcaataaaagataaaaatcaaaatgtcgtctacttgaccatcaacataaaaaatcaattgaatattttaaaatttaaaattacaaacaaaacaaaattttattagttataagcaataaaattctgaaaatgtgctgcattctgaaaagctaaaaattgaagcagtgttttaacattgaaaaagtttggatctctttggaccatgaatttaatgagtttaaaagtaaagcatctctttaaattnttannnatatattttcgtcagacataaattctgttacca

SEQ ID NO: 24359 - DNA, 1919 bp, Heterodera glycines
tctcattattttaacctaataaaactttcctaatcagtccttcctaggattccgttttttgattatttgtaattttccagccttattataattcaaaacaaacggcgcagcattggtttccaaaattgttcgcgagaaaatgccttttcaggtagcatttattgctttgtttgctcttttcgctgttgttcctttttgcttcccctttttctttttaggttttcctcgtctacacgggtctcgtcctcttcgtttatttggccaccgacagtttccaaaacaatgctccgtttgtgttcaccattcccgtggtcgtcctcggttggttcactctttggacgcgaatgccacggaggacacgcattctcaccgctgtttctttcttcacgttggcattggcactgtacagctggtcaatgttcccaaaaaagtgagaaaaatgggaagagacagagagggagaacgtaaagagaggggggagagaaagagagagagttgggaagaaaatgagagacattcaaatggggagagagagagagttggtgatgatcaatgcttatcagtcagtcttttgtcgatcattaagtctgataatgccttgtgtccctctgttttgtgtcctcagattggagctgtccgccctgctcatttgtttcagccaattcgcctatttgctctccttctacaaatcccttcgcaaatggtggatcgctcttgcaatttcgagtaagttttggccaacttcattcttttttgtaccctctctttttccaattccccccccccccctttagcttgtcttgtgatgggactgtttctgtacggcattttcgctgaccttttccgctccatcccggcactcgtcctcgcttgtgccaccattatttctctttcatcgacttcgttcatcgtcgcggggttcgtaatcattcgtctcatttcttttattgcatttctttagctctgtgtggaaaaatggttcaacgatggcttatgaggaaagggtaagcgaatggtcttttatttattcctttcacttttatgcccttttcagtccgctttggtccgcttcttcggcactttctttcttttggtttgcaattcggcccttttggtatttatttccatttttatttcccctaatttccgtccatttctttttccttaaggtaaatcatttcgcgcgacacaccggcaccatcgtttggtatctcaacttcacctattacatgtcccagtttctcctttactttgccaacgaaagggcattttgaacatttcgtttggtcaccccaaatgactcaaaaggcgcctttcccatttttctcttttccgttcgaatttaaatgtttaaattttgtattcggtcatatgggtttcttcttattgtctttgtcttccttttttatgatcctaagtaaaatgtctctttttttagtttattttctttttcaattaattttcacggtgtaaataatgtgttccttttattttgtgcgttcgctattttatttcatgcccaatttgaattgtacgctaattaaatacgggaatttgtgaggatggtggtcttttcatagtcaacacagctcttccccctccatttgatatgccattagtctctcgccgttccctccgattcattctttgttatcccaactgttccgcgtggtggtactgcttgcgttgtgcatagtccgggttctgttcgttcagtcgtgttgattgaatgtcgcccggttggattagccccgggggcggcgccggtggaacgaccgccgactgttcgcgggcgttggacggtccgaagggcgtgaaagaatccatgccggccatggccactcggagcatatggacgagggagaagtgggaagctagaaggaaccaattgcataattaaatgctaattatcagcttaa

SEQ ID NO: 24360 - DNA, 1671 bp, Heterodera glycines
cggcgttgaggaccgtcggctggccccccttggggggtcggctgcgggggcgatgctctctgagcgggttaaaaagcgtttaaaagcttggtgacaatttaatttggcaaaggaccaatgataaaatgtcaaaatttgagtggaaaatgttaataaaaaaacattgaaaagcatgaaggaaaaaatgccattatcatgttcgaaatgccatttccgcatttttaagtatgcaaataatttatcaaaattgacaaattttgacacaatctattatttaaaaattagtattttttattcgagctcagacagttggggtcgagaaaaatcccggtgaaaaccccaattgattctgatgaattaaaaaaggcttgtggcggatcccgagatcgaacctcgagaaaatccaacgggatcccgagaaaatgtaacaggatcacgctcccgtccgattgctattttctatgtccaacgaggattttgtgccatttttagtgccaaatttggtttttcccacatgtttggaactgtcttccaattacaattttgttcagcggatttggacgcgcgcctttcctacaccgttgaaaaggcgggcagcgcttgccgcgaccactttggcgcgctcatgaacgcggaacgctgcctgcgtgcgttcagtgtgtcgcaacgcgacagcagcggcgacgacgacgacgcgtcatcatccgcgtcgtcagcactcgttgtgcatgttgatcaggctgcagcacagccaatgtccgaggcggtgctgaacatttctgtgcacgacgcagcgcacgcggcagagccgaaggattacagtaagcccatcaccgttttttactggaaaagttgattactgtaattgttcattgattcattaattagcaattctgttggtcaaatttgtggccgaaaatgcttcatcggcaccggaaagcgctgctgctgaaccgttcagcttaaagaaggcaatcgctaacgcaaattttccagctgagattacggtaaaaacaatcatctggttacggtacattaaaatatatttttttatttttttaaatcggtgccgtttttagctcaacgattctttgcccgccaatgcattggtccacagctttgggttggcacttccgcgccctccggcgttgagctttgcgcttttcaccaatttgcggcagtttgccatcggcaaagactccggcaaaatttaaattatctaattcgattatttatgaaaaattcatcaaaattcaataaatttaaaaaatattcgaaattcttattcaataagattttatttatttataaagaaaagaaaaagtccacaaaagggataaatccacttactttgtgctaaaaaccttatgcaaatttgtttcgccagccttttaccgaggcttcccaataaatttttgaaaattttggaatttttcgcaaaattttcaggccttttggtgagtacgcgtccgttgcgcggtttggccggcaaattccaaatgcgtgtcgacatcaaatatgggcatgaagtggaacggattggcatcaaattggaagtgttacggaacggcggcaaaaattcgggcgaaattttgaaatttaccaaaaaatttgaccctaacggacacatcaatttggaggatgaaaatgtgagaatttaaggcgtgaaaa

SEQ ID NO: 24361 - DNA, 2650 bp, Heterodera glycines
cacgttcggccatgctgctttcttctcagaatgggtcctttcatatttctcgacttcctcttcatcaaaaagctttttcatctgctgatttctgaattctgtacccttgtcggagaaaattctgtgtggtttcattggcatagttgaaaagactcgcttaaatccttcgaccatgtcatcggatttcttggtacgaagaggtgtcacaaaaattcgcttcgaaagtacatcgattaccaccattaaataacgattgccgctgttgtgccgagaaagtgcttgaaagtcagccaaatccacctgacaatcggtcataaaaccggcggcagttgttttagcgcgcggaaaattgatgcgtcttggacgcatcagagtgtaggtgcgatgtccctccaggtagtgctttacatcgcgtttgggaattttatttccaagttcttttttggcttccagccacaatcggtcgacaccggcgaacgcagccggggattttgggtcattgtagagtctttccaacacattttctattgatttttccatttttgtggtctgagacgttggcttttggtggggatttccgtttctattgctgacagtgccgtcgacttccgcttgacgcccctcattggaaacggaagtgtcattccttcttgtaccctgcctctcgcctgcctcattcctctgagcttttgggatttttggtttaattctgtcgtttgctctgcttgtgacaatctccgtttgggtccccttggtggtactggtggagccgtccatgttcgcaaaataaggtcactgttaatgcgatcgcggatcaattttgttcctggaggctgtctaaattgtggaattcgtcccgctctgcgttctataatatagtcgagagcttgggcgacactactgtccgttattgggtttcctgcattatttaaaacggtgtcaccgtgaacaccgtacttgacggggttacgattaaacacgaactgaagccgtcttctcttttgctcattggtaagttgcgaatttggaatggtgaaaaggtgctgatcctccgcaaactgatgacgctgctcttcggaaagtacttcgccgaccgggttcttttgtctttttggctgatttttggtaacatttggtgaagacaatctttttcgagtgccaattcttgttctttttctttcgttgtcttcttcaactttgttgcttttccgctttttcgttttactaggcaacggaggtcccggtggatggacctgagccgaggtccccgattgttgtgagagttcaaagtcatcatcaaccggtaatggggcagctgctgccactgctagtaagtccctctttcgggagccaattttgattctttttctttcgttgtcttcttcagctttgttgcttttccgctttttcgttttactaggcatcggaggatcaggtgcgagaggctggaaatattctccatcaaagattttttgtcactaatattaatggccattttttggagctttgatcatgaatgttaccaaatttaaaatcgaatcgttttatataccctttttcattctcttctgttccatagtttatttaaaaaatgtttcctcatcctttccgtttatcgaccaaaatattgctacgggtcaaaagattgggtaaacaaatgcaatcgccgatgttcgagactctcgttccttatttttcattcatttttatcccttttccccaaatggcacgccatccatctctccttccgatttacaaacgaaatattcgtcgccaaaaccacgtacacattaagcatgtacgcgtaaatttttcatgttgacataattaaattataattattcaggtgtttgttactggaggacaaccgccaagttattgtatttggtgtttagcacttgggattattcttttattcgcttggttgatttggtaagaaaacacagaattttattcattaatttaaaaagttcgtaaatttcaagatgtcccgcgagaatcggatgacctcgaggatgcaatggatggggaacggatgtaagacaaacatttcaattgattaattctgaccttaattatttttcagtaaattttaaacctttctctaattcctaccgtatcattttattaaatgttttataaaattttaaaaattgatttggaattttaaatccattatccaaaatttattcattcgttccgtgacctctttcatttaaaatgtaagatttgatcaaaaattatttgcttctttccttttatcataatcttcattcaatcagtgacagtcagcgtccgatcattccatctagtcaatctaaaaattcaaaaaaattttgtaaaattaattgatttttgcatgtgttggctcaccacttcagtcgcctcctcgatggtttccaattgacgcgatgttgaagcgtcggtggccgagacctgctaagcaaagaaaaaaaattcattcaccatttccaccccctcattttttactccttcaaatccaacgcggcgcacaagacgattaagcggtgccggtataggggaacgctacaaaaacaatgtataaaatgtaaatgagaggctaattaggggggggggtggtagtacctgacggaacggacagcgaacagcaagcgggtgaccaattccc

SEQ ID NO: 24362 - DNA, 1907 bp, Heterodera glycines
  misc_feature (1600)..(1600): n is a, c, g, or t
ataaaaatgagggatttttggtggtccttcgtcaaaatccaatttttgcgcggtctgccattgggttgacagttgctgcgaacgaaagtgcgtcattgtccgcgcacttaagctgaaaacactcgaaacgcctgacaaaaagggattttgattcgggaaaaattgcttttagcttgtggattgtttcaccaaaacctatcttttccggtgcagtgggctgaatgctctccgtgtagcggcgatactcctcagcgcccaatttgttgatgatcagtcgcactcggcttgcttcgggcaaattctttccttcatctgcgatgaaagtgccgaatctttcaaaccactgctcgaatgtgtgattgtcgtccggtgtgtagacgaattcggcgatctgtgcgctgagtttgcaaaacaagtccatttctgaattctgggatggaacatttggttgtgtgcttttttgtaaaagcgaatggatcgcctgcagaatgtctttgagctccgttgattgttcggcaggcatttgatcgtgatgaaaaatttctcagattttaagtgaaatgaatgagaggagagagtgatttgatttggaaatgtttttgtttgagtcaaaataagtattttgcttagcttcggtcagaaaccacaacggattggcttgataagtgagtgattgatgatgtgatgtgatcagataattgccttttgctgttggaagtcgcacaagtgcgttgcaaccagcggtcaccgccgtgacttggctgtccacacaagtgactttcagaacgaaagtgcactcagaggctttttacggcgtgagtgttaaaaaaataaaaaaattttcgatacatttgtgacagaaaataataaaaatagatggccaaattttatgtttttaaaaaataaaatgtaattttcgaaaaaagctcaagccatccagtggctaaacttgtagtttatcttcacttttttgactaagaaatttaaaacctttttacgtcttagaaaaacttaaaaaaccacgaaattattcatttttggtgtcaatttgcaattcataaatttttgaaaattgataactttttattttaaaattagggattgctgaaattgcgcggcttttgaggtccgcaattatgggttgcactcaatcgaaaaattcgattgtgaccacactggtccgatccctagggtcggggggggggagctcaattgtcaggggaccccgatcgggtagtgattaacaaaattttttcaagaaaaactcaatttttattttaaatgctcgtaaatcttcttttttttcactttaatcatctgatttcgttagcgccaacaagagtgcgttatttataagaatgttctgattttggggtagcgacgaaaattgttcagatttcttaaatatatttatagttttaattttttatgcaaaaaatgctaccgaaaactcccaattttcaatttttttttcccggcggcacctgtcggcacctccagtccgcaaaattgttcttaaaaattttctcaaaatcgcgcaaaagttggtcatttttggtgaaaatctgtgagcaaaatgaactcaaattttcaaaaattnctccaggcggcgcctatcggcactgccggccactgtgtccaaaaatttttttcgggaaaagcgcgtcacaaaaaagcatgtttttttcattttgactaaaatttccaaagtgctgattttgaccccaaatgatgattcttgttggctaaatgctggttttgaaaattttaagttagcagcccagtttttacaatgtaaaaagccgttttttaatcttatttttgagtccaaaatcttcgttttaacctcgttttgtccttagtttataatgggagactaaaaatataaaatttgatagcattttgat

SEQ ID NO: 24363 - DNA, 924 bp, Heterodera glycines
  misc_feature (127)..(127): n is a, c, g, or t
  misc_feature (853)..(853): n is a, c, g, or t
  misc_feature (912)..(913): n is a, c, g, or t
cagagtgacgtcgtcgctccatggactgcggaggggagactgcccagtggcaactccatttggcacggtggtgccaaatggagttttagagttgtggcaccggtggactgaaaaaaaattcaaattntaaaaattcattttttttttgtttcgcacagatttgaagtccccaaattataggcttatttataaaaaatttagcttttaaaattaaaaaatatatataaatgtatagaataatacatggttttaaaatggaaactattaatatttggtggagaatgaaatgcttgggccgttggtcattcttctcgaattatgctgggcttaagggtgcccattggcctaaaagaggcgaggaaagagggaaatcgatgagtgaaaaggccgacgacagctgcccagcagctgccgaatggccttagcaaatgcgaaatgacaatttattcaaaaattacagtaaattacaaaatttagcattttagaaaaccattcggaaaaagattatttttaaagtaacacattaattaaggttcaaattgggacaaatttttgatgtcaattatctgaaatgacaacattttgatcatataattttttccaatattttttggaaatatgtaaacaaataaattctcgtaatatatcaacaataatattcgtcaagcgattgattggcttctgatcactgctgatcattgcggccgcgtgatttgaacaatttgttggaggccaacgcgcgtctgagttggtcctacgtctctgttctgcttcatgatagatgcttcctcgcttacatagtcttaccggccgattagggaaacaacgaaagaaaattatttttctaaatgtncaaaattatcaactaatatggtattaaagatttatttttaaggccagtaaagtaggcannatgactctaga

SEQ ID NO: 24364 - DNA, 2332 bp, Heterodera glycines
  misc_feature (810)..(810): n is a, c, g, or t
cttttgaattttcttctaattttagtcgattcccaccgctttgttcaactacggccattccaaccatcactaccaacaccaacataagcagcttaatcaacagcgtcatcaccgaatcgccacaccatcagcttcgtcctgttcggacaatgccaatgccaccgccgtcgtcggggtgccatcacaaaaccatccgccccatcaaaggagcaattcagcgcttacaccgtcgccggttaacaggtaggggcatacggtatggaaagacaagcactacagtatcagggcatagtaccgtgggaaatgcctattttggaattaaatgtaattattgaacaagttttacccctggggggctttggaccatctctgacaatgacccgtgccaaatcccacacgagatgtgaatagacttttggcatttatcgggtaggggattggcattccctctatcccaacaagtttggcgttaaaatggcattttgtccctacgtacagttcgtacagtccgacgggcagtgtggagagcagcagtggagtgagcagtggcagcggagtgagcagtttgaacggtgccgccgccgccaacatgatgacgtcactgccgatgcatcatcaccaccagagccagcagcatgtgacagtgaagacggaacccggcatggcacctgcttcaactgctgacatttctgccaacattgtggccaccccgtcaacatcggaaagcagtgatggtagtggcagtggcacaacaccgaggacaacaacggcaccgccagcaccgctcattggtggagaagtcgcgcgggngggagccgaaagcgcaaaagcccaatggacggcaacactacggtaaatggtggtgggcacggtaatgagcagctgcttcatcatcatcaccatcatcatcggatgatggtagacgaaatgcgtgatcagcaccatctccaacatcaacagcagcagcagcggcatgaccaatttgacgggtcatcagccgccaaaatgtcgaacatgggtaagcggagggtggcggacactcacttagggggaaggaattgtgacgcataaaaatggcataaatacccttcgggattgggttttcagggtcagctaggtcggggtttggatttttcggagtcagctaggtcggggtcggggtaaaccctgaaattgcctaaattttcggggtcggagggccggccgtaaattgacatcaatcaatgaattttaatcaaagcctcgtgaacaaaaggatagttttagtctgagaatgggacaaaaaaatggctccaggcttagatttttaaaaacccgacaaatttttctcggttcggtgccaacaatctctacaattaatgcattcgttatccacaggcccgtcattgtcgcgccgggcacggcctcagcccttggacctgacttcgtgcgttaatcccgccgtcaaccaactgaccggacaaatgagccaaatggttgcttcttcaccgcttctgcttgcgctccaacagcaacaccaccaccaccaacaacagcagcaacaacagcagcaaagtccgttcctttccgccgcgctcaatgccatgagcagttttgccgcttcaccggccgcgatggttgccgcttcgtcaccgttggcacacgcggctgtgtggcaccacttggccagcaacatgttcaacaacgcgttcagcccaagctgtcagtggggtataggaaaagtgggcgggcgacgcgacaaaccgatcatttagtgatcactaaaaaaaagttaaatcgttacaaaaattttgatcgatagattgatcattttggaccagtaaattgactgcaaattcattttccttttctaaatttttggagccttaacctaagaattgccaagcaaaaatttaaaaacacattaaaattttataaaaaatatttaaaaacgaattgtaaaaaattatttacaaatatttatatattaaattgaatttcaaatgccattacagtgaattcgttgtccaataacaacaacaacaacaacaacagcacaaacaatatcagccaactgttgtcatcggcgggcggtggtggtgacaattcgccgtcatcggtggcgaacagtgtcagcaacacaaccaccaacggaaacaatgacacaaccgcagcaacgcaacaactgcaagcaaacaagacaaataacaacaacagcctgtacagtcagctgcaaaatgcgttgacaacgccgaccattgtccacaaccatcaccagcaacaacaacaacagcaagcagttcggacaccacaactgtccaactcggccatgctgtccgcggtgatcaaccat

SEQ ID NO: 24365 - DNA, 1538 bp, Heterodera glycines
tgattttcattttcttaatttggcatttcttttctggcactttttcttttttccaaattggttaataccaaaaagaaattacgtaatttttcaaaaaaaaatttttttttgtcaatttatcattcatttctaatgaaataattaaatttttgcattttgaattttgtcgcaatgagagaaaagagagagaggggaaagcagagaagcaaagactcgagagagagggacaatcgagagaggagagagttcgagactgacgagagtgagtgagtcactcttccggatacaaagtgccgcgtcacgtgctgcgctttccttcgcttggccattcgttgcctttgcgtttatttgcactgcgggggcggataatttacaaaagggcaacacattgtgcgcttacaaattaatgtggcgtttaagcgacacttttgccctttgtcccctcaattaaaattcgccattcgtttggcctttgattaattaatgcgtttggcactgcgcaaatgttaattaattttgtccatggcaaataaccttttcaaatgtttggcttttcttttttatttaattatttctttgtatttttcattttaaaaaatgttttaataatttttcccattttcgcataattaattaaacattaaatttattttgttttggtaattgccccccccccccctcaatttgctttaaattccccgatttttgttttcaaattttggtttggttttacaccctctcaaattataaatgacccctcgaaaaaattgacgacccctttctcccccccccccccccgccgtttctccttctaattggcctaatttggccgtgacgtaattatgcgatcgcgcgacgtctcccaaaggtttcccaaaaacaaaaaatttgcccggcgaggacaaagtttctcaggccgaaccaattattttatttgacagtttctgcgaattcatttaaattccaatttaagtttttatattttttaaattatttaataaaattaattcctaaattaattcaaaatcattttccgtttcaattctccccccccccgtttattttctgttctctgattggcccctttttctccttttttggcgtgacccgaatttaaatgagtttttctccctttttttcctttttgagggggtcaaaaattatctctcctttataaaaattgcataatttgacttgaaaatgacgtgacttttttgcgccagaataaaaaggtgacaaatataagttgaaagctcacaaaaaaccattcattacaaaagcaaaggtaaatttaaaatttatattttttaattttaaaaattaaaaagaattaattttcaaaatttatgggtttaattcaattcaatttccattggtctgttggataatcctcggcagaaagacggtcaatccattcacttcacttactctttttgtcactttgccccccccccgcggcattcattgcttttgtcgccaaattcattaaaatgcggcgacgttcgccattttcgctttttggcacagtttttcgtttt

SEQ ID NO: 24366 - DNA, 1247 bp, Heterodera glycines
gacgagttataggcccgggactcaaacgtcccgctcaggccaaaaaatttttctatttccgggaaaaaatcgaaatttttccgaaaaaaataccagtcgatagagctcgaaaaactacgtttcggaagtggtctccgtttttctcgggaaaattcgttaaaaaatcataaaattaaaaaacccgaaaaccgttttttaggcctaactcgaaaaattttgaaaattttcgaaattttaaaatctggaaaaatcgagcttatttaactctacaataagtctgctggccacactcgcgctcaggtcaaaccctaatgagttattcgcctggtactgaagtgggaaaaaaaaattaactgagtctccgtgtctgtacaggtccgggatttggtctgatcaaaaaataaaaaatactggattatagaggacacttctgcggagtgccctcacagcgggaattttttgatccgagttttaggaaaaaagttaggggccttcaaacgcaagaaaaagtgagaaatcggtccccgggactcagtcgtccgcgctgatttttttcctatagttttcccggatactcctcaaaaagttgtaagacccttccaccactttcagggcgctcccggccttcggccgggagaaaatggttttagcaacgaaactccttgtcaatataacgtatatattaactagcgggtgtgtgcttacatgtttctttagtgcttaaagcgcttcgcgctttgggagcttcgctacctaggccttgtgttagggtctttgcgtcagccgacatgcacttggtttcactcacgtgatgagctgacacattgcatttatcagtgcaatggaaaccggaagtgccctaactcgcacgtcatccctcctccctcccttagtccaggtggcagcactttttgtatgtgtatccgtttaaagtgcagatgagaacggggcgacatcagtaaagtgccacacactctggactataactcgtttgccttattgtaatttgagcatgtttttggccacaatgttcaacactttggtttgaccttggccatcggtctcccttctgggagcgtacactcggacgttgttcccgtctgttgcccttgaaaaggcagtgtacaattgaccatgggaaaacacatccctttcgaggtcaattccgaccgtgctgattgtttggccttgacctttgagaatggtcatggcaaaggcaggtttgatgggaaactgcaaacgctcat

SEQ ID NO: 24367 - DNA, 2022 bp, Heterodera glycines
  misc_feature (2005)..(2005): n is a, c, g, or t
  misc_feature (2010)..(2010): n is a, c, g, or t
gatcaaccagtacttgaccatttcgtttccctttttctcttctccccagccaataatttttaccgaatggccatttttctcttttcggctgtttggtgagcgctaaaatacactgcttttttcaaattgtatttatatcatacaacataaatttgatttatatcagctgccattgtaatttgaaaatcgtcgtaaacggcatatgatgcagtgatagagccattgaccatgatttcacgcatcattttttgctcatttccaaaatgccacccaatccaacactcatgtccaatgacagtcggtgtatcagccatttctgaaagtcgtagtaattatcttcataacttgaatgaagaaaacattaaatgtgctctttataaaattaaccatttgaaagtaaacatgaattaccgttttcgacagtctgatgccaaccgattctgcattcttttttgcagtttggtctttttgttttccacgaagcctcgggaccgacaaaaagatattccatagttaaaattggtaaacgttcaaaaaaagttccagcaaaaattggatcaattgtccaaggcctacatccatcgtacatttcataatttgacccagatactgtttctttatgaaaaaatttccaagccatgctgggccaaccacctttacacctgcaaaattaaatactcttaatttcaatattttctacattgtatcgtattacccgtcacttcctggagtgaattcgcaagtgaattgtgctgagatgtatgaccctccataatgggaggttttttgtccctttttaaggcgagcaatacaaatgcgatcggttaatgttgaagctgaagccactgcccagcagcaaccgcaaagtcctatttaacataggaataatttgaacttccaagtgaattaatttttttgagaaatcaaattaccttggtctgtaattgtgctgattatatccgcgcaatcaggccatttttcccgcgcgtcaaattgacgcggtaaatcattgtcgttgctgtattgagtttcaatatttagcgtttccaatgtcttcagctgttgattctgtggaccatatatgggcggaaacacgccatcaagttttttcaattccgcatctgtcagcaaagcgaaaggttcgtagataacagcctggtaaatttattgaaaaaaacaatttcttattaaactaattattaatttttatttttattattacgagtattttgcaaaagaataagaatattataattttattttaaccttccaatatttttggcttttattaattgtgtccacttttttctgcgctgcagctaactgcttcgaccgatactcagactaaaacaaaactgttaatttttaaattttgtagaaaatttatataagaataagattttctgattaccgcttcgttcgggaatttgcgtggttcaatttcgaagtctttttgttcacagtttgatccatcaattcccaaatttaattttccaccataagtcactaatatgtcaagcaatacaccgagagtcgtgccaacattaatctggcaaaaaggaaaataaaaacaatccttatatacaaattattcaattttcattcacttgcgcattgtattcaccgcctctgcctggtaagccttcatttgctgtgattttctcccatactttcgttccacaatttttactgttgaataatttgaagttggcggacacccaattctgtgccaattccttcgctttgtccttcattcttaattaagtacaaaacaatacacagaattttttttacgaaaaccgtttggtgcccgatttacgcagtccttcgatgagcatgagttgtgtggactaaattttctatttttttggccatgaattaatagggattgaattgtttttcttcttaaaaatcaaactacaacactatttcaagcgttcaaaaaatttaatttaatttaaatttaattaagaataaggtcatttatgacacgcctattcattanaattntcggtttttatc

SEQ ID NO: 24368 - DNA, 1042 bp, Heterodera glycines
ctggcatagagaataaatttaaaaattccctgtagatattatggccattgctctccgcgcccctctgcccatgctggtctcatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatagccattgctctccgcgcccctctgcccatgctgggaacatttgtatggtacaaaatttctcgcaaaaaagagatagccatttttctggcatagagaataaatttaaaaattccctgtagaatagaatagccattgctctccgcgcccctctgcccatgctgggaacatttgtatggtacaaaatttctcgcaaaaaagagatagcctttttctggcatagagaataaatttaaaaatccctgtagaataaaatggccattgctctccgcgcccctctgccatgctgggaacatttgtagggaaaaaatttctcccaaaaaaaaaagcatttttctggcttaaaaaataaatttaaaaat

SEQ ID NO: 24369 - DNA, 1770 bp, Heterodera glycines
  misc_feature (1680)..(1680): n is a, c, g, or t
  misc_feature (1706)..(1706): n is a, c, g, or t
  misc_feature (1715)..(1715): n is a, c, g, or t
ttcattggcgaaagaaactcaaaaaattgaaagccaatctttttttaagcatttcttgtgaaaaaaatattgaatccaaaaaacgaagtccctttcttgtttggcattttcacggaatatgggcgcatcccctcattcattcattcatcaatgcccacccactcctcaagaggaaggaatggtggaagattcttagatttgggcaacgcgcacttctcttcccccccccccccccctccctctctttcttcctctctcttcccatcatctattcttcccctctcacccttattccctcacttcgcagacttcaagccctgcaaaaacctgggcgacaccgaagaattcctcctgcaactcgaacgactcacacgcgaactcaacaatacaggagaagacatcgaaggcccaccgaccttcctcatgattgaaaagaagctcactcccggattcctgcgcacaatcctcaccaaaaagggagaagacccggcacgctggaacacgacaaagttccgagacgtactcaacgaagctgttcgaaaagaaacccaaattcaagaagtcatgggcgagtacggacactcgcagcagcatccgcaacaacggccacaagctcaaaggcccaatttctcggcatcgaaattccgagaccgcgcaccaatcccacagcaacgggaacgcacattcatcacctcagcagtggatgacaatcacaaaaggctgatcaatcgacagcctcaacacaggccacagcaacaaaggcctcgcgcaccacaaccgcaacaaagaaacttgcgcactttcaacaatcaaaggcaatttccaactcaacgtaccaatgcgaccaacaatcaacgacaatttccaactcaacgtaccaatgcgatcaacaatcaagggcaatttccaactcaacatgccaatgcgacattcaatcaacgcaagcctccaagtccatgcatcttctgtgacaacgatcactggaatgaagaatgccggaaatacagcacaattcaacagcgaagagaagtgctgcgcacaaaggcattatgcttcaaatgcctcaaaagcaatcatcaagcaagcaattgcccacaaccgaaaagatgcttcaaatgcaaacaacctcatccaacggcattatgttatgcagacgaaaaaccaccgaaccaaatcacagcagcaatgttggggcaaacacaacaaaatgtgtcaatcacaactcaagacggaagtaacgaaccaacggcatcgacatcgcaaatgtgcaatgccgtaaacggaagcgacacacgcgcactactcatgaccgcaacttcaacggtcttcaatccagcacaaccgcatctcagcatgactgcggcaattttcatcgatccaggcagccacacatcattcatttcagcaaaggcagcacagctactggatcttccggtggtccacactgaagaatgccacttgaccagtttcggagaacgcgaaccaaaaagatacatcagcgacctggtcaagctcggatttctctgcacgagcggggaaaaactcatcttcaacctcaacgccatgaaattcttggtcaacgacatgccaatgattcaactgtcagagctggacaagtcagagttgaggcaacaaaagctcaatcctccgcatgaacaacgacaacctgacatcatgctncgaattgatgtctggcacgaactgcnaggtcaccnaatcgaaaagttgccaagcggcttcacactgtgccgatccaaaatcggcaaaatc

SEQ ID NO: 24370 - DNA, 967 bp, Heterodera glycines
ttaaaatagacatcatattcgtactcagcaccttaaacattcccagaaaaaaatttttcactttcattttcaacccaaaaaaaattttcgaaaatttctaggggcctagctcgaaaatttttgaaaatttccggccatataatacactattcgatagcattttaaaagctctacaattttgccctaaggcgttttttcgataaaatcaacccctaacgagttatgagcccggtactcaaatgtcccgctcaagccaaaatttttttctatttccgggaaaaaatcgaaatttttcagaaaaaaataccagtcgatagagcatcaaaaacggttgcttgaaagtgctccccgtttctctgggaaaaatcgttaaaaaatcataaaattcaaaaacccgaaaaccgttttttaggcctagctcgaaaaattttgaaaattttcgaaattttaaaatctgaaaaaatcgagcttattgaactctacaataagtctgctggccaccctgcgctcaggtctaaccctaatgagttattcgcctggtactgaagtgggaaaaaaaaattaactgagtctccgtgtctgtacaggtccgggatttggtctgatcaaaaaataaaaaatactgacttatagaggacacttctgcggagtgccctcacagcgggcactttttgattcgggttttagaaaaaaagttacgggccctttactgcaagaaaaagtgagaaatcggtccccgggactttttagcaacgaaactcaaaacctatataacatatatattaataaaactgataacttattaactgaaaattataggtgaatcacaagaaaattcaacatttgggcttaaaatctggagaaaagtcaattggtgcaatgttttcgggatttacttatagaattaaagaaataaactgacaacttattaactgaaatataggtgaaatcacagaaattcaacatt

SEQ ID NO: 24371 - DNA, 999 bp, Heterodera glycines
aattataggtgatcacaagaaattcaacattgggctaaaatctggagaaaactcaattggtgcaatgtttcgggattacttatagaattaaagaataaaactgacaacttattaactgaaaattataggtgaatcacaagaaaattcaacatttgggcttaaaatctggagaaaagtcaattgatgcaatgttttcgggatttacttatagaattaaagaataaaactgacaacttattaactgaaaattataggtgaatcacaataaaattcaacatttgggcttaaaatctagagaaaagtcaattggtgcaatgttttcgggatttacctatagaattaaagaataaaactgataacttattaactgaaaattataggtgaatcacaagaaaattcaacatttgggcttaaaatctggagaaaagtcaattggtgcaatgttttcgggatttacttatagaattaaagaataaaactgacaacttattaactgaaaattataggtgaatcacaagaaaattcaacatttgggcttaaaatctggagaaaagtcaattggtgcaatgttttcgggatttacctatagaattaaagaataaaactgacaacttattaactgaaaattataggtgaatacaagaaaattcaacatttgggcttaaaatctggagaaaagtcaattggtgcaatgttttcgggatttacttatagaattaaagaataaaactgacaacttattaactgaaaattataggtgaatcacaagaaaattcaacatttgggcttaaaacccagagaaaagtcaattggtgcaatgttttcgggatttactatagaattaaagaataaaactgacaacttattaactgaaaattataagtgaatcacaagaaaattcaacattttggcttaaaagtcaattggtgcaatgttttcgggatttacttatagaattaaagaataaaactgacaacttattaactaaaaattataggt

SEQ ID NO: 24372 - DNA, 865 bp, Heterodera glycines
ggttaagataaagaaaatacaatagaacacacatacccaaaagcaagaagcattgtccatccctttttatcagttaagcaaaagattttatatcaatgattaatgattaataatcaataattctaaaatgataaaagtcaattattgtcacagcatttatcacaagataatgacaagaataatactcacgacagtcagcagagacaacttcataatcagtgtgagtaaccgcttattcatttgcagaagcaccgaaaggcgccgccgggaaaaattttgtaatttttaatgcgatttgctaacagttttttgtcaaaaaataaccaaattttgcgcaaaccttatattttcttgataaaatagtgacattctgccataaaatttcaaaattttgaatatatttaagaaataagaacaaaataagaacaatagccggaaataaggacaaatcttacaaataaggacatttttattttgtaagatttggaccctccaaataaggacaaatcttataaataaggacagaccacacccctgctttaagggcaggctgaagcagggctccacgaaatttcatttcgtcctacatttctggcactttctgagtttcgttttcgtccgtcaaaaaaattttcgtttttggatttaaaacttaaattttcgtttcgttttcttccgtacgagaatttgcacgaaaagggacgaaaatcggcgccgccggacccatccatcccccgttccccgagtttttgaaaaaaatgcgctgcaaaaataattgttaaaagtgtcttctttttttctcccattggattgaaacccctgttatggtaattcactatgggtcaactccacatgtgcagagaaa

SEQ ID NO: 24373 - DNA, 1711 bp, Heterodera glycines
acagcccatgggaatggtggaaccgggcgcaattgccggaattcgaagggaacggccggagaattggagacgggacaaaaagaggaggggggaaaggcgggacaaccggacaataacgaagatggcacatatcagagtcagaaaagttttgaagcctcaatttttggggaatcggaatccaactcttaaaatgtcggaaaacgaaatttattatagaaaatgtcgaaacacggaaattacaacaccgaaaatgtcgaaaaccggaattccgactccaaaaaagtatgtttttgtacgcgtgggattgctgagatcggatttacgaaattaattgaagaatcgcgtaatacaatgtccatgtttttgtttttcttaaataattttaacttttcggtgggcggttgattgggcgtcaagaatcacaatcaagacgccccacgccttagtccgaaatcaattaaaaccgcgcccggaatcaattaagacatcaaatttcatagattcgacatcaacagcagaactgggtgtgtgtgtttgttgttcgacgcggttgcccctcccgccgcccgacgaccaaagaaaaggcaattaatcttaaattaattgcttgcactataattgttatttttggaacattttgggcaataaaaattaatggataaaatgaggaatgaataccccaagcattctcctctctctctcgccaattgattcggccactcctccgtccctatccgccgttgttttggttttcccatcccaatcggcaacaaaacaaacaaacaaaaattgacaaataaaaactaattatcttatcttccatataattagtaaagattcattgaaatttagttgttttttccaccgtttaattccttcaaattgggtggttaaaaagggtcaacagaaaaacaacccatccatcagcagaagcagaagtgagggaaaagcgccctcaaaaacatcgcattttttgccattttttcaaataattcttttatagcaaacacgtaaagtcaacaacagagcggtgcatcaatccctcatgaaaaaggaaaaaatggagcaacaacaaaaattgatgaaatcagtcaaatgattgtatacagataaaaaaatgggggggggaggaaaagacaaaacaatttgttgataaaaaatttaaaaaaatgatgagatggatttgcaggaatgggccgggttcgcaaatgataaatggacgaaatttaaataaatatgaataaaaaagctctttgcttctctctaatctatgtagagagttgccagagcggtcagctgaggaaaacctaataattttgaatttgcataaattttcacagacggcacatacagcgatggtggcaccgtcgatgtacacatggcaaaaatgagggattttacaataattctccgtaattttggtctggcaactccgtttacacgtgtttctgcacacaaaaggtcacaaacacacactctctcctctcctcttccactctctttgtcaatatgtccctgattttgttggccaatgtttggcgccgattcaatgcccggcggcggtcggtttcttcttcgcctgattggccgtagcagcagcaattgttccaccggcactgctcccagcggtgcatttgctatccaacagagccaccagctttgtcacgtaacaaagcatcaccaaaatgccttaatgaggggacagcaaaga

SEQ ID NO: 24374 - DNA, 1669 bp, Heterodera glycines
gcctttttgtgagctttgaagggtctcttccatttaataatttcaaatggagaaaccgtattacaaagagaactgtccggaccaacttggtccaggaatggtgcctctttgcattaaataattgctgttttggctctgcacatgtatgagccaaaaatattttttcatcttctttcggtggatcatgtaactcttcctcttttatctcgaagaagagttcatgaggccaatgattttggtcctttgtgagccaattaggcccaccccaccacgaagaatgggttgagagctcttctggtgtagctcctcttgttgccagatcagccggattttcagctgttcgaacaaagtgaaacgaacactttgttatggtgcgaatttctttgattcgccgttcaatgaattttggttgggcttcttttgaagccacccaatttaaagcaatttgagaatcactccacaaataggagtgttcaattgctcggcgcaattgagtttgtatgaattttaagcctcgaattccaataagaatggccatcagctccattcttggaatagtgagtaccttataataaatatttttatgacttttgaaattttttaaaaaaatttcaaaaaaggtgtgataccatcggtactattaccaaaattagccaaaaacctaataataatcaaaaaataaaataaaaaatgtttttttatagatgaactagttttgcttcgttcttggtgtatctgaatgcctaatccgagcactttctttttcaagggttcgaatgaagacgggcaatcgaattcgttacaacgcaaaacgtcgtcattggcgcagaaccaaactgaagctgtaagcgcaaatgaacaggcggaagacggcgggcgatgatttgacttgttgctgttgattcatacatttttatggactgttgataaaggaaattgtcatcggaaaagccgtccaaagcattttgcccacattcattcaaaaatgatgaaaagcgcattctttatgcaaatttagttaaaaaggggggcggggcggcgacatagggcaattgtcagtctaaattgaatagagggaactcaatcagacgaatggcttttcccctggggtgtcgccgcttttcctttgtacttccgccgttccctttgattggccatttccggtggtttatttacgcacttttattttgctttgtctttttcagtgttcatctttaagatgtgttgaaaatgccacttttattcccgtgccccacaattcacacaagtcacaagcaaaaattcgaagcgaaatttggggaaaaagcgtttaaggaagagtagacattaattaaacgcaattactttttttcttcgttatttccgtttttcatttcttttttattgtctccgatattaaaggacaattgaacacgcaaaataaaattcaaaattttgcattgctttgaatttgacaataaaccgacaaaaggacacttcgccccttaagggcactccaaaaagaatggcaaaacgaatgcatattttgtcgtttaaatattcgtttggttgttcagtccttgtcctttcctttttcaccctttcgataacccattaatgtccatcgtgtggaagtcattttttgttggttagggaggaaatagctgagatgatgaaaaaaaagcaaaaa

SEQ ID NO: 24375 - DNA, 1683 bp, Heterodera glycines
aaactgagctaattctccagtttttgggatataatcctccacagaattggtttggagagtcgagattttgaagattgaccccccccccccccatagtcgagactgagacccaaaagtttctcgcttttcgagaccaaagactctcgaggagcccaataattgagagattaatagcctattcagtcaggagtaacaactacttgaaacactgtgaaagcattccggcgaacactgaacacattgaatcgtttagtgcaaaacgatcggaatggccggacaatgaaaggagcgtaaattccaaggtaattaacaaggcccaccaagcacagacctgttcaaaattttttttttacaaaatgccaaaatatgcgggaaaaaaatgaaaaaatcggaaattttaaaataattccaatttttaaaattttatatgaaaatagtggacctgaatgttgtaatttggcacctgctccaatttgtggaaagcagtttcatagggtgaaatcagataaagtgcatgcctggaacaaatttgattcattggcaacacatcaaataaatcttttttaaatttcaaaaaaaaaaaaattgtcggcattttccaatcattttaattatttttttaaatttcaaacagttttctggcagagaaagccctccaattattttcaaaaaattaatccattttcactaggaattttaaaagatttgtgccgtttaaatattttcttaaatttttcgatatggcaaaattgacaaattttcctgcctaagattggtcagactaagtcgtgagcacagtaattccatcgacggatccgttaaaatgtacgatagccatgccggcatcgtgatggaaccgttcaccaccgcgggcagaagcattggggatgaagcagcagcagaaaacatttttgggaatgtgtaattgaagaatttaatggctcaatgaactatttggctgatcagcgatcagaagtgatcgggcagcttttctaagtaaaaaattcacaaaaattaattcgtcaaataataattgaaatcaaaagttggcagaggtaaatttagcattcaaaaatttgtccaagtttgaaaaaataaagttagcacaaaaagtgcgaaaaaatattaaggatattcgagtacatcttaatgttcgatgggcaattaaaaaaaaaattaaaaattatttttaataattaaaaccggcaaaaattgaaatttatttgtttttatgtgtgttttattttttattcaattttaaatttatgttttgtcaattcataaaaaagaagaattgtcaaagtttattaaatataaattaaataattttccaataaaatttaattaaattttttttttatataaaaatcaaatgataaagaatcgctataaatttggagaattactcgaagaaatattttttattcggcttttcgtgaaataacaaaaaaaaaaatccggtctcgaatggataacattagctgctgctgctggtggagaaatgggatgaacgcaaaataatgtgcgcggcgcacttataacgggggataattagtggttaattggttgagaggaaatccgaatttgcccgagggcatttaacggatgtgcgtgcgcattgggtgggcaaaaaaagagggaccttttgttgtcgccaagtgggggatgatagaatttttagga

SEQ ID NO: 24376 - DNA, 1609 bp, Heterodera glycines
atatttttttcagaaaaatgcttaggaaccgcccccaaattttatttacatgctagtttaggcactctgatgcttttttctatcgaaaggggagatgaataaatttttaaaaatttttattcccttttaaaacaggccaaaaagtttaggctttaacttttttttcagaaacttatcagaagcgccccaaactttgcagggatactgaaaggaaaagaattaacctgttttatcacattagcttgtcatcagtttttataaaaaattttcaaaattctgagtctcctattattttatttttttttcaaaattttgaagggcggggggggggggggcggggcgaaggcccaccacgaggccgcgaagaggccgagtgagtaccttcggtgcaggaaaattattaaattttaaaaattttttaattgctttttaaatatgccaaaaaatgtaggcttaacttttttagtgtaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttt

SEQ ID NO: 24377 - DNA, 1099 bp, Heterodera glycines
gtcaactcaacaattcgcacatggtttaaggttgagtaaagagcaaaagtgttttataaatttttcaattgaaaattatattaaatcaatttatttattgtgaaaaataaaattcgatgccgggaaatggggggggggggacgctccaacgaagggagaggagagaaaaggaaggaaaatttttaaatttttatcaatttaaaatttatataaacccaattttactccaattagtagcgccagctcgctactccccccagaaactgtttaaaaatgcgctgaaatgctccttttttataatatttaatgaaaatttaaaaaaatataaattactcaaaatatgtacctttttagctgtgtggagcttttgaacatgtgccaaaacattattttttcccgtctgttcatgatgccgttttatgtgctcaacaaatgggcggtttcattgcgccaagcattcacatgaggtaaatatatccatatttaatatttttaatattcgagagtctcggtttgaatcggttttttctctttcaccactttcaaatctgttttttgttatatttttctgtcaattgcaatcaaatgaatagataattttttagtgtttcgttgaatggttgccgtgatctgatcactctgtccaacgctgcgtccaaccacgacattactttgaacacagaaacaagcggacaatcatcagcaaacataccggtaattacattaaactgtttgtccagaagttttttctatataaaaaatggctgccaaaatggtgaccatctttctccgccagtgaaaatatatcgaaaaaatgttttaatgtgcaattggaatagatataattcgaaacattttttgtgcctttaagtgtaagcggtactctatttgatgtcatatttatttttagaaatggaaaacaattaaaatatttaaaattttgcaaatatttacgaaaatgttcacaaattcagatgctaattagtccaaattaagcatccagaagttgccagccttggcccatccgcggccgccggctcctcctcccaattttgctcccgtccgacctcatccccgacaataattggcggttcggctg

SEQ ID NO: 24378 - DNA, 2088 bp, Heterodera glycines
ttaaaaattaattctaaaaaatgttagagttctggttaaggattcggaattggctgaaatggaggccggattcgtgctcagcgcctcaaaacacccctagaaaagtgtttaaaaaattttcagaaaaaaaaaattaaaaaatttcgctaccattgatcttttactttcgactacatcctgttctcacacgcattttgtatttagaagggacaaaaagacaaaaaaaaaaagcggacaaaataaattgaaaattcattcgttaaagaaaaaccatcactaagagaaaattgacgaaatcatggaaaacatggagcaaatagcagaagcattgacaagtcactatagactttgttactatttacccatcaaaatgcatttggtacactccatttttcaattaaaaaatgaacagacggagagagagagggttacggtatttaactgattactgtagttagttttctttcgtctgtcgctttccaattttattcgggatttgtccaatgttcacatgtcttctgttaacattctttcagcgaaaaggtaacaagacatttaagaaaatttggcatttttattaagtttttttaaattggttaaattaaaaatgataattccgaatcacttctcttcaataaaaatgagtgacaaaatcatggacatgagaacagtgacttttgtaaaaagtgccaattgcaactttgacgggcgcaaagaaaaattgtgatttcttaattgggctttgattttaggcaacagcaaatatttgagttcatatttagtcgaaataatcaaaaaatggcattttagatcaatttaattatgtcctattttttctatttcgcatttttggtacttttttttgatattttaacaaattcatttcttaaagaagtaataaaaagaaaaccggccgtcggaaaatttttagaagaacaaatccataaaatgtgaaatctcttcaaaaacttttaatgtaaaaagcgttaatttaaaaaaaaattttttgcctttttgtgtatatttcgggttttgcagcttatgaatttactgcttaaaatcgaagcccaatttaattctgtgcggtcccaacgaataataaacataaaaatttattttgtttttcctgcggtgaaaaatgtgctgattacgaatctgagcttagaaaatgtctatttttgagtcggtttaaaatggttcgattaaaaagatacatattatgatttataaaaatagttcaattattatcaattattattctaattcacaatcagcatatacagtggtggaaagaagtcttgactcaaagtgataaaattagtaaaaattaaaattttcctcgtttaagttggcctattatctttctttttgtataattattagtgatgctcgagaccaaaaatttcccgagactcgagaccgagaccgagaccagaccgaggctcttatgcaattttggccttattgtactacaatgcttaaaatgctacaaaccttattttagaaatgctgtattattgacgcttttttccactgacgaatttttcatcaaaaggcaaccctatatatcccctattaattttaagtgatcgaattattaatttagaaaaattaaataaaaaattaatatttaaaaaatggtccaatacaaattgtattattttgatttgcgtggtttgggtgaacccattcgccttttgcttcactatgttggccaacagtttgaagacatccgctttaaagactttgaagaatgggagaaaatgtacaaaccgtgtgagtaaaaaaatatgtggcataacgccagagaaatgccaaattaaaaaaaaaaacatgtttgtacaggcattaaaattttttagaatttttctacggaaaggccccagttttggaggttgacgggaagccgttggcccaaagctcggcaatattgcgctacttagccgaaaaatttggtaaactaattataatattaatttattttaatttatttaattttataatttaagacttggccggcaaagatgaatgggaaaaggcgaaggctaacgaaatcatggacatgcagaaagatgccaacaccgattt

SEQ ID NO: 24379 - DNA, 1660 bp, Heterodera glycines
gttgttgggggcctccgaaattttttttttgtcacaagtcgtgaaaatttgtttgttcactggggttgctgtttaatcacgaatctgccttctatgtcaacaaattccaactccctccaaaagggtacccctcttagaagaaattttttagagggccccaaaatatgtttagtttacggagtttgcactaataaggtgcatatgcattttggaatttagaaaatcaagaatggccagcaaaaacaacaacaaaaaataaataaataggtaaatatttttttggcgaaattaatgatcaacaactatgcctatagaaaaggatcaaaattctgttttgaatgaccgtacgtactttaaaactgttaatgatcttactattaccaaggggcatttgtttacttacaaaggtgtgaccaagccgaggacatgggtgcttcggttgtccttccaaaatttgtatgttcaatttgcgccactcccaacggtttatttgaagctcgtatagatcatttgagtacctaaattaggcattttttgcggctgtcctcaaataaaattacagaactcgatcgggatccaggccaggatttccctggtttttaactaggcctagatttttctacaggaaatgcaggtccaggctttttctaaaggtcaagctcttatattatttaaaacccaaagaattcgtaccggccatattcgatcattccaccaaagatgaaaaccttcgactgatttgtgaccattcctttcagtaattgggttcaatataacaaaatgttgtgcaaatagtgttcaaaaaattaccataagccgcaaaaccaggtggtctgtggccacgcaaatctggcacacaccactaaacggtaaattgcaattagttgactctatttttttattaattcaagtccagcatttgattacctaatttgagaatgtgggacttgacaagtaaagaaaaaaaagttatggccaaagaaactgaggatgatcatcaattggacgtcttattaaaaatataagtagtggaaaaatataggttactcaaaatggcctacaattaattgtccaaaagatgaaaggaaaaaatcatccaggactcaaattcaggcggaatctttaaacaaataattaatttcaattagcctcactgtgttggtgcttgtgtcgtaaacatgcaattcgttgacaattccttcatttccacctccaaacaccagcataagcccttttatggtaacagcgcggtgcccatggcgtggcggaggcgttggcctgcccaaatcgtccactttacaccattttggcataaatcgatgatgctttgcataactgttattattgttgttgttgttgctctctaatgacgtacaaacactgtcaagcaacattgttttttactgaaagagaaatttgtacaaaaaaacagagtgccaaaaaatgaattgtttgacatgtgaagtgtttaaataaacaagcttgacgcgatggatatttcggcttttgcaaaaatgtgatttgccaatattacaaacaatatttaaaattattaaatgatttagtcacaaaatgagaaaattttatttgaacttaagagtttttgattataaataaattagctacgaaatatgtatgaaacaaataatgcacaaagaga

SEQ ID NO: 24380 - DNA, 1790 bp, Heterodera glycines
  misc_feature (1694)..(1694): n is a, c, g, or t
ttttgatttttttctattttctcttggggagagtgatattaaagtttgttttttttgagaattgctttggaaaaacggatcccccccccctccgatttggccaatatttaccatttgtcgcatcgctccgccactttggccattggaaggtccgtccagccgatgtccgccaaataattgtgcatttcgcgccgtttgagcgtcggcagcagccaattcaaaggccacaagtaaacgctgccgtaccttaaggaaaggaattgttggcaaattttgtgatgcacttcactccaccccccttcgtttccatcagaaaattttttttaattttttgaaacctagaaattcaaaaaaaaaaatttaggaatcataagaaaacaacaagaaatctttttttagaaaaatcgctaaaaaaagttttcaggggggggaatttttgagtgccgaaacctggagaacttttgaccggcgtaatttaagcggtgaaattttggggtgcaccagtggactcatttccatgtttatttgacatggaaatatattttttttacctttttttggtcaccaattcgtaggattcgtcgtcaagccatgacaaatatttctataaggtaaaagcaattttgaaaattaatgattggtctcaaaacggtgccaacttcggcgtttcgaagcgtttcctcaatcagtgagcaaaatgcctgaatgtccgcctgttcagcagcgcttagcgtatttgacggacgaattccctgaaaatttcttaaacaaatcagacaatttttggttcattttttttgcatttggcccagtttcaggtgctattccagcttttgaaatggttttgtgtgaaagttgtctgcacgggtatgccgacggttactaattgtaagccggtagaaatgtttaggacctttacaaccccagaacacaaaaaagtaaattcaaaatttttttcaattctgtgtccgatttgaatcggagggaaggaaaggggccatagcctaggcagcctttacgacctgtggctataccactgttgaaatttctttgatttaagccaaaaatgcgggaattttatcaatttgcgaccaactattttcgagcgaagaaaaaaattacttttttgccgaccaaatcaacaatagggaagaattcagcgaccagagtgttctgaagacgcagaaagggcacttctcctgaaaagcaaggcaaaaataatgaaaattaaagaaaacattcaaattgagacgcatagggtggaagagcaaaaaaaaaaatctctttgggtgcctcccctgaattttttttccggttacgagcctgcacaaggaaattttttgtgaaaataaaatttgggaagtaataccaaaaatggtctttcaaaaacattttttttttgcatttttacccgtcggggacataaattccgcgtttggcctctgctccaaaacgaaggacagatcggccatcataagaaaggcacggacagccaactgaaagcggacaaaaacaaaaatgttgacgatcaattgaaaaatggacacgaaaagcagaccgtgtcggcatattggtccatcagcgcttgctcctctaaagggttaagaaaaggcgtaaattgcgcatttaaatgaaaaaaccgattaaaatacggaattgcaaattacggatgccttggggtgggggggatgggnatgatagcaaaaaatttgaataaaaaaagaaagggctaatacaaaattcttcgtaataatgaaatttttccaaattttgtacccaaatctaagcga

SEQ ID NO: 24381 - DNA, 1256 bp, Heterodera glycines
  misc_feature (69)..(70): n is a, c, g, or t
  misc_feature (113)..(113): n is a, c, g, or t
gtaatttattctttttttggtatcttttgccttcatggggttttaactgtcacactttttctatatgtnnaaatttcttatttcgatccatattcgttgaaattatacaattntatttcaatttttgcggataaaacttttttattaattcaatttgtgcaaaattttagaaatatttgtacagcagaaaatggaaacttttgataaaatgccttaattacattctttttcaataatatcttttaattggatgcgaaagtataagcaaattaaatatttgaggcaaaaaataagaaataaatttaaaaaaaagaattttcaggaactttaataatttgtaaaaagaaatatgataatgtgatgaaattttttaatttaatttttttttttggtataaaattagcaaatttccaaaaagttccccaatcccgagtgccagtcttttccattctcgagtttttcaaggaataatcactcaaaatttgtcaatttatttaaatatgataaactcaaaggccaccaaaaaacaaattataaaaaagattttttaataataacaaatttcacaaattaattctgttaaatcactgaatgtgcaaataaggcatcacatggcacgtgaattcgtgtgcaccaacagttaaggcagggactttatcagaacttggaggatttttgagatcagacggaagcacctaaaattatttattaattttaaatgtaattttaattataaatattttggcactttatatgcgagaaagaagttggcggtgaacaaaaataaggtcattcgggtcaatgcttcaccagggcattgtctaagaagcaaaattatttttaaaataaattaaaattatttttaataaaaaaggaagttaattcacctcttcccaactccaaatggaattaatttgtcacattttttcaattttccctcatcgtccaaaaagcgctctggccaaaattggtggggttcggcaaagtactaaaaacaaaatgattgaaaaattaaattttttttaaaattttttacacaatttttttggcaaactaccttttcactgaagaggacactgctgatctgaaaaataaaactaaaaaatatttcgccggctttttgtccacctgtggcacaattggtgtgccactttccaccgtaaaattgccaacttttatttcatcaagagtcagatgaggattgttgaacacaaccaaatttgtcaaacgcaatgtttcctaaaaaataacaaatt

SEQ ID NO: 24382 - DNA, 2220 bp, Heterodera glycines
  misc_feature (48)..(48): n is a, c, g, or t
  misc_feature (68)..(68): n is a, c, g, or t
  misc_feature (2160)..(2160): n is a, c, g, or t
ttttaggggggtttacattcgccttcaatgaaaggtctaggtgctttnagacattatgtcaaaatttnaattttttttttttgctttacgggatgccaatgtttgtcggtgggtgggcggcactggcacaaaacggaaggattttccgccggattttccgggcaccaaagcgagggaggagccggatggactgattggcatggtccccccgaaaaaaatccccagaggggttttggctccccaaaattttgtagcaaaaagcatcgaatttatgttgaccaaatgacaaggcccagcagaggacacaaattggataagcaaacattgtgacagatgggcgaaacggaaattttagttattattattactatgaaattaaatacaataaataatatattaggcaataaagaatttaataaaaaaaattattgaaaaaacattatttacttattttaaaattttaaaaaccaaaagttaaacagcattctttccaaaaaaaaagttatgaatagcaaaaaaaaaaattaaataaaaaaataagtaaatataatgcaggtataaaaataaaaacaaaattaatttttaaaatcattataaaaaattaatatttgtaatttgtaaattattttaaaatatagaaattgaaaaaaagaaaaaatttaaattaaatatttttttataaataaaaaaaatgaaataaaaataatatttttattaaaaaaatacattaaacatacaaacaaaaaaccacaactgtcattaaaagcacttgaattttttggcccaaggggtataaacgccgcagagcgctgaaggaggaggagcatgaggaggagaggagggcattttatgccgatgatgaggaggagcaaatgccctccggggatgccaaagtcttccaaaagcgccccgaggggatttcttgggatgtgtgccgactcaaataaagaatacacaatttcagtgaaaaagcgccaaaaattaacataaatcttcttccagtaacaaagcactcaaacccattacattggtcatttttggatgaaaattaaattgtctattttttttaatttaccaactttttcaatttttgggattttcctttttggataaagataattgaaaaataaagcgtaattaaattcaatccaatattatgtaggaaattaaaaatggaatgaaaaattaatgaaaattagaaaggaagaattttgaaaatataatttttgaaattatttttaaactacatttttgtccacaatattttatcatccctaattataccatagcaacgtataacgattaatattttttaaataaaaattgttttaaaaaattagtgaaattcacatgaataaaataaaaaaaatacaataaatttttgtaaaatcaatatacttaataagaaaaacgaagaaaaatgcaaaataatgcatattatgattgcgaaaataagcagaaaaaaataatattgtaaacaatattattatatatatattttattatctattaaatattattaaaagttaataaaatgcttgtgcgcttattaatggtactaattttaatggtgtcattaagcacatcgactaccaaaagtttccaaattggtgaataataatattaaaaaaataaataaacgtattatatttttagcaatgactgacgaagaaatcagcgatcattatttaaaatttttgaatttaaaaaataatttaaacgataaaacaatgaacagatcaaatcaatttaaacagaagttgacaacagcaagtttttacagacaaattgttgaattctttaagcaacacagaacgccaaatggaaaaaatgaaattttgaatgccaaatttaaacaattcgatggattaatttcggaattcagccaattttcacttttcaacaattgcaaactttgggttttctggcgagagcttgtccaactgttaaagccagattcaagcacaaataatgacctcgaaaacaaagttaaaaactgtgaaaaaattgtgaattgttttggccaagggtggtatactgtaaaatctgatgaatactgtaacctttatttacaacattttcaacagtcccattttgaaatgctttcgcatttgttgcccaatgaatccgaaaggttacctgcatataaaattaaattanatattttatctagctaattaatttactctaatggaaataaaaactaaaattttttatatt

SEQ ID NO: 24383 - DNA, 1471 bp, Heterodera glycines
attgaccggattaccggattgactggattatgagagaccggatccggaatccggtcatttttgaaaatgccaatccggtccggttcggcgaatttttgaccggatccgatccgactcggtctctaccaaaaaccataactttttttcattttcctttgaaaaatatctctttggcataatgtttttaactttaaatggtcaaaatttcaaatttttcccccggcggcgactgtcggcaccgccgggcccctttcccaaaaagtttttcttttagaaaaagagcgccacaaaaaaacattataatttttttcagttggaataagaaaatttttcaaaatgctgatttttgaccacaaatgatgatttttgttagcaaaatgattcgggggtcggggaataggtcccataaacgtctcgggtcgggtcggggggctcggggcttaaccctactccaggattcccaaaaaacataggttttcaaaaataaaaaaactttaaaattgtttttttttttaaaattttttcttgaaaatttgaaaaattatatttttttggcgaaattgtcttttcaacggcgacattttctggtgcaccgaatttctacatataattgatgaaattttgcgggttttttcccaatttaagatgcgaaattttaaatttttaccaatccggaatccggatccggcaatatgaaaatccggattgaccggattatgagagaccggatccgggatccggtcattttttaaaataccagtccggtccggtccggagaatttgaaaatctcggtctctaatttaaagaattgtcgtattaatgccgatgtcaatcctagtttatcatatcaaacacacataatacaattaatgtaactcaaatatatctcctactcaatccatcactgaggaagaacattgaacggcatcgcatcttaaaaacgttaaaattattgtcatttttaaagaataatggggagaatccgacagtgccgacaaggcactctcgtaaaattttgataagttttgttaagattttttcggaaattattaagaccatggtcaatcgaacctgacaaaagaccttcattaaaatgcccaaaagttactttggttgccttgttcaatagttttggccttctcttcttttggcaattcgcgctgaattgcgtccaattcttcgtcccacgccttttcaattttgtgccagtgagccttaaaatcaagtgaattttaactttaatggcaccgcccaccataagttcttttttgcgttgctcgcgacgattaaaataatagggaaattgctcccctttcagcctaaaattaaagaaaaacagcaatgaaaaaaacatagattattggtcccaccaaaaagaataaaaatataaaaaaaaaacattttaggggttttttgatgcgctgagcataaaatgagatcttcctttgactttgttcctaaccccggcac

SEQ ID NO: 24384 - DNA, 2648 bp, Heterodera glycines
  misc_feature (32)..(32): n is a, c, g, or t
cctttgatgggggttgaataatagagcccctngggggctattatcgaagaagtacggtaattagaattttaaattttctcctttaagttgtcctggttgcttaatggtccgctcagtttgctgcttgtgctgtctggcattgtgctgaacgcactttgtaattaaattaattaataaaaaatgacttttttaattgcacaatttttgcttgttttaataaaaaggtgtgattgtgttcgtgcgatttcgtcgaaatgttagcggtggcacaactcctataattcactattacttggtaaagagcaacccaaaactcataattttcatttctattttaaaaatatgttgaattttttcagatttctttggcgggatggcactcggcacttttgttcaacgcctttttgctttactgtctaccgacaatggtgcgaaactatagataaaggccatttcatttaaaaaaatgaaatttaacttttttattacatcttatatgttttaattattcaacaattaattattttaaattgtttatatattttatttttaaaatttaaaattcacatctcttaactttgtcaaataaatattattttccttttcataaatttctttgtttttctacaaatttgcattgcttaaatggttaaaagaatttagctttggggctccgtcgtctcatcgggtccctatgtgcatttgtacccgccaacctacgcattggcaaatgcgacacacaccggcactgtttggattgtacggttttttgacgaagaaattaacttttgtcataaaggctttattttcatactttctaaaaataggtccccgacggcagcaacgtcgcaaaattttgaacaatttattaactgaaatttcgcaattgcagattttggcactcactttggaccgctatttggcgttgtgtatgccattcaagcatcgaatttttagcaaaagaaggttaataatacaatttttgattatttgattttatttaaaaataaataaattgtttttagccgtgtgaagcgtctcgttgtcggcctttcaattggcgcgctgttcttctgtttgccacgctttttcgaggtgcaaaccgcggtggagtgctacgcgttggacggtggagcagcagcgcttttgtccagcgcgcacgctaccgtagccgaaacagaggtgctcatagtagcaaatgctaccgtaaccaatgaacagcagcaacaacaacaaatggacactatgtacggtagtgcaattacaaagtgcgacacgtttgtgcagcggacagggctaccggaggttgtgggaaggaaaatggaacttgtttttactatctattatttaaattttattgtattcgtttattgtattaaatcgctttttaacttttagaaccaactctaccgtaccatctaccatatccttctgggcagtgcctttgtgacaattttgccaggtaaattttttttattaacataaacaaaaaaatgataaacaattttaaatgaatatgatttatttttcagcaattttatttcataatattgattcaatcttataaacttttttttggcattttttgcttaattttaggctttttgtattattataattaattttatttttttaaatatttaaaatattttataattttggttctaggggttctcacttttgtgcttaccttgcgtatttcaattgctttgggcgaggcgcgccaccggcgaaaacggctaagccactgctgcgcccatttgcacagcgtcgatggcaccggcgccgggtcgaccaccgcacggacaacaacgacgacgatcagctgcaacacagaaagtaatgggactaaaatgaataatgagaattttaaattgaactgtaacgtactgtaacagttgtattcaaaatggtgctatgacattactcaaaaaaccaccaaaacaaaacaaaaaaattgaagcttgcaaaatttaaaaaaaacttttcgaagcattttctgtttttttctgatacttttcaatatttcgcaataaatcggtgaaatattttgtttaaaatagtaaaatcaaggagaatcgttggccgataattctgtgggcgaaaagcagcactaccgtataatgttaatgtccggggcgatgaccaacggcggcaaaaagccaagcctaaaacggtgaataaacattaaaaaagttattgttaagtaaaataaatttcttacctatttttgagccgtgtatttatattttaaatcatttttcaataataaaaattaaatttttatttaaatttaaaaaatcattttttcaggaaggaacaccgtgccaatgttatgctggtggtgataattgtcaaatttttgatctctgatattcttcccactgtattggacgtctttgaaacagtaaatttaaatataaaatatgtttatgtgaaaattttaaaacactttaatattttcgaagaaatatttaaaacattttaatataatttcattccaaaaattagctataaattaatcaaaaattatctctaattttgaaagaattaaaaataaataagacttaagttgagtaaaaaccaaaaataaactttttttttgttatttaaaaaatcagttttccctctttttgtaaacaacaaaa

SEQ ID NO: 24385 - DNA, 1921 bp, Heterodera glycines
ttatttcaatttgcatcacagaaaaaggccgctctgttttggaaattttccgttttggggatcatttcaacaaatatttggtcacggatgacggtaaaatgcgcaatccggggtgcaaaatccttaaagcttggattttttcccaatcgtcattccccggagacattgagctgagtgtgcgcacgctcaagtcagcggtaggagtcccttcgagagatcaggccgatcctcgttcggacacgaccacagctgttccgagagaccgggtcggtcctcgtcgagaccaaaatccgtcgttccgaattctccatggacgccgtggatcggtgcgctatcagccgtaccaaggacatttgcacggacctgcgcgagtgcgtgactccgatcgccgaaatgatggccgcccccatcgtcgttgatctgctcagaggaccaccccttttggttttcaaggaactcaaggctaaaggcagggacgccttttttgattgtttgggggtgttggactttttgacctttattttattttttatatttgtttggcattatgtttaattatttgtgaccattttttcccaccttttcttgtattcgaatttaattgcattagttttatgttttgtcttctccaaagaaaattgattgtttcttttttttaatttggaataaataaactctctgagaagccttgacaccttccttgaatcccgaaccaaaagtcgaagaaaaatctcatttggcgctcctgaggaagcaggtaaaaacgattgggggaggtcggaaaaataggactaagcagacttcgccgtgtgagttatcgatccaggacggacgataattaacgaagtgtgcaacaaaaagcttgacccaggaaagggcgagtcgcgtcttacttgaaaaaaaaaaaaaaaacaacaaaagttcgggtcgaatctcgcctatttcttccgttgttgacaccgggtcggtgctacagcataaagttggaaactgcagaaaagtgaattgtataaacatatccgggtcggagtgttgtaaaagataaattggaaatgataacacgctcgccacctcttactcgccaaagagcgcttaacctgcgtatgttcggaaatgtcgaaaatcggccggccgctgctgcaacgcaacaaaatcaagaagaaaacagagacaatacgaattttactaataacccgatctccccaaacataactcataatttggaggaacataaccaaaatcaaagtcattttagtgaagtcgaaattatgggcgccgacgaaattcgaaccacattactgagtgtgtcaatcgagacaagctcatacacgccaccataatgcgcttgttacataacagccagcaacaaggcaaggtctcaggtattgcggaattttgaaatactgggatagtcatcatcagaaattttgtgagaggatgagattccggctctcatgggcaccgataggaatttaaaaaagaaacaagaaaattattagaaataatttttattaaaattttcgtttcaaaaaaaaatattacaaacagtcgttgcctaaattgcaaatttttaataaactagcccaaatgcgcgccttcggcgcgcatttgggctagttataaaaacaaaattgtctcattgtctcgataaaactattacaaaaaattaaaaaattttcttaaatttttgattttggttaaaataaagtcacggtttaaaattttttaaaataaaataaatttaaaatcaatatcctcaaaatttattacctgtaagcaattaattaagaattcattcttatgaactgacatcgatttattaaaagtacgactgattgattttatgatattaaaaaaaatttctatctcaatttattgcttgttattgccttgccataaaaattaaaattattttctattt

SEQ ID NO: 24386 - DNA, 1616 bp, Heterodera glycines
  misc_feature (63)..(63): n is a, c, g, or t
  misc_feature (68)..(68): n is a, c, g, or t
  misc_feature (112)..(112): n is a, c, g, or t
  misc_feature (115)..(115): n is a, c, g, or t
  misc_feature (148)..(148): n is a, c, g, or t
  misc_feature (150)..(151): n is a, c, g, or t
  misc_feature (155)..(155): n is a, c, g, or t
  misc_feature (160)..(160): n is a, c, g, or t
  misc_feature (168)..(168): n is a, c, g, or t
  misc_feature (181)..(181): n is a, c, g, or t
  misc_feature (187)..(190): n is a, c, g, or t
  misc_feature (195)..(195): n is a, c, g, or t
  misc_feature (199)..(199): n is a, c, g, or t
  misc_feature (202)..(202): n is a, c, g, or t
  misc_feature (206)..(207): n is a, c, g, or t
ttttgaagatggcattgaaattttgtctttaaaactttttgtaaagacacaaaacaaaacganaaaancaaaagaccacagctgaaaaacacagctaaaaatccgcaaaaanggncaacccatggagaaaacaacgcataaaaacatncnnaaanaccgncacaaaanccaggcccaaaanccggannnngaggnaggnatnaaannggggatggatgagggccgattgaagttatcctaacgcccaaacaaatcccaaattgcggcgggccgtcaatttttgaggtaattgccccctcccccctccctcgccggcggattttgggatttgccggataatcggtgaataaaatatttgaaattttcggcatgaaaacccaattttgtacgctttgaaaggaaggaactgagtgtgatcaatgcgatcagagaagcctctgatcactgcctgatcgcaggatgtttgttgatcgccttgtgattgtttggaaatatataaatgcaaagaatcaaaatttttgtcccaattcatttatcagagattgattttgaatttgtgataagataaagtttgatcacaactgctgactgatcagggcgaactctgatcaatggaaaagtttgttccataaaaagtttaaaaaggctgctggactttatctagttaaaaactaaaatgtgctaaaagtataaaaaagtgccagtggaaaaataatgttcaaaactgacaatgagacaaaaatgccaaaaatggtgccattttgacgttaaatttttcatttttatgttttaaatgtttctcgtaatttttttttttttgaaatttatggtcaaatatattcgtaaaatatctgaattcaaaataaatgttcttcgtttatgaaaaaaagagaaaaaaaatttcaatttattagtttttctttggaataaattcgtcataagccaaaaaattcagatagaaatatcgtaatgattaattgagttgaattctagcaaattaaatttcaatgcccacggggcaattgtgttgttggccaagacattttgccgcccaccgtcacgcttaagggcacaaaaattgagtgccgccgtcagtgatgccaacaaacaaacgatgccgtccgtgtttgcgtccataaatcgcgcaataaaatggaaggcattggccaaattgagtgttggaatttaatagcattaattgcgttagccccacttaatttgatgggccaatgaaatgccaaaaaatgataaacaatttaatgtttaagaggtgattttctttacaaaaataaattccaaactgctcgagagggggattatgtcggctggttttgtttgccccattaatttaaatcttaaatctctccatccatcgggactgagttggccgccaatgcgctttcgtatgacataatcagggaacggattttatatttaaattttaaaaaatttcaaacttagattttttttaaaaaacttcgaaaatttttcaatgagaatttcaaaaaaaagattaatataattttaagcgattctaagtttgaaattttttttttaattttggcggggaagcccgaactgctcccaaaccctggacataataatgccctggggca

SEQ ID NO: 24387 - DNA, 1719 bp, Heterodera glycines
  misc_feature (1634)..(1634): n is a, c, g, or t
tgtgcatactgtaattttcgtgtgaggtgctgtagtacactttatcagtttaaccccccccccccttagggcacaaaatgagaaggaaaagcattgtcccatcggcgcacctcaacaaattcaacggcatcagttggcccattctcatcgttctgctgattgtcctaattgtaagaaaaaaagaaacaaaattttaaaaatgccaaatttagtgccaaactttggcggatggcactagcaaattcagtcagggcgcgggagagaacgaagttgcgcagatgagaacatttgggggaggagaagcagcaaacagcggagtaacaaattaaattcaattgaaaagcataaacaggcaattagcaaatgattggtcaattagcaattaaatgagacaattagcaattcaatgggacaattagcaattcaataggctctttccaaaatgccatctcccaaatattaattgcatttaaatagatcgcttcgaattgggagggttcgggcgcaattccggacgacgaggacggagacgtggacgaagaggggtccggaggtttgtgcccttaacaaacacattgatgtccaatcatttgaagatgggccatccgcggaggggtcgggcagtgcgccgacggacgaatttggacgacagacgccaaacgaatcggtggccatcactgatacggtaagtgatcgatcagcagggggcacagtattccggaagggttacggtggacgggagggactgactgatcattcactgtccgatttgatgcataaactaaaaaaagtgccaaaaacgaacaattccagcggtcccctgcccaatttggtgacagcgacagaagaccacagtacgccaacacaacaactaccgtaatccacctgcacagtttgagccccgtttctgtcctctccacaacgcgtgccactcctccaatatttgccaccacaacaacgacaattatgctggccaccacattgaggcctccgttgatgaagccagcggcaacgacggcacggacaacgacgacactcccgagttcagtttcctcaagggcttcatcgccaaaaacggccacgaccaccgtgccgagaatgatcaagccgaaagacaaggacaaatggccgcaaccgctgccgaaaagcaccatgccgcctttcgctcccacgcgcaccacaaaaagaccctttttcatttcggacccttccggcactttggaacaacttcggcccggcattttcgcctgttcgttttccccggttaattctcaaaatgtacgccccatttttagtcattgtcggcggagttgtggttggactgcttctgctaattctgatcatttcatatttggtgtatcggcttaaaaagagagatgtaagtgcacttttggcattcgattggcacgccaaattttgcgtgacggaggcgaaatttcaaagccaatgccttttttagtgcttttcggtttaagggaccatcaaaaaatagttttaatagagatggaattttaggcaattcctatataattgaaaatgaattaattttttggctattattttggccttatttttgcctatttttcgtttttgtgtctgaaaattactccctaaatttcgaaggttacaataanatttttgttttccccatttcaggagggcacttacatttgcgatgagccgcaccagcaaagccattacccttacgcttatcataag

SEQ ID NO: 24388 - DNA, 1734 bp, Heterodera glycines
  misc_feature (13)..(14): n is a, c, g, or t
aattaaagtacannggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaaatgattttttcaagtgaaagtttggggaactcaaaccattatggggagcaaaaatccaacgcagaatttaagtacagggtatagtggagctattccggaaggattcggtctccccataaattttgggcgcatcgtttcagggggactgcccccgaaaacccaaaaaaaaatttttgggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaattttttttgagccagctagctcggcgctcatttcagtgtaagttagtcctttaccggggagtatccctgcatagtttggtacgcttctgctcaattagcaaaaaatatgagtgatcgaattttcactaaaaaagttaagcctacattttttggcatatttaaaaagcaattaaaaaattttaaaatttaataattttcctgcaccgaaggtactcactcggcctcttcgcggcctcgtggtgggccttcgcccccccccctcccacgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgttacatcacggcaccgaaccttttggctagtcagcaatcg

SEQ ID NO: 24389 - DNA, 1064 bp, Heterodera glycines
tctagggttcggaccccgtgggcgggggtggcttttcacgggggcgggggatggtgggggtcagagtcgcgggggcggggacgggggcacgataattccgcccccgcgggggcgggggcgggggtttgatttgaattaactccaaaaaattttacaaaaaattaattttttatgaatgatgtgatggctccacattcctttagtcaatgtatcgcctcaattcaattccttttggcataaattacacagattttgtctaaagaattaccaaattttagagatttttggctaattttttaagaaaaaataggtttttggggggccggcggtgccgataggccgcctggcgaattttgaaatttaagctcgatttctaacagatgtttacaaaaaaaataagatttttacgataaatttttgtttttttaatatattaaattatcatgatttactcaagcaaaattggaactcagatttgtaacatattttcttgaggcacatttttcaaaaaaaaaaaaaaacttggtgaatgtgcgagcgtagaggtccggcggtgccgataggcgccgccgggaaatttttttgaaaactgatggatctgttaatagattttgtccaaaaaatgataggtttttgcaatttttagagaatttttttaataagatttacgaatttttgggccctgcgatgccgataggcagcgccaggcgaattttaaaattaaaaaaaataaattaaaaaagaaaccgtcaacctgaatcgaactcacgacagaaagtaatgtcaaggttgattcactaaccactacacatcaatgaccaataataaaattaactttaattcataaaaaatttgtcaaaatggttaaaaaaatcaaaattgtataaattttttgcttttatccatgaatatgtcattctttagggtggtattttcccccccgcgccccccccgggggggaaaggtccgcgggggcggggggatgggcgggggtccaaagtcccggggggggggaacgggggtggaggccaaaaacctggccccccccccgggggggggggggg

SEQ ID NO: 24390 - DNA, 1020 bp, Heterodera glycines
tgtcgttgggcacttccggacagtgcacaaaaacaacaacaccagcagcaccaatcggcccaatcatcagcttttcaacgtcacacacggacaccgtatgccaaacaggtgtggccagaggacagcggcttacgataaaaatttgatccaccccgcataataccgtaatccaattcacagggctctagctttggcactggtgttatgggcggcgctgaacggcgcagcagttgggcttcatcgtcggccggctcgccggtgttggcaatcaacgcgcaacagcatgcacagttggagcgtttgtatcgccaatccattggacagcaacaggtggttggggaggaggggtaattagttaattaattagtgtatttaattaattatccatttaacggttcattagaataataataataatccttgggttaatgaattttatactctattatccaattcggcatgggcaaataagcttaatcttctcaagaaaatcgttgccctcccatatttctcgtggttcagttggttaaatgtccgactcagctttctttcgaacttcgttggttcaaatccccttgtatgcggcgccatatttatttatttatttctctctcaatattttaaaataacggaacaaattgtgcatttaaatatggaatttgttctttcccatgttgagaggcaaaacaatcttacgaggctgtatctactcaaagtgccttttcctgttggcgttgagttcgtccctcgattacaaattcctttttaacaaatatttttttttaattaaatttaaaaaatacaatttttttttgatttttttaaaaatacccaaagattagagaaattgttctttttttttcttatggcgaggacggaacatattgcaccttttgaaaactaacgaattcaaatttgtgtaggggggggggggctggctgctcagaatttaaataccggaaatgagtttttccgtttcaagaaattttgttaaaatccgaatttcgaaatcgccgctat

SEQ ID NO: 24391 - DNA, 1089 bp, Heterodera glycines
  misc_feature (1068)..(1068): n is a, c, g, or t
cgaaacatagcaaccggagtttgaagaatggagaaaaatgccggctgacttttttgttttaatggatttattttaatgaaaaatttgattgaacgcataaaaatttgattggacgcataaaaatttgattggacgcataaaaatttgatgggacgcataaaagtcgattggacgcataaactgaacttgagccaaaaaagttcaaaaaatgtgttatttcgaaaaaaagcgaaattttcgaaaatttttgaactttccagtcgagtctgggttcggaattggtctaaatagatgccggattcgtgatcagtaacaccaaaataatgcatacctacctatatgcaggcacaacttcacaataccagtggtcgcagtagcagcaatggggacagtgcatttgctcgccgtatccagcaacattttcagccgggcgacggtgcgcagcgtttgtacaaaatggtccagcagccatttcgggtcaaattcgggtaagggaccattaattacataaaaagggcccggggatgcgcaactgcatttttgaaacattgtgaaacatttatttttttaagaaatggcgaagttgagcaacaacgtgccggttcttctgccattcctccattaacaccgtttttcaaaggttttatgcaaacataattgtgttaattgtaagaagggaggagaaggaaaaaaacgccccagtaaaaaaatttttttttaaggatagaaaacctgaaatatcattgaaataatacttgctaaatttaaaaaaacccctaaaaatttttttgattttgtttccttgaattttgattaaaaacgattttgaattatgtaacgaaaattttgaatttttttttaattttctaattttgataaattattttatggaactttataatatcaatatgttttcttgtagatgcacacccgcttttttgcaatgactctcccagacccaagcccatcacccaatcagccggcacacaaacgttcgcttttcgttattcatttttttttatctgcggaaattttgtttttttcccataatatggcaacctctactanataaaagggtttttacttttt

SEQ ID NO: 24392 - DNA, 1099 bp, Heterodera glycines
ctcgcgtcgcttggaccaacgttttcaaggcgactcctccaaaatctgaaagaaaatgaattctggtttaaatggtcttctccaaaaatttaaggccgagaaaagtcactcaaattagttttattaattaagcaatgtaattacgaagattaaagaccattttagaagaaaaattaaacagctgactttcaagtaatgataaatcgccaatgatttaccaaaatgggacggacccaaaccccaaaaacctcgtcatcctcctggtcgtccgggtcacagaacattcccgccccaccaccgccttcggcagcagtgggcgctgccggtgtgccgggccgaggcgtcggttcgggcggttttttgggcggcggtttgcccgaaccgtcaccgtccgatgccgtcgtcgttccaccgccctcccccgtcgcggtgccattggtcgccgctccaccgctgtcgctgctcccgcgttcgaccgccatcattcgcttttgttgctgttgccttgcactgctgcccgtgagaatgggataaaatatagtcacaagctaaaatatagaaagatatagaattatggacataaatcgcaatatggaaaaatatgtaaaatatggatatagaaatcaaatctagaagcttctaatgaagctaaaacatgtttttcctgcgtttaaggccatcgacaatccaggaaatattgatttttttcgtcataaagaatggccttctttttttaaaaaaaatccacatttaccaagagacaatatgtatagttttcgaaaggcaaagggtgacgcacaagccgcgcgaaaaagtccgcggcgaaaaaactccgcggcgaaccgaacggttccctaaaattatatgggaatccctactatgtaatttgggtccgttttttataccaatttttttttggtttaaaaagtcctgaaaacaggtaccggggggttttctaggttgctaagagagggatagaaagagagagagagagagaaagagagagagagtgaaagtgaatgataggtgtctgacagagaggatagaaaaaggaagagagagagtgagaaaagggaaaagaaagggaatggattggaat

SEQ ID NO: 24393 - DNA, 1342 bp, Heterodera glycines
ccaaaatttccctttttcaattaaaaaaaataatttttccattagggcgccgaagttaaacttggctcaagcgtgcccgatttgggccccaaatttgcacaatcggacagtgactacaaagcggaacggagcgcggaacatttccgcatgcaaatcattgagccaaaagtgatttcacatgcgcacattccgggtgagtgaaattattgaaactccgacatagccagggggggcctaacctaaaaaatccaattttaagggaaaattgattaattttcaaaatttaaaaaaaggccgtgatcaagagggcgcctctcacttttttccccagacctgtcgccttctacaattgtcatctcatatttatgttttacaaaataaattctttacagaaaatgtcatccattgcacctcatcctttttaatgaattactttttattcaaactaaaatttaattactcataatttttaccctgtaattggaaaaaaatcatcaaaaattattttatgttttttgcttcctattctgttaataaatttaaaaaattttgtttttttttcatccccaccatcaaaaaaattttttttagacaaatacatataaattaaggaccagttcatacatgtgcgccggaggttacttttcctttttgtgaccccctaaaaatatttttgtttttcgagggaaatgttttgagatgaacatgaatatgatgttcgtttttatctcttattcatgttacatgagttacgtaaaattttttgacaagcaatcggtaattgtgtgttttgtccccctccccccccccgccctccatttttcgaaaaaataacaaaaatttaaaaagtcgtgtaaaacgactttttgtgtgttttcgaggtcgctgataatgaatctgacatccatttctattaattccgaaccccgaacgcgagttagaacaaaaagttaaaactcaaatttcactattgctcggctctaataaaattgtttacaacaagaaaaactaatcagaatatattaaaacattaaaaacgaacgatcattctgatagatttttaaattttgaaaatgtgaattttcgactttttgttcgaattcgggtccgaggtccgcaattcgcccccctcgttcgttgtaagtcgtaaggggggcgcgtcgccggcaaacggggaaagaggaaaagttttaacaaattatggctctatccagtttatgagtcgggggcgtttgggccccagtttttgggcccccgcgtttgggcccccgtttttgggccctcgttttttgggcccccagggtcgtttgggcccccaagtacagaaaaatgaaaaatcaca

SEQ ID NO: 24394 - DNA, 1886 bp, Heterodera glycines
  misc_feature (677)..(677): n is a, c, g, or t
  misc_feature (681)..(681): n is a, c, g, or t
atgccgaaaagtgcctggggatgcgcaagtgggcgatcgttcacggcagtgccttcagcggtgccccaattgacaatgtaaaaagatggctctgtgtccgcgcggtgccgcactctctgccacgccacgacgacccttccgtcgtcccttccccacaaatcgacgacattcgcacactttggcccattctctaaagcattttggcaaaaggaagaaacatttgctgtgaaaggtgttgcctttctgacagaaggaaaggtgcggaaacatttggcagttcaaatcgaccgaaattttcacgtcgaaagggtcaattcgaacgcatctgtccaattgaaagggcggcactttcggacaaaattatggcatttcacctcggcaacacccgcacttccatgtaaatgtggcactgtccccggagaacatccgcgggaatggccaaatgcattttggcacccccttggaccaattcgagtctcggtgagtccaaatggtcgtcaacagtttggcaccgcttcggataggctgtgggtggtgaatatccgtatacatcggcatcgtcatatcccgagggattctgtgacattggcattggcataactccaaaaagataaaacagtcactgacctgccaactgaccgaaaggtgtaccgtccgctggtcatccgactgcttgngcanggcaagctgaatctgagagcaaaagccgttatttaaatggccataaagataatgaatgcaaaattaaacccaaaccgatttttttggacaatgaaacccgggatttggggggaaatggttttggcccgaaaaaaatttaattgtgggggggatttttaacaaaaaggaaaaaaaaaaatttggggggaattttgaattccccgcggggatcccccccccccaaagagttttttgggggggaaaaaaaacccccccaaaagggggggggggatactttttaaaagggaaaaaaaaccaccccccccaaagggcaaaaggggggggcgaaaaaatttttggggggaggaaaaaaaaaaaaaaaaaaaaccccccccggggggggggccccccccccaaaaagggggggggggggggggttttttgtgccccccccccctccacaacaaacacccccccccccccccccttttttttttttttttttttttttttttttttttttttttttttctctcccccccccccccccgccccccccccccgccccccgccgcgcggcgggggaagaaaaagaaaaaaaaaaaaaaaaaaaaaaaaaaaaaaaaaatatccccccccctccccccccccccccttatttttctctccttttctttttttttttttttttttttctccccccccgccccccccccaaaaaaaaaaaaaaaaaaaaaaaaaaaattaaattttttttgtgtgggtggggggggggggggggcccccccccccccccaacaccaaaaaaaaaaaaaaaaaaatttttttgtggtggaagaaaaaaaaacccccccccccccccccccccccccaaaaaaaaaaaaaaaaaaaaaaaaaaaacaaaaaattttttttttttttttttttttttttttttgggggggggggggggggggggggggggggggcgggggggcggccggcccccccccccccccccccccccccccccccctttttttttttttttttttttttttttttttaatatataaataaaaaaaaaaaaaaaaaaaaaaaaaaaaaaaaaaaaaaaaaaacaagggggggggggggggtgttgtttttttttttttttctccccccccccccccccccccccccccccccccccccccccccgcccccccccccccaacacaaaaaaaaaaaaaaaaaaaaaaaaa

SEQ ID NO: 24395 - DNA, 1216 bp, Heterodera glycines
ccatttttcgcacttatcccgcgggtaatcgccgaggaattatttttttttttgggcggagggtcgtttttttataatttttttgtgaatggagaaaggaaatttcaccactaatggggtttttgaaaaaaattttcaaattaacattaaaattttcaacggaaatgagtttaaaaaagtttgtacgagctcaatgtacacacatcgtaatcagataaaacttcggtttttttactataaaaatataatttaattttctattttttggtacaaaagctcagtctgattgataccttttgaattttcttgggttttttttttaatttgaattcaattaattctttaaatttatttaatggcaaaaaagcgcaattaaaaaaattgttttttttcttcagttgaacaaaagcacttggagttggtgccgcatgagctgagcgagcaagaattttggacccgattcttccagtcccattatttccatcggcagcgcaacactccggcggatgtgccgagcacgtcaaaggcagccggcagcggcacaacgacaacggcactggacgacccatttgctgactgtgccaaaatggacgagaaaggtaaatggcacaacacaagcacaacctctgggtgatgagggtttgcgggtttaaaacaaaaaaaaaatttctctcgcaatcaggaaatttcgatgatcataccatcattatacatgaaagaaaaacacaagaagggggtcgactctcctccctccccctcttataaattagtcccaaaaattaacaacaaaaaaaaaaatccacgccgcagaaaaggcggttttaaaagcaaaaaaaaaaaaagtcgatttacatggccaaacccaacccttcgttcgcaaaagactttttttatacccttttcaaattcatattaattttttttaatcaaaattaataaatttaccaatgttttttttcccatcaaaaggtgtcgaaaattgatacggagtaaaattttgttcaatcaaaattctctggagaaaacaaaaattttttacatgactccaaactgctcaaagcagtggtcgttggatttagggatttgggagaaagtttttttcatccaaattttcgggttttaattttttcccctgctgggaccgtcctttggttaatcgaaggacgacttttcagatatggccaatctcattgccaagggacaacggacactcaaa

SEQ ID NO: 24396 - DNA, 1135 bp, Heterodera glycines
ctcgggttccaatgctgcacgtgcgccacgcatgcccattccaactgctcacgggtgccacgcaagcccattcgccaagccctcgggtccaactgagcacgggtgccacgcattcccattcgccaagccctcgggttccaactgctcacggacgccacgcatgcccattcgccaagccctcgggttccagctgctcacgggtgccacgcatgcccattccaactgctcacgggtgccacgcatgcccattcgccaagccctcgggttccaatgctgcacgtgcgccacgcatgcccattccaactgctcacgggtgccacgcattcccattcgccaagccctcgggttccaactgctcacggacgccacgcatgcccattcgccaagccctcgggttccaactgagcacgggtgccacgcatgcccattcgccaagccctcgggttccaactgttcacgggtgccacgcatgcccattcgccaagccctcgggttccgactgctcacgggtgccacgcatgcccattcgccaagccctcgggttccaactgttcacgggtgccacgcatgcccattcgccaagccctcgggttccaactgctcacgggtgccacgcatgcccattcgccaagccctcgggttccaactgctcacgggtgccacgcatgcccattcgccaagccctcgggttccaactgctcacgggtgccacgcatgcccattccaactgctcacgggtgccacgcatgcccattcgccaagccctcgggttccaactgttcacgggtgccacgcatgcccattcgccaagccctcgggttccaactgttcacgggtgccacgcatgcccattcgccaagccctcgggttccaactgttcacgggtgccacgcatgcccattcgccaagccctcgggttccaactgctcacgggtgccacgcatgcccattcgccaagccctcgggttccaactgctcacgggtgccacgcatgcccattccaactgctcacgggtgccacgcatgcgggttccaactgctcacggacgccacgcatgcccattcgccaagccctcgggttcaactgttcacgggtgccacgcatgcccattcgccaagccctcgggttccaact

SEQ ID NO: 24397 - DNA, 1255 bp, Heterodera glycines
aactctacctatacccaattgggtaattgaacaagagaattaataatgttttgtcaaaaatgttgaaaaatgtacatataaatgaaaatgaaaccaaaaaaaaaaaaaaacaatgtatggacatgccgcacatcttttcttcctctctcgactcttcttttcattccctctcctctctctctcactcttttctctctcttcttttcactttctctctctgtctcctcttttggctttctctctctgctcttctctctctcctcatttttttctctcaatttatcttttcttctcctctcctctctcctcttatttctctctctctcctcttgtctctttctctatctgctcttttctatctctctctctcccctcactcactctcctcttttctcgttctctctctcctcttttcactttctttctctgctcttctctctctctctcctcttttctctctctccaactctttctctctcctctattctctctctgtccttttctctctctctctcctcttctttctctatctctatcatcttttctctctccaccacactctctctctcatctctcctctttctcctcttctttctctctctctcctcttctctctttctctctctctctcttctctctctctctctctcccctccctctcgctcctcttttctctctctcagtctcatcttttctctctctctctctcatttctcctgtttctctaataattttctctctccttcactctccacactttgctcttaactatatccctctctctcttcttcactctttcctacaacatatttttttcctggcttctccatgctctaaatagtacgaaaaacactttcttttttgtgtttgcgtataaaaatcgggacttttatttgcatatttttgcatatttcgagatttttgtttatatttgcatattttggctttttctgcatatttcgtgcatattttgccattttttgtgcatattttccgattttttgcatattttgccatttttcgtaaaatattttccgttttgaatatcccttaagtaaattttggcagacaataggatgagctttagtaccgaaaatcttgagaaatttttgattttcaattgcaaaaacaaccgatatgaggaaaattttttaaatttatttgcacccctaattttcaagtttttttgtgcatatttggtgcatatttcacgactttatttgcatatttatgcgcatattttggccattttccg

SEQ ID NO: 24398 - DNA, 1246 bp, Heterodera glycines
attatggcctggaattgagactaaataggaatttctcgtaacgagacacagaatttcgggttttatgtagcctggaatcgggactaagaaagcggaatttccgactgaggtcccgaaattgggatcaagatgagaaatttcttgtaacgagactcagaagcgggatcaaaaatgatgaaaaaaatatttcggattgagtgtcaggggcctggatcaaaaaaaaacgaagggattttcctaaaaatggacggagtctcggatgaattattcgaatcataaatcgggatttgaactatagaacttctgttgttgtttgggactagattcaggaattttgaatcaaaaaaatgaacaaataatgtaaaaaataaatacaaaattttatgccaaatccggtattttgtgccaattttttttttcgtgccaaagggtccacctacggggccgcctggcgtccggccaccccgttctacgcgtacgctcccccgccaccgcccaactggccggaaccgatgcgcatggcggccgcgccgtgggcagcgggcggcccaattcggaaagagcggcgggtaggccaaaaaataataaaattttaactgggccaaaattattttggcaaaatttggtggcacaggacaaaccatttgacaacaacgacggagaggcggcggcgactgctgcggcactgacagatgaagaacagcgcaaaattgtgcaggtgggcaatttttcggggagcaattcgtcccccgccgatctccctctcgaaattttttaaataaaattttcaaacataaattttaagaacaaaaaatttagaaatttttttttcatagaataattcgtttttttttttttgaaaaatatttcagcaattttttgagcaatttcttcataattaaaaacaaagaattgctctaaaattattgtattagtattcttgaaaaattttctaagttttttttctgcatgatatggatccaaggaaaattaaactttgatgggtcttttttgtaaaaaattacattttattttattttcttgagttaaaatgcctcaaaatttcagtgaaaatctcttttaaaatggtcaaaatttctatttttcctccgacggcgcctatcggcactgtcgggccccaaaaccttattttttcataaaaatggggtcaaaatctcaaaagtggtcattttttggtgaaattctgttaacaaatttgattttaattgaaaaaatttttccggtg

SEQ ID NO: 24399 - DNA, 1437 bp, Heterodera glycines
aaaggtgtacagaaagagaaaaagagcagatgggtccccctagatgcttgtaaaatttataggatatcccaatcgggaccggattcatgaatctcagcttgtataaaagcgatcacatttttcattttgttgtaataaattcaaatatgtcaaacagtttctttgtgtttttgccgagcaatgtaacggattatcccgacaatcagcccaacaaatttcgggtccgcctcccgaagcctttacattttaatggctcatgggtctgtgggctgcatagtattagttacccctactcatggtcaaccattggcacattggacgaccaatggattgacattcacttcaccgatcgccgtgctagtgatgaggacagacagcgggtgatcagagttccagtgcccagggcatcgcatagtaaggttgaacagctcagagattttttgactgtcactttgcgaaatcatagtggtgcaaagttgttgccactcccccgtgaggaggaagagaatcgcaatcggacaaaacctctcggttcgccaccaccgttgaagagagagaaaagagctgcgccagtaattaatgagagcggaaaacagcttgactcccccttattgtacgatggaaatgatcaaggtgggattgacgagtctccgcctcatcatgaagaagaagaagaagggacaattcaggagtctccgcctcatcatgaagaagaagaagaagaaggggcgattcaggagtcaccgccccattatgaggaaacaccaaaagaaactgtgaaaacgcccgtcacaccaaaagtgccgacaccaccgcctgtcataagccctactaagccatcaatagtaaaaacgccagctcctccctctgatacaacaacatcgcctcccacaactgttaagccaccagtaaccgtccctcctccaatcacaaaacacaataacgccgtccgctcctccagccacaaagccaaagaccgagcctccaccaatcgtgcaaccaacaactacccctcctccaagcacaaaaccaacaaccgtcccaccgccgaccgaaaagccaaagaccgtccctccaccagccgtacaggcaacaaccacccctcctccaagtacacaaccaacaaccatcccttccccgaccgcaaagccaacaacaccgatccctccactgccagcaataaaaaaagttcctagcccgtctgttaagccgacaattccggcaccaccggcgcaactaaaaagctcgacactgtcaccaaaatcaaaagcacccattttgccagctccagtttctctttccgctaaaacgagtcctaagtctcaatcgtcgccatctcctccggcagaatctccaacgcattttgaagaagaaacaacacctgtaaagcctcaggggggggccgacaattacagcgcctccagcacagctaaaaag

SEQ ID NO: 24400 - DNA, 1492 bp, Heterodera glycines
acaaatcgcattaaatttcataaaatttctcgcagatatcgataggcaccaggtatggcacggaaagacttccggtttccgacatttttggggtcggaattccgacttccgaaatttttgatgaaaagtcggaaatttttttaatttttttttttcaaaaaactagtaagttttgtacaatttctgttaataaattgaactgaaatttttaaaaatttcccggcggcgcctatcggcaccgccggaccctaaaaatccctatttttcttgcaaaatttgctcaaaatcgcaaaattttgtaattttttggacaaaatctgttaaaaaattttcccggcggcgcctatcggcaccgctgtaccctcctctaagttcccaaaaagtttttgaaaaaatagcgctgtaaaaaacgtgtaaatagtcactccttttcccaaaaatgttctaaaataatgaaaaatgacaaaaaagattttgataaataattgaataatttttcaagcgaatatactaaaaacatttgtgaaataccttttacttggttaagaattaaaaaatttagcctattaaaatatttagaaattttttttattatattgtatattttttgaaaaatttccgatttccgacgtttttggggtcggaaatccgatttccgacacttccgaaaatttttggggcctcggaatgccatccctgataaggaccgccggaccccctgtttctagtttttgaaaaattgcaccgcaaaaaagtggttttgaaaagaaaaaaatagtcaaatttatgaaccgttaataatttgatttccgatcaactttttaccgtcggatccaatcggaaaatcttagtcgaccaatcagccccttttaatgcatcccgccagcccttaaaaatttatttttcagcatttttttatttttggaaattctttgaatttaattgaaattttttcgattttccaaaatcccgcaatcccgcacgggatcccgcaaattttaattgcgggatttgcgggattaatcccgcgggatcccgtcccgcaaaaaattttgagttccagtcccgcagcgggatccgcaaatttgaaatttccggtctctatgtactacctgagttttcaatgaatttttaaaaatttagaggacagagttttcatttatgttttgggacacgggactgaatttgcgtgatttagttggaacatttcgccattttttttgtatcataaaatttgaattttcaagatcacggtaggggggtccactgcgtttcggcgctcgcgtttcggcgccagctcgtttcggcgctcgcgtttcggcgccaaaaaaaaattataaaaattcagatacttggttaaaatctacaaacaaaaaaaaaactttttttagttaatcaatttcatcgaatatggcttcaaaaattgaaacaaaaaaacaacaagtgaagcttcctcacgaaggacatctttacacattcgacaaaatgagtg

SEQ ID NO: 24401 - DNA, 1293 bp, Heterodera glycines
  misc_feature (90)..(90): n is a, c, g, or t
  misc_feature (103)..(103): n is a, c, g, or t
aaaaattttgggcctgagcgggacatttgagtcccgggcgtataactcgtcagggatcgggtttagccaaaaattgccttgaacattttntgtagagcatttnaagctctatcgaatggtgtgccatgtgtcggaaaatttcaaaaattttcgagctaggccccctagaaattttcaaaaattttttttagggcgagaagtggggtgaaaaatatttttctggggtaaaataaggtgctgagcacgaatatgatgtttgttttttgtttgggaaattttggaattttttaaatttttttgaaaatcggtcactttttttgccctctggattttgggttaaagtttgaaaattcataactcagtttagatcaggtctattttaatgtatagaggcttaaaaaatggagtaaaaatcggagaaatttttgccctttatttggtatttctatcaagaatataaaaaaagttattccagaaattctggaaattttcgaattttcagaaaaaaattcactactcggttctgaaaagatattttgtaaaataaaaatagcccaaaaatccgcaattttttgctctatttgataaattttatttcatgtttttatcattttttagtaaaaagttataaaaataaaagtgattttggaattcgggaccataggggggtgcacatggttttcgagtggggaaattttttcgcgcccaaaaacttccagaaatatgtctttagaggttatttaggacgctgatcacgaatctgaaatcagatttcgtttacctcttcgggaaagcctcagaatccctgcgtatagtgatgaatcctatgatggacaccatccccataccgtttgctagagggatggccaccatccccataccgtttgctaggaggatggacaacatcttaagattgactaaagggatggctaccattttgtgtgaggggggggcagtactattagagtgtcgagagactgtgttaaagagagaaacagttagagatactagagtaatagagaaatagtgtagagattactctaactgtcggacctattattcaacccatattctattagagtgtcgagagactgtgttaaagagagaaacagttagagatactagagtaatagagaaatagtgtagagattactctaactgtctcaatcttaaagggatggatcaatccctttaggccatccctttagtcaatcataaagggatggatccatatagtaaaaaagacgtatggtaaatgtttaagggattgatccatccctttaggcatccctt

SEQ ID NO: 24402 - DNA, 1672 bp, Heterodera glycines
ccaccaccaccaccaccaccaacatcagcagctcaaatagacccatcgcgtttgattcacacgctcgacccaccaaaaatattttttagaactcctccagctaatcaaaaccctctgacatatgtgcccaattcagtgtttattctgtatgaaaccaatatggaacgattcaaggtggtcttcaatgaggagatcatcagccatttgtctttctcaccgcagctaggctatgtgcttggctttgaaaaccctcagcatgtggtgtcaaatgaagttgccaaatacgggtttgatctacgaggtggcatatcaagttttgcagtctactcaaaaggactaactgaaaatatgataattggcaattcattgagctccttgctccgggttgtgtctatcagcggtgctatccccggggagtataatgagaagatttacgactcgccaatatttgcgcgagtgttgccacgtgagatcaacgagattgagattgaactgcgcacaatggacaaaggtcgtctcgtgccatttgcctatgggacaacgatggccgtgttgatatttaagaaagtgataaatttttgatttcattcattttgtgttttatttgttatacgttaataaaaatggttcatattgtgtttgacccaagcattgcgcagtatgacgagtatgtgcagtacggtagcggattagaaaaggacgattttgactacttcagggggtcaagcccctttcagagggggtacggtattcaacgaggggcgggcgttggagatgtgtttcgtggactgtggcgttttttcctacccattcttcgccgcgttggcaccacggtagggtcggaggcgctaagcactgggcaacgcgtgctggagcgagtcgggaatgagggggtgccatttaaagaggcgcttgtcagtgagggaaagcgaggaattgcaaaggaggactaccaaaacagtttggaagcggaaaacggagtataaaaagaaagagaacacatctacccagtcatcagacactaattggacgaccttttgtaaaacaggcaaaaaagcgtattcgatcggacgcttttggactttattaattaaataaatggctttccataaaatcgacaacgactcggtgaactcaatcaccaatgcattggactttttccgtataccccctacaaatgtgagcatttcatcatcaaaagtgtttgagcttctgcctagcaatccgcttacagacacaccttaccatttcaaacttcattccagccaaaattatattgatctgtccaaatgttatttgctcaccgagtttcgaatccgtaaggaaaacgttaatggtcaacttgttaacctaactgttgacgatgcggatattgcgccaattcaaatgatcggacaaaccttcatccgcaacataaaaatgagtatcaatgggcgtgaaatttttaatgccaatgccctaatggcctacaaaacatatttctcacatgaactctcttattcaacgacagcaaaagactcccatttaaatgctgctgggtattacagggacacgggtgaagtgcttgaaacaggaaatggatgcatagcgcgacgtaatttgtttgctggtagtaacgttgctcaattcatcgccgaaaattgacaccgacctattcaaccaaccgctatac

SEQ ID NO: 24403 - DNA, 2116 bp, Heterodera glycines
  misc_feature (1999)..(1999): n is a, c, g, or t
  misc_feature (2036)..(2036): n is a, c, g, or t
tttaaaattattttccgtttagcaaagccttctccaagcaccgccgccttatcatccgaccggcgcctatttaatggacgatttccatcagaatcatcatctccatcatcatccattgatcattcccgaattccaacaacaacaacaacaaaggtagagagagagaatacggcaatatttaaagattttaagttttaaatttttgttaaaatttcaaattggcactttatttcgtcggcaccgacgccagactctttgatcattagtgaaaattccttaaaagcatatccggcgcataaaaaaagggctgtcacctcttgagggcgatgatagcctttcgaattgttggcatttctctctgtcgaaaatgccaaaaattggatttttgggttaaataaaattattaaataaaattatttaccccccccccccctctccaccagtaattcaagcagtacaacaattggtgaacaacttgggcaacaccagcaataatgccaacaatttgttgatgccgatgatggcaacaaaatattgcacagaatcagcggacgccgatgccatcgccgcaacgccgtcgtcggcggcacaaattggcaaaatggacaaggagttggcaacaaatggcagcacaagaccattaaccgcaacagtaattggaccaacacaacagctccaacaacaaaaatgctgatgccattgacaattgtaaggggaaaggccagaaaattcaaaaatgccattgtcagagtaaaaatggtggaaaaatgccatggtttgggtaaaatgacatttaaatgacaaatagaatgaggtaaaatgccattgccggagttaaaaatcgtgccaaaatacaattatcggggtaaatgatagaaaaacgccattttttcgtctcgagtctctggaagaaaaactacaaaatgccattgccagtgaggaaatccttcggcaatgccaatagcccccgggaaaattgtaaaatttagcccttttttgtttcaaaaactaacaaatttaggagactgatcattatcaacatccgatgcggaatgaacatgattgttgcagtgagatggaaatggcaaattcagtgtgaagaaatggaagagaaaaaaaatcaaattttccgcgttaattattatttttttttttttgtttgacacaccaccgtattaaattgacccaattttccataaaataaaataaaaatttaaaacgaaataatttatacaaattgatcaccaatttgttggcacaaacaaacacatacaaaataatcaaatcatcaattgaacacattatattaaagcacaaatatttggcaatttcttttgttttttgttgggtcagacattttcaggaaaattcaatttatttttcccgcaaaaattaaaatttttctcaattaaatttttggcgaagttcgcccactttgcccggctcggcgccaccaatttttttcgaattcgaaccaccaccaccagcagcgttctcattattcacagctgttgccgtcgtcggcgcaaaagcattgaaacgggcgatcagaccggccactttttctgaaatttggccaaattaatttatttaaaaatttttttcggcattttttgtgccaacttttttcgcgcatttggccaagaaaggcttcgtcagcagcagcattgggtgctggactcttcactttctccgccgactgaaaaggctgaacggtgtgaatttgtaacattgctggacggggacgaccctttgcttcgaggggggcctgaaaatttttgaaaatttttttttaaattttccgaaaaattttgtgcctctgccgtcgtcattgtctcctgctgttcaatcagtttgagtttttcctgatcacaacattcatcatcatcagctgcattcccattctgctgatgatcatgacgatcaaggcaaaagtcagcgcgacaattctttttgaaaatgaaaaaaataaataatttttttttcaaattttgattanaatccgtcaatcgaaaaaaacccacctcatttgactntccacactttgcaagtcgtcctcctgaaaatttttgttgattttaatttaatttacacatttttaaattaaaaaatatat

SEQ ID NO: 24404 - DNA, 1586 bp, Heterodera glycines
tcgaggtcagttagtcagtaaggtcttcagtcatcattcccactaatagccctccccctaagccgaccgatgggacggagcctttccgcgggggctacggcccagtctaacaatcagttggtgaacggtcggagatcgatctccggggttggaacgaagcaggccgggtcccgaaacccggcacggcttaactatactaagacagttagaaatttattaaaacgagggtccgacaatggacaagttgattttaaggcgtcgctgattaatttttaaatttattgaatttttcctatgaaactttacaaaaatgcgaaggtataaaatccccaaaaatagttagatcataaaatcctactaacaattgtccatatgccatattaaaggttcgaacattcaattctcacaaattaattgccgaagacgaaagcgtgccaatgtccgtcaaatattccaaggcgcattccaacgaattcggcagcatggcgctcaaattgagtgctttattcttttctttatcgcatagatgatgattgctggtgtgatattttcattcttaaactgtcattacaagcatcagatttaattccatggacaattctcctattatatttcattgcctttgtgttatttggcaatgaattcgtcaaaaagtgcaccgcctgctttcacaacaataataaccaaattcactcattcgaaatggcggagaatggtcccgctgctgctggtgctaatgggcagtaaattaatgccaattagcgaaaggaaacggacgaatttgtgatactgtatcctttatatcgttgttgtgtagtgaagccaatgttagtgactgtgtttttcataactatttctttaataatagaactaagtaaaaagaacaccgcaaaagaaataccttacctaataaagttaatacaattttaaaagaaaaatcacagttttgtgctgattttttttaatagttttttcggtaaaacacgtgtagccatgaaaattccatatttcaaaaagcccgttcagagttcaaacatttcaattatttaatttatcattttcaaatgtaacataaatattttttaaaaacatcattaaaaatcatagaaaaagatggcattgtgaagaaacggggaaaacaggaattggcatctccttaaaagttatacaataataaatgaccaatgtcgtctaaaaaataaaaaacacacccctaagaatggcatattcgtggaattaaaggcaaaattagaaatcttattttttggcctttattcttattttgaaaattttgaaatagaaaccctggatttagacaaaaacacccataaaaattgactattctggcataatttataatccttaaatttggtcatttttagacaatatctatgcaattataccaaaaaagaatcattcaaaaaaaaaatttttgtgagattttttggagctaattaaaaacaaacccccgcccccgtccccgggggcgagaaatttctcacccccgcccccgcccccgcgactctgacccccgcaatcccacgcccccgcgaaaagccacccccgcccacggggtccgaacccta

SEQ ID NO: 24405 - DNA, 515 bp, Heterodera glycines
  misc_feature (135)..(135): n is a, c, g, or t
  misc_feature (137)..(137): n is a, c, g, or t
  misc_feature (164)..(166): n is a, c, g, or t
  misc_feature (191)..(191): n is a, c, g, or t
  misc_feature (214)..(214): n is a, c, g, or t
  misc_feature (223)..(223): n is a, c, g, or t
  misc_feature (343)..(343): n is a, c, g, or t
  misc_feature (345)..(345): n is a, c, g, or t
ttaagcctaaaaattttttggcatatttaaaaagcaattaaaaaaaaattaaaatttaataattttcctgcaccgaaagtactcacaaaaacctcttcgcggcctcgaggagggccttcgcccccaaaaaaaaananaaaaaaaaaaaaaaaaaaaaaaaaaannnaaaaaaaaaaaaaaaaaaaaaaaanaaaaaaaaaaaaaaaaaaaaaanaaaaaaaanaaaaaaaaaaaaaaaaaaaaaaacaaaaaaaaaaaatatatattaaaataaaaaaataaaataataaaaaaaattaaaaaaaaaataaaataaaaaaaaaaaaataaataaattataaananaaaaaaaaaaaaaaaaaaaaaaaaaaaaaaaaaaaaaaaaataaaaaaaaataaaataaaaaaaaaaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaa

SEQ ID NO: 24406 - DNA, 1587 bp, Heterodera glycines
aaaaaaaaggtcgtcgcccggggggaggtgcccccccccaagccaaaatcctgggaccgtccctgtttgggggccggcggtgccgataggcatcgccgggggaacttttttatgaattttgttagaaattagcaaaattttccagaaatttccctcttttgggcgaaaatacgcccccaaatcagaacatatcttagaaatacgaatataaagaaaccatgtattaatcagataaaaataattaaaaagaaaacgtcaaccggtattgaacccataataaaaaatactgttagttgtgaagcaccaaccactaaaccaaaatatattgggaattcaaagcaaaatttactttatttcataaaaatttgtcaaagatgattaaaaaattcaaaattgtataaatttttgcattttatcccacaaatatgccattcttagggggtgtattttcgcccccgcgggggcgaaggtcgcgggggcgggggttagagtcgcgtggacgggggtgaggccaaaaaacctgtcccgtccccggcgggggtgacgggggcggggtccgaaccctagttataacttatcttatcagctatcacttaacaaacaaaaatcgaaataaaaggtttgaattttttagcttcgtgaatttgttgacggagctgacttcatggagaggattcagcagattatccgagaagaggtgttcgctcaattggccttcttttctttaaaaataattcaggtgaaagcattgcaagtgaaagcgaaacgagtggacaagcgcgaaattgaggaggaaagggcgagcccggccttctcttttagactgcacatgaattttacaaagttattcggcttttgatcactctcgcggagatattatgaaattttaaaattcattgatgtttatttctcttattcatgcgtaaagcttttgcgattgactctttgtcttaacattcattcctcggcacattaagtgccttaaacataatgactaattatgggaagtcagtgaaaacatatgaatggggtgggtgggacacattcgtaaattgaaatattgaaaagtcccaaattccttggaatttcttcaaatctgctacgcaactgatacaaatttcatgctcactttttttcttccaatacttaacatgaattacaatgcaattaattttatttatttaaaagaaaatgatgcctgctaaatgatgaatgaaaaatgcatttgtttgggagattgctttgtgagtattgtttttcatatccgtgtttgttatttttgcgtgacaaaatcaattttgaactgtttcaaacggaaataaggttcaatttctgatggaaatcctcggcttcagggaatgctccttccatttgtggcttctcacactcaatttcctcttcgaacatttttggcttttcgtttgatgtcgcgtgcgtcaaattgtctaattttccgagaacaacacgcataacatccttctttctgctggtgttaatttcagaatttgaaaaagaatgaacagacgacgatgaaggtgcgttttctgatgaggaagaattcgtgcattttttattgttttggttcac

SEQ ID NO: 24407 - DNA, 2019 bp, Heterodera glycines
ttaattttctgtcacagcgttttcaaaacgatcagctgcgcacaaactgaattccatcgtcaaatcggcggagtgcactcgccgacggacatttgccgtaattaaaatttaatttaaaataaaaaatagaacttttttaaattaatgaacttcaattaaaaaaacgaaccaaattttgctgttttttgtaaatatttctttttttcatttcactattcaaatcttttagcaagttcagccaagtgtttaataaatttctcaaaaatcatacaaatttctgtgattggcaaataaaaggtccacaaaaaaatgtgtccacaaaatttgaattaaatgttttttttgaattttcaaataaatttattttttcatttttccaggcaatttttgttgcgattttctgatgaacgtggaaggcccaaccaaagacacagagtgttcccgaaaatgtgccaaagcatcgtttgccattggcacatccatcaaaaaacagctgagggacttgcggaggatgggctgtgccgcggcaaaaacacaatttgccgtaagtttcttagttctttttaattaaatttaatctaatttaattattttttattaaaatttaaaattttcttaatttttaaggcattggaggattgcctaaagggcccagcacagtatttcaacgacataagccaaagaagcagcagcagaagtgccaacgacgacgacgagcaggacgaggaaatggcaaaaatgcgggcactgaacgaagtgtgccggcaaagggcggaggagcaaaattcgtaaaaaaaaattttgaaaaatttattaattttcggtccctaattttaatattaaaaattttcaatgtacaaatattttatgtgcgttaattgtactatttttttgttttgtttttaatttcttctatttatattttgtttatatttatttcgatttattaaatgcaataattaatcaattaaatttttctgcaaatttatgtcagcaagcctttataaggattaattattaatttgcgtccaaatttctccaaatatttgttccctaaaaagtggccagaatttatccattagtcaaaattgccaaaatttcccaccacattttcgtttagcaacaagtaacaaaggcttatctaagaaagttagaaaactaaaaaatttcagttttgaagaaaaaaaaaatttcgtgaagcgggaaaaaatgcggggggagggcaacatggctaatgccacgtcgagactgaaaatttcccaatcgagaccgaaccgccggcacttaatcggacagcttaccatcaacggcactgtttccatgtgccaaatttgttcgcctccctccgccacaattcatttggccaattcttggccaaagttaaaattgtgggggggcgggggcgccctcgtcgtccatcttaattttttgtccccacttttgggctgattgtacagcgaaattgccccccggggaaattaaaggaaggcaacgcgccgccttcctgttgatgattaatcaccacaaattttacctttgcctccgagggtaatgggaaaatttttcttccgctcggtccccacattttcaaaattcaccgtttttgttttttgaattcacattttttggcattttgtccctccctcgtgcgcctttcaaatcccccgggggcaggggggggggcacattggcattgcaatatgccaatgatgtttctgctgctgctgtttgtcaatttttgtcatcattgtctcgcttctttcttctgtctctatggcttatatcattcctccccgcctcgacccatcaattttaaatgaatggcattttctgcacttttctctttccctttttcgctctcatcactcactctttccgccactatttctctcctacttcctctcgctctctttttactatctctcactctctctctccctttcactctctctctctctctctctctctcccttccctatccaccaatttgttgccctttgtttctttttcatactccct

SEQ ID NO: 24408 - DNA, 985 bp, Heterodera glycines
tatttttgtcacttcgtcctaaaaaataatttacggtaatctgaatttttagaataaaaattaactattaaaatattaaatcggttcttttcatgaacattaaaataaattcatttgaaattttaattaaaaaaataaaaagtccattatatcaaataataattatatatatattaaatatgtaatgtttataaggagcacagtattcgaagaaatgtatttgggagttccagtcaagttaggttatgtagcagggatgggcctaggtttcgcttttcgcatttcgcctttcgaattattcgcattttttggcgtttcgcatttcgctttttggtgcgaaatgcgaaatttccacccctaaaaatgaatatatttgaaaatttaaatttttaaaacgaatgcttcagtttattcttattttgggctgcaggattaataattaccttttttgctaacttgctatagcctaatacgcacgaaaaacgagtttttaacttgatttgaagcttttatcttgaactttttggtgcatttttttgccttttttgcgattttggtgccttatgccgggcacgtaattttgatgccttttttggcctttatgacttttttgatgccttttagtatttttttgaaaaaaatagtaaattttttgaaaattttgtaacttttcctatcatatttacaatttccaaaaaaatttgcggcggcgcctatcggcaccgccggacccgcattttaacttaatttttgaaattttaaccccaaaatgggtagaatttgtcttttttgatctgagaaaaagattgaaccggaaaatgcagagattttgtttttttttgcatcacaacctcaaaagctattggtaaaatttttgaaaaaaatttcgcatttttggcttttcgcatttcgcttttttttcatttcgcatttttcagtttcgcaaatttcgctttttatttttcaatttggcccatccctgata

SEQ ID NO: 24409 - DNA, 2084 bp, Heterodera glycines
  misc_feature (1302)..(1302): n is a, c, g, or t
aaacagtcgaaattcaaaagagcaatgcggccccatccctgaaccatgcccacaaaattgtcatcattagtgttaaatttgtctccacatttttctatcaatcacttcccaaaaaagaaacccttcccaaggacacacaatgaatgaattctctctatcgcaaaaactatacaaaaaggcctataaaattgtaagttttttcgggtgtgggaattggatcgcgcatatgagaagatgatgatgatgatgatggctggtgaagaaaattcttctttgcctccgaggaatgttttaaatgtgcaatttttttttggtgtatggatttaataagagttttatttttcaaattccattttttaatgattggtaaaataaattttaaattacaaaaataaatttgtgtttaattttcaaattttactttatttaaaattaataataataaattcgttattttcaatacgaacatcttttatttggtatataattttcattatataatttttaattttcccttgaataaatttttactaagtttctttcaagaatttttccaaaaatcactgaaaaattgtttaatttttttttgaaattttcctataataaattttctaaaaaatttttaatttttaactaattttatttatttttttctacctttattaaacaagcaaaaataacccatcttttcacacttttctgcacaaatacaatcgtaaaagttgaagcaacattacatattatgtgtcatgtcattattattatataattgcagcgccgaaagcattgcgcgtaatcgtcgcgcgcgcacgcgcgatttgtcacaccaccaaattccattttccaattttctattcaaatataatttgttcgaaaaaatcccaaaattttccatggtaatatggatctaggggatgattaagttatttctgagcaaaaaatcatcgaaatatataaacataaaatatgcgaaaaaatctcaaaaaatatcggaaaatttattcccgagagaaagagagtcgagagcgaggggatcagctcattttccctctgacaaaaatataaaactttaagttttctcaagttttttgagttttattcctgtaaaaacttaaaatatttcaaaaaaatttatttttaatttattttttgattatttttaatgtttttgtcaaaattcagatattttattaaatcatatggccaacattgtccctcatgatgaggttgatgaagaatatcatcgtgaaacgagcgaaaattcccggccaaattacacagcagtgatgacaattgggccanatgagacaaatgaggaggacaaaatgacgacaaatgatgtggacaaaaggacgacagatgagacggagaaggataaatgacgacaaatgatacggacaaaaggacgacagatgagacggaagagaacaaaatgatgacaaatgatacggacaaaaggacgaaaaatgatttggacaaaggaacgacagatgtatcggacaaaaagacgacagatgacatggaggaggacaaaatgacgaaaacgaaaaatggacgagacggcacttcaacaatttttgtgaatactatggagaacgatgagaagtcaccgtcatcatcatcatcaaattcttcatcgtcatcaaattaccaaaatatggatgctcatccggcaatggatgagaagcaagatgaggaggaggatgaagatgaattgccgtccccggcatcctcaaatgagaggagggacgacaatggaattttttgttcatccacgacgatgaagaacaacaacgaaacatcaccgccaacatcatcatcatcactggtgactgatcggaagaacatcagcatcccatcatccgcttcatcctcatcggcattggcactggtgaatgatgatgggcggaaaatgggggcacaattagtggtgccggcggtattggtgaaaactgcttcatcatcctcgtcttcatcctcgtcctcatccccatccgccgaagaatttgatgaggaacggaagagcaaaaataattttcttcttcaaatgccctccggcgacggggaagaaaagcagcagcaga

SEQ ID NO: 24410 - DNA, 2293 bp, Heterodera glycines
ctgttccagcggacggtgccgcaacaattttttacgtggtcaaaccgctccatttggaattgtccggcaccagtggacagtaccaaccccagcctgattacacgtttacggtggaagcgtacgattccacggaggacccaaggtgaatggtgtcggtgttgtgcgttacggtagatgctcggccggggccataaacatgagaaatttgatcactgatcacctgtgcttatttgaatagtgccgagataagcaaaagcctcatggtttatttgttggggttttgaagcacttgaaaatgccgagattctcgacctgctcggggtttgtcgtgaatggcacacggataaaacatgcaaaatgccaaggttttcttgggcaacaatggcatttgtgccgagttcgtcgggaatggaatggcatgatatagaaagttttttgaatatcccttggagtctcggttttttactcaagaaatttctcggattttttgcaggaccgcacgcgtgacggtcaatgtacgccttgcggacctgacggagcaagaggcggaacgcgagcgggaggaagcggtgcgcgagcgacaattggaccagcagcaccacaaccagcagtttgaggtgcaacaggacgagccgtccgctcaactggaagcggatgaggaggaggagcaggacagtgccgtggatgatcggcaccagagcagaatgtcaccacaacacacggcacaacgccaacggcacaacaattttgatcgggacagtgataacaacaggagggcacatgccgtgccaacattggcacttgatggcaccggggccaaacaacctttacaggtaaaaaaatcatggcatctaatgcattctaaaatgccatggcacaagattgccagatggtcagtacccatggtgtgccaactcatgaacagtgccatttggtgtgccaaagtgccaaaacatgactcatatgtccacattgaataattgaatccattatttttggcacgatcataggcatcatttattaacaaatgattggcatgccaataatgacaccttttgaaattttgtttaagtttggcaacaaatttggcgatctgctaccatccgatgatgacgaacggcaccagcaacaagcggttggcttggtgcgcttcagtgccgacaaatacacgttccgtgcgcgcggacctctcgcggaaggccaaaccattggcatggtgcatgccaaacgcatggacggcacggacgaggcatgttctgtgtattattactgtacataaagcttttacagtaccctgctccgattactgtacttgattttcacaaacgaagatttttcagttttaatttgttatttaaatttttatagtaaaatttccttttggacatgttgtaacaatttctgaattataacattagaaactgggatagaatgcaaaagatttttcaaatccaatcatttttattgaccattttttgtatccaaaggttcatttttggcacagctcatcattctcgagaccgtgtgccacttcattaaaacagtaatttttattttacccatttttcagattgaatttgccgtcgaggaaggcattgccggctttgtcggcgtcgacgccaacacgggacgcctttttgtcggcccatggcttttgcgtgaccgttttgaggaaatccgcttttcagtggctgcccaacatccgtccggacaagtgctggtaaaacatcattctcttacaataattcaaattgttctccaattgttttgctggcctttttcaactcccgccagtccacattttttaatcccggtttttttgggcggggggggggggggctaaaaatctccatttcgcgtactccataaaatttaaatcattttgatgtgccaccaattgattgcgggatcgcagtccgttttgcgggattaatcccccgcgggatgcaggacattgtcccgcaaaattttttaatccaaaatcccgcagcaagcgctgcaaaaaatcgtggattttttattattacaattctcatagaaaagaagataaaaccaattttttctcataaaccaaaataaaaattttcaatttttaagttttttttttactggaaaaatatttcattattaaatttttttcctcctcctgaaattacttgaaactctcgcccctgaattttcagtcttggcaaaaataagaatagacagttttccctctcacaaatcaaatcttggcattttgcatgtcgtcagaatgcatttcgccaattaaaattaataataatttatgtca

SEQ ID NO: 24411 - DNA, 819 bp, Heterodera glycines
ttgatctttgcacccgcgcaaattgatttacactttcaaatgtcagcacttcttttggccagcttttgctgttaaatgtgacaaatgaataagttggggagacaaagagcgaattgcgatggaaaagcgatgggattgtgcccacagcagcaagagaagaacactcgcatctcttccatacatttacattccatcccaattttccttccatttcctctgactattcttttgccattccattggcgtattgcgaaacgcgatacccacgggcatttttgtcgctaggtgcttaagtgggagtgggcgagaaaaaagtctcgtgtaggaaagggggaagccgccagagaatgagggactgtaatggtcgaagacgaaagaatttggcgtatttcaccgaaatttgaccctctcatcaaaatagcagcagaaatagaggcggcggaagaagcagtgaaattccatttggatattttaattgtttgatatttcgggattctttcaccgattgagaaaaggcaaatgaatgggtgggacagacggagggggggggggggggaagaaattgtaaatgtgtggccacgaaaggttcgggaaagaattgtggaggaagctaatgggtgtttgagaaggcaatgggcgggggaggagaagcagtacgtggaagaaagggaagcaagtggaagaagagcttatgttaagattggtccttttgctgttggtgatagtgagtcagtaagcaaatttgatgagtgagtgggaggaaggggagacgaggggaaaggaaagaggggaggggagggatggagagaagggagagga

SEQ ID NO: 24412 - DNA, 1367 bp, Heterodera glycines
attacatatttgatggcttttctgccgatccgtgctgaataggcgaggacggcgtgtggggagcggggggcacaaaacggacggagttggccaacacggaaaaaggaacagcggcagaaagggaggacgaagtgagcggcggatgagtgaaaagtttggactggtggctgtaggaaaaaaggcgggaaaaaaaaggggggggggatagagcaaagaacggaatgatcaaacgcagacagacaaaaagtgcaaccgatgatcaaataagagaaatacatgcaaacgttatacactcgcttacaaaatttgtataagaaatctcatttttgtgttcaacccattcacatttcccaagctttattcaaaaaaaaaaagaattcgaaaggcaccaacggatgaatgaagctccttttttgttcttctgttccaatttctttttctagagtatgtaattttccaaaatttaagtgccgcgggaggaacaaacaatatttaagcagatttttcttcaaaaatacaagcatctttatcgcagtttttgttgtgttagagcatccgcaaaaatgccaaggcttcgatcttacatatcccattttgtcaatgattaagccgtggcatcccacatgttgagttaaagtgcaggtcaacggaaatagagctacccgaaacatggccggccacctgataaaaattttgattggacgcataaaaattgaatagacgcataaaaatacccctaagaatgtaatacgctaaaatcgtagaaattttatttttttaatattttgtgcttaattgctatttgtgctttctaatgcttaatttagaaaagccttgatgcttaattaagtacttaattatcgttttttatctatatattaattttgcgctgtaactaatacatttaaaagtaaacaatttatcgaaacgaattccttttggaaaatagttcagtctttttttcttttcttttttgtttgttgtttacgtcttttttgtgttatgagcgagcacatatttcttcattattggaaaaatcgaggagagagaaacagaagagggagaaagagaaagaaagggagaagaggagagagagaaaagaggagagagagaaagaagaaaggagagagaggaagagagagaaaaagagaagagggagaaagaaagagaggagagaagggagagagagagagagaagaggagggagagaagaggagagagatagaaaagaggagagagagagagaagaggagagaaaggaagagagaaaaagagaagagggaggaagaaagagaggagagaagggagagagagagagagagaagagaagggagagaagaggagagagagagaaagaaaaaaggaga

SEQ ID NO: 24413 - DNA, 1173 bp, Heterodera glycines
ttagcacaaatcaaggcgagcgagggggggccactgctgagaagcgttaaaatcaacaaaagaaaattcaataatagtcgatggtaaaatgagggattaaataatggaaaggaattgaaatacataaattgagagatgaaaatgagaaaaaagcagtgggaattaaaatgaataaatttacaaagttacaggaaattgcatacggcttaaatattatgtaaaattgcttttaaattgtcgagtaattggcaaaacgattgaaaaagtcaaagaaaagaaaatggaggaaaaataatcaataaaaataagcttagaatgggaaacgggggcaaaaagggcggtaggggtcaactccgtctggccaactccgtctcagcaatgttcaaaaagctataacttttttctttgttggccaaacttcacaatcatggtatcattcgaaagccctagatgtttagaagatatttataagctatttctcagtgattaatcagctctcaaaaaagttgtcagttgaaaaccgcaaaaaaggcagaattttcgaagttttttatttctatctttttttatagttcgaaattttctgtaatttttagtaggctaatagagcctgtgaagagctttcgaatgatatcaagattgttttattcggtccataacttcaagagttatattgactcaaagttggctcagacggagttggccagacggagttggccagacggagttggccagacggagttggccagacggagttggccagacggagttggccagacggagttggccagacggagttggccagacggagttggcccgttcggagttggctcagacggagttggccccaagacggagttggcccagacggagttggcgagacggagttggttcagacggagttggccagacggagttggccagacggagttggctcagacggagttggctcagacggagttggcccagacggagttggccagacggagttggccagacggagttggctcagacggagttggccccaagacggagttggccagacggagttggctcagacggagttggcccaagacggagttggcccagacggagttggcgagacggagttggctcagacggagttggccagacggagttggccagacggagttggctcagacggagttggcc

SEQ ID NO: 24414 - DNA, 1199 bp, Heterodera glycines
aacagccccactaattacaaccgaaggttgtgagtttcattgattgtctgcctcaaaaaagatggtgtttaatggaaggtgctcaaggttggcacatgcgaatttagaaaattagcatttttattgcaggcaattcatttagaaaagtcattaatttatttgttatgaagttctttcattgaaattagtttaaaaaccctttcttgccgattacattctgttctaaattgtagcaaatgagcctattcttacaacctatttggcatttactataattgtaacctttggcgtttctaattgtaaaattaaaattataagaacagttttttcagtatgtacgcccgctattttctaatgatattttttagccaaagaataatgcttttttgaggtatggggtgccattaaacaattggcaacatctggaatattactcaaaaaggtatccttctactagcttccattaaatctttgaaagaaattttcaattttttcaaactattttcataaaatcctaccgaattcatttttagccggccgattaaattttgactgttatatctgaaatgatagatcattaaatagaaaggaaggaaaacgtttgggctaactcttcgcttcttcagaagaaaatttattgatatcattgtcctatcagataatcgcgggcgtagaatttaaaaaaacaaagcaaaagcataatctattaaatgaactaattaaaagcagaattttttaagaatgtgcctgaatttgtctattaatttgtggcccgttaaatatgttttttcaataaaagcacatcaattttgaaaaaggacctagtgcagaaatgcgtatcgccattgtttttatatagacaatttttacggcgactgcctgaacctttcttgaaatttgagaaatttgttcaattactgacgcctttagatgtacggctattcttaatatatagcaaaatacagaacattttaatagaatagaatattttttaaatagatgggcatttattgcgaatatttgataggcaaaaaatttaacatttctattccactaacagccccactaattacaaccgaaggttgtgtgtttcattgattgtctgcctcaaaaaagatggtgtttaatggaaggtgctcaaagttggcacatgcgaatttagaaaattagcatttttattgcaggcaattcatttagag

SEQ ID NO: 24415 - DNA, 1825 bp, Heterodera glycines
ctttcgctgttcaaatttgtttccttcgcaaatggtttaaattaaggcacatttaagcactcttggggaatgaatgtgctcttttcaaagggattagacaagtcaaacacagaacaaacaaagaaatgccctgggggaaaggagcaaagagaggggaaaaggggggtccttttttgggggactccgttcactcattttcatttgacacagattcaatttcgggacggaagcagtctcctgcttctcctgctgctgctgttctgctggtctcccgttccctcctccttttctgtcgcttatttataaactgtgccgccggggggtcattcattgcctttgcttttcctttggttttccttccccatgggccacccataagcattagccatcgcagcgggactaaaaagcaaaaagcatcataatccctccctctcccttttcctccccctctctccccccgcctccaatttgctttatctcctcctaatttcttacctttatttatccctttggcttttgtcccttcgatacgctaaactaattttgccaattaattttcgcctttaacttttattgtctcattttatgctgtaccatagaaaatcattgtcatttcttcccctcccccgccgtttcttcgaaattcaaatcatatcgaatttactctttagtggctcgtcaaattgctcatttccatttccatttgcattggcatgtgcttttcctttaaccaataaaagctttcggctgccaattttcaactcattcgtccaatttgcaactgattcgttcggctaattccccttcgatcatttaaccaaaagaattgggaatggatgatggagaagggtcggaagagcaacaactttgtggagaagtacattttatctctcaaatttaaatttcgtttggcgatatgcccttcccctctctcccccagtacgaaatgtacactttggcacgcttcctcttcctctcgctgtcctccgtgttggcactgttcggcgcggctgccaatgccatgctttttgtgctgttctcctcccgcgccgcgttagcacgtgccaatacgcccgccacgctttacccgcgcgtgctcgcgctgctcgacgcgtccatttgtgccggttacattttgttgttcggtgccgacgcggcggtgatttacctgcgcatccgtccgctctttctgctttaccatttgtacattgtgccggcttttgtcctctcgcgcatttgccaattggccatcccttatatgtacgtgaagtgccttctccgaatgtgtgccatttttcctttcctttttaggctcattttcgccactttggagcgcctcgtttggattagcagtggcaaaatgtgcgcaattttagccccaattaacttttaattgccttttcagtcgaaattcgctcctccggcgaatgtattccgtcaaagggcgccatataaccgtggtaatttcgtcctttctgttctttgcactttgtgccaatggcttttcctcaggcttttactctcggcgcgtgtgccattctccgtttgccaacttattgggccaccacagtccacgaataccctcaggcagctttttgaattcaaatttattcaaaggcatttccaatttctgtgttcagtgcgacgactttttccgcacaaaaaccgccgggcccgccgattgggtgatgaactcgcgctttttctacgtgtacgacttccacttgctgtccatcgctcaaaccgtgttccccttcttcgtcctggtcgccttcaatttggtctgttctcggcttttcctcttcctttcccccctcccttttgg

SEQ ID NO: 24416 - DNA, 1891 bp, Heterodera glycines
ggcttttcgcagtcgaggcagtaggggtgtccaaacaagccatgtaattctgcacaccatcaaaatgctggttgttcaaatagggcacaatgggggtgtcgtaatgatcgttgatgtatttgtacaagggcttgtattgtcccgatgagccaaagatgaacactgcaaatcgttgctgctgctgcgtgttgttccagtggtcgaccacacgcggcacacaaatctcagcatcataggtgttccgaccggtctgtacaccaatttgctgcatcagttgtaaagcatcccgcctcagacatccctgttgtcccctccgactgtgcaagtagtcgtaaaatctccaacggggccaaccgcacgttttgtccaccattgtcgcctgcaaggcgtagaagaggcaatgtccgtcggggttgcaaatcttaacaaaattttcacttaaattattctttcgttgtgatgtttggaccttaatcaaacaagtttccgtcaccttatgatgcacaggtgctaggcttcgtcgagcaccgcccttcagcacccttcggccgggcagtccagtacggtcaactgtggtcaccaccacagtgaatggctcgccccacagtgtgacgttttgctgctgcttgctctgtgccactttggtgaactggttgaggatggtgttgacggtgttgtctgtgatttgtcgaaccggaatggggatgtccccgccggtgagcaacgaactgctgatcatgcagccgagatgagtgggttcaattccacgtccacgactctcctccatcgctgcgtcaagacagtactggaagatgccggccaggagtccctcaggatttgctgctggcacatcctcaatgctgaaccgcgacttgactttgctgtactggaagcggggcacatgctcaatggtgctgtccaactttttgacgtagtcctttgcagactttgatgatgatgagctgctgctgctgccgccctcttgaagcacctctccaagcaattcattgatgaggaagccgcgacgcggctttttgcttggggccgatagaatttggtcaatggaaaacagagagggatgcttgggaggctgattttgcattatctaatttttcagggaaaataatgaattgaatgaataaaatgaacaatcttgacacatatttttgaggcatggaaattgtcgttgtgaatgcaaattaatggataataataataattttaaaattttttaaccaactatgccctgaagagcagcgcactgccacccatgaagcataacacgacagggcacataaacggctcggataattagtaaaggtcacgcgcacaaccccaagccctaaaagacacacaagtgctgccaggataaacggagcccaataattggagcaaccgccctggttaacagcaataaattaactatttaaaatattattattattaaagtgagtaaagatatgagcagatgtaaatgaaatgtgatttggactggggaatttatgaagattgggggcggggtgtccccatccgaataccaattaattttctcgaactccttcgtagtgtcggcaaattcaaatttcctttgaagtcatctccttcactattgtcggcaaattcaaatgtcttttgaagtccatattaattattgaataattaatgagcccatgagaaccgggcacaaaaatattttaattcactcttcattcattctttcaaatttcatgaccaatataatgcccaagcgattaccagccgagcttctcttccaattatctactcacttcccataatgaatctgttttgcagaggtaacacccaagccaactggaaaaaaaatcaaatttcaattttttcccaaaatttaaggccgcccaccatccggtat

SEQ ID NO: 24417 - DNA, 2213 bp, Heterodera glycines
ctaaatcttttatcttttttgaattcaattttagctttctttctatttaaattacatgacaaccctagaacaatgacattcaaaacaaatatgcttcaaatatttttgtacaaaaaaatttgtaattttttgtgattaactatgcaattctgttatattgattgtatggacgccaagggaccaatttaaaagtaacatataatttttacaaaaaaaagtgtgcataaaagaactggcaaacttcaagagtgagctttttctataatttactattaaggctatttaatgttttctacttgtcatgcgtgattaatatgtataaaaatttgtaattcaaaattataaaattaatttaatttaaaatttgcaaaaattacaagcaaaccctaaaatatccgatgaataaatgatctctttataatattttgcacaacatataaattaccaaatggaatataagaaattatggctatgttgcgaagtataaataataaaattaaatttcaaatcaaattaataattagattttaaaaagtttatggtaatttaaaaacgcaatgaagaaacattttatgaaatggcattgtgaaaattaatatactaaaaaaattatttttaattttacaatttaagaaaacaaccaccaaatctggaattcatatacctattaattatttatgcaagcattatttataagacaataagatcaatttcaggtgaagaagcttaagtcatggcttagattataaaaattattataataataattatttaaaaacaaacaaatttttaattattgttgtatcaacattaattacctagcaatcactatatatatatatttgatatttatttttttttgttgcaatattttttagtgatgtcttgatgttaaacaaacaataaatgtactttaaattaatgaaaaaatttaataaaaatacactttaaatttataaaaaaaaggtttttgctactgaaatagggttttacaatacatgtacgtggggaaaattaaggcacgtggtgtgggtaaacatcaaaataaggattactttaaaatttcaaagtttttgattataaaaaataagaatattaaattgctaacaaggcataaaaatcagaaatttttaatgccgatttcgactaaacttcaatagattaaaaaacccgagtttgcatcgacttttccaccggcctcaacaattcgctcgagttgaatagacaccctttgccccggcctgaagacatttacagggccatcagcggctccgtctatttctccaatctcgacctccgagacgcgtatttgcagatggaattggatgaggaatccaaacacctttgtggaataaacacccaccgtggcctcttccaatgccagcgcctcccatttggcgtcaaatctgcgccgtctattttccaacatttgatggaccaaatcgtctcaggcatcccaggcgcatttgcctacctcgatgacggcataatcgcctccaaaacgcttgacgagcacatttcttcgctctacaagcttttcaaacgaattcaggaatttggcctcaaaatccaatgggaaaagtgcaaattcctccagcccgaattgctatttctcggccacgtcatctcagcgaaaggaattcgccccgaccccggacgatcagaagcaattcgccaaatgccgccaccacatgatttgagcacccttcgctcgttcctcggcgcattgaattattatggaaggtttataaagtccatgcgcgaaatccgcgaaccactggaccagcttctgcgaaaggacgtgaaatgggaatggaccgacgaacagcaaactgccttcaaaaaggccaaagaaatcatgctgtcggatcttttgctcacccatttcgacccgtctcttccaatcgtcgtggctgcagacgcctcaaaagacggaattggcaccacaatcagccacatttttccggacaaatcggaaaaagtcattgaacacgcgtcctgcaccctcaacgacgcacagaaaaactacagccaaatcgaaaaggaagcattggccctcgtttttgcggtccagaaattccaccgaatgttatttggtaggaaattcacacttctcacggaccacaagccattgctggcgatttttggctccaaaaagggaataccgatttatgcggcgagtcgtcttcaacgctgggcactgatcatgtcca

SEQ ID NO: 24418 - DNA, 2259 bp, Heterodera glycines
  misc_feature (1017)..(1017): n is a, c, g, or t
caaacatagaatttttcacataaatcttaaaaaattttgaaaggattttttagacaaattttgaaaaatatagtaatccatcagaaatttttgaaaaaatcgctagaaaaattctccaaaatgggggcggggaatgtaatgcacctctataatagaggcatttacgtagctggcccgagattctgtccaatataatcacctaattcgtttttaaaacaaataaaatttctcataaaaaaatatttctatatctttacaataataatgcaaaacaattggaacaacaaaagaatgtatgtcataaatgattgatttaaaaatgatttttttttgttccgaccgataaaaattttgggcgcaatttatcttaaaaataaatattttcgccttcattagatccaaagtctattttaagtagtcctttttaatggaattaattaagccagcaaaattttgttgtggttaattaacctagccaccaatttttgtttgttttttggattattatttatgccactaattaattagagccgagcttaagcgctgtccaacaaatttacttggattttgtttatgtatttactatttaattactgaaaatgttcaatgtgtactttgcctaatctgcttaactacaagggattttttttttgagaaaaaaaggaactaaaaatttgcttttaatcacttcgctataaaaacaattaaaatgtggtaaataaatcattcctttttgaaattacaatattcgcacaaaatttaaaaaaataataagtttcaattatgtccttctctggctttgtatttgaatgtgtcattctgttgttcatcacattcaaaatgttgaactacatttgtgtgcctaaggtctgtgaaatgaatggcatttttatacaaaatagcaatcagggctggacgaaatttcgtgtcgttttcgtttcgtcctacattttcggcactttttgagtttcgttttcgtgtttcgttttcgtccgctaaagttttttcgtttcgttntcggtttcggttttcaattaagtattttagtttagtggcgaaaacagcaggtttgctttgtgctgtgcattaatgttcgatcccgcatgaccgcactttattttaccgattttttaatcatgtttttaccgattttaattgaaaatctgctatgaaatagcactcaaattttcccggcgtcgcctatcggcgccgccggaccctcttcccattcatcaacttgtaaaaaaaatacactgcaaaaaaaaacgtttgaaagtcttttttttcagcagttgctaatttcttccccaaaaattgttaaaatccataataggatgtgaaaaacataacattttaatacattttttatcgaaaaattatatattaactgattcgaaccaattttgcaagattgtcttttttgaccctaaaccttattttttgtcattgatgttctttattttaaaaattgtttggtcacacccctatcctagagccacattagcttttccacctactaggatcttcattccttcagttagaggatacaattttaaagttttatgtttcttaattatgattgaaataagttcaaaaaattttcggttttttcgtttcgtttcgtacgaaaattgttattttttcgttttcgtgtttcgttttcgtccgtcaaaattttttcgtttcgtgtttcgtgtttcgttttcggttttcaaaatattttttttcgtttcgtgtttcgttttcgtatcgaatgcactttttcgtttcgttttcgtatacgaaaaagtttttttgttattttcgcacagccctgatagcaatctaactttttagtatttttggtttttttttttttgctacaataaaaataattaattaaattttatttattttgatagccgaattttgaataaaccaaaaaaaaaaatatatatatatataaggattcttgaactaaaagtaaattatttaaaaaacaaagtaaagcattcattaattgcctctttctaattactcagaaacgaacaaatgttaatattaagttattcattcatataatagcatttttaataaaaatcttttaaatcaaaaaattaaataaattttttgatcagattaagaagcatttttttaattgttcaattttagttgatccattctccgaaacaatgcgatcacatcagaaggacgtcaaaaaattttgagcaatttgcgcaagtggttggatgacaaccagtgtgccaaacacaaaaaaga

SEQ ID NO: 24419 - DNA, 1200 bp, Heterodera glycines
gtctggctctacccaaccactcacacgattatttgaaatgctacggaaaaaaattcttgccgaaaaaatggctatctcttttttctcttggggatttgaccgcaaacttggtaccaacatttgccttctctagtctggctctaccaaacactcacacgatatttgaaatgctaacgaaaaaaattcttgccgaaaaaatggctatctcttttttctcttggggatttgaccgcaaacttggtaccaacatttgccttctctagtctggctctaccaaacactcacacgatatttgaaatgctaacgaaaaaaattcttgccgaaaaaatggctatctcttttttctcttggggatttgaccgcaaacttggtaccaacatttgccttctctagtctggctctaccaaacactcacacgatatttgaaatgctaacgaaaaaaattcttgccgaaaaaatggctatctcttttttctcttggggatttgaccgcaaacttggtaccaacattttccttctctagtctggctctaccaaacactcacacgatatttgaaatgctaacgaaaaaaattcttgcccaaaaaatggctatctcttttttctcttggggatttgaccgcaaacttggtaccaacatttgccttctctagtctggctctaccaaacactcacacgatatttgaaatgctaacgaaaaaaattcttgccgaaaaaatggctgtctcttttttctcttggggatttgaccgcaaacttggtaccaacattttccttctctagtctggctctaccaaacactcacacgatatttgaaatgctaacgaaaaaaattcttgcccaaaaaatggctatctcttttttctcttggggatttgaccgcaaacttggtaccaacatttgccttctctagtctggctctaccaaacactcacacgatatttgaaatgctaacgaaaaaaattcttgccgaaaaaatggctatctcttttttctcttggggatttgaccgcaaacttggtaccaacatttgccttctctagtctgggtctaccaacactcacacgaaatttgaaatgctaacgaaaaaaaattcttgccaaaaaaatgcttatctcttttttctcttggggattgaacgcaaatttggaacaacatttgccttcctaatctgggtctaccaaacactccacgatattt

SEQ ID NO: 24420 - DNA, 2426 bp, Heterodera glycines
  misc_feature (893)..(893): n is a, c, g, or t
gtaaacgtgaccatgacagaaaaaatcgtggaactcaatggtaaccgtgaccgtgaccgaaaaaccaagaaactcacggcaaacggaccgtgacagaaaaacccgtaaatatgaccgtgagtgaaaaagaccgtggaactcacggtaaccgtgaccatgactgaaaaaatgaagaataagcgtgaccgtgaccgaaaaaaccaagaaactcacggtaaacgtgaccatgacagaaaaaatcgtggaactcaatggtaaccgtgaccgtgaccgaaaaaccaagaaactcacggtaaacggaccgtgacagaaaaacccgtaaatatgaccgtgaccgaaaaagaccgtggaactcacggtaaccgtgaccatgaccgaaaaaccaagaaactcacggcaaacggaccgtgacagaaaaacccgtaaatatgaccgtgaccgaaaaagaccgtggaactcacggtaaccgtgaccatgaccgaaaaaatgaagaataagcgtgaccgtgaccgaaaaaaccaagaaactcacggtaaacgtgaccatgacagaaaaaatcgtggaactcaatggtaaccgtgacaatgacagaaaaaatcgtggaactcaattgtaaccgtgaccgtgaccgaaaaaccaagaaactcacggcaaacggaccgtgaccgaaaaacccgtaaatatgaccgtgagtgaaaaagaccgtggaactcacggtaaccgtgaccatgaccgaaaaaatgaagaataagcgtgaccgtgacagaaaaaatcgtggaactcaattgtaaccgtgaccgtgaccgaaaaaccaagaaactcacggcaaacggaccgtgaccgaaaaacccgtaaatatgaccgtgaccgaaaaaaaccgtggaattcactgntaggggctaaaaatagcattttttaatttttactattttggggagggagggtaaaagccattttcggcagtttttaggcagtttttagtgtatatttgggaatttttcggtttttagggcatatttgagggatttttagtcatattttatgggcatatttgacttttttttagtgcatacaacttataaccctatttatcacagtttcattatttttctactgtatctaagtaattcaattcaatttatcctttaattatattcaataagccatcagttgttattttgttgtttatattcgaagcatcgttcagtagtacgactcttccccatccacaaagtcgacgggggtcagtgttctaaaaaagcgcaaaattaattattaaaaatgcaattagtgcaaaaacaatgctattaagaagggactcacgcgcatctctcccggtttgcctcaccacacttattgcatgttcttgcgcagttacgagccatgaaatgcgggttacgctcacattctttcatcggaatttgcttgggattcttttgctttataggcttccctaaaatattttatttttttgtgttcgggttgaatttttcataaaaatatagttaacttttaattaatccataatttattggttaacatctcccccaaaggacgataaaaatttctcgactttcgagtcgagaattccacttagatcaaagtgaatttaaattggttgcctttgtggccgtgcccatagcccgggagtaggtcaagcaaagaccagcgtaagcactgcaagtgaatgtccaaacaaccttaatatagtaattaagcctttttcgagatgtttccttatggcgcttaatcttcaatatttggcacgctcctacgctttttctctattaattaccgggaaagaacgccagagggtacggttggcatccgtcatagcgacatgaggccgggcacaaattgttcatggaaatctttgccatcccgcaggtgccattcgaagcccatagtgggcaacactcgtggttgtcatagcacaaacggaatttggggggtgaaggctatggaaaaaggaaaagaaacagaaaattaatttaatggggcaattaatataaatttctattaaatttctaatagctttttattttttatgtttttaattaaaagggaattaatgaaattgggaactcactgttggcgatggcgttgttggcccacggcctttgccttttccatggccatttccgttgccatttccatttccattcccttggccatttccgttgccattcccctggccatttacatttccgttgccatttccatttccattcccttggccatttccgttgccattcccctggccttttccatttccgttgccatttccattgccatttctgttgccatttccattgtcattcccttggccatttcccttcccattgctatttccatcaatacgaatacgaaactgaaatatattccagagcatgacgccataaaactggtcttaatccccgattggg

SEQ ID NO: 24421 - DNA, 2383 bp, Heterodera glycines
  misc_feature (86)..(86): n is a, c, g, or t
aattaatgtttataattatgatggcttaggttaagtaaaacttccagatcgggttcaaaactacctcttatatatagcagacaacncaatattttttttttgtcaaaaaatatataattccttacttttgtaatcgcgcagcagtcaagtcgataatgttctctacaacaatcagaagcaggccatccttcatcaaatacgcaacttggcgccaatgtttcaccaagcataaaaccatgctatattaaagattttatttatatatgggatgttgctttttatcgtgtctcgtattctcttggtttaatgccgtctcggtctctttttttgaacgagacacgagatttttattcattggtaagaatgagggggaggaggggggtagagaaaatattttttttgaaaatttagagaaatattttaagagaggaaataataatttaatttaacttttaaacttaaaaaagtgaaaaacttacagtctaatttggttcattctctgtgatttctgccttggttcgactcccatacagaataaaattagtctattattcttttaattgtaaaagtatttttaaaatttatttacgaaaatttttcaacctccaaaaacaaaaaaaacaattaatttttttcactttttaaacagagtcaaaatccaatttttgtcgatgctaatcatgtaacaaaaatgtgacaagattccgaaattcccggacctaaaatcacttaaaatattctaaatttaatccaaaatatatatattacatctttgcaaaatggtcgagcgtgatcatacggtaggttgccagtaggtctccagcaaggaatgttgcacttattcatctcaattgtagcgcggcacttatgatcgcacaagcgagggaaggggtagcatttctccagacaagattcatttatgtaagtctcattgaatacttaaaaaatcgcatattattagagcatattttgagaccttttggtgttttcatcccctttttttggagtttttttccgaaaactcccattttgatcgtcaaaatttgtttggtttttccttgataagaatttagatttaaaaattttgcttattcgaaacaaattaaaaatatataattatcatttaaaattttcttttctttttattacacaaacaacatacggtaacattgactgcatttttacctccgcattcgaatttgcactgggtgtttttgcagttcaattttttagccatagcatcacattttggtgttttataccttcgatgcgcttcctaatgatagtattaaaatagaaaaagatattaaaaacattcttcgagataataccgtggattgttgtaaaacttcagggtcctaaaaatattgtagagtacaattaaaacaatagttaagtatttttagacgaaaaaaagttaattattttagaccaaaaaactttttatttatttttttaataaacattaactaattattcaatgtttgcaacccgggattcattgcacgggattctctttcgcatttttaaattcgcgttattattattttttactttgtaccaatttttcagttatacatttcttgcatttgggtcttccctgtttttcaaataagcataactggttattttattaaattttaccgttttacagcagtcacattcttgcccccaaacaacacaacaaacacccttcagataactctgactgaaaattttttaatgcagcttttaaatgttaataatatatttcaaaatgcctattcagccactccaccccccacccctctcgagcaaaatgttgtaggaaattttttctcttaattaatttgtacagttaaagaagatttctacttacgggaaatttttggcttcgcaaaggcaaatggttttccccttgcatttttcctttgctcgcatttcacggtacacgtccatctgtgtaattttggtatgagatatgagtttactgtatgtaaacatgatacataccaggtttcgtcgcacccatttaattcttggattctcaaaaaattataaattagaattggtctgctctaatacgataatgaaaaaaagagttaaaaaacaaagaaatgattgataattagcctaattatcgaagggggagcactccaaaagctcgccgcccaaaatctcgccgtgaaaaaatgtcgccgtttcttaaaaatttcaaagcagaatttttcaagaaaaaatattaagaaattttttaaaaagaaaatttgaaaaaattttctttttttaaaaaagtttatataaattttttttgaaagtattttcaaataatcgctctaaaaacaaaaaattttctgttcgaagatgcctataaaaaaagtttaaaagatttgttgtcttgaaa

SEQ ID NO: 24422 - DNA, 1675 bp, Heterodera glycines
ccgaagccccgcccctatttttgaattggcggttaaatgctgttttgttgtaataggaaaaagaaacagaaaattaaaaaatataattgaagactaatagagaaaggttggggtagaggagagattgcattgtttgtttctttgtccgcgcgggtgggacgaaatgcgtgtgagtttgtttatgtttgtgcttgatgtgtaggagtgggtgggaatgagaaggtagataagaagaggaaaactagagatagagtgagagagcgaggagaaagaaaagaaagacagtaaataggattgagagaagaagaaagggaaatgcgaggagaggaaaagagacagaacggagaaaaagagaaaggaaaagaaagagagatagtgagaaagagaaagaagaaaataatggtgagagaaaaagaggaatgtgtgggagtcaaaaagaagagaaggacaaaggaagggggagagagaaagtagagaaaaaagagggagagtgttgtgagaaagagtgacggagagggagagacagagagagagagagagagaaagagatgggtagaaaagaaagagagtgaggtgagaagagagaaaaagaaaaagagagagagtgagtgagaaagagatggagtgaggtgaggagggagaaaaagaaaaaatagagagagagataataagagagagagagagaggtaaagagagatggaggaaaaaagagagagagagtatgtggtgaggagagaaaaggacgaaaaaatagagagagggagagagagtgaggtgaagagaagtgagaaaaggaggaaaaaagagagagagacgcagagaaagagggggagagagagaaacgagcagagagttagagagactgggagagagtgagaagaagggagagaaagaggagggagagaaaaggagagagagagaataggagagagagaagaggagagagagaaggagagagacaaaagaagagagagaagaggagagagagactggaagatagagagagaaaagagaagagagagagagaaaaggaaggagagagagaaactgggagagagagaaacgagcagagagttagagagactgggagagagaaaaagaagagagagagagaaaagagagagaaagagggtgaaaagagaaaaaagagagaaattgggagagagaggagatagagagaaagacagagagagagagatagagagagaaagaaaagagagagggaaagggagagagagagaaaagagaaagagataatgagagagagaagagagagagggaaagagagagagggaaagagagagagcgagtgagagggaaagagagaagagagtgagagagaaagagaggaagagagaaaagagagtgagagagggaaagagagagagatgacgggggagagagatagggacagagagaggaagagagagagtatgaacgaagaaaagcaaattactttatttaataaaaatttggcaaaatggttaaaaaaattcaaatttgtataatttttttgccttttctctcacgaaaatgccattcttaggggtgtatatttaaccccgaccccgagtcggggttaagggtcggggttcggggtcgtcggggttggaagtgtcggggttcgggtcggggtaaaccagaaaaatggccaaaaatgtcggggtcggggcgg

SEQ ID NO: 24423 - DNA, 1881 bp, Heterodera glycines
aaaattgctgttctttttcagttttttggaacatctttaaaaatttatgattgtggtaattttctgatatagtctacgaaaactataaattcatctataattgacgctcttggggagcgcaccgggcgggtcacatattccttcatcgtttcctataccttatcgactaattctccgattccgaggtcagactgtgtataagcgttacggtacgcagtgccaacgtcttctctatatttctcgacaatctgaaacgtctttttcgcttcatctgacaattctagacacattaacaagtccttcctatacagacatttattcatatcatcaatgataaatcccattttctgataatcttcattaatattaaccgaaatgctctgtacttttcttaccccttctaaaagtcgtccaaaccatatatttacccctgaggcttcgagatttcttatcttaactttttcagcttcttgaatggctctatgagatgagtagtaaaaatctatacattcattatgtaatgtgccggtatacgtaaacactgtgtcatttgttaataaaacagtgttcaattgctgtttttcaatcagtagaaaggcatcaacaggggggagggggtacgggcgggggcaggaaacgaactgttcccgctaaacgtgttccatttttagcatggcatccaaagcgtttggagttgctttcgtctggcgccaaccaaacggtggtcagatggtcctactcagattcggtaaccctttttcatttcttatattttcccaaaataatttttttttggaatctccaggactccatttggcttccaatttctcgctacattgttggcgacgaggtcaattgctatgacatcacttattcgccttgtggacggtacgcactgtgccattcattcctcggcggattccatttttgggaaattgacttgaaagtgcgcgaaatgggaaaatgttggcaaaagaatgcgatttctaatttaatttttttcgttttgggttgaaaattggtatatgtgggttttcgtgggtgctaaatactaatctaacaccaaatttatcgtatacattatttaaatctatgctgggaactctatgattttgaaataactgggggcggggctttaggtttgcaaaaaaaatttttttttttttttggtagtaaacttgaaaccattcccaggggtttcaaattcaaaattttcgggtttttgtcttcaagtttatgatttttcaaccctaaataatacgaaacccccatttttcagccttgcaaaagtgtctaaaaaaatttaattaaatttcatttgtttcagggcgtggtgttgcccaagtgtttccccattagcggacactttgccgaagtgaccgacctttgttggtcaccggatgggtcgtttttgctcagttgctctgccgacatgacgacacgaatttttgccaagcacaaaaaggtctgtccgttgggtgtatgcacttcatttcttcccacgtgtttccggggacgggacaaagtttcgacgccgaaattttggggtccatccgtatttccccccccccccccaaaaaaaaatttaaaaaaatgttcgaatctagttttcaagaaaaaattaaaaaaaattcttccatacgaaaatctaaagaaaaatattcttggaaattttacagctcattttttgaataatttttgagaaaaaacagtattcattataaaattttgaaaaaaaattttcttgcaattttcatgattatttcttaaaaaatttctaggtttgaaaaaaattaaaaaaattttcctgaggggaaagatgtggggagcaggcccaaaatttcggggagggcacccgaagagttttttttttactcttcg

SEQ ID NO: 24424 - DNA, 1189 bp, Heterodera glycines
cgggcaatcttgctcgaaattgtacccgatcagtcagttgccacattcatgttgagctttagataattcgttgccaagtttggctccccgtccagtgtttattgcgacaatgcgcctacatttcacgcatttgccaaattttcccaatctcattttccccttaaatggcaattccgaaccccagcagccgcgtggaaaggcggacactacgaaaggctggtggcccttattaaataccacctccgaagagtcctttccggccaccgccctcgtgtgctcacaagggaacaattgggcacaataatttcagaaatcgaaacagttattaactcccgcccgataacatttgactcatctaatccagcggatccccgcccactccggccaatagactttcttcacccacttggccaccgctcccaaatttacccggtcttaaatcatcccgaaattgtctcaattgaaagtacccatcacaccctaaacgatttatggcgaaatatgtccaaagtaacaaaatctttttgggaaaaatggacaagtgactacctcccgtcattaagagaaagacataaaaaattgattgccaaatcccagagatggccacaaaatggtgaattggtcttaattcacaacgacaataccccccgttccacatggcctcttgccgttatcttagaagtttacaccaatgaacaaaacaccccaaacactgcaaaaattaaaaccctttccggccacattaccatacgttcggttcaccatttacttccccttgaaacaaccgaagaaacggcacaccgtaccaccccctccgaacaaattgaatctcccaatgaaaatctcaaaaactcagataaaagtcctattcatcctcccgcacctattgtcccaacattttcacagaccattcaatggccaaaccaaacaaaaggcacagaaagacgatggctctattcccaccaaaccgccgctgggcaaagcagccgccgactcaacaaaattgaaagcgatcattttcaaagccgttcacaaaaggccactttcatttaccaccggcaagcgttggaaagtcgcggtcgcttttctgctgctctcgagaagtctgctggctttgggacaagctttgcaggttcaactccggctgaacagagggcggaggttgcggctctgaatgggcattggtgta

SEQ ID NO: 24425 - DNA, 1575 bp, Heterodera glycines
atgttgttatttttgctccaaacgacgtttagacccctctcactggagttcgaacaaatttcatttgttattttcgctcactgagcacttgtaagacctcaaaagagactttaaatgtttgtacagtgactgggagccctgggttattgaaaataaaaagttcgaacaaaaggtctaaaagtcgaacattgttcgaactctacaaaaatgatcaggaagacatttccagacagggggttactccaaggggggtcgaaatgttgttatttttgctcaaaaacgacgtttagacccactttttggagttcgaacaaatttcatttgttattttcgctcacagagcacttgtaagacctcaaaagagactttaaatgtttgtacagtgactgggagccctgggttattgaaaataaaaagttcgaacaaaaggtcgaaaagtcgaacattgttcgaactctacaaaaatgatcaggaagacatttccagacagggggttactccaaggggggtcgaaatgttgttatttttgctcaaaaacgacgtttagacccactttttggagttcgaacaaatttcatttgttattttcgctcacagagcacttgtaagacctcaaaagagactttaaatgtttgtacagtgactgggagccctgggttattgaaaataaaaagttcgaacaaaaggtctaaaagtcgaacattgttcgaactctacaaaaatgatcaggattaggtctaaaatctgaattaaataaaaatgactattaaagtagcgtaataaagtgatttaatacatttaacttaaagtaattttaaaatgcatttttttatttgaaaatatgctttttcatattagaaaattaatatataaaaacgaatataattaaggaattaatatttattataaaatgagaatgatgtttgttgctgatgaaaattttaacaaaactgaaaaaatgagaaaaggcaaatgttcaggagcttaaatatccttaaacaacggtaaagggatagcatataatcaattaattgaaaaatcgaaacagaggcgtccaccatactctctcatcgccacacgcccgcctccgcagtgcttgtggtgaagcaaaggggaaaatttttcaccatttagtcaacaattatcccattcctttcaactcaccctgtggccaagtggttaagctcctcgcttccactctcaacggttcgagtccactaccatgtttttgatttttcacaatttttcggaattttcatcataaagtcaacaattatcccatacctttcaactgcccctgtggccaagtggttaagctcctcgcttccactctcaacggttcgagaccgcgaccatgtttttgattttccacaatttatcggaaaaagtcgcgcacaaaaatatttaaataattaatttaaatttaaattaattaaattctcgcgcacaagtccatccaataggtttcggttgaagggatcaaagatcatccaataggtatggggcggggggggggggggtccgaaaatatggattgaaaaaaatcgataatcaaagtactcgtacattgtagtc

SEQ ID NO: 24426 - DNA, 1837 bp, Heterodera glycines
ggtcaaagtggtcgccgtgttgattcggcaggtgagtcgagagggctccctgaggcatgactccgtctgtgtggtcacagcgatggtctcggcgttgctgagggcgacaggggtggctaataggatgccgatgagtcgggtggccgccctttgagctcgccgtccgtggtgccgtgtctgtcgtcggaccctttggactccaacttcgaggcgtcctgcgactcgttcccggtcttctcgtgtccagggacggccggcgatgaagaaggctagtcgaaggggccaggaaaggagcaatgcggtgatttggtagccgaacttgagcacgacgcgggcagagggcaaaaacagacaacccacccgatcagacaactgatcagtgacccaatgaccagaagtaagacaagggagagccggggattacaccgccaattggcgggtcggtcgatgcagatagaacaatcgatcaattcacattcgttgaccgccggacaggcaatttcggcggtacagctgcgggtcgaagagagaccgaatgtcgcggagcagacatactcgttgacgaggaggtcggaggacaactcatagctgatctcagaggcggcgagacgatcaaagcaggcattcgaacaacaaattgtcaccttttgtaccgcaggatttgacgagattttgacgccttttcgggtgcaattgacgtgattcccgacacaattagatgttaggggtgactcgggacggtccggatcgaatggccagattccttgtgctggggaggcttggacccacaggagagtgacgagagtggcaatggtcattgttgtggtgggagggatcgcgaaaagccgtgattttcgtcgcgtaagcatgccgctgtgcttactgatcgtcggttctccagaaagtgaggggaccggcggcatttcatgtacagacatttcgacgtttttggagtcactggggctttgatcagacgggataggtacggtggcgtccggggcgggttccggggtttcgacgatgaccacttggccgatgtggggggtggcgggagttcgaaggcggggacctttatgagtccatgcggcgcgctctctgatggcgaggaggtactcatgactccatttgagccaaaaatggtcggcggcttctcggtaagccttccaaagggcggcgaggcgctcgggaccggaaaggcagtcgtcatagtcgaggtcagagtcgacgatgtccaggtcgttgaggaggccgggttggataagatctttcggggtgaggggttttgccgagtccggttggtctgacacccatgtgatcgggcggctgttgacgctagcttcaatttcggcaaggaaggcactcagatcgtcgtagtcaagaatccgccggccgattgttcttttgatacacgatttgacgaggccgatcaggcgctcatagcaagctcccatccatggacagtaggcgggaatgaagtcccactggatgcctcggcgcgcggcaaatgtgacggggtcggtttcggccgaagggccggttagaatgtcgagggctttgctggtttggacgaaagtaggggcgttatcactcaggattcgccttggtcggccacgacggctgaagaatcgtcgcaagacattaatgaagcttggggccgacaagtcggtagtcgcctcgaggtacacggcgcgggtgacgaaacaggtgatgatgaccaaatacgccttggtcagtgatccgtcgcttagccgagagggggtgggcccggcaaaatcgagaccgacaaactcaaagggattggccggtttgacgcgcattgagggcagagggggcatag

SEQ ID NO: 24427 - DNA, 2396 bp, Heterodera glycines
  misc_feature (61)..(61): n is a, c, g, or t
  misc_feature (121)..(121): n is a, c, g, or t
tgagccttttgggggcattcatgaatttaatttggggagagggaacattcgaaaatttacntaaaaatcacagtgaaggcgcagaatcagctacttattgttagcaaatttccttcaaatntaaaaaaatgcctcaaaaatagcgctccaccaagtaatgggatgaggaggaaaaagtcaccaaatttggcttcccaaatttagccccccccctttttttgtgtccggaggcctcccacgttttgaatttccatcttcaataatttatagccattttctgtcattgcttctcacttttactttttactttctcttcctctctttcgtcctttttctctatcgtttcgtcttcttccatctctgggaatgatttcaaacacaaaaaccgttctttgcagctgttttttgtcctcacaaaatgaattctgtttttgaaagggaaaattctttttcattgaccaattaattaatttaaaaagaaacacaaacagaaaaacttctcggtaatcgctgttgaaaatcagctaaataaaatggataataaatttaatttacaaaattgggaaattcacataaatgacgcaattgacggaagaattgaagatgaccaaaaagttgctggcatcggagagaagatttaagagaagggcgtcgggttcgaagaaagtctcgatcaaattgacgataagggcgagagtgttacagcacaaaaacagcacgaccacctgccaaaacagcggctgatcatcgatcagtggaaagattttgcaagagtccccacaattgacgccatccgatggcattccaccgatccgtccgactgaccataatcatcgtgatggtctcatcggagccaggggtcgctttcggaaggggcggaaattgggccaaagtgccgcccaaaagagcagccgcaatatgcggctggcgctggtatcgctgagagttccgatgggggccgtaatgccgtaaactttgctgtggccctcgggggaaactcgaccggcggaatttgccatcgccgttcacgctgagctgtctcttggacgagtcggtcgcaagaagcttcttctgttgggcggctttggtagggatggaggagaccgaacaattgctgaatcggccgagcggagattaattaattaatcaataataattaattaattaatgcgaggcaatggccaaaggcaattcactgctcaccttttcttcttctttcgcatttgatttgcttccaccgatttgcaccaaatgatcagcacattgagaatgagcagccaagagaagggaagcaaagtcatgacgatcatataaagataaactgaggggagagagaagggataaagcgaaaaggacgggggagagaggagagaccgttgtaaacggtgttaatgttgaagaacaaagtggtggggcaaatctcgacaatcatttccttcaatgggaattcgaagtttcccggcacttttcggcctttcctttgccattctttgccccccaaccgaactttgcttccctcgtggatacaatggcgaagattgaactgtggaaaacgtagtgaattgtaaagcacggaggccaaaacaatgcaaccgacgattcgttgtgccctttttaccgtacaatgccttttggcattggagcgccagcaaacctaaaaaatcagaaatgaaaagacatttttaaaggagtgaacttacacaaacgtaacagtcgaaagcagccgcgacggtgaagtaaatggagcacgactgggccatgtaccctaaagcaatgggaggaattggcacaatgccaaaagcacaatggcaccaaagggaagagtgtaaacggtggtgtacggagactggacaagttgagggatgtaggaacgagctgaacaatgaagcgatgaaaaggtgaaattaaagggggaagggccgacccgagtcgacccagaagatgaacaggccggtgatgaccacgaagaagtcggagcaggccaagtacagcaagtacgtgttggacgagtttctcattcgcgagcgcgaataaacgaacacattgaccacgttggtaatgacgccgaaggcggagagagaggggagcataatgatgatgacgatgtagttgaaccaggcgtacagcggggagtaatcctcgtgttgcaaatccgagcagatgcctaaaggcaaaaagataaacgtacagatggaaaacccagcagcagtcgcagcacattctgaggcgttgaatacgtcgggctgagcagccataatactgtaacagggcagggtatacggtacaaaaggggggggggacaaaagcaccgaccgatcaactcacctgggaaagaagggaatgatgcccggagtttccacaacagtaaagcttccctcaccctcaaagaattcagt

SEQ ID NO: 24428 - DNA, 950 bp, Heterodera glycines
agatgggagtggggagaagatgaacatgcgactcctgacaatgagcgcattggatgtccatcagaatatcaataacacctgtgcatcaatccgttgatgctagtctttccgagacaaacagaaagcagtgaagtgaagagagagtaatacacctgcaaagggaatggaaggatggaagaacgctaatttgaagtcattaatagtaattagcgtgaccggacatttggacagtggacaatacgaaagagagtgaatttttttactattaaaaatggctttagtaataacaaaaatattttcctgagccatttggcaagtctaccaacccgattagtcaatttataagcgcccggctcgttaataaacagcaataaatttcatcttgtttattttttaaaaaacaatctttatcttaacctttagaaagtatcacttacttattttaatgccatatcagacttatgaaaattcaatttacctagatattcttaaaatatatttttttattgctgctaaagccatttttaatagtaaaaaaattcagtctctgtcgtattatccactgtccaattgtccggttctgtccaaatgacttcactgtccaaatgtccactgtccagatgtccgggagccgttttccgcgggtgacagctcgcgaggttcccttgtgagaatgacgggagccgaggagacggcggcgccacaaattttggtaccctttttaggggactttataaaatgccgtaaatttacattttttttttctaatttggaagggtacacaaataaaattttaaaaagttacgcacaaaatgtacaaaaaacaaatggtggcgccaaaaaaaacaacaacagagaatggctttagtgatcagtgatcacattgtgggatctttcggcactaattaaaatgtacgttttgcaaacttttgtaaaatatttaataacta

SEQ ID NO: 24429 - DNA, 1692 bp, Heterodera glycines
aatcaacaaaaattgccttttcaggcagggatttccgggatcactgatcactagggcttccaattatatggaaatccatatttttttcctggacacgcaagaaaaacatgtttttagcttggtttgaagcttctaggatggatttctatatccatatttttccatatttcgcgatttatgtccatattttggcatttttctacaaaacccctattagaacggccctcgtcagctaaattggccgttttgaccccaaagactggaaaattttccgaaaaagacattttttaacaaaattttgtcgaaaaaattgattaaatttaaattttcttagaaattggttatttatgtcaaaaataagcaaaaaggaaaatttcggtttttttttgttggttttcattaaaaatagctttttttcttttaaaacgagttcttataccgtatttagccattttagatgtattctaatagaatttaatgaatttgaagaatatttttgaaaatttacccctcaattcggagaatttatgtccatatttttgctattttatgtccataaaattgcggagaccacggcggttaagctacagcagaagaaagatgaaaattggaacaacaattgtaacaatgtgttcatttggctttttagtggcactaattgcattgggtgagcaataaaaagcatttgatttttatccaatttgaattttgcgcttaattaaggcctttgtctccgccaccggcagaagaagcgggacaaagcatcacaaaagtgcgaaatgagtgagggacaaacgaacaaaaacagtgactcctctttctccccctccttcttccgtcgaatttttccttttcctctctttctcttccgtctctcctccttccccactgctattttcatccttttcctcttctttctccccctccttgcttcgaatttttccttttcctctctttctcttccgtctctcctccttccccactgctattttcatccttttcctcttctttctccccctccttgcttcgaatttttccttttcctctctttctcttccgtctctcctccttccccaatgctattttcatccttttcctcctctttctccccctccttcttccgtcgaatttttccttttcctctctttctcttccgtctctcctccttccccactgctattttcatccttttcctcctctttctccccctccttgcttcgaatttttccttttcctctctttctcttccgtctctcctccttccccactgctattttcatccttttcctcttctttctccccctccttgcttcgaatttttccttttcctctctttctcttccgtctctcctccttccccaatgctattttcatccttttcctcctctttctccccctccttcttccgtcgaatttttccttttcctctctttctcttccgtctctcctccttccccactgctattttcatccttttcctcctctttctccccctccttcttcgaatttttccttttcctctctttctcttccgactctcctccttccccaatgctattatcatccttttcctcctctttctccccctccttcttccgtcgaatttttccttttcctctctttctcttccgtctctcctccttccccactgctattttcatccttttcctcctctttctccccctccatctt

SEQ ID NO: 24430 - DNA, 2369 bp, Heterodera glycines
  misc_feature (1654)..(1654): n is a, c, g, or t
ttgtagccgcacatcggacaaaacaagttgacgcgcacccaattgtagaggcagcgtcggtgcagcggatggtggcagcccatcgtggtacgcgtgattcggctcagtcggccccagcaaattgaacagcgctcggctcgtcgcgatttggcggtctgtgggaaaacaattggggaaaattattttcggttttaaatttttttaatctaaacttacgtttcctgcccttgctctggccgccttgcgcagctgcgcttgacgcttttccgccttggccgcacgcgcccgtgccgcgtacattgcgttggccattcgctgaaaaatgggggggggcaattagcacaatgaaaatgcacatagcaaaacaattaattacctaaataaactgacgatttaagtggcggtggaggaggacgaataattaagtggatggaatgaatgaacggaatgaacgtggaaaagcaaaatgtgtgggccttaaatagcaaattttttagtcggaagagtcaaatttttcggataaattcatatataaaaggcacaaaaattcatttggttgccatttttccattatttaattaccggcaattcatcttcatcaatcatcccttctctgtgtacaacgaaaacgacgacaattgagcaatgtcggaccatccagatgctgcgctggccgacctgtaagccgctcgaatttaaaatttcacaaaaaatcggattttaaatttttgcaattttcagcagctgcgtggcaaacgacgtttggctggacactctgttttggattgaccgcgctgaagttggcacgaagtttgcactgatcgacgcgcgcttcggcaggctggtggccacgcatttcaaactgcgcaaatggaagctgggcgagctgggcattcatcgggcaccaagcggatgggacaggggcggcacggcggctgtcaccgttatggacgaccacccgttgatgaatcgactgccgcttgccaagtgtcctgcaccgaacggcgtgattggcttccgtgccatctacatttggtcttagcgaacaaaatttttttgcaaattttcaaaaattccctaattttccaggtacgtcgacctggaagtgatcacatttctgcagtgcctgcaacgcgttctcaacctcggcactgctttgcagttcaccatccattcgaaggatgtccgctgctgggcgctgatgtcccaacgcatttggccactgatcgcgcacgctgtcaccacgctgcacgacatgaaggacgtcgacttcgcgctgttgcgtcgccatgtgtcgccgaatgtgctgttcgactgtgtcaagcttcgtgtcatcaccaacacgcacatgttcccggtccaaccgccctccagcgctgtgcacatcaacgaactgctccaaccgcctgccactttcaatgagaagccgaagcatcaactgttacgatggctgcacacaccgctcccagatggcagtcccaaaattttgactattcgcaagtggcgacgcgcgcattggtctacgctcacgtcgagcctgcgaacggtcggtcggaaattatttttttttgcgtttttcgattccaaattttttttttcaaattttccagtatttcgaagcgccgagtgccattgcggtcaactacgtcgtcgnttgtcatcgggcatcgcgtcgcaacatcgagggtcgttgagcgggagaatgaacggacgggcgagtggctgacgctgcgttggcgtgtgcccgtggaggctgtggttgtacgccagcggagccggcacggattggcgcacagtggcgaagtgggagtgggacgcaaaccatacgttggacactatgctgtgcatcaacatccaggacagcgacattgggtagagtttttgaggaaatttttttgaaattttaattttcaacaatttttaggcccgcacttctcgccgaactgatggccaacgaatgaggagggatgagaaggaagtcatgcgcaatccaagcggaagaaatatattcattgtaaatttgccgatgtgctttggtatttgatcgtatgcatatttgtgtgaattgtataacatactgtatgtataacatttatactcattattacattttgctgccagtgttgtataaaactgtacacaatttactggatttggtcaatttacgaaaataatggtctctgatctcttcgccgaaagggaggggtttatgattttggagaatttctggcacttttgctgccttggacccacgaaaaaattcaaaaacattataaatttttcattttttgagtcccggaaatttaagctaattttttatgttttttatttggtttttctgacataaagatgagttttcccagaaattt

SEQ ID NO: 24431 - DNA, 1877 bp, Heterodera glycines
tttgcgattgtgtggctgcttcactgtgcaacggctgttgcagcgcactgggaaatcgggtgggttttgtgaaacgaggagaagcggactgatgcaaacctgaaaggaaattggcttgaagtaaagcaaattgaaattttgaataaaaaagtgatgtaataaaagtatacgtttatcggcagaaaaatgatatattgtcttctaaactgtttaagcaccgcctatgtcagtcaaactgattctaattgtaagacccaaaaaataaatccaaaaaataagtctaaccaattacctggaacgctgacttgagcaagtgggaccggtctaccattgctattgtacgcgccgccgccgccagtcaatttcggcctgaactgttgacggtattgcggacgttgtggacggtattgttgttgttgaggctgctggtattgttggtcttggtaagccatatgctgctgctgatgatgatagtacgaattgaacgaactgcccatggttggtggccatccgtacagcgctgctgccgcctcgtaacttccgccctcaaattgttgcggctgttcgtgttgttgttggtgttggtccggtctgccaccgatggaacgaagtgcttcttgcgcttttagccatgccggattcatttcctgttccgtcggcacaggaatggcggacaaatcatcaggcaaaggcacttcctctgtcgattgagtttggtatgcagaaagtcgccaattctcattgccagactcattttcgtgtgctgagtttgtcctgtcaccaccttcatcactgtccttcgtttctgtttgccaagaatcagccatattacacactatttgtgtatggctaattgggagtgcaacaagatttaacaaaaaatggagaaagtagtaaactatctgaatactaattaggcgatatgatgattaatatgtggtaaggataatgttgttaacaaagccttaactttgcacttaaaatttaagacgaaaattgcatcccatcttcatttaagattaagcatagagtgtcggagagtcggacgggaaagaacaagaagcaatttccgatcccccactttttaccggaacaatttgttcgcacgaaaaacgcgggactcctgcacaaagtttccgtcttgcattttttgagaatttccgtttctgttcggtaatcggcttggtttgctctatttttggcattatgattttaatttaaattttcaacttttttcggtaaagaaaaatttttttcaactcaccagtctctaaaaaacctgtaaatgttaataaatatcagcatgtttcttctgcctttttttataaacacatatgaaccattgcgaaaatgaactcctgttccataaattctgtttttctctaatatagagcacatacaataaagaaaagaggctgaatgattttaatttaaaattgatttgtagcctaaattccaatggatccatatgatctaatagagcctgtcgatatctcatcaaaattgaacatcaatttcgaaagcccaaaatggcaggaaaggaaagaggccttggacgcactgcaacaattgttgtcgcaaacgccacgacttgctgattcgccaaattaccgggaagtcatcgaacgcttagcaaaggtctataaatgcgaatacaaatagaaaaactttttttttttaaatatagactgtggcaagtgacgcaaatatcattgtcgccgcaagtgcgaccaaatgcgtgatgcttttcgccaagggattacgtgccaaattcacgcctcacgtgtcgttggttgtcccggtgatcttcgacaagttcaaggaaaagaaacagttgctcagagatgcgctggtcgaatgcatcgatgtcatcgcag

SEQ ID NO: 24432 - DNA, 1807 bp, Heterodera glycines
gggcaatagacttttctggggccccgaattcctctgaaatgggaaggaatgaatgccattgtcaaggcattcctcggtagggaactcacttccttgtccacccgtcccaacgcttttttcgcctcgtaatcatttgggtcacgttgcaatcgctgattgtagcgcaaccgttccgcgaccaattcttgaacactcttttgaggcttaagtacaaaattaattaattaatattttgggagaaaaagagtgccttcgtcagcccaatggggtcgggccgagaggaggccaaagagaaaacggcggaggaaggacgcgcggagaaggccgaactgctcgaaaaggtggccaattccccgccggaggggccgtgctgctgaacagccgttgacagaatggtcgcctgcagtgccgactcggccttctgacgggcgaccttaacaaagcaattcgcctgaggcattttcaccccaaaaaacaaaaggacctgtgcctcgacaaaagtattaaatcggtccaaaaagtcctttccatggccccccgtcgtttccttcatcgtctcattgctctgttgaccatttgtcgtcctctgattggtttgtgccggatttttggtcgttggcaataccatcggtgtgccagagtcggaagggacgaacgctaatttggtggctggcggcaaagcgggctaaatgtaaggcataaaattaaaatctaaaacggatactgtagcaaatgggtgttttgttttttgtgcaatttatttttgctttccctcattctctgggttttgactgttttcattcaatgtcaccatcattgtcacaatcgctcgttaacttctcccaattcagtctctcttttcggaatgtttcccttttttaattgtccctccgcccattaagtgccttcttatttatgtaattttcctgaccatcgtttccgtcaatttttcattgtaaagggtccaaaaaatcgttcagtatcaaaaatatttcttctctaaatcaaaaagggactgaaaatgtttcacccctcaaattatgaaggcataaaaaagagaaaggtttggacgagtcttttgattaaatgctcttcaaagtttccctatttaattgaatgacaaactccagcaaaaccatttccaaacccaagtgaaacatttataaaggaaatgccaaaactcttaattcttttttgcgcatcaatcatcggcacaattttgggcaagttccaaaacaaaacagttttaaatgattcacataaatgcaggcctggaatgttggacagaagtgaaaccgacgcacccggaagggtttggactcagtttaaggaaaatgcggtgcccggaaggcggaggcgcgagaatgcaatgcgcagagacaaaatgtgtaacgagtgagtggttggggaaatggaagaagaaaatggggggggggcaaaaaagtgtaaaatgggaagagagagattcacccagttttaaatgagtttggatcaaagggttatgggataaagcacaaatttacggaaggacaaaccgaaaatgaagggaatggctacgcgacggtgggcaaagcgtgcgccgatcgattctattgtgaaatgacgaaaagagcttgcgaatttgacggggaggggaggatggaaaagtgcgatttgtgtgacggggacttatgcaatgggacggggacaaagtacagaaaatggcattttggatggaccatttgcattgtggcgacgatggcacgtaaggaaaacgcaaaaccgaattggcacattcataacattcagtacttacctcctaaaacga

SEQ ID NO: 24433 - DNA, 1842 bp, Heterodera glycines
ataatgattttcgtttttaattttatcttattaaacctttagagaattgatattttttaaccaaataaatgatattttttacgattataatagtcggtgaatttattatagctgcctattaaaatgagaaattgatcaaatcaaatattttataagcaattttcttgttttattttctttcatgaataaatgataatattttttattcatttgtttttgtattcgataaaaattatataattttgcattttactattttttggtatccgatttatgactacaaatgtgaattgccgagaatatttttagaatttatgttttttattagagtatataaattaattatattgtttatctgaacaaagttaaattttttatattttaaaacaatatttaatttttttttaaatagttatatgacattaataattgagatcaaaatagtataaataattatagattattaaattagcatttttatgcaaatttgttggccgttggaagtaaatcgactaaggttgtgtaaagttgttttttctgcacgcctttgtttagaaattatttcgtttttaaaatgcaaaaacaattttacttaatttatgtttaatctatttagttgatcgccttaacaattgtccagcgcaattgtttgtaaaaactttttcctgcacataattttttaataatctttatttaaagtttctttatttattaaaacttatttgcaactttcgttaatgttttaatttacttatttttgcaaagcttcaataaaatttttaaatacatgatccaatcatcatttcttgattaaaataattattttaaatttttatttttagattcgaacaaaatttttctttgatttgattatttctgtaattttggcagcgaaattttatcccgtcgaaattgatttgtaaacaattccaaaagatgaatttgacaagcacaaaaaactctcttttttttaaatttgttttgattttaaatacttaagcgaattttctaatgtataaaagtatttcaaaccactggacatatatccggttagattgcatttaaaccgtcaaatctaattaaaaaatgctaagtaatagagacagttatttataaaataaaatattaatcaatttaaaacaacatactataaaatattttttaattattttatttaaaaaattatactgcaaatttatttattgtgagaaataaaataaataaattttaattattctaataagaaacaaagtgacacaaaattaccgacaaaatccataatttaattatttaacatttgtttttaaataataatgaaattagtcttaattttatgatagagtttttgcaataaaataaattaatttataaagaataataatcacataagttaaaatgaaataatttaaaaattctggaattctttattcatggttttcaaaactaatggccctctgtgagctataatattttcagttacatttcaagatttattcaattgagtgtttaacagtttcaataaattcgaaattcgctaaattttctgaaattattcatttttatttctagaaattttttttaattttcttcatgctatgtgattgaaaacatgaaagaatttatgatttagaattattaatataaagtcggattacaaaggaggttattctatctttcttctcattgtcctgataacaatttatttttttcaataattaattgtcatattattttagcatttttttattatatttatttttttcaataattaatttcaaatataatttgtaatgttatttatattatttagctatatttttatttatattttatatggatata

SEQ ID NO: 24434 - DNA, 1623 bp, Heterodera glycines
  misc_feature (818)..(818): n is a, c, g, or t
  misc_feature (852)..(852): n is a, c, g, or t
ttaaaaattatccatctcattaacaacattaatatttataaatttaataaaaaaatttgttttttacagtacttaatcgatatttaataaattttgaaaaatttaaatttttttttcttattctttcgttaatcagatttttatgagggttttccgaccatgtcaaaaattttttgggaaaaaaatgaagaaaatataaaaatgaataaattagtgtttttacatttatttaacttttgcttttctaccaaattattttattggcaatatgtagagaaagaatctatttgtaggtaaatttgaaatagtaattttattttttataatttctgttttaaatttattctttctatgtaatttatattttgattgaaaataataaagaagtttaatttttttttatatttaaatccatcatttcgtcgttaattaatatttatattttaaataaattattaatttatattaaactttatatacaaaatttataatttttttaaatttcgctcttttttataattacataggttaatattaggtaattgtaaatttaatttaaaaaactatttatttaattttcatgcgctttaaagatggtcttccttctgaaaagttgtccaaatttttatataataattacagacctgagacagcataatcaaaaaatacccctaaaactaatgaagctcaacagaaggcaaaaagtcacaaaagcaataatgactaaaccaattaaaatcatcctaaaatttaaaaaaatatgtttacattattattattattataaatgcaaagttaaaatgagcaatttgtcgtanaggataatcggaaaatttccgccgggacatccanagccttttttttgcctttggacttacaacataatcgcacggatatttctcgcgagataaagatttaatctagtgtttttagtaatcattaaagatgagatatggtaaggccctactgtatccacctcataagtcaaggcccgcgtgcctttataaatgccatttacatttgacggtggtagaagcacaaccgccaaacaattcggcatttagaaaatcggccacattttgcaaattccttttgcgcgagttccgttcatgtgtagacagcagactactgttcaggttacctaaaagagaatgttcttagagctaggaatttatttaaaacaagacggattggggcatttatggcaaaattctccgttcttcctcgaaaataccttcgtcgtgataaacggcacctccgccgctgtaatgtcgcgccattcgaattggttataaatgccgtgccaaacagtcgacggattttgcgcggacacttcggctcgaattggtttgaatccactgatcatcaaacggcgatttgagtgcgcgtcggacagtgccaatgtcaacatccaccaccaaagggaagtggtgatatgcgcgtccgcgttcaatcagagcgggtgtgcccgacactttagcaccgcttggctaattaccaaatcgtcgcgttcgtttgtgatcaggcgcggagcgatgacagaaacacatcggactaatgattcggaatttagaaaatcgtgcacatttttgcaattccttttgcgcgagtgccgctcatgtg

SEQ ID NO: 24435 - DNA, 1322 bp, Heterodera glycines
tgcccccccggggcctgaatggaagccgtttgccagcaacgatcactgagaagatgtggtgcggatccttgataaggccgacttttgaaggaaaaaggattggcaaatgcattgcagctgctcggactagtgcgaattcatgaccgtgagattgaagagagtagtgaagaaacaggaaccgaaaaagtcacgactttaattcgacttttgaatttttagaagtttgtagagcttaccatagaatgattaagcaaatattttttgaaaaaagaaaatattatatataagaatttaaaatttttgggaaataattttttaaaaaatacaaaaaaacctgtggaaattttatgggataggaaattggttgagtttccatagcttaaaaatcatcacgaaacggggattgtgcttggatttccataatttaagaaagtttatcaggaataggaaacctatttttttaattagaaatttaacactaaaatttattttataaattttttaaatgaaaatgagtcattttcctatttttcccgtcagcaatcacttccccaagttttcatttcaaattaagaataagacttaaaattattttctttgaatttcgtaattgactatcgaaattatttttcaaaaattattttctttgaatttttcgagagatatgaatggcgttttcgtattcgactattgaaaattactatttcgtttagtttcgcttttttgttttgtaccaaatttgcttctctcatgaatatttttttgtactttcatccgcctccgataataactaatgacaggcattccttttacgcgacaaagaaaagtaacaaaataagcaaaaattgcgtaaatatagaaaagagaataaaaaggaaaagaaaaaaagtgggtctgtagagctaaattttatcgtttttttaccattcaattgctcttcgcgtgttctatcaaactaaacttcgaaaaggaaaattagtaaattctgattaatttgctatcaaattttctgaattgcttaaatagagcaattagcttttaaatgtgtaaagctttcgaatgacaatgattttaataaagttagtaaactaaaaaaatgatccacaaaattgtctggagctaaaattggcgagctcaaccgacccatccgaaggaaaaaactcaagaaagtgttttaaatgacagtaaatgttttgacgttttaaatgcttttggtttggttagtgctccgtctctgctcggcttccatcacttttttcatccaagcgatgccaaccccaacccttgcagttggccgacaatcattgggtttgcccccgaat

SEQ ID NO: 24436 - DNA, 1654 bp, Heterodera glycines
tttggcacggcataactcggcactcgtactcattcagcaaaaataaaaacacttttcttaagaacccatgggtgctctatccacccaccaaatttcattcggaaatcccacggacacccggggaccttcctttgtaagccacttgaacaccaatcaacaaatttcattgtttaccttccttcccttgatttccttaattaatttttgacttacaccccaatttcgatgcataacaaattaacatttcgtaataaataataacaaatgcaaactttgaacccaaatttgtcagtttaccatcagcttcgccatttccttgaaatgatcaaaaaatcaccagtcagtgttacgctgggaattccccaccattttgcttataatacgcaaggaaagacactgaccgagtccgccaacattaatttcaacgaaatgattcgacgagaaacgcagaaaaaaagacaattataaggaaaggaaatattttcgaaaataatacaaattaagtgctcaaagatggtttagttaatgactagattaacaataagcgaggcatttaatgctgagatttcgtcccgtctgtgccggcgcaccgatcattccgcggatattgttgaagaagagtcgttgtccgggcatcagctgaatgtcgcatatgttttctgcgcaaacgcggccaaacttttgcagcgactcgtaaagttcgtccagggaatggacggtaattgcgctggaacgcgcggcgttgttgaaaaagccctactggtgaacaaaacattttgtaactcgctgcaaatgccagtacaaaccggcagaatatggccttggtcgtccaccctaacgacgggatgagttgcgaagaaagggccctgtcaaaacatttccatttcaccacaaaggaaatcccattgtgatacctcggcgtactcgagaacacaagtcccgaggaagaccaaatgtttggggtatcgcttcctcatttcgatgagcactttctcaacgtcgacgaaggaaagcctagccggcccggaaagactgtccaccgcaacaaccgaagggactttggcgaggtgcggccaaattgtgcccggctcttgcgcttcctctccccagtaacatttgcctaattcgattccgtcttcaattggcactcgcgcgtcagaaaaagccagcaaatggccattgagtgggccagccatcgatggctttgacctgccaaattgaccattttgtctgcctctatgagcgccgtaaagcctttccacggggctatcgagggcaatgtcacgaagaaaattggaagtgtatctaaaatgataaaaggaaagggtcagtatttaaagaaagcaaaaggcaaagcacccgccttgaggcaatgaatggcggccattgcacttcgagtgcctctctgctgcatttgatttcctggggccgcgtgttgaggtcgagatggaccaacgacggacgccggcgggcgttgtcgcgtaaccaaacgtaattgaactgaaagtcactttttgaaatggagagaccgatcgatccaactgaatgaaactaacctttgccaaaagaccatcttcccactcgacttgaacatatttctgcaaatttcgcgcggtttttagcccaaaccatttcaattttatcttttaaattg

SEQ ID NO: 24437 - DNA, 1462 bp, Heterodera glycines
  misc_feature (1438)..(1438): n is a, c, g, or t
cgtaaataagactttttttcaccattcatttttgagaaaaccagttaaaaaaaaattttttttgaggcaatacttttgcacctgactgtatatcaatcgattcctctaggtctgtaatagaagaatccgaaagaatttttctgcgggaaccaatccctgaagagttacagacccgggactgaaatggccaaatggctttgggactgaaccatccaaagccataaacgcatggaattgcgaccaaatagacaccaatcgattcctcacgttctgctaatcatgaatccgaaggaatttttggataaaaaagaaattggaaaaagttatgggccatcaaaacctatgaaattactgtgacaaaaaaaccaatttaccgtaaatccgctatttgaatgcccctctctggtagaatgccccctccaattatttatttgtttattcataaaaaataaaaaagtcatcagaagggcgagaaccacttactctgacgactatcagataaatgtcgtagagtaagtgacaaaatatatggatgatcacaggaattaaaaaaagacaaaatatgtgaacataaataataaataaataaattgaggtcaaagtcaatgaggtcgaaataccaaatcacttagaaatttgttacattctagctttcccggtcttacagattaccctagtgaacttttaagttttattttaaattgatttaaagaatttattttaatgatttctttatcaagttgattccacaattttgttaccctcccagcaaagggaatgaattttttgcccagtttatattttgagttaaatctgtaaaaggggatgttaaagcgcgttgagggattaaaaatagaaaatagtttcagatctgttcggccataagcaattttatgcgccatgaacagatcaaacagctttcgcctattctcaagtgttggcagttgcaggtattctaatcgattttggtatggaattggcggaaggctgcatttaaaaaatacccttttggtgaaatatttttgacacttttcgatttttttaatatttttttgaagagacggattccaaacctccggagcgtattccaataaaggcctaatataagttttatataacgtaatccaaatcttagacgatttggatttaattattcgaaacaaggacgcatacgtaaatacgcattccttgttatttggttaatatgatcggaaaattgtaatttgttatcaatgtttactcctaaatccctaattgtatccacagcatttattgtatttccatcaaatttatatgtttcttttgggttttttgaacccaaatataatacaaaagttttttgaattgaaacttttatttgccagttatttgcccattcgaataaattatgcaatgctttatgcataatttccgtgtcggctcttgctttataacaaantatataatttaacatcatcagcat

SEQ ID NO: 24438 - DNA, 2095 bp, Heterodera glycines
ttgtcagttgaatgctttttggttaggagcagaatgaaattttggaaatgactgatttttcactgattggacagcgcttaaatgcggtggccgacagtgcccaaatgggcggtccctgcggcagaagcagcgcggctaatgggcgggaaccgcatacatcccactcgtcccccgtccccaacacaaccccatgggcgggatgggcgggcggtgggtggcgctgtgacacgtcgcgtaaattgtccaacccccccccccccccatgaaagccgagcaaaaagaaattcgaatcaacaattagctaaagggtaggggggtaaaaactgatcgctaatagcgataacagccaaattcattggatcggattggggatgaatcacttttggatgtgcattccatcaatggtggcggttggtgctaaacgatggtcagaaatgaatgaatttgtaatgagtttttttgatgatcaaaaaaaagcaaaaataaatttgatttgaataaattattattattattttcaaataataataagcattttgtgataaatgcactttaattgagggaaatggaagaggtactgtaaaaagattgaggaaaatacagtatgatgcaaatgattgaatgaattcaataaatagactacaataattgcaaatttgtgtgactttatggctttgataatctattgggtaggtataccgtaaattattcgatcagaaatacagtaagaataattcctctgctcgtatttgaacggctttccggcattttaaaattcaatctttgtcagtgcgcttcgcagtgtgtcgcaattcaaaattttctatcggcgaaagtgcgacatttggtgtgatctttgggctttggtctcacgaatgccaactctgatgagtaattgtggatgtattttgtttcatcggtctgacaataagcaaaaccgaagatccaagcttttgtctcattctccagactttcatctcaaaaaatttgtcttttcaatttttcgattgttcgatttgagactttttcctgattcgaaaagttattgatgaatgatcagaagaatcttttttttcttaaataccgcatttcttcatgtttgcttcaggtttcaattgcgtcagattagcaactgatggatcaattaattgtacttaaaatttataattataaaactgcttaattgtttaagaaattgtcaataagatttttgccagtaattaattaatgccattttttcaattattatgatgatttgcgctatttaccaccatttataattaccacaatttgcgaatatttttgattttcattaccgtttaagatccttaagaaattgactcaataactttttttaaattcttccattattttgaattattcttctcttgaattcgattcatttaagatttgagagttataacagaataaaagttaatcattaattaagtcaaactaaatttacaaaaaataatatcgaacattgtgccggtcctccatatccatatttcaaaaattggtcataattaattttataagtttattagttgtttttttttgaaatttcgttttggcacttacttccacaatctgacaaattttctcgtatcacatcaaaaaatgtcgtaacttttgtgtggatttggaattggttgaaatagatgtcaaattcctaattaacgacccgaatattcccgtcaacaagttttcatacttatgacaaaatttttcgggggcgccatactgtgaagaacaaattattttaacaaatttgtggcagatggaatgggacaatattgaaaaggatgtcaaaaaataatactccaaacattaattacttcattaattatttataaaatcttttcgtcgctaattgaaaaaaattgcttattaattgaaaggcgttggttgatcaatgaactatgatggatgaattacgtcattttactttcgtaaaagctaccctcaaaataattaatgagtctgtctggtggtgccgatggagaaaattaggaaaatttagttactatttattaaagattccatctgaaaattgactttttgattttagaaaataattttgaaaagtgcttaa

SEQ ID NO: 24439 - DNA, 1655 bp, Heterodera glycines
  misc_feature (1496)..(1496): n is a, c, g, or t
  misc_feature (1520)..(1520): n is a, c, g, or t
  misc_feature (1583)..(1583): n is a, c, g, or t
ttttgcgtctgtttctgcccgccgatgtggtgacgacgagagcggcacttgcgaatacgacgcggaggagggtgggcatggaatggcattattgttagtcattgttttcgttttccggcattttcacggtccgaatgccaaagaagacacccggcgaacactttgcccgtttggaaatgcttaccgaactgctccgaccgcaggagccgaacgcgcaacggatggtggaggaattggacggcggagcggacgaattgggcgggggtattattaattactacgccgtttcataaaaatgaccccgtgttatacaaaaacagttaatacaatagaaattcgaacctataatttttagcttatttggtaacattcgatgcataatgaagagttggaaacaatgatttaattttatatctcaacagatagcgttattaaaagttatggccaaaaaattcgaaaattggccaaaccatcaaacttggatttctctgttaaacatttgttttttgaactttatcttgtcaatcatatcgaatttgattaactgaccaagtttcaagtcattccaaaaattacaccataagttatgcaattttggtctgaaaaagtgctaattttctttgcccatccaaatttatttaaaattcgcattttttaaacgacgagacaatttaatagcttattttaagacgcgtcatcagggctttcgatttcatttattacatcggtttttatttcattagcaatttttggaaaaaagaaaaatggatcttcttttatgatgcgaacctaaatacaaaaatgacccaattttatcctgcttttagacaatgatagcattgactgtttcgcgcaacagtctctgcccgaggatgggccaacaacttcgagcagtgcagcgacggcactgttcggctacggttttggttggcaacggcacggcgtgctgggccgtttgttggccgacattggccaaggcgagttgcccatcgaccttgaggacccggacggaacaccgatcgacgaccgattagagtgtcttcacgcgttcgacgccgaccattttcggcccgagcattacttgtgagccatgaacaaaatagggaacaaaagggaggaacgggagaaatttcgaaaatgcccttcttgggcggagtcatttctttcgggagtttcgaaaaatgccaaaatttaatcacaaaattcgaccgtcgcgcccaattcgttgcattttgtccaatttagagccgatttgcatgaatctgaccaggcccaacttgatgcgatggagtttgacccgttccaacacaaagacagcagcaatttcgcgctcagcgaccaggacagggccgacctcaaagatttgccacgacggaaattgccgcatttcgcgcgggaggccatcagacaaattgtgcgctcgttggttgacattctgttcggctttctgtacgacttcaggacaacattggtgaggagacggtggcattccatcnggtgggtcgttccccccaaaaatnattttgttttaaatagaaattcggaaaatggtttgagaaatttctaattaatttttttccggntttggacgagggtcgacccccccccaaattttttgtttgtcacaccatctcattatctatgccttcgaattg

SEQ ID NO: 24440 - DNA, 1666 bp, Heterodera glycines
  misc_feature (1654)..(1654): n is a, c, g, or t
ctcgcaacccagaggagctgcgattcagcgctggcctctctcccagttctctcgtcgttactactgaaatcctcgttagtttcttttcctccgcttactgatatgcttaagttcagcggtagttcacgtctgagttcatgccgaaaaatcatagcacgaatgccagcaatccacgaactccgccacaacatgcaaagtattggtgcgtccgacttacggaccgtaaaacgttaattataaccacaagttcgcgccagcacaccaaaaccccacagccgagctaagcaagtaacggaagaacacgtacaagtacatgatcccacgaagtaacgcacaagcagtgcattttatggtaacgaccctgaaccaggcgtgccaatggatgtaactccaatggcgcaatgtgcattcgaatgttttgtgttcaaggtttctgcagttcgcactaattatcgcagttggccgcgttcttcatcgatccacgagccgagtgatccaccgataagactagaattcattcttcaacagaagtgtaaaaaaaaataatgaaaaaaaaagaaaaagctggcggtgcccgagctgacactcattgagtcttaagccacgtgctaggccaagcacgggccctaccgcgtcgtctcatcacggccacggacgtagcagcaagcacaaacacaccgctagttacggcacgtaagaccgggaacgaaaccaccatccccagtcagtgtgttatgtgcctgccacaacaaccgctcaacgacgcacagacgccagcacagccgttaggtcgccccacgagcgtgcatcccacattggcgcagcgaaccagccaagcgaggcggcccgccaccgacacattgccacgcagcagccatacacaggctttcacacgtgcagcactgagcggtataccacagctccaacgtatggaagcaccccaaaagcatggctcgtgaggcagctgccccgtaatgttgggcagcgtccacaagtcatctcgaacgacctgtgcccatcagcggacgggggcatttggtggtgccaacgctagcccaacaggacagcaggtaggtggtgaataggaatcacttgggtaatgatccagcagcaggttcacctacagctaccttgttacgacttttgcccggttcaagccactgcgattaaatcggttccagtctgcataccgaccgaagccggaacactaaccgtccccgaatttctcgaaatggctcagtcccgggcagcgacgggcggtgtgtacaaagggcagggacgtattcagagcgagttgatgactcgcccctacaaggaattcctcgttcacggacaataattgcaatgtccgatcccaatcacggcaaattttcaccggtttaccaaccccttttcggggaaggacaagcacgctgattttgccagtgtagcgcgcgtgcagccccggacatctaagggcatcacagacctgttattgctcaatttcgtgcggctgaacaccgaaaatccctctaagaagttgtgcccacagaagcaatgagccaactatttagtaggctagagtctcgctcgttatcggaataaaccagacaaatcgctccacgaactaagaacggccatgcaccaccatccaccgaatcatgaaaaagctatncatctgtcaatc

SEQ ID NO: 24441 - DNA, 488 bp, Heterodera glycines
agtgaagaatgggatttggattatccctcccgccgctctcatcccccctttcccttctgagtttccccgggttcatcttccaaattcccttccccattctttggctttctttcccttctcttctcattgagaggaaatcattgcggaaattaagtgaagtggaggccattttcttccccaaaattgcaataccccgaatttcgaccaagtttcgttttcgtttgctttgctcagagtgaccacagatgaatgaatccccttgggggtcatccgatgcgtccgagggccttaattgctttccaaattcgccgttttttgtttgagcccctccctttgctccgcccccttggcacacctctagtcattctcaataacgcgtatctgtgtcttatcgagcgtccaagctatactgtttgaaacttcgagagtaaacgaggtagaatatggttagacaagactttcacccccatacgcaagtcccacgatcg

SEQ ID NO: 24442 - DNA, 553 bp, Heterodera glycines
gtgagagaggaagagagagaatggagggcgccttagtgagaatggagagatatagatagagagggagagagagattggagagagggagagagagagtggagagagagagagagagagagggagagagagagagggaggggaaagaagggaaaaaagagggtaagggggagagagagagagggcgagatggaaacaaagagaggtcgaattgcctaatgttggaataatttattcattcaatgggtgaataacgaagaaatgattcataattgagatgagctaaaaataaattgcaaaaggtcaaaagagaaaagcggggaaagcattgcaatggcaaaagaatcgaaatgagtgaatgaataatgaatgatacgatcagatgtccggtcattagcacggggcgagaacaaacttagaaaaatgaaaccgtcaaatttttgctttggccctccccctttttctctcttctcggcccgtaccaaaagaacgaggtaaagttaccgggtaactttacctggtaaaagctacccgcagctgcgggttctagaaccga

SEQ ID NO: 24443 - DNA, 1823 bp, Heterodera glycines
tgataaaaactcggaaattttcggaattttttttcaaaaaattagcaaattttgtacaatttttgttaataattgcattgaaattttcaaaattttcccagcggcgccgaccggcacagccgattttgataaaagtcatgaataatttatcaagcagatacatatagaaatataccaaaatatttttgaaatcacctttcatttggtttagaattttaaaatttaatctaaaaatatttttaaaaattttaccatattttatatttttcaatccgatttccgacgttttggggtcagaattccgatttccgaaaatttttgtgccctcggaatgccatcctttgtttgtaaccaaagcatcggaacccgtcagcagttgggccttcagactataacttttttctttgtcaaccaatccaacaaactagtatttacatgctctattagccttacaaaaaacaaagattttctagcatttaaaaaatttatcaaaaaaaatcaaaaaatttgattttttttgcaattttcatgtataacttttttagtaattgtctaatcgctaagcaatacattagaaagagcatcaaacatgttaagctttcgaaggatatcaacaatgttggatttggttgacaaagaaaacttcttaccttttataaatgaagttgggtgaaaattatccgtcgaattgattatttgattgatttgggtggtagggggtaaggtaaattgcacggcaaatttcatcattttgcaaatattctcctctttagtgttcgttcctcttctgttgtggcactgccattggctctattccagtttacgcgtccattgattgaccacactcaattttttaggtcataacttttttcttatatatttggtcaatccaaacattcttggtgtcattcgaaagcttgaaatctacagaagtttttctattgcaaaattttgggataaaggcaacagacaacaaattattcttgattatacgcgaaaaatgatgaatttcgagttttctaattgcattttttttcgtaatgcaagtattaactattttcttatatttacaaattccataatctttaagctttcgaatgataccaataatgtttccatgccattccctttttctgctcgccggattttagaggttcaaaaaaatggaaaagtctgccgaaatgttagaggacggagttctcaattggggacaattgaatttttggagggcgggaaggaattggacccgaaaaagtcgaccactggtaaaaagaatggcaaaacgaacccgatcttcagaaattttggtggatcgtacaaggaattaggaaaagctgggcatcgaatttcggcaaattttcgacaaattggcaatgtaaacgaaaatcgagagaaaggaggcggatggaagagaaaaaccatctattatgcgactccatcggggccaatccctaaatttgttggatcgtcgacggcggacggcaatgtgtcagctgagaacccttcctttcgggccgaatcgaggaaattttgacggcagagacgccttttttgttgggggcgggatgtgataatgacgaatatttattttagttttaaatttattggcgttttgttcttattattgtttgtgaattgttttagttcttcttttttcagactttatgtttttgaattcatgaagatatttttatgtttattatcgtctctcctcctgaattttattgtggtgtttgattttaatttggaaataaattgtgtttgtatttgcttgtgtgttataatttgattgagcagcgaatattagagcccccgactctctc

SEQ ID NO: 24444 - DNA, 2338 bp, Heterodera glycines
tcagattctgaacacgcatttttctaccctcgaaaatgtgcttcttaaatttttattgtcaaattttcgcagaaaaatgcaccattgcctatgactcttcctgacgaattttttgaaaaaaaaaacaatttacataatttttaaaaacgaatttaatgccaaaattacacacaatttgccaacacgcacacatattggttgggaataaatatccagcagatacaaaatcagggtgggggagatcgggggcatcatcatccaatttttcgttgtttttttttttgaaaattttggtcacacaaacacattaccgtgaccaattaattttttattttctattgtattaccctatatttatttaccatcattctttttttcaccatcatccgcggaattgttcttcttttccttctcttcctcctcctcatcatcatcatcattgtcatcggccatcaccagtttggacgacgacgactgcttgtcctcctcctcttcctcttgtccatgtttgccaccaccatcgtcgttgtcatgctcatgatcatcaccgtcacactcagtgccactttttggtgccgtcaccgtttctggtggcacagcaattgccgccttctgttcctgctgctgctggtccgcttcaacattagccgccaccaccgtctccacctgctgctgttgctgctttggttcctccggttcagtcgtcgtccgatcattatcatcatccttttgatcagtttgctgttgctgaacaacagctggtgctgccgattcaacaatatccgctgctgctgcttctgcttgcttttctgtagttgtagttgatgatgatggcactgtatcaacaacaacatcagcaactgtagttgatgatgacggtagaggtggtactgtagcgattgttggtgttgttggcggtagaggtactgtaacggttggtattgtgggcgtcgtcgcaacactgctgttggtggtggctggtggagctgtactgcttgaacttgacgacgcattcaacttttccaacaccgcgttcagcttcagacccttgccggcgccaccaattgatgacatgccaagtttacgtgccggactttcggtggcacgatgctgctgttgttttagttgagttgttatgccgtccgtcattgaggtgaccagcgggagtgaaactgaaaaatgttaatttcgcaaatgactcgtaattttaaaaatttatagttggattaaatttcgggaattgatccaaaagttctctcatcctctatattttttgtgttgaaaaaatcgtttttaggggtacaaaatttaaaatttttttttttgaaaaaacggtaattacaataatttttttattaagcaagttttttattggatcattcatatactgatgtttttgcataagtaaggaaaagggccatcatgcatttgacacataaaccattatatatgacgcacaacacgacgcacttgtctttgccgtctccacctttgtgagcaccgtttttgttggcgtcgtgccaacagcagaaacggcgccggtggtagacgaaccaccggcactgaccactgatgatgaagcagtagcagtagcaccagcagcagatgaatgatggtggcgcatgtttgccgctgctgacgtcacaatacttttttgctggctgtggtgttgttggtgatgctgctgaagcgatgatgatggcgccgccggcttcggcggcggtgccgtcgccatgctaccgaggcccatcatcaacgcggagctgtccatgccagccgcttggaacagttgctccaacgccgcgttcatgctggccaacgaggcagaagaggtggatgatgaggacagcgctgttggggggaaacagggggataaaatgaggaaaagggatatagaagaggtggcgaagtatcaggagggtgcacttcattcccccccccctccccgcatcgtttccccccgaaatttttttttaaaaaaaatcttagagttttttcataagaaaattccaagaaaaaaattttcgagaaatttttatggtgaattactaagatttttcggctctaatgcactttatgagtccaatcgacttttatgagtccaaaagtattttatgagtccaatcgattgacaatcctgggtttttatacaataactttgttcatgttcgaacaaaccctatctttttggtatcattcgaaagcacaaaatctacgaagctaaaatatataaaatcgcagcgttcaggcaattaccaaaaaagatttgattaattaagtaattgctgattattttcgtttgttactttcttggaatgttagaattctcttgttttct

SEQ ID NO: 24445 - DNA, 1701 bp, Heterodera glycines
ctcccttctcccaggggtattattttgtaaagtcttcttttccccaataaacttttcaaaccccatttttcgcaccgtcaatgttatttttattgaattctgaaccgttttgagtagattagactagaaaaaattgaaaattttgaaatcatgtttcccactcccttctcccaggggtattattttgtaaagtctttttttcaaaataaacttttcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactaaaaaaatatgagtgatcaaactttcactaaaaagttaagcctaaactttttcccaaagttaaaaagcaattaaaattttattcacctccattattgatagaaaaagcatcagagtgcctaaactaacatgtaaataaaatttggtgcgtttcagaaccctttctgaaaaaatatttatgaattaattttgcaaataaataaaaacgaaagactcagattttcgaaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtggtgggccttcgcccccccccccccctcccacgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattacagtacaggctatagggaagctattccggaaggattcggtctcccataaatctaggcgcatcggttcggggggactgccccgaaacaaaaa

SEQ ID NO: 24446 - DNA, 1619 bp, Heterodera glycines
tatgttgtcatttgctataattattgtgaattttttggtggttcaactccttgcctgcgtcccactgatcaacagtgatcactgatcagatgtttttctttacagcacaaatccagcctacgcataaataaaaaaaaaagtttatagagccccaaaaagttaataataatatttcttaatgagccatcatactaaaacaagcaacattgaattgaaacatggtcactaattgtttaaaaaggttctaacagcttttggaagccgccctcttcaagggcttctcaattattgtttttaattagttcggaaattaattggctaattaagcattcccatttgttaatttaatttgtttaatttacgctcttctccattagcggtggtgtacgaccacgcttttaagatgatagtgggagggagtagcaattatcgaggttggccaagtcaatgacttgaactattgctgaaaggcagcactaacgcatcagcagcagagcaagcggagtttgacaacgacatgatcgacgtctgaccaaagattttgtagagaggtcgtccggtcgaaaactttcgaaatcagaataacccaggtttaccatcggctgagctcaattttaaaagtaaaggacagactaatttgtattaacaaaaatttgcaacaaatttaatgacaattcaacaaaaaaagtgaattacaacataaaggagaagcaaaaaacttttgtttccacatctttttgcgacacacttttcattggaaaattgtcagcataccagaatggcccgccatgcgcggccccatatgttttcctggaagccgcagtacgtcaacaagaatgtcaaacaaaatgcgatgttgtcggtcttcgagagtgcagtgactaaatcatagttcataaaactttcaaaaattaacagtaaacaaaatatatacgatcataaaaaattgctcactggcgagcccgaactgtggccaaattcatgtgccaatgttaatgtggacatcagcagcgtgcttgtgttctttcgttgactagagttatgaaccccgtgttgtttcgttgacaaaccccgcggtcattgtctttaaagaaacaggcgaacttgtcctagtccaaccccatatttaagtattaatttatacatcattagggtggaaattttttttgattaattgataacaattggcacaccaaatataccagagggagcggcttgccacactcgaccccatatgttgtcaaggaggtcgcggtgagtcagcaggtaaaccaagcaaaatgtggtgctgttgctggtctgtgtgagtgcatggactaacccataggcgtccaattcctcagcacagaatggattgttgctgaacccaccaacgccaactacgcacgtgtctggtgcgtaaatctttgatggggttgaattcgaatcccgtttaaactccaaaaatacaaccccaactacaaactgtggtccgttggatggcaaaattaatgcccttaattccgtcgaagtcggtgttctcgtaaatgtcatttacgcccttgatcaattcactcatgaacattcgaatttcgctgcgcgttcaacaaaggcaacgaaagatcggaaaaccagccacc

SEQ ID NO: 24447 - DNA, 1019 bp, Heterodera glycines
atttgcatcaaccttccgtttcaatttgtacattgactttctcacagatgaacttagcccattgaaagtgacttattccgtacgtcccccgtcgggaccgtctaaattaggagcagaatttcatcataaactcaatggttaagtttttatttgatgggaaaatggctaacatttaaaatttgtgccattgacatttcgtaaattggcgtttcgtaattaccccccccccccaatttctcacctcggcaccgttgcgtcggcttttcccacccaatgtctgtgctcttacgcgccttttgggggtttcggagaaaaaatttatgaaaaaataaattttatggcgcacatttaatttcatcagtgtgtatttataatatgaaaagagaccaaatttcaatcatttccctcctccgccagcattttttgtgctccttttaaaagaggagacaacaaaaaatattttcagtcactccccgtcaaattcaaaaaaaaaaaaaattcaatttttattccgtcaaattgaattatcattttttaaattttgctaaaaatgaacgctttctgggtaattagttttatagaaaaaggaaaacaattaataattataattaatcaaatcaaatttaaattcgaaatatcattccgtttccttttggcgttcagtttcaacacgaccttggcctgatcaaccatttggtagtccaacagcagcagcaaaggatcaaaaaggagatggccgaggagcagcagcagcagcagcagcaacagtcgctgctgaacaatggccaagcgaagtgcggcgccgtggacggagccgcggcacagcacagaccgccccagcgcatcccatccgccacgtcgagcatttccagcggagggcactcggagacggaattggcacgcgcatctcccgcggcattggtgcgacgcttaaaagccatttgggggaaaacagacgaaattggagatggggagggaaattatggcgaaagaattggcattggattaatttaaaataa

SEQ ID NO: 24448 - DNA, 2325 bp, Heterodera glycines
cacctttcccatgtttttagccttccacgaagcgggacacgccatcgtcgcccatttctctgaccattcgaatcctttgcataaagtgaccatcattcccagaggcacttctctcggccatgtgagtgtttcgcgtttgatttggaaaaaaacggttcattaattgcagacatcgcaactgccggacaaggaccgtcaccaggaaacgaaagcacagcttctcgctcaattggacgtgacaatgggcggccgtgtggcggaagaattggtttttggccaggaacacatcagcacgggcgcaacttcggacttgcggcgcgccacaaaggcaaaaagggggaattggcatgaaagaaataaaagcatttcattttaaggtggcggaacgaatggtgaaattattcggaatgagtgaccgggccggacttcgcgacttcactgttggacaatcaaaagcattcccatcgcaatgttctctttaaggtggaaccgattgaatctgagcaaggcttttgtgtggaaaggggcccgagcaccagcgaaacgatcgaccgggaaattgaaaatctgttgcagcagagccacgaacgcgttaaggaactgttgacgaagcgaaaggtggggagggggacaatatgaaagggtgtttggacaacagaaacaaagagtgtacattttaaaaatggcaatttcagaaggagcatcatttgttggccgaggctctgttggagcacgaaaccctgtccaaaaatgacattgagaagttgctcaagggcgaaaaagttatgaaaccgccgccgaccccgccgaaagggcaaaagcataagggacggacattggcaatcggaaagaaggcgaaggacgagggggggcgggcgtaagtaaagaaaacgaagcgcggaaagaggaaaaatgtgaaatcgagaaataattttaaattgtttagtgctgtcgttgctttttatacatacaaataaattattttcaaatgcatctttttgtcgtttaacttttaccttttccaatttaaaaatgccattgatccctttggccattgcccccttttgccctgtcggaattgttaatttggcttgccaaagcacagagtgaatgctcaaaagcactgaatgaatgggacgaaactgcgggggtatttgaggagagatgaaaaatttatgggaaggcattgagtcaaatggcatttactgtaagccaaccaattctttttgggaattacggaaattggctaacatttgtgcccactctattaacaaaaacttcaaaaatgcgtcggggccctccggcgatgcccacagttccgacgagtgcctgcggctacgccgggggcgcatgggccattttcggtaagttcttcggatttggcccattggtttggctgacggattcggacactttccgctgccctttaggccaaatgccgggccattcgaatgtcgccactccgtccctttctgcccatcccgcgcatgcgttgttagccgcccatggcaccgcggggttcgccggcgccgccgctctgttcgccaccgtatcgacagcaccgtattgccagccgacgtcgcttttccagcggtacaatagggaaaggatcactgaactgtccacattcccttgttgtcctcctcccctcataatccgtccactttttctcccatgtcccctccccttccgaggcttatattttccgatttttttaccgctccccccgctcttcgctttctccctctctctccccttctctccctctctctccccttctctccctctctctccccttctctccctctctctccccttctctccctctctctccccttctctctccccttctctccctctctctccccttctctccctctctctccccttctctccctctctctccccttctctccctctctctccccttctctccctctctctccccttctctccctctctctcccatttctcccccttcctccgattgatgcgtttcctccactgccctatgggcgcacctgtcctccctcatttccaaattcgttcttatccagtgtcttcatttattcattctctccaccagccccacgcttttggccgataattggcggggtcgacgtcccccccccccccctccccccctgggggcgttctcttcggcccattaggcgattaatccgtggacattgggggacagattcggtcaaattgacaatgtgcctgtgagcggcacatccggaagaacagctgggggaagggcaccgattgaaggggggggggggggaaggtgggaaaatgtttttatgaaagagacttgacgga

SEQ ID NO: 24449 - DNA, 567 bp, Heterodera glycines
tgaccaaaaatgttaaaaaaggttttttgagtttctcaggtcataacttttttggaacttgatgatttttttttgaaattttgcatgataatagaaaacacttatggctaccgaatgatatcaaggttttaaaattttcttcattttgggcgaattcacacaaataaacaatgttaaattaccgtatcatccaattaccgcactatctcattttccaaaaatactactgcatagcagtgacgcatttttttcattggagctttttccacattttccaccgatgcatttccgggcacgcacccactcacgccttcttcttcttcgctggttatgggcctgctgcccatgccccaccccaattaaacgacgactaattaggcacccaattaataataatttagcccctcgcgcagaaagaaaaatgggaaaaaattggacaaaataataaaaaccgatgcggaagaggagaagccgaagaagcaaaaggacaaaaataatgggaggaaaaggaaggaaaaaaaggagaaatcggagatgggaaaaatgggaaaatttatgtgagtgaat

SEQ ID NO: 24450 - DNA, 1038 bp, Heterodera glycines
  misc_feature (65)..(65): n is a, c, g, or t
  misc_feature (83)..(84): n is a, c, g, or t
taaaagcaatgcttccaagtgtcccggttctttcagatttgtcctgatttagaaaggggcaattntagaaattcagattttcnncaaaaatatttcacgggaaaattttttaatcagtttttagcaccaccaggtaaaaagtaccaaaaaaaacggaattttttttcgcattttgccaggacacagactttggcttcaccaccttcgttggtgggcctggcattttgggaggtggcgaatgcaatatgaaaaacgggaaattgaagtacatgttcaagttggctgacggtgtgacgattaaaaatgccattcttgacacgccgggcatgggcattttctgcagaggcacttgcacgctggagaacatttagtaaaaattttttttaattttcaatcatcctattaaaaggcatagctagctatacatcttctttcagtgggaggcggggcctttggcaaatttgttgatagatttgcacataaactgctgaattgtggctttttggaaaaattagtgaaattttctattgagaaatttggatggggggggataaggtaggggttaattccgtcccgccagttccgtcccaggcatgtttaaaacagcataacttttttcagttggccaaatgttataaatttggcttcattcgaaagctctacatgtttagaagctgttaataaactaatttctaagcgattgaacaatttattaaaaagttgcaccatgaaaactgcaaaaaagtccgaatttttgcatgtttttatttataactttttacattccggtctttcttttgggaaatttgggtgaggggggggggtcttggacgggtatcaaaatgaaaacagaaattcagcaaaaaaatatttattatatatatactttttgtttttatctaaatgtaacactgttgaaaaattggcacgattttttcccacccatatccaaattaatggttccgcgaaagtggcattttttctttaattaaattttaattcattttaaatttaaaaaagttattttcatttttgtat

SEQ ID NO: 24451 - DNA, 1345 bp, Heterodera glycines
tttcaaattttgttgggctcgggctggcgcttcgcgcccattttttaaatttgtttgggccagacgggcgcttcgcgcccgttttttaaatttgtttgggccagatgggcgcttcgcgcccgttttttaaatttgtttgggccagtcgggcgcttcacgcccgtttttcaaattttgttgggcttgggcgggcgcttcgcgaccgttttttaaatttgtttgggccagacgggcgcttcacgcccgtttttcaaattttgttgggcttgggcgggcgcttcgcgaccgttttttaaatttgtttgggccagacgggcgcttcgcgcccgttttttaaatttagttggggccagacgggcgcttcacgcccgtttttcaaatttagttggggccagacgggcgcttcacgcccgtttttcaaattttgttggggccagacgggcgcttcgcgcccgtttttcaaattttgttgggcttggacggacgcttcacgcccgtttttcaaattttgttggggccagacgggcgcttcgcgcccgtttttaaattttgttgggctaggacggactcttcgcgaccgtttttaaaatttgtttgggccagacgggcgcttcgcgcccgttttttaatttaatgatttttaggccgcacgcggcctcgtacgggcgcatcgcgcccgttttttaaatttagttggggccagacgggcgcttcgcgcccgtttgatcgttttttaaatttgtttggccagacgggcgcttcgcgcccgttttttaggggtacaacagtgattagaagaggtacaacagtgattcattaaattaaaatgaaaattttttttaacaaatttaattaaaaaaatacatgaaattctatcaattaaaaaaataattaatttaaacttataaaatttatttatcaaaaaaaaattaaatataatttttatttattaactcaacaaaatattttaaatttattaaaataattgaaaataacgtaaaaatgcacagaaaaataatgttacaccgtccggatccgaacctgccccctcccccctcaaaatgatgcctcagaatccccaatcacacagggattctgaggtcttgacgatgtcaaaagtaaaatctgatcacgtattcgtgatcagcgtcataaaatagccctaatgacatgtttttggaagatttttggtgaaaaaattttccacccaaaaatcctggtcacccccctttggtcccgaatcccaaaatcacttttatttttataacaattcgcaaaaaagtgataaaaatgccaaataaaatttatataatagagcaaaaaactgcggatttttgtagtattt

SEQ ID NO: 24452 - DNA, 1495 bp, Heterodera glycines
ctgaaatgagcgccgagctagctggctcaaaaaaaaattttcgaaaatctgagtctttcggtttaatttatttgcaaaattaattcataaatattttttcagaaagggttctgaaacgcaccaaattttatttacatgttagtttaggcactctgatgctttttctatcaataatggaggtgaataaaattttaattgctttttaactttgggaaaaagtttaggcttaactttttagtgaaagtttgatcactcatatttttttagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaatttttgttgaaatatttgtcgtgctctgaagggcgtgggagggggggggggcgagagaggccccacccagagccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctaaacgttaattctgcgttggatttttgctcccccataattgt

SEQ ID NO: 24453 - DNA, 925 bp, Heterodera glycines
aaatttaaaaattctttttagaggcctggacaataatttacttccttaattataggcttggactaaactttcttgaaaaaaatgccgccttatcttcggttttttggtatttttagaaaaaataaacaattaaatattttttccaaatttacacattttttttgcctaccattttccactggttcgtctcgtgcattttcaactgccacaaccgctctccccagcattgtcatgtctcggcggagctcattttgatttttctgctgctgctcttgcttttcacccgccatttcaattgaaaaatttcgttttgtttttgttgtattttttctgaaaattttcattttaaaccatatttttttattatttgtacaatttattagataattaatatttaataagcaattttttatcttaaaaagtccaaaaagctattgctaattgagttgttctgtgaagtaattagccaattatgtactgtaaatttgctgctgaaaaagataaggtagcgtaagtaaatcattacggtaatttttagcaaattttgaattgtgcacagaagcaaagaatgaatgacacaccaagtttttattagcattaaataggattcgtaatttgcccaattgagagccaaaatccgaacagattcgcataacggaggatcagacaacgggcgaatgactgtgaatttgaattccaaattccacaattattctaattttcaccttcaaatggcaaaaaaccgctttttctgattgggttgttgcgtgaaataaatagctatactttactaattaattggttgctgaaaatgattttgagaaatggtacggtagcgtatgtaaatcattacggtaattttgagtcaaattttgaattgagaaaaagaagcaaatgacacaccaagcacttttattagaattaa

SEQ ID NO: 24454 - DNA, 1300 bp, Heterodera glycines
  misc_feature (18)..(19): n is a, c, g, or t
  misc_feature (70)..(71): n is a, c, g, or t
  misc_feature (1293)..(1293): n is a, c, g, or t
catgaagaaatgcgcaanngatggaaaatttgggcagaaaagatgcttctcgcctacaggacaccccgannattcggcactcaacggactttcgcccgatcaattgttcttcggtcgaaggcttcgaactcagctgtctctcgtccatccgaaggaagaacaagccgaagtcatcgacccagccaaaatccgcaaatcacaagctgattatgcgcgaaaaatggcccgtcaatttgatcaacaccacggatcaaaatcggttgagtttttgccaaaggatcccgttctacttttgaacttcaaccgtggaaaacgattttggctaaatggaacgatcatcgaaagattggaaaagtccccgacgtatcgtgtccacgtcccggctctcggaagaaacgtccaccggcacgcaaaccaactgcgacgccgttatcctcttgaggaggacggtaatgatacgataaggatcccaccccaggctcaagaagagcaagaccgggacccatcgccgatccgcgagcctcctccgcaaccgccaccaattcgacggactcaggcaaagcgacgatctccgagtcctcctttggccccgcgtcgatcgcaacgccaacggaaagcgccgatccgcttctcgccaaacccctgagggttcagcttaaagaagggaggtgttggagtgttaaagaatttgaatttggcgcccatcgattattgattaatgttgtgacgtgtcaatccctccccttattcattttgtttatttaagcactccctccttccccacttggttccttctccattcattttgctattttacattttgtactgcatttgacctccgacataaattgtgtttattattttattgtgtgtccaaagttgagacacaacaatggtaaatcctcgacgctttcgcgaaagttgtgaaaacaccatatcctcggttgttgctttgctggtagattgtgccgagctaacggcatttgcattttcgtcgatgtcactgtcaccaatgaggtcgcatccgccacagatgacttttgatccgtatccttcaccatcgcttgagagtgagcatggtggaatggcgtgacaagacctggagcattttcgacatcggtgagcaccagacgtgggtttgttgtaaaagcaacagaccttaataaacattattcgagagcaaatgaataataaaaggatgctttactaatttgtcggcgtcgccacatttatttgatgggtccattttataaagaaatttatttaaataaatttgtatacctaggtaaatanattttat

SEQ ID NO: 24455 - DNA, 1453 bp, Heterodera glycines
tttttcagatcctaatccacaacaggcaaaggctgggggatcgcaattcgttccgagtaagagcaacaaccgcaacaactcggtccgggcaaagagcaatgtttttgtgttccatccaaatgcatttctgtccccattttcagtaaaagattcaaagtatcagacgcttgccggtttggatgcgaacatctttgtcaagaatgcaccaccagcagcagcgccaaaaccgcagcagtcaaaggcaccgcaacaactcggtaatgggcaagagaaaccgttcaaattttaaccaaattcatgtctgtgttcccctctttttcagtaaaagattcaaagtatcagacgcttgccggtttggatgcgaacatctttgtgaagaatgcaccagcaacaccagcgaaggcggcaccgcaagccccgggtaagagcaatggttttttgtgtttcatctccaaatgacatttctatcctccccttttcagtaaaagattccaagtatcagacgcttgccggcttggacataacatctttgtgaagaaatagttgccgaagtgcgtatatgatgagaatggatgattgaccgatgtatatatttatatatgtcatatgatgtatttctctctgtttttggttgtatattcgctgttgtacagtactatatatatacatatgtgttcctaactcataaatattattctcaagtgtacaatgtgcatttttgtttattaaacacggtaattggtaaacagacaaaaagtgatgtacctatctaatcatattccttaaattttcgaattccgatttgcaagccacaaaattttcgaaaattgattacctacttgcaaaatgcaaataagtagttcgttgattctacacagcgagtcaattttgggctcccagtgcaaatagaaattaacacacaacataaggaggactcgaacctgagaccccctttttggtgactaactcacagaccacttagacgaaaaatccaacttaatcagggttcgcagatctgaggctttagcctcattttgtggttttttgataggtcaatgaggctaaattttcaaaatgaggctttgaggctttttgtggttttttgagaaattttggtaatagtatggtttacaggtcccacaaaaaaaagaggcaaaaagggggttttatgcaattcttcaaagtcctttagggttctcgagggcgctgatcacgaatataatattcattccgaccaatttcgaaccccgaacccgaattcgaacaatttttttgttgcttgttttgacttaaaatcaacgtcaatattgaaaatttaaatatgaagaacaaagcaatgtctggcacccaacgcaatttgctgccgggttatatggacgaatacatgtggcgccaatttaatggcaaacaaagaagagcggcctatgaaaacattttgaacaaattgctcaat

SEQ ID NO: 24456 - DNA, 2366 bp, Heterodera glycines
ctctcattttcctcactctctcgcctccccccgcctttccacccgccccccccttctctctctcgctctgtcctttttccgtctgtttaattcgtttctctccctccccttccccctctttcccccattatgttgatccaatctcggattctcattttatggtagtgcgcggaccttttctgatggattaggtaaattctctcaaatggacacttttcttcctttcgtcgcccattgcctttttctctgtctaattgcccccccccactttttttggctggtgggttttatccaattatttttatgtctccaaaaaaccaatgccttttctgactcattaatccctccctccatgggccattccttcacggcgttatctttcaaaggatttctcttaatttcttttttctctctttcttctctctttctctctctcttaatggacaagcaactgaggaggagaagcaattcattggggaattcggcataaattttcggcttttgggaagattttttggaaaagcgggcggggaaaaagggggagggaaagacgcaaaagagaagtggaagagatggagtgaatgaagatgggaaaagggaaaaacaagaaagagagatactgggagataagagagagagagaggaaagaaggggaagaagagcgaggggtgagagagaaatagacaggaagagagaaagagagggggcggaggggggaaagaaaaatgccacgggaaatccctcgggcaaatcgccgcggtccgctttttctctgtgcgctttccgtctttgaattttgagttgtttctgtttgtccatttttagcttcttgcaagtccaaattagcctccaaactgtccctccataattcgcttcccaatttgcccctcccattgtcgtcagaagaggcatttcttggcccaatttgtctgtcttcctaattagggccttcccccaatgacccaataatttaagctcccccctccctctgcttgtcaaacgcacattcttccaagtcaagcccatatcggacttaaattcgatattttatttatttaaattttattttggtgacatttttaataacaaaaaaggcagaattttttcatttacatatctaaaatatttttaattaattttaattagtttctaattatttggtgcctttttctgatattatcaatggacaacgaaaaaagccgagaaaaagctgccgttgtaattccgcacaacagccgcaacagtttcacaaaaaaagtgagtgcgcctgagggttcagcggacagcggaatcggcggcttttcgtcgggagagaatagcggaggaagtggacctaatgagggtaattatcatcgcttatggatcaaggaggattttgaagaacaattgggtaaagagacccatcggcaaatcgaaacgacggcatccgatcattggcccaaggagaggggagagactgatcagacacaaagagtagacagaatcgagactagtcagaaaggaaggggaccgacagtcgagactttccaaggagaaagggcagagactgatcagacacaaagaggaaagaaggtcgagagtgatcaagcacgaagaggacatggaatcgatactgaccatagaggaatgggacagagagtcgagactgatcaagacgagagggccgagattgatcaaggcgagaggcccgagattgatcaaggaaagagggcagaaactgatcaagacgagagggccgggactgatcagaggttagagacagagccactaaaagagacaaaggaccgctcttcgcattcgacttccaaattttctttcaacaacttcgtcggatgtgcacatgctcggctttttgcccccaatgaccaattgcccctcgccggaggggtcagtttcaatttccgtttggaagggccgaagtgtacaaatctgagcatcctaaggcaaacattccttcgacggcgtattcccacaggacacaaaaccgtggagaacccgcggaaaggcaaaaacattcccttggcatcgaattgacatcactttacttcttcttccccttcttccaattgactcacttttggaattgattgatttagtttccagcagaagcaaaactaaaaggagcagaagaggcgaaagggctattaaaaggaggcaaaagcaaaggcaaaggaggaaaagcggggaaaagggggggagagagggcggcaagagtctcgagaatgtgttgatgcttttgtgcttttggtcacccccccccccctctcattggcttcttttggaattcattcccttccttttttaccaattaaatttgttgagtattgaattcctcgaccatttcaatcaaactctttttttattat

SEQ ID NO: 24457 - DNA, 2179 bp, Heterodera glycines
tttttaaaaattaattagatgatcatttttatggcatttgtcgtttttctaagaattttttacaaaaaaaatcaacatatcgggtttttaaatattcttatttatcaatttttgaggatttttgtaatttatttcattgccaaaaaaacggaatcacattttttcgtacatatttttaatttatttttaacagcttttcaggttttgagaatttattgatttctatgaagaatttaattttttttttataataatcctcttaaatcaatttttcaaaaattgaatatcgaaaattaatttaaaataaccaaaatattattctaacaataagactaaaaaagccgaaaatttagaatagtaaatcgaccattctcatcacaataaaagtggttttaaagtgatttgagcgttgacagctcagaattttccccgggattgcgggatttatacctgcgggatcccgtcccgcagaaattttgagttccaatcccgtagcaagacccacaaatttgaaatttcccggttttacagtggggcgccggtgccaaccaaagacgggccacagcaacagaagaagctgaagacgaaagcggaagaggaggaggagaagaaagagtgacaatgaaaagagggggcgagtgttgatgaaaaatgaaccgatcaaatgcgggggaaaggacggacaattaacaaaaaaaataattttcttaccattattattttaaataaaatttttgattaaaaattgtgtttaatccaagtttgtccttattttaaggggccgatttttaaattcaaaaaagctaaaaaatttgttaagaatttattcttttttggccaaatattataaaaacatttttttgaatttctgattaagagctttcaggtcggtcaataaaattttttgcttaatttggtcgctcatgcaaacaaattaggatgataattgaaattttgcataattatgaatattttttatataaatcattaattttgaacaatatgaaagaaatagttcaatatttatgctttaatcgaatgtacaaggcagaaaataattcataataatgggcaattaaattataagcgataaataatattcattaagagaataaaacaaacgaccgaaaatttttgttagaaataaaatttattttgatcgtataattttgaaaggttcaaaaattttttgtaaattttattcacaaagctttttcatcattttcttcataaaagaatctctcaaatatttttattaattaaatattgtttttaccaaaggctatttggattataaattgatgcaaaaatttaaatatacattttataaatttcattggtttccaaaattaccgttgattcaaaatttaaattataaatgaaaagaattttaaaaaatctttaaaacaatttcaaatcaatatttattatgcttcacaaattttgaataacataaaacacaacaaatatataaagaatttaaaaaaaagagtggaaaaacttcattaaatttaagtattatttaaatattttgtatttaaatataagaaaaaaaaattagtttggaaatgttgattgccgaatgacgcgcataattataagtaaacagcaagagaaaagccagaaattttcatctttcaatttgtgtatagataaccaaaatttgagtatgaatggcttaaattaattttccaaaaattgtaattgtgatttacattttgataaataataagttttaacttttccatttttggtgatgttgcgaattcgaaaatgctacccatctcaacgccggcggacacattgttggccatctcttcttcggacaccaattggaccactccgccctcacactgaatcagactaagatagtcgcacaagaagcgcagataatctataaaaatgatagcaaaattatttataaattgggttttggtcacaaaaaaaaggattttaaattcacaaatcagtccacatttttatacccgaatttgaagccaaaatggcatagactaagtcccgatcattaacaagtgcaaaaaaaaaagtttcacaattcttaggcattccgacattttttatcggagaagcttgaatctgaaatccttgtccaaaaattatcaaaaagaccattttttgcgtaaatcagttcgtgaatgaagaaaaaggtggactctag

SEQ ID NO: 24458 - DNA, 1508 bp, Heterodera glycines
ttgtccgtcaactcatagcaccgtgcgaagccgcccttgccgagaaaaatgcctttggtgtaagtccgttttgtgacgttattctgtacgatgaaaggcacttccttcagcacaggctttgtccgcttttgtgttgacatgaagcaaataattttcaactacaaaaaaaggaatttaaagcaggtaaaacaaaaaggatggataacaaatttagtcaacaattaataacataacgagttaagccaaataaaatacaaatcgtcattagaaagtacagatccgacccctaatttagtcaagaaatcagtcgctggaaaggaatttgctcaacgatcgtacaatccataatttaaatttaaattcaaaaatttcataaatttttcgtttcaaaattaattcattcaaaattgttgtgattggttcttcccatcctcataacttttcctattgttccttcgcccttctccacaactcttcacttatcactcaaccaaagtaatgtgcttaaaaagtaataacaattcagaggatattctgtatataattatctttttggttctttattaaattattaaaaaccacattaaaaataatcgaaattaaaaacgttaaataagtaaataatgaaaaagaaatcatttgggcgttcatttaagcgccgttcttcaggggcgtgatgagccggtgccgcgctttcgctgttcctccgcagaataacagtactgttgtgtttgttatacatattcattgtttgataggttaaaatgagctaactgaccaactcgcactcctgcttagtgcggggagaacgccaaaggttgaagtcgagttcaggacaataggggaaaatgtaaggctaaacggacggaagggtgaatgaatggaagggacggcacggggaatggcattttttgggcgggcgaggggttgactgacctcgcattggtcagtgttgctgaatctgttcaccttgggatggaagtgcattagccaatggcacttcttaagtgcaatgccttacccttctgaaccaccggtgcactttctgtgccgagtcgcgcgtgttcaccgtaatgtttgggcagccgttgacaattaaatcgtgccaaagaacaaatggcattgggtcgcagccgcgggcaggcgacccgattggacacgcacaaagctttgaatgaactgactttggcacgctttgaccaatgccttttacctggcatccgttgcgttccgttaccacggcacagtcgagccctgaacaatttgacaatcactcgtaagactttgagttgaaaagtcttggatggacttgcccgtgcaaagcattggcggacagttttccacaatgagacggcctaagtccgcgatgatttggtcctgtcctaaggttgagaggtggggggggggggtgaaaatcatttaaattactttgggcatccgacgaatggcaaatgaaaagagcgaaaaggacggaagagaaatataataaaaaattcatcgtttttttc

SEQ ID NO: 24459 - DNA, 1182 bp, Heterodera glycines
  misc_feature (110)..(110): n is a, c, g, or t
agtagtgatttttgtactcaatgtatggcgctcagtcggccatatcgaaaagtgactgtccaccaacgcattgaaccgttggctgagccgtgcgatcagaaggcgagttngggcagggcgaaagaactcaaaaacatcgaaccaaatgtcgttgcaaataaaactaaatataaatttctaaaaacgacacattctgtcggattctttaactgttagagggaaagggttgcgaaataatatccaaattttcatatttttcaaatgaattttatgtgtgcatttgagatttggataggatcaaatgttctcccattttcaattacaattgctggattatcctagtgaatcactaattgctttgaatttcattttctgatcaatcatttaaaattgatcggcgataaacaaatccagtgataaagtgattccattaaaacatttgcttatcaaagttttgaccccccggcggtgattaatgctttacaaattggtcaatgatcttacctttgtctttgtgtcaagctcaatgtcttttcaatcactgatctgatactttcctttagggttgcaaccctgaccccgccccgaccccgaaccccgacatttttggccatttttcggggttatccccgacccgaaccctgacgcttccaaccccgacaaccccgaccccgacacttttaattaaaaaagaaatgacgccataagcacaacaaaaaatggcttttgcccttctgttgttgggcaagccttcgccgttttgccttggcactattaattcttttccccttttcacccgaggcgattaattctctccccgccctccgacatttcccccgaggcgttcctccgattcagtaaaaatgacataataatggatacttttaatggatgggaggaaaattggagataatggtgaagaaaagaacggacgattggcaagggaatgacaccaaaaaatgaaacaaaaatttgtgttattttggcggacaggggccgactgaacgcaaacagtaatttttcaagccaattaaattgaaaattttcaaattttatggaatgttttttcaaaattttcctcatttcggccacctcaaaattcgtactttactctcatttaactagtttttttttattgttgtttattgtacatatttctctatttttgtgcataaaacttaa

SEQ ID NO: 24460 - DNA, 2457 bp, Heterodera glycines
  misc_feature (56)..(58): n is a, c, g, or t
  misc_feature (118)..(118): n is a, c, g, or t
gtgtaagatgatgccaaacaaagtgctcacggtggtgcaataagcgacaccacaannnggaagaaggcatctctcaaatcacgtgaccgtgcccttttcgttcgtcgtgacggcatcncattatgctgatcagataaagctgacgtttgatcagaggagacattttgtccactagcgaacaaagtcggtggtaatcgctcatctaaaagggttaaatgcttcattatataattaataaccatttttaattaacaataccggtgatgaattctcggaatattttcaacgcggcaatgcaatgtttgacaaatgttccaattgctgtttgattttcagggctcacaatttttaatttcgtcaattttcgaaatccttcttcgtatgtttgggggttcactttcacatttctcgccgctgttacaatggcattgcccgccgaactttccagcgcttcccaaatgttttggccctttttcaattgttggcaaaaattgcgctgatttgcttcaaattccccaattatttctgctaattcatcccttttcatggcatcctttttagctttgattgtaatacaacacaatgtgtcaaatgctttttctaaaaattttccatttttcatttgtgtttgagttccagcaaaaaatgccggtgccatttcttgcaaccggtggaccgttgcaaaaaagtctgaaaatgctaatgtttgatttgaaattttgaaaatttatattcaaacctttttgacactcgcccattaaaattttttgttcagtcgtaaaatccatcataattataaaaaggaatgaaaacatcaattttaacattgctgaagtcgctttcatttgaaaaatttaataacaaatattagtaataattttctgccttaattaggctgaagaagaaaatgccaacaaaaaatcaatgatttgcataagaattttccagaaagccacgaaaagataaaaaatcatttattaaaaaataataaatttataacaaatgtaatgcttgcggtctctagttttagaattaattatatttttccttgacgcaccttggtcaaaaagtacaaaaaattggtttatttaaattgtaattatgtctattttatatgaatggaagccctatttttttgttaacttatttcggcctaaaaatttttatgggttgcgaatttttcaaaaattcaaaccaattttcagaaatttttgtctatattttcgtactttttgtcaatacttaagcgtttttgttttgatttcgtcggtgtactctcaaaggacccacagacaagggacccacaaagacagaggacccacggacaaaggacccacagacaagggacccacaaagacagaggacccacggacaaaggacccccaaaaatataattaattaaaatgtattaaaagatttaaaataagctgtgagagaaatgccagttactaaatttattcaaattggactgagaaaaatgctatatgacaaaaaatcactaatcttaatgagaaaaatgttacatgaccaaatgctatatgatcaaaaatcactattcctattaatgagaaaattctatatgaccaaaaaccactaatcttaactaattagaattaaattttgccaatggatttgcccgaatagcctgaaatacaataagtgctataaaagctgaactaaatttacaaaattcattaaatataatggctacgtttttccttcacaaatgggcggctacaaactcgttttcgaaggccatatgtaccaaaaaaagaagcacgaagggaattaatttattggcgctgtgaccaaaacaaaacaatgaactgcaccgcgacagcaaaaactatcgggatgagagctggagttgaagtccaactaggaaagccgcacaatcatgacccttctccaacacgatgtgaagccgctaagatcaacagaagcgtccgcaacacagcattgtcatcacgtggaaatatgccacgcacagttgtgaatgaatgcctcgctggtgcgtcaaatgaagttattgcaagccttcccctaattctgtcaatggaaaaagctgttagtagagtccgtcatgcagccgggggtcaatttcaaataccaaaaacactcgcagatatcgagataccagcggtacaatctatttccgaccaaacttatttttataataggatttacgggtcaccgatcgtggggaaaattttttgatttacgaaagcgaacgtgaagatcctcatcgcatgatcatctttggcactcaaattgactgtacacgtttgtctcaatgtacaacttggtcagctgacggcactttccgttcggctccttcgatgttttttcaattgtgggttattcatggcttgtacagaagccgtgttctttccgtttattttttgccttctgcctgataagcaacaaacacttatctgaatgctttgcgggtgattt

SEQ ID NO: 24461 - DNA, 2129 bp, Heterodera glycines
ggcacatttgagggatggcacatttgagggaatggcacatttgagggaatggcacattttgtgtgattggcacattttgagggaatggcacatttgagggaatggcacatttgagggaatggcacatttgagggaatggcacatttgagggaatggcacattttgtgtgattggcacattttgagggaaggcacatttgagggaatggcacatttgagggaatggcacatttgagggaatggcacattttgtgtgattggcacattttgagggaatggcacatttgagggaatggcacatttgagggaatggcacatttgagggaatggcacctttgagggaatggcacatttgagggaatggcacatttgagggaatggcacattttgtgtgattggcacattttgagggaaggcacatttgagggaatggcacatttgagggaatggcacctttgagggaatggcacattttgtgtgattggcacattttgagggaaggcacatttgagggaatggcacatttgagggaatggcacctttgagggaatggcacatttgaggtaatggcacattttgtgtgattggcacattttgagggaaggcacatttgagggaatggcacatttgagggaatggcacattttgtgtgattggcacattttgagggaaggcacatttgagggaatggcacatttgagggaatggcacatttgagggaatggcacattttgtgtgattggcacattttgagggaaggcacatttgagggaatggcacatttgagggaatggcacatttgagggaatggcacattttgtgtgattggcacattttgagggaatggcacatttgagggaatggcacatttgagggaatggcacattttgagggaatggcacattttttcacttccaattccctgccgtttaatctctttttcccctttttcacctccaaaaggtgtgccatgcttcccgacccgtttctctgtaaatttagcgatgaaattgctgcgagatcgctgagaaccgacggcgaatcggacgagaattttcgactgtttgacgcatttgccaaattaattacatttttctgctctttttgttgcatttctcgcggcgtcgtcggggcggacactgcgaaaattgggaaaatgccaaaataaatgtgcgaaagttcggcacaattttttttcaccaattaaataatttttggtgttttaactcccagcttttaattgaagtccatgtgaaaatcgcaaatttacctttgcttttgcgttcttttctcttaccggtggacactttttggggtgtcggcgtaagcgccgccgtcgccacgggcactgacaattctctttcattggtggcccttttctgcggctgtcttctgccaattagacattccgactgtttgctggtcaaatcatttgtcctatacgtcgaatggctttttccttccttcgtccgttcattctctccgttctgtccaattagttttttggtgtcattggccggcggaaggaaggcattgccattggacgggggagttgcgaatgtgccaatgccaggggtcgtggcggtcagcgaagagacggcgcggcacaatttggccgaattgacagcggagttgtcggtctccagctattgctgttggcgcggagcggggggcagaccgccagggacctgccattgccgggtgagtgccattcgcgatgatcgcccgccgaagcgatattaatgataagaaaaccgcgagacagggattgcaacaatgaagagaaatgtttcgcgcagttctgttcaacgcaaaatggtaagatgaaaataattataattataataataacactaaaaataacaataataatataatagagataaataataaatacaataataaccagggcttcttctttttttatgtaaatacatgtttttttcctggattctccatagcctaattagtaggaaaaacactttcttttttgtgtttgcgaacaaaaattgcgacttttatttacatattttgagatttttctacatattacatatgtacatatttttatacatatgtaggactttttgcatatttgcgtacatattttgcattttttgagaattttta

SEQ ID NO: 24462 - DNA, 1368 bp, Heterodera glycines
catttttggtttaaaaacggcgtaaatgatctcttaatgaagggttggtggcttttagttagtttctgtgtatttaaaccggttttgaaccaaaaatgctgatttcgaaaatttgaaccttcgactttttgttcgaattcgggtccgggtttcggaattctgaatgatgttcttatagaattttacttttatactcggggacccgacaaggaactatgattagatcaggatctcgtgggaagccctagggtaatcattgaatttaaatattattaatctgacggtatccttcccgggatgcccccctgatcagtcgtaattttgttcgaatcaatgataggaatgtcatcgatttgtgccatcggcttaaggcacatgatcgaagatctcgaccgagttgaatttgggacattcctatcgccagctttcgattcggacttttaacttttgatttttgccacacttacaatcacttgtgccggactcatgtagggcagctgtgcgtttgttggcacaacaatttttttgacaatgaatgtgatgttgccacggagttcggtctcttgaaaaattggcccaccaatttttttgagtgccaaaaaatgttcggccgttaaaatgccgtcaaaatcaatttgcgaagtaatcacgtcatagtcatggttgcctttacaaaattttaatgcagtgatcagacggcccaaaatgttggcaattattttggccggcacttttccattaaaatgatccaaaatggcatgccaatagcgcgggaacggcacataattatcagtctttacaaaacattagtgtataattgttagagcccggatttttaggtttttacctattttttttgcggcttagttatgatgagagaaggccaaaaatagcattttctccgaacaattttcgatttagagcgactttttagcacctaaaaacacctattttggcgttttgccacctaaaatagtttacaacctattttggcatttttcgaatttttagcaactatatttcttaatttattcaaatgccgaaaataacaaaaagtatgcgccggtgacttcttgtgacgttgaaggcagtttttcaatttacaaaacaattttatcagaaaaaaaaccagttttacccccgaacacctcgaaatgtatttatttgcaattgttctggcgaaatgaataaagaatgagacttaaataggattttttgcataaatacacttggtttttcctatttttaacacctattttcgcacctattttggccttttttcgggtttttggcacctattttgcacttttttggcaccttttttagcacctattttggaatttttagcacctaaaaatcctagctcta

SEQ ID NO: 24463 - DNA, 1735 bp, Heterodera glycines
  misc_feature (1607)..(1607): n is a, c, g, or t
  misc_feature (1617)..(1617): n is a, c, g, or t
  misc_feature (1714)..(1714): n is a, c, g, or t
ggcaaagaaatcatttaaatttcaaatgagagaaaaaatggccgaattttaaggtaaaaatgacaaatcgacaacacgcttataacatgcgccaattgccatctcttgaaatttgattatttttaattatgccaaaattttcaatcgtctttctgatggttccgattttaaatttaaattattgggcggagattgcgtttaaataagcaaatggtttcaattttatgaccattgtcttcgaagcggtgccgaccagggacgggcgaaacttcgagcttcgtgcttcgagcttcgaaaacttcgggttttttgggcttcgaacttcgtgcttcgagcttcgtgaaaatgctcgaagtttcgggaaaaatgcacccctaaagattgagttttcgaagtaaaaatactcccctaattattgatcttaatgtgagtaatggtgatgatgtttatgaattttataaattaaatatttcttcaatattacctattttatattctacatattgtatatctctttttaaatgatttttaacacattttacatttttagcttgaaaatgccaccacaaagcaaatatattaaatattttaaaatttattgtgacagatttgagaaaaaatttagcaggagaaacgttgaaagaactcctttttcttcaacagaatttgcctctttatggatttaaattcgaaatttaattgagttttactatctggataaattttttggattaaaaaattgaaaaacttcgtgcttcgagcttcgaaagcttcgaaacttcgcggtttttgggcttcgaacttcgaacttcgtgcttcgaaaaaaattgggcttcgccttcggcttcggtttcgagtgccgagccgagcttcgcccgtccctgttcccgattctctctcaccttttccatcaaattcttcactctaagccatttatgtagagtaacggcgaccgtttgaattttttgaaattttgcaggataacaagaaaacacttagggctatcgaataatatcaagattataaaaattgatttattttgctctaagttatgaataattttctttcaaaaattttttattttgatagttttttgagtaacgcccattttgatgggttttgagcaacgacccggcacatttccgctcagtgctttctgttccagttgggctgcggagcggcgccctcgcggagacgcgaaaaaatttgtgccatttgttggttgttagaaatgtgccggttgcaaaaaagtttgtttgaagcgaacgattttaaaaaatcctgggtaatgatggcagcaatcagattgttccctcgtgtggcaatcaaaaatttggcctaagagaaattgaccacgattcttgcaattacgaaaagtctcaaacttttattcagtcaagactagagagaccgagagcactatctgctacaaatataaaataattatacaaatataacataattcatggaaatatatgtatataaaatccatattaatcaattcatgcacatgcatgcaaaattttatgccatattaatgttatagcatctaaaaattttctatactcattacgaggtatggcaaagaatttcgtaattttccttanaatttatatnatttgtgtatgtattcaatgctgtaaattgtggccaaaacaaattgattctttgactatcgccaagttttccagaaatagtcaaattttggaggtanataatttcatgcatttaatac

SEQ ID NO: 24464 - DNA, 1433 bp, Heterodera glycines
  misc_feature (8)..(8): n is a, c, g, or t
  misc_feature (32)..(32): n is a, c, g, or t
  misc_feature (63)..(64): n is a, c, g, or t
gtttttcntgggaaaattcgtttaaaaattcnttaaaattcaaaaaacccggaaaaccgtttnnttaggcctagctcgaaaaattttgaaaattttcgaaattttaaaatttggaaaaatcgggcttttaaagctctacaataagtctgctggccaccctgcgctcagttcaaagcctaatgagttattcgcctggtactgaagtgggaaaaaaaaattaactgagtctccgtgtctgtacaggtccgggatttggtctgatcaaaaaataaaaaataccggattatagaggacacttctgcggagtgccctctcagcgggaattttttggtcagggttttagaaaaaaagttaggggccctcaaatgcacgaaaaaatgagaaattagccgctgggactcagttggccgcgctgaatttttctctatagttttcccggatgcgcctcaaaaagttgtaagacccttccactactttcaggacgctcccggccttcggccgggagaaaatggttttagcaacgaaactccttgtcaatataacatatatagtaactaaatgcaacattcttggcatcattcgttagctctaacaaataagtgtcctcagatatcatgagagtcaaaggtaattgaaaacggcattgaatacgtaaaattggtccaaggctgaggaagtgccggttttttgcaagtaagcagtctcatttcgccgatagtggagcattttgcaacgaaaacacacccaacttaaattttaaaattagttaaaggacatttagaaaaaccccaacgattgctgatgattttcaccatcagtttgcagaaatgatgttgcggtcggcggaggaaatatgttttttgtcactttatatttatggggcccaaccacatttcaaatgctgacttataagccaaaatgttgctaaacaaaaacaaaaaaatgcaaaaatgttggggtgatctgggaattgaacccaggacctctcgcacccgaagcgagaatcataccactagaccaatcacccatgtcaatccaagcttattagtgtgcttaaccattctacacggtgctgcagtgttttccagcaggggaaagcatttcgattttaattcatttctcccaaatgttaaaaaacataaaaatttattgtacaatttgaaaaaaatttaaagtccgagcctagggctgggtcttcattaatttctgctaatgatcacttaaagaatcgctttcgtctccccaatttggcatcgtttcattagtagagcccggatttttaggtttaacaattttttacggatagtacttgatgagagaagcacgaaaatcacattttctccgcacagtttttgagttagagcgactttttagcacctaaaaatacctaaaacggggattagcacctatttttgcctttttccagaaatttc

SEQ ID NO: 24465 - DNA, 2339 bp, Heterodera glycines
  misc_feature (71)..(71): n is a, c, g, or t
  misc_feature (171)..(171): n is a, c, g, or t
ggatttccgatgctcccccattttagtgcgttgttcaatttgcgatagaggcgcatataaaagaccagaanctgcgcttcttcctgaaaagcgtctccactcactttgccgcctttccgtggcaattcttccaaaattttggcactaaatttggcattttcctcgaaaatntcgtccaaaattcggcccaataatcgacaatatttcagtttttctcccatatctttgatcagttttgttacgctgaatttgcctttgctggcattgatctcattggcgagtttttctccatttttagctttgaatgtcaatttgaacacttcgtttgccatgaagccaaaatcgatggcattttgcccaaacgcgcgaatactttccgtgcacactgtgccaacaacgtcttcaattaacatctgctgctgtacggcatttgaggaatgaccaacacacatttttaaggcatgcacttcgctggcttttgacactgcattggcattttgtccagtacttgaacttggcatcactgagctttctctttctgtttgtggtcttttggcactctgttgttggttgtgatttgccttctcaacttgtgctgctgattttggcgttgactttgaatttgagggcattccctttatttcgtctgcttttggcattaaaacattgacattttcccttccatttgaatttgttttactcgtccgttttgcttgtgcggcattggcattctgttgtctgatcaattttagtgcgtccattttaccaatttggttttcaccagactttggcactgtttttgcatctttttttggcactgtttttgcatcttttttctgtttgctttttgaatccgttttttctgattgtttacttggcatggaatttatcggaatcggtgcttcactgtttcccattatcattaactgattataactgttatcatttttatcagtttgattcgctgtttcgtcgtcgtcttcgatatcaatcacttccttatcattgttatcatttttaatgttggcatttgacgggccgtccgtttccttttgggttttttcattttgttgaattggtggaaaaagttcttcgtcccaaaatgtcgggtccgtatttaacacttccaacaaatcgtccccaaaattgaacggcacaattgccatggcatttccgtcctccgtcgccctcggcgtttgatcattcgtttttgcctgttgatccaccatttcttcatcgtcgtcatcgtcgtccaaattgatcactattttttgtttgtcctccatttcgtcgtcatcgtccaacagaataatctccggctgtttgccatttccgttcttccgccgatcacttccaatcgcttctgtgttccttccaattgtttcttgccttcttggctcgtgcctctgatcagtccttgcctttttcactgatatttccactgattttgccaacatttttttatcaaattcagtcgttgggttttccttcgatttgtcaccaatttgaatttgctgaattaattcggcatcaattggagcttttccaattacgttcggtaaaatttgaccaattgccttcttcaaatttttaacaatggtcaaattctttagttagggtgtgcaaaataaactctgtcggtctcagtttttacttttttttaattcataactttcggtgatttttggatttatttttcttttttaaattttgttgtcatttattttgttggctcaccagcaggctataaaccccggggcttcaatttaacaagcccacttatgagggggaggggcttctaatggaggggcttttattttgaaccctttttattaaagaataacaaaaagttttaaaaataaacttctcgtttttactttttattgccgaatttttgtttggttcccagccatttttattaaaatatttttaatttcttgttttttgtgaacttttattgaaaattggggaatgatttgagaacaaaaatctcgcgctttggtaaaactcaggccaaactattttattatgcaactcaaaatgcaaaaaaaaagtgagaatttttatatttctttttacagttcgacattccaaaaagttaaaaaaaaattaaagtcgtcaagaactttcgaatgataataagaatttaaaaaattaattaacattgccataaccacagggctcggatttaattttttatatgtttttttttgttgttgctaatattttatcgcatgaaaagctcaaacttagctttttacgagttttcttttcaatcagagcgattttttataaaataaaaaacatattttggacattctattaataaaatattttgg

SEQ ID NO: 24466 - DNA, 1620 bp, Heterodera glycines
  misc_feature (69)..(69): n is a, c, g, or t
  misc_feature (1213)..(1213): n is a, c, g, or t
  misc_feature (1215)..(1215): n is a, c, g, or t
  misc_feature (1260)..(1260): n is a, c, g, or t
  misc_feature (1267)..(1267): n is a, c, g, or t
  misc_feature (1270)..(1270): n is a, c, g, or t
  misc_feature (1274)..(1274): n is a, c, g, or t
  misc_feature (1287)..(1287): n is a, c, g, or t
  misc_feature (1316)..(1317): n is a, c, g, or t
  misc_feature (1324)..(1324): n is a, c, g, or t
  misc_feature (1590)..(1590): n is a, c, g, or t
cccccccccccccccccccccgccccccccccccccccccccctcctctcttttttttcttcttttttnttttctttttttttttttttattttttatttattattaataaaaataataaataaaaaaaaaaaaaaaaaaaaaaaaaaaaaaaaaagaaaagagtgtgaaagttgcctccgccccgccctctcccacccctccctcccccctcccccccctccccctcctccctccctctcttctttttttttttttgtttttttcttttttttttttttttctcttttctcccccctcaaccccctctccccacccacacacccattttaaaaaaaattcccaccccaactcccccccccccccgccttttttttttttttttttttttttttttttttttttttttttttttttaaaaaataaaaaaaaaaaaaaaaaaaaaaaacaaaacaaaagaaacaaaaaaaaagaaaagaagaaagagggggggggggggggggggggagaaaaaaaaaataaaaaataaataaaataaataaaaataaaatattgggtggtggggggggggggggcgggggggcgggggggggagagaaaaaaaaaaaaaaaaaaccacccccccccccccccccccccccccccccccaaaaaaaaggggggggggggggggttttttttttttttttttttttttttttttttaaaaaaaaaaaaaaaaaattttttttttttaagcgagagggtttttttttttttatttgtgggggggtttgttttttttatttttaatttttttttgggggggggggggggggggggggggttttttttggcgccccccattttttggggagaccccccaaaaaagggggggggggggggggggggtttttttcaacccaccttttttaaaaaaatttttttattttttaaaagggttttttttttttttttaaaaaaaaaaaaaaagggggggcaaaaatttttttggaaaaaggaaattccggcccccccgggggggatttttaaggggggggaaaggggaaaattttaaaaggggaaaactttggggaaaaacctttggggggggcggatttaaccaggtttttgggtttcgggccaagtttttccagtgaaattcggacctgccttttcgggttcccacttgctggacaaattagatcaattgttgtttcaatgatccattattntncttcgggggaagctttttctctttatctcaccactgaaaactcancattacnganctgnaaaaattgctttncctctacatggaaattgcgctcgacgagnncctaccnggaaatacggtatgtgttattttgtcatttttccaattgttaattaatattcaaaaatagaaaaaaaaagataaacatgttttccaatcagtgacgctaattgagtcatttgccgcatttttggcttatttttgagaacctcgcgacacacttttagccacagctcaaaccttcatgaagaaaacaacagcagctgcaacaggtgctttttgtttcaaaataatcaactgctgttctgttgtggtatttatcatttttgttttcanaagttttaattagtttttttctattttagt

SEQ ID NO: 24467 - DNA, 284 bp, Heterodera glycines
cccttccactactttcagggcgctcccggccttcggccgggagattttgttttttaagacgaactgcaacgtttctctatagtagtataaactagggtgcccagttggctatggtgtgcatacgtggcttggtaatatatggccctcatttgttattttaaaacatacaaaacattaattccattagtgtgatgttttaaagcgctatcgcgctatgggacgcggcttcgccgcgtcgctagaaagtgatgtaatttagcaattcatcgcagcctcaggacggg

SEQ ID NO: 24468 - DNA, 1305 bp, Heterodera glycines
tggacatttgcgcttttttgtccatatttcgggtatttttagtccatattttatgtccatatttggtgttttttagtccatattttttgtccatatttcgggtatttttagtccatattttatgtccatatttggtgttttttagtccatataatttataaaattttttgaaatttaacaaaataatagagaaatcttaggtctatctaatcatatcaagaaaattaaactttgttgtttctcaaagttactaaggaataaaatgctttatatgtttatggtcatacaaaaatgtgagatcgtttaaatgcttaattcatatcatccttaaatgattagactggcgaaagatttctctattattctattaaatttcaaaagattttattgagtttaaaaaagttaatgacaaaattagtgagtctaaatttttcggaattttttgcttataaatagggctgggaatttaagtcactattcaaaaagtcgactaaaacagttataaaaaatcgccaaaaggtcataaaaaatgcaaaaaagttagcctaaaagtcacaaaaaatccaaaaaagtacgaaaaaatgcaaaaaattttgtgaatgttaaaaaaaaatcccatttttaacaatttatagaataacatcttataaatagagatcggatttttaggcacttaattttacaaatatgtacctaaaacatacataaaaaagttattcttccaacaattacgaaaaatttcatccagatttcattgccttttcaccgatggaaattttattttttggagttttctttgtatttttcggcattttcattggttaatttaaaacttggcctcaaaaagtcaaaaaagtcacgaaaaaagtcataaaagtgtaaaaaagtcataaaaatcccaaaaagtgtaaaaaagtaaaaaaaaaagttacaaaaaaatcatgttagaagcttcaaacaaagtttagaacactttttaagccattttaatgccatttagaatcagcaaaaaaaagtcatttgacttaaattcccaaccctagttatgtataactttgtaatttttttatggtcgtgtaaactgcaattgagcccgaatttcggcaatctttcagaattgcggtcccgaaaaaaagattttttttaattcgtaaggcactttttcgagccttaaaaatacgctaatcacgaatatgaactcggattttgaaaatctttgattattgtctatgattttttatcgcaaactttatttttggaattttttaaatcgattttctggggtaaaaaatacgttgatcacga

SEQ ID NO: 24469 - DNA, 478 bp, Heterodera glycines
cccccccccccccccccccccccccccccccctttttttttttggggggggggggggggggggaaaaaaaaaaaaaaaaaaaaaaaaaaaatgggggggggttggttgtttctttttccccccccccccccccccccccccttttttttttatttattataaaaaaaaaaagtggggggggggaagaaagaaaaacccccccccctttcttttattgggggggggggggggggggggggcgattttttttttttttttcccccccccccccccccccccccccaaggggggggggggggggggggggggggggggggttttttttttttttttttttttttcctcttctcccctcccccgcgcgggggggggggccgcgccgcccccaaaaaaaaaaaaaaaaaaaaacaaaaaaacacacccccaccccccccccccccacaaaataatattattttttttttttttttttttaggg

SEQ ID NO: 24470 - DNA, 1695 bp, Heterodera glycines
tgccaaatttgggctttattccatagccttcgggggggaaatgaatgtctgacatttcgagacggaaatgcccatttttggggattttctgagatcaatactttcgaaaatttggattacgatttcgataattttcataaatttcttttacagtttggctcatctgccaattcacagccggaaaaggatgggttcggttggatcaccggtgtgctgattcggtgcattttgtgcatttttggcgccactgtataaatatataatattttttatttttaaatattttacaaaaattatttttagctttttcttcgtatgtcctggattgctggccaagccgggctaagtcgggatttttttttaaattttaaacttcgcaaacaaaaaatccagacaatcaatgtggaattcaaaaaaaataaggaaaatttttgaacctgtccaacattgaatttgtaacgtactcattccaattaaatccttcgctaattgcttggcaacaaaatgccaaaaaaacgattgataaattaattaaaatgccaaaatatttggacagttttgggtggtgttgttgtgctgctttcatttctggtggttgtggtcaccgccatttcaatgtccgccattgcgaccaatggtgaagtgaagaacgggggctgctattatttggttggacattttgaaccttggttttttaaatcattttataatttcaagatttctcgctccttgggtcccgaatttggcggtagcattggcctcatactgtacattgcgaatacggtcaatgcggtatatcatttttgattaataatggctgaaaagcagcagccgattcaattattgattgagattgattagcttccacctgatcggaactgataaagcttagttttttaaatctgatcttgatctgttagatcgatttaattactgatcgagttcatcgaagctaatggctgggaagcagccgtttaagttattgattgatattgattagctttcttctgattggattgataagagttagttgttcgcatcatttaaatctgatattgttcaatatatttaaatttgatcactgatcaagttattaatagctattctaatctggctcaatgacctttcatttgattattttgtaatcattaatcaattttcagactatgaactgtgttgagccgcccgaagccatagttcgtaatgctgcatacataccatacggatgactgatgaaacaaagatgcgaccaaggacatgatcagcaaccctcctcaataacggcagaactgctgccgttgtcattcgatgaaaagaccataaagttgattttgatggtggtgcggctgctgctgctgctactgctggtatagtttgaactactactgctactactgctgctgctgctgcccattattgaattcagagaaaagaaaagttggtaaatttgcttcataattataagatgcggaaaattacgagtatgatacttcgggattaataagcagatcggacgagataatccaccaaaattaacgaaagggcatttcaaagattttaactttgaattcgaaaatactaatatgctaataaataaattactgcatttttataatacaaccattttaacaaaaaattctaatttgattataaaattgttactgaattcttagacttatgaagggaggggctttt

SEQ ID NO: 24471 - DNA, 1316 bp, Heterodera glycines
  misc_feature (527)..(528): n is a, c, g, or t
tttattcgttgtccatttcatcaaaaataattggaattatctcgtctttttttatgggataagttccggcggtggatctttagaatgacgataaatataatgatcgcatttaaagtgataaatctatcttctaaatgacctaggggtaacaaaattggcacttttggagttcccgcccatttccgtcgattcattaccaaaaataaaggttcaaaattaacacttttttattttaaaatgaattttgcctggcaacggtccgtccgtcgtttttagacatattccattttattagcagacagagacaaacatcaaattccatcttgctaattggcgtcttattgtgtatatctgttgaggtttaatataatgatatttcattcgaagttcactttttttcattatcccaccgtatgacactttttttccattttatctgttaaaaatgagacattcgctgttttatggcatctgtctgatttacttcttggcatttagtacttttatttgcggcaggtgtgatgttnncgccggacccccttgttccccaaaagtttttggaaaaagcgctgaaaaaaaaaatcaatttcgatttttcatactcagattttcacaaaatgcttatttcaaataaaaaattgctcaaattgatcatggacagtcaaaaatacaacatttgaacattttaaacgtgttttgaataaatttgtaaaaatgaggctttttgacccaaaatgaggctttttggcttgccgaatgaggtttttgaaaattttcatctgcgagccctggttatttatgctcaatatatcgaaactagtgcgctgaaaaaaaggcatatgcctcaaaatgcggtctctacttatatatcaaaatcaatagaaaattaaaaataaagttttagttttataaacaattttttgataaatcattttaacataaaagcaaaaataaaaataaaaacattttatgcctcaaaagtgaatatgcgtcaagtaaatggaaccgcgctgggatgaagtccgaattgttttaatgtacaaatgtcatatgtttacgaccgtaactttgtcaaatgacggtcaacctgaacgatcttgatttcaaaaaaaaacattaatccaaatcacagtcgacttattttggcattttttggaaaattcaattaaaccgggttttaaactggtttaaaacgtatgccgtttttcttaccgaaggaaaaattttttaggtataaaaatatatatgttgtttctacactgagttctctacaagatgcatcaaccgcgtatcccaatcggtcattaggagccgag

SEQ ID NO: 24472 - DNA, 906 bp, Heterodera glycines
tggcaattgggagaaagtgcaaaatgcattcgtcctgcgttctcgtcccaacatgatcagcaacctttaaaacgaaaaccatttggtaaaattagcctcccatccacctgattccaatcatctttgaacatttcaagcccctccaacaacaacaaagtctcttgcggggaccaatcacgggtcggcgcagcgcccttcgtcttcattgcggccaattgctttctgtactggtccaacttgaggcccggttggtgcatcattttcctgtcatttgccgctttcgtttccctttggtccgccgatttttccctttcgtttggctgttgctgtttctgctcctccttctgttgttgctccgattgctgctgctctttgtcattgtcttgcggtggttgtgacaccgctgggtgtgggtacacgcgttggctgggcttttccgcgtttgacatagaatggagtggctgcccccccccccccacacgcctctcccctctcagcccacgccaagggattttcggcctaaggcatcgcgaggacgcattcataattttgtggaggactttcggccgcttcacggcctcaggacgggcgcttcgcgcccgttttcaaactttgtagggaaattaggacgcttcgcggcctcaggacggggcttcgcgcccgttttttaattttttaatggacattcgaccgctcgctgccgcaggccgggcgcttcgcgcccgtttttagactttgtggggccagacgggcgcttcgcgcctgtttctaaattttgttgggcttggacgggcgcttcgcacccgttttgtaattttttaaggcattcgaccgcttcgcggcctcaggacgggcgcttcgcgcccgttttcaaactttatagggaaattaggacgcttcgcggcc

SEQ ID NO: 24473 - DNA, 1765 bp, Heterodera glycines
aatattgtagtcaaactctatctgattaattaaaatttcaaacacagatttctacattacagaatatattggataaaactttgatggaattgataaagaaagttttttaaattttttctgtcagaaatagataaaatgaacgatgcctttattgataaaaaatggcacttttgtgtttgtacaatattagttgattccattgaaatatgaacacggttttaaaaagaaaatttctcccgacggaattaattttcgaattaattaattttctgccacccaaaaggcgttgggcaacaataagggtttcggcaaaattcgacaattttgtcttacgaaggcaagccaactggcacacaatgtgtttatttatagtatgcgattaatttaaatattttacttaaatataaattggatcgtccataatttattttgagtgtccgttcaatttatttaaaattaatttaggcgggtcaatttgatgttgctgttgagcatctcatgaaacatgttttcagagttaaaggcgtgtttctttttcaagacatacggggtaatatttcatcataattaattgatgtggggggtgggattaaaaaactttcaaaagtaaaagcggggcctttgtcccttcattttgacttttttatttgaataaataaaataaaaaaaattatcagattaataatttttaattttattttcaaaaaaaaaaccaaaaaatcggctttagcctagagcaaacttcaaagttcgtgagtcagttttaattgcaaaatgaaattgcaaatttaataaaaatataaggcggctggattgagtagttgctaaaaaataaaatgatataaaattatcagtttgtaaattccactaaacttttagaaaatttctcgccattaccggcaccgacgggacaaaatattctttaaaatttcttaggctcaaaatcctaaattttaattttggacaaatttgataacaaatgcaaccaattttccaaaattttccacaaaggtttttgaaaaagagcgccgcgaaattagtgtgaaaagcacctgccacagtatttcatatatacatacactctcttaaatttctataatttaatttaaaaatataaattgaaaatccaaatccctaccatgctgactccgttaaactccgaccccgacatttcacaacccagacatcggggtttcagccttaatgcaaaggattggttatcattgcttgataagaatttgacccggattaatattgcaattatttgctcctatgcagtttatgccccacatatattttttatgtttatatgtaaaagtacggcacaaataatgccaatttataggtttctggctcgctaaacacgaatccggcatccatttgaacccaagaagccgaacaacaaatcgaaaggccattttccaaattcactttatcgctcaaaattaattcaaataacacgaatacgtgttgagttagtggaaaattcgttcaaaatgcagaacaatggacaataatagctaataggttttgaatcgaagaagcgaatgacgcccaatgaattggctatttcatgcatttgaattgattttgagcattacaataaatgtgaattttggaaaaataggatttcgattttttcttcgggttcgggattgttcaacaacgacccataaaatctataaattggcattatttgtaccggtacttttatatgtttttttataaatatatatttggcctacaatccctttggtttttgcat

SEQ ID NO: 24474 - DNA, 2171 bp, Heterodera glycines
caaactgaattaaattttctgaaattgtatttaagaaaatttatgatgactttttctcgaaaaatttgcaaactttgaagttttaggaaacgcccaagcacgaagtctttcctcgtatctactgtcatgctctttttgatgaatgaataagctttttgtcaagtctaaccagagttatggttatcttatcttttcctggtcttttaagccatgttgaaatttaatttcaaaaattcaaaaaaactttttacgcgttttatgcgagaaaccagtgcatattgtgtgcttttgaaaatccctataaaattcaaaatcgctttagcatatcacgctccaactgatcttcctggacggggaggaagcgttccacgagtggtcccacttggattccatttacggggcaagacatttggcggacacgtgggagcgcaagtggtacccgagcaccgatggcagtgcgtttgagctcagccgagaaattgatcgaattgtaagggataatcggatgccaaatcagctattttgagaggatttggaagggggggggggataatcctaaattttattatgaattttactgacctctaactcagcccccacccccctaattctgtgcggttatttacctctgtcactttcttcgttggggtatataatctctttttttcatggttactggaaattttgatgaaattcatcaactaaaagagctcaaaaaaattaatttgaaaatcgttgaaaaaataaaataaaaatataatttaacaattttaattcgtcttaagaatgtaggatgtcttggtgcattaacttcccatctttcttcactttttgcctgagatcaatttcctttttattagtttcatttttttaattatgagcggagttttactattataattttttaaattttttctcaaagccgccttttcgggggagcaggtgctaattgcactttataatgataattagtagggttcgaagttgtatgcactaaaaaatgccaaatatgcttataaaatatgcactaaaaaccggaaaaatgcccaaatgtgcactaaaatatgccttaaaaattacccaaaatagcttttaaccctcaaaaaaatgccaaaaattgtgtataaatagagaattgactttgaaaagaagacaagggctgggagcatttttttgacaattgcaaaaatattgaatttctaaatttttgaatttttattatatgctaaaacaaaattacatttttatataaataattttttttccaaaagttcttacagaaaattaaaaaattttcgatttttatttaaaatttccaaaaagtcgatccttaggggtgtatttttcgcttttttcgcatttttcttgtgaaaatttgctaaaaatgaccgaaatatgctctaaaagcccaaaaattgcgaaatatgcatttattctgaaaaccccaaaaatatgcttttatatttcaccaaatcaaaaaattttaacgtagaaatgctttttttgagtccctttcttcatagcatatgcgcagaaaaaatatgcaaaatcatacaatttataaccctaaaaattagtaattagcctcttaaattcaaaggatgtctttgtgctgctggatttgttgggtgccaaaaacccgcacattcaaagcgtgccgggccatggtgcggcctcactgtttgaacaactaccgtacactggtgagaaaggggcttcagctactgtaaggtgatgataataattttttaaaattatacagagggacagttggcctaagctgaacttgctgaaccggatcccgagaatattttatccgggcacttcatactttggagcagttgaagatgatcacctcgctttcatgcggaagggtaatggaaagcataagcagaaatttattgaaatttgttaattttttgagaaaatttaccaaatgcagatattgggaatcgtcctaataagataaaaaacgggcgcgaagcgcccgtcttgagcctcgatgtggactaaaaacccctaataattttttaaaaattcaaaaaaacctctctcaaccaattcgataaatttgaatcgctttacagcctaggtagcgaagctcccaaagcgcgaagcgctttttcccacaataaaatgccaacggttcacgcacccgctagttatatata

SEQ ID NO: 24475 - DNA, 1077 bp, Heterodera glycines
aatttagaaacgggcgcgaagcgcccgttagaggccgcgaagcggccgaatgaccctataaaattttttgattaatctcaaatatcttttggaccaacaattactctacaacccatagcttatctaggtagcgaagctcccaaagcgcgaagcgctttttcccagctaaatagccgacggttcacgcacccgctagttaatatatacgttatattgacaaggagtttcgtttcaaaaactaatttgagcttaacggctaatgggacgggtctgaaagtagtggaagggtcttacaactttttgaggagcatccgggaaaactatagagaaaaattcagcgcggacgactgagtcccggggaccgatttctcactttttcttgcagtttagggcccctaactttttttctaaaacccgaatcaaaaagtgcccgctgtgagggcactccccacaactgtcctctacatgctggtattttttatttttttattagagccaccccctggcctgcacgcttggctaactgaagtgtgctcaaaatgtacacttcagtaccaggcgaataactcgccaggggttgctttgaccgaaaaattgtttctgagcaaaaatgtgtagtatttgaaaggctatccaaccaagttttaaaatttcgaaaattttgaaaatttttcgagctaggcctaaaaaacggttttcgggtttttgaattttaggattttttaacgatttttcccagagaaacggagaccacttccaaaacatagtttttcgagctctatcgactggtatttttttcggaaaaatttcgattttttcccggaaatagaaaaaatttttggcctgagcgggacatttgagtcccgggtccataactcgttaggggttggttttatcgaaaaaactccatagggcaaaattgtagagttttttaagctctatcgaatggtgtgccatattgccggaaattttcaaaaattttcgagctaggccccctagaaattttcgaaatttttttttgggttgaaaatgggggacaaaaatatttttctggggtaaattagggtcctgagcaca

SEQ ID NO: 24476 - DNA, 1925 bp, Heterodera glycines
  misc_feature (1898)..(1898): n is a, c, g, or t
ttttaaaaattctttatttttttggcaattttttgcccctcggattttggggcgaatattgaaaatttcatatctagcctaaggggtgaccaattttgagcaaataaagcttaaaaatagagaaaaatcaggagaattttatgggatttatttaggttttctaacatcaatatgaaaaaagttattccagaaattctggaaattttagatttttcagaaaaaaattcgttactgccttctgaaaagctatttgagaaaagtaaaatactacaaaaatccgcaattttttgctctattatataaattttatttggcatttctatcacatttttaataaaagatacaaaaataaaagtgattttgggattcgggaccaaaggggggtgcacatggtttttgagtgaaaaaattttttcgacaaaaatcttccaaaaacatgtctttaggggttatttgggccgctgatcacgaatacgtgatcagattttacgtttgacatcgttaagccctcagaatccctgtgtgattggggattctgggacatgttctgagggggggggggccgcaggttcgaatccggacggtgtaacattatttttctttgtatttttggcttattttacaatgtttttaattaatttttgaagatttcttttaaattatttaaatttattttttttaaattaaagaatttcattatttatttttgaatttgtaaaaaaaaattcatttaatttcaaattaaataaatattcaattaataatttccaaggttgtttttaattaataaaagagtattttattattaaaaaatttttaaattaaaatgcactcgatttttaacttttaataaaaacgtttccttatttatttaattttaaacaatattgtacctctcctaacaatgttgtaccacttctaatcacagttgtacctcttctcatcactgttctacctcttctgatcactgtttacctcttctaatcactgttgtaccacttctaatcacagttgcacctcttctaatcactgctgtacctcttataatcacttttgtacctcttctaatcaccattgtacctcttctaatcactgttgtacctcttataatcacttttgtacctcttctaatcaccattgtacctcttctaatcactgttgtacctcttataatcacttttgtacctcttctaatcaccattgtacctcttctaatcactggtgtacctcttataatcacttttgtacctcttctaatcaccattgtacctcttctaatcacttttgtacctcttctaatcaccattgtacctcttctaatcacttttttacctcttctaatcacttttatacttcttttatcactgttgtacctctttaaatcacatttgtacctcttcatcaaatttgtacctcttctaatctctgttgtacctcttctaatcacttttgtacctcttctaatcacttttgtacctcttttatcacttttgtacctctttaaatcacttttgtacctctttaaatcacatttgtacctcttcatcaaatgtgtacctcttctaatcacttttgcaatcccaaattgcttcggatcgaaactccacaacccataaatatcgggcgcgaagcgcccgtccgactcaacacaatttaaaaaacggccgcgaagcggccgaaaagcacaacaaaaattagaaacgggcgcgaagcgcccgttcgaggacgcgaagggcgcgaagcgcccgtcttgagcctcgatgtggactaaaaacccctaataattttttaaaaattcaaaaaatctctccaaccattcgatcaatttgaatcgcttcacagcctaggtagcgaagctcccaaagcgcgaagcgctttttcccagctaaatagccgancgttcacgcacccgctagttatatata

SEQ ID NO: 24477 - DNA, 1130 bp, Heterodera glycines
tcatcaccatcattcgtctcccaattacaaatttatctttcaccagcagaattaaaattgtacgatcatatacacatttcggcactacttgcaaagtgggacggggacacgttttagcgattccccctttggtttctaataaaatcattgcaatatccaaggaaaatttaaaataaatttcaaaacgccaaaataattataaactaagattttcttaaaattcaaaaaattagtatttcgaaatttcatttctaactaagaatccatcagtcgttgcgggcggagattaaccaaaagtttaatttaagaaggattcattaagaaggattctctacttattcccgtcattcgtctttttacaaattatcttttctttcacaggcaatacgtatttcatttacctaatttgaatcccaaaattccttaattaatttgaaaaattttctttactgtttagccatacatattttattcaatttcatgacgactcagaacagtgacgaagaaattggtgcggaggctttgcaaaacggacagaacaatggtggaggaggggaagaagcaggagcaacagcagttaatgatggagaaacaattgctggagaagttgaaggcaacaaagtgaaggaattgaaggcgaaggaaggggaggaggaaaaggcagttgacaatggggatgagtcggttgaggacgaccgcgcattcggcacaaaaacgccgccggcgtcgcaactgcgccaaacgccgcctctctcggccagcattcgggctccgaccgtgcgcaagcgttgctccgcagtctttggtgcaaggacgaggtaaatttaaattgttgtcttggagtttttcaatggaccctaaaaaattaaagatttcatcgatttttttcaaatcgactgcaattttgtccaaaatttttgctacaaaaacagattttcttaattatgtttagccacacttccactagtggcggcggtggtggtgggctgtccgcgttgaccagtgcgatgttgggcaagaagccacgcaagcagtccgtgctggacaacgcccagtccggctggcgctcatttgtgcaggaggaacagttggagcaggagatggagtcgcacatgcgcagcaaggacgcc

SEQ ID NO: 24478 - DNA, 1519 bp, Heterodera glycines
  misc_feature (37)..(37): n is a, c, g, or t
  misc_feature (50)..(50): n is a, c, g, or t
gataattcaaagagttgttccatacacccctttcatnttggccatgttgnagacacatcacaactgggaatacgcatacggacaatcgacaaatctcaaatacgctcttaagtacccgttcaagggagcaagtttttcctatttgcgttgtgcaaatgaaaacaaaacgaatgtcgacgaaccggcttactatgccagaatgctttatcgttcacctgttgaggcctttagtcgcatcatgtcattccgctacgcaataatgtcacataatgtaatccctttatcaatccatttgccaggtcaacagaaaatttatacacgtcctggacttgaggcccaacaaattgcagaaatgttacaaaatggacaacttcaacttcctgatacagccctcacagcatattggaagcattggcgagcagatccaacattgaaaaatatcttatttgagaatatgcctgagaaattttcgtttaacaaaaaaaacaaaatctggaaaccacgcatcatttctaaggatccgaaaaggatggcaaaccgcagaccatgcattggacgaatttatcctatcttgcctcgggcccaagaactttttgccctttatctgttgacaaggcattttcccggtgaccctgatcatttgaagaaagtgggagaacatcaatgcgaaacgtttttggaatcagctcgacttcggggacttatcaaagactcggatgtttggatccgaacattgcaggaaggagccaactctttgactccagctcagatgcgacaactccttgcaagcatactcatttttggaaacacggaaaactgtgttcttgatggatcaatgctatggaatcgctttcttacgcacatgtacgactcaagatgcagtgagacagagaaagcgcggcgaatcgatcaagcactttcattgcttgagcgattgttggttcgccttggaaaacaatgctccgattttggactcccaacgccgttaaattcgattgtcaacgacccagatcgaggcgtaaacgacttcttctttcctgaaaatattgctgacgatgaacaagacgaatcagtggacacaagtgcatttgaacacgccaaacttaatgatgaacaacaacacttcttcaaccgaatacgcgatgtcgccgcaacaatgccgagtaattcaagcaagcgcttattctttttatctggtgatggtggaaccggcaagacattcctgcttaactatgtgctgtaccacatgcgaagattgcgtaagaaagtcattgcaactgcctcaacaggaatggcttcgactcgcttctattcaggcggcacaacagtccattcagcgtttcgattcggcataaatgttgaagttggccaacttcctacaataccttttgacagctattttggacggcgcattaccgaggcagacattatcattattgacgaaattacaatgcttgaaaaggttgttctggaaaatattgataaactctgccgaacatgacaccgcgctatgcgcatc

SEQ ID NO: 24479 - DNA, 975 bp, Heterodera glycines
cggggatctctagagtcctccttttcttcattctgggggaacagagacacatcgaccgactcctctttcgacaaaactcttgttttctttccgccctcccctcaactccttttcttctttctggggggacaccgactcctctttcgacaaaacttttgttttctttcctccctcccttcaattccttttcttcctcctgtgggggactagttcgactcctctttctcctctctgtctcccatttcctccttcttcctcctccttttccaccatgagcaattttttgtttttttcctcatcactatcatcgtccatcaacctccgtctccgaaaccgcgaaaaaacgggtggaaaagaggccctcttctcgatgattttgtgtttacattgccgctattcttcgcttccttcatcctcgcgaacagctcgtcccggttgctgggcaattcttcggtcacagttgccggcacgttcggtgccacagatggcacaacaacgggcccatcatcggctgctgagccatcgccatgttcggcatcagcagcaacaattgggtccggtggtggtggtggtggtgcagtgcgatctggcgacacttcataggcgggcggatgattgatgggacggcctttgaaaaaaagttgttaaaaaatttaaaattttcccagaggcgcacctctaggcctcaaagtgcacatgaatgctttaaaatatgactaattgtaaataaattaagtagtaaatttaaccatttttgaaggaaaaaaaaacaaatggaccaaaaagatgtcaatgaataaacagaaaaaatatagaaatttatattgaaaatgaggagaaaaagcatgagtgaggcgcgcaaaaaaaaactcaaaaaattttgttttaggaagaattcctttttttgtaactctttttgcgacgcttttttaaaaattttggcgaaggaaaacgggaaaattttagtgaaattct

SEQ ID NO: 24480 - DNA, 1939 bp, Heterodera glycines
  misc_feature (55)..(56): n is a, c, g, or t
  misc_feature (58)..(58): n is a, c, g, or t
  misc_feature (60)..(60): n is a, c, g, or t
  misc_feature (62)..(63): n is a, c, g, or t
  misc_feature (65)..(66): n is a, c, g, or t
  misc_feature (72)..(72): n is a, c, g, or t
  misc_feature (79)..(79): n is a, c, g, or t
  misc_feature (95)..(96): n is a, c, g, or t
  misc_feature (99)..(99): n is a, c, g, or t
  misc_feature (105)..(106): n is a, c, g, or t
  misc_feature (109)..(110): n is a, c, g, or t
  misc_feature (113)..(113): n is a, c, g, or t
  misc_feature (117)..(117): n is a, c, g, or t
  misc_feature (131)..(131): n is a, c, g, or t
  misc_feature (137)..(138): n is a, c, g, or t
  misc_feature (153)..(155): n is a, c, g, or t
  misc_feature (158)..(158): n is a, c, g, or t
  misc_feature (167)..(168): n is a, c, g, or t
  misc_feature (177)..(177): n is a, c, g, or t
  misc_feature (180)..(180): n is a, c, g, or t
  misc_feature (188)..(188): n is a, c, g, or t
  misc_feature (193)..(194): n is a, c, g, or t
  misc_feature (198)..(198): n is a, c, g, or t
  misc_feature (200)..(200): n is a, c, g, or t
  misc_feature (203)..(203): n is a, c, g, or t
  misc_feature (205)..(206): n is a, c, g, or t
  misc_feature (208)..(212): n is a, c, g, or t
  misc_feature (215)..(215): n is a, c, g, or t
  misc_feature (217)..(217): n is a, c, g, or t
  misc_feature (219)..(219): n is a, c, g, or t
  misc_feature (232)..(235): n is a, c, g, or t
  misc_feature (245)..(245): n is a, c, g, or t
  misc_feature (247)..(247): n is a, c, g, or t
  misc_feature (250)..(250): n is a, c, g, or t
  misc_feature (255)..(255): n is a, c, g, or t
  misc_feature (258)..(258): n is a, c, g, or t
  misc_feature (261)..(263): n is a, c, g, or t
  misc_feature (265)..(265): n is a, c, g, or t
  misc_feature (268)..(269): n is a, c, g, or t
  misc_feature (273)..(274): n is a, c, g, or t
  misc_feature (276)..(277): n is a, c, g, or t
  misc_feature (282)..(286): n is a, c, g, or t
  misc_feature (291)..(291): n is a, c, g, or t
  misc_feature (295)..(300): n is a, c, g, or t
  misc_feature (304)..(304): n is a, c, g, or t
  misc_feature (308)..(308): n is a, c, g, or t
  misc_feature (310)..(310): n is a, c, g, or t
  misc_feature (312)..(312): n is a, c, g, or t
  misc_feature (317)..(317): n is a, c, g, or t
  misc_feature (320)..(322): n is a, c, g, or t
  misc_feature (324)..(324): n is a, c, g, or t
  misc_feature (326)..(326): n is a, c, g, or t
  misc_feature (329)..(330): n is a, c, g, or t
  misc_feature (332)..(333): n is a, c, g, or t
  misc_feature (335)..(336): n is a, c, g, or t
  misc_feature (338)..(342): n is a, c, g, or t
  misc_feature (346)..(346): n is a, c, g, or t
  misc_feature (355)..(356): n is a, c, g, or t
  misc_feature (359)..(361): n is a, c, g, or t
  misc_feature (367)..(367): n is a, c, g, or t
  misc_feature (373)..(373): n is a, c, g, or t
  misc_feature (392)..(392): n is a, c, g, or t
  misc_feature (409)..(412): n is a, c, g, or t
  misc_feature (415)..(415): n is a, c, g, or t
  misc_feature (419)..(419): n is a, c, g, or t
  misc_feature (427)..(427): n is a, c, g, or t
  misc_feature (431)..(431): n is a, c, g, or t
  misc_feature (448)..(448): n is a, c, g, or t
  misc_feature (456)..(458): n is a, c, g, or t
  misc_feature (462)..(462): n is a, c, g, or t
  misc_feature (468)..(469): n is a, c, g, or t
  misc_feature (473)..(473): n is a, c, g, or t
  misc_feature (478)..(479): n is a, c, g, or t
  misc_feature (493)..(493): n is a, c, g, or t
  misc_feature (498)..(498): n is a, c, g, or t
  misc_feature (503)..(505): n is a, c, g, or t
  misc_feature (512)..(512): n is a, c, g, or t
  misc_feature (529)..(531): n is a, c, g, or t
  misc_feature (539)..(540): n is a, c, g, or t
  misc_feature (544)..(544): n is a, c, g, or t
  misc_feature (547)..(548): n is a, c, g, or t
  misc_feature (552)..(552): n is a, c, g, or t
  misc_feature (560)..(560): n is a, c, g, or t
  misc_feature (567)..(567): n is a, c, g, or t
  misc_feature (569)..(569): n is a, c, g, or t
  misc_feature (572)..(572): n is a, c, g, or t
  misc_feature (579)..(579): n is a, c, g, or t
tttgttaattaatattaaagcaattatttgtttatttacttttaaaaaaagcaannangnannannaaagcnaaggaanactttgagagcaccgnnaanaacagnnaannccnaccnaacgggagcgccgngcggannagaaccccaaagcannnaancaaaagcgnnaaccacaangcnacggcgcncccanncgcncncancnnannnnncanananaacacaaaacaannnngcaaaaaagncncancaaanaangannngncanngaannannaaaannnnngacangaannnnnnaaanaaanangngcacnccnnnancnaannannannannnnngcanaagacaaanngannnaagcancagagncaagcacaaaacggcgcanacaaagggcacaacgannnnggngcanaagccaancccnagcgcaggacaaagganaaagaagnnnacangggagnncggnagcanncaaggaccccaagncaaancccannnggcaaanaacacatcgctcatcannncggaccanngccncgnncacntccagaangggaagnanacnatcgcantgttccgtgttaaaccttggccatgttgaaccactgatggagaaagtatttggaccgtttggggttgggacgactgaattcgttcgctttggggctgttgacgagcattctttatttaaaaataaacaaataataataattcacaaaatgttttttttaatcttcattcattcatgcgtctcaccgctctgcgtctggttcctcctcctcttcctcggccacgtccggcattggcattggcattgtttcggcgccgagatgaagaaatttgtgggttctaaacaaaatgcaatattaaacaaataggcaaaaccaaaaatcgttaacaaccatattgttgttgttgctgttgtccaaagcgataggttccatttcagctgtagtggtgagatcctgtaattgatatgtctatttttttttacatttttactaccaaaaaaatttggttcaaaagctgatcgtcattgtcgtggtcaagtgccaaaaactgatgactttgctgctgctgctgctgcgcttgaaccacgtttggttgcaagatggcgtttgcccggatttgtggatgttcaccctgcgttggttgtacactctgttggcgctcgttcagcggactcggtacagttggttgttgctgctgtacattgtttgtttgtggcgacagtggtggcggatgttgctcagcttgaagtgtcggcattgtgtctctaccttgcattggttgctgattatatggacgatcattgtgcgaaatcgttccactgtgctgctgatgttgagggggtagggaatttttttgaccatcgactatttaattttatttagtttttggacaaacaaattgaggaacccggtcgctcggacttcgaagagttaatggattaaatgctactgtcggtcgcttaaactcatcaaattcaaaatgacaaataaataaaacaggataacccgaatcaagtgaactgaacttccaaatgcgaaagataaagtgtagttcacagattgtccaaaatcgcgcttcggtctcacattcaaatgcatgaaccggtaagtgcctccaaccaagagagtgtttgataaaagtgtagccctggcctctttagcacaaatatgaacacgtaaatgttgttcattttccaacaaaatatttatgccgggcgcggttgtgccattgcgaaaaggaactctctccgcgtaatcaaactcaagcactttaagggttaatccactaagcaaaaaaaaagctttctactcagactttaatgaaagggtttacgggatgtatgatccaatttgccaatcgaagacgaaaaaatcaattgttgtagtgccatcctgataaaattgctccagaaatggtcga

SEQ ID NO: 24481 - DNA, 1565 bp, Heterodera glycines
  misc_feature (19)..(19): n is a, c, g, or t
  misc_feature (29)..(29): n is a, c, g, or t
aacataaaatcacaaattnttggcctttntggcacataaaaacatcgcacatatttcggggttttggcacatatttagcaaatattttggcattttatgacaaaattgtaagaaaaatacgagaaaattgaaaaatacacccctaaaaatcaaatttattgccatttcttacagcatttgcaaaatttcttaatatttcgaatgctgaaagtattcaaatcgaaacataattggtcattggatttcagggttctttgctggagctttcaatttacaataagttgtaagggaccgggacatgttactgaaaaacacgtacaactgagtaccaaagtccaggttttgaccgggaccgggaaaagtctcgggtttttcccgtttcccaaccaaaaaagtcccgtttcgaacaccttgaaatgtatttgttttgcaattgtgcgggcgggcgaaaatgataaagaatgtgattttttgggatttttatgcaaaaatacacttgatttttccaatttttaacacatattttagcacatattttgccattttttggggtttttagcacatatttcagcattttttagcacatattttattacgtatttcaggatttttagcacataaaaatccggcgaaagtatcggtcatatggcccggagctcaaaatggccgaaatatataacaatcgatagctctcggtctgtaatgtaagaatccgaaagaatttttttcggcaaccaatccctgaggggttacagagcctggattgaaatggccatatgactttgggactgaactgtccaatacttaaaacgcatgaattgcgacaaaatagataccaatcgaccggactcgctcagttcggtcgtcacggttcgaccgtcacgatcgccccctcacggttcggccccaacgtgtttttccactatagcttttttatttgtaatccaaatccaataatcttggtatcattcgaaagctcttaatatgctctattagccttaaaaaacaaaaaaattttcaagcctggaaaaaatttattaagaaaaaacttgaaaattttgactttttgcaattttcatgtataacttttttgagaattgtctaatcgcgaagcaatagctgattaagcttctaacattttaagctttcgaatgataccaacaatgttggatttggttgataaagaaaaaagttatagaaagttatagtggaaaaacacgctggggccgaaccgtgagggccgaactgaggtaaaccgcaatcgactcctctcggtacgataagcagaacaataataattatggaatttaattaaatgaaaaagaaaaaacaaattaaaaagagaacaaatattttggaaaagaataaaatgttggaaaaataaataaataattaaataaatattaattgagtgatataaagtgagaaagcacgaaaataccacccgtttgacaaccaaacgattttcattgcttgcacaacgtgccccgacaaaagggctgccgcacgggtccaccaaaacgcgattttctcatcccgaatcacttccaaaccatttttgacct

SEQ ID NO: 24482 - DNA, 2154 bp, Heterodera glycines
acacatttacaaattaagaaccaggattagtgtaccttttttttggtcgctaataagtggtttatcatttttttttttgtaattataaatatgttctataaaacaaaaacaaataatgttaactttaatttaatgattgcctaaatatagccgacttaatatttgtttataattgcaaataattaaattaattaaatattcctttagattttatcattttgagttattattttagctttatatatatatatatattttgcattagcactatttaaaattgttttattttttatttttaaacattcaattatttgctaatttattctgtttgttaattaaattttacttttatgtaatttactcgatctgttgcgattcaatatgtacaattcatcatcgaatatatatatttcacgaaattattttttgaaatttataatattcccttattttataattgatttattctttttgatgtatcaaaaagtctatttttctgttaaattgttttttctatggtcatttcaatatcatttttgtgttaattcttttatttacaattttaattcttttttttcttttaattatgaaaaaatttagtttttttattagttcatagttctacaaattatatatatttatttgtcattgcacttttattttttgttatttttatattttattttcattttataacatattatgtatcatttaacatattacttttttcttgccttcaatttttatcactgaatatattactactaattttttatattcttataataattaagaatgaaattttacttttattttattaaattgaaaaaaaataaattttaaatttcataaatataaataattctgagatggttttaaattttttcactattttaatgacttttatttgcagcaacaatttaattatgcttatctttcttctttacttttttgatgcttttgagtttttggttaaattctttttgtttttattccattgtttcaatagtcaaatgctgattttaatgcaaatgattttctaaatagtaattatctttcaaaataaatataaaatgacttcattccatggttaataattaatttatttgactattaatttttaactcaatcattcattttttctcttaagttgcttgaacaaattcacataaactatttaataaaatccttttctgtttcataattttgtgtgcatttcttttcaatttcataattaatttaaaaaaatgcgtaatttattttttttttaaatttggttcattattcatatataataaatgatgagatgtcacgaaaaatgaatattttaaatcaaattttaaaatgccttctcttgctaatgtccataaatttggcgccgtttgtcatttgtgccacccatggaaatgaataaatgagtgaatattcggcacaatcagtcaaattaactacacaatgaatgtcgtgcatttaattaattattacagaattttaaaaaaaattcatataagcataaattttttagaacaatgattcattaaaattgtcatttgataccgtattttatcagttagttcgtagaatttaagacataaaaataaaactttaattgttaaacattgacagttaaagacagaagcatcattttgtgtatgctacttagtgtactgccttccttattacggtatttcttatacggtgccagtaacttcaaatgcccacgatcgttactcggcttccaccgtaagaatgccattgggggacatgtgcgacttcaccgatgccggactcactccgtccggcagacggtactgacgacggagctcgcgtttgacgccatcttaacttgttaattctttgtttgtaataaggatgaattgcttttcagctattacattttaattggtgctatgtcattacttaaaaaccatcataatgggcgttacttaattttttgcttataactttgctctaaaaagaccaaatttttaatccttgctatcattcaatagatctaaatgttctttatgagccttttaaatttcaaaaaattttatcaagtttaaaaaaagtatggacaaaaatgttcgaaaatcaaggtttttgagttctcgagctataatgtttttaaaattaacgaaatttttgaaattt

SEQ ID NO: 24483 - DNA, 1120 bp, Heterodera glycines
  misc_feature (1089)..(1090): n is a, c, g, or t
aaaattggggcccaaacgaccctggggcccaaaaacgggggcccaaacgcggggcccaaaaacgggggcccaaacgcgggggcccaaaaacgggggcccaaacgaccccggggcccaaaaacgggggcccaaacgcgggggcccaaaaacgggggcccaaacgcgggggcccaaaaacgggggcccaaacgaccccggggcccaaaaacgggggcccaaacgaccccggggcccaaaaacgggggcccaaacgaccccggggcccaaaaacgggggcccaaacgcgggggcccaaaaacgggggcccaaacgaccacggggcccaaaaacgggggcccaaacgaccccggggcccaaaaacgggggcccaaacgaccccggggcccaaaaacgggggcccaaacgaccccggggcccaaaaacgggggcccaaacgagggggcccaaaaacgggggtccaaacgaccccggggtccaaaaacgggggccctaacgaccactgttcccaaaaacggttgcccaaacgaccacggtgtccataaacgttgggccaaattatcccgttgctctatattttaagattatactatttcgttgtccataattgggggttaaaactattatttttgatatactcttctactgttaattatctcatttccctcataaggtatgtctttacttttttctgtactccattgagcgcattacataattctcttcgggtggacccatgaattgtttcaataatttttgtcgttttttagggtctttttacatttattttattattttacttttttgtaatatttttacaaatttttttttgttgtttcatttcacgttttgtttttttttcttttattttttttatttttgaaaatccatttttttgtatctaatttgggctttttatttttttttttttccaaaattttttttttaagattttttattttcaaattttttattttttttttttttttttttttacgacaaatttttataaaattttttttttttttttttttcatccccccccctttttttttttttttttttttatttttttttttttttttttttttnnccccctgcttttttttttttttttattttt

SEQ ID NO: 24484 - DNA, 1805 bp, Heterodera glycines
  misc_feature (177)..(177): n is a, c, g, or t
cccctcccaccattcgcctcgcgcctttctccgttatccatcggcggcagtcatcagtcgtgcaaaaaatgcgcttaattgtttcatttaaacgcgaagaaagaaaagatccttcaaattgcaatatttatttgtgtgcgaaagagtctctgcagaaatttagcctaaggcattttntagaaaattacaaatataagggaaaccgagaaaaaacgagaaaggaggagagaatgggggtgagagagggtgaaagagagagagagagagagagagagagagagaggggaggagagagaacggaaggaagagagagagatgcattaaataatggatagccaaaatcattaaggtaagggacttttgggcttccaatcgtggtaaaggggaatcccgaaggaggggtacgatgggatggataatcagtcccaggaatccctcccactcggttagacacaaagaaaataagtgactttattggctttattccaggggagaatgattgtgagacaattaccatagaaattaattaaatacaaatgaaagtaaagtgatcaatcaatcaaattattagtctcaaaaggggcggtacaataaaagaaaataaatacgaaataaaattaaatgtaaaaatgccattcctaatagtttcggcaagacaaaaagcgaatttaggccatctctttcaatctcaaacgaacaaaatatggccactgttggacgaactgcgtctgatcagaatttgttctcccaacattcccaaatctttggaagccgcgcgagactctcgacgccgtgaggcaaaattgacactgatgccagtggtgctgtggtgcccgacaagtccgccgctgacccacccgccgggacggcccaattggtgggtgcggctggtgcgcaccaacgaaagctgacttactgaaccgatcggacggaagtgactgatcgaaaaacacaacagaggattgatcggcggccgatcagggtaatttttcaacattttaaatggttaaaaatcatttgactaattttggtgtcattgggtcaaaaataaatgtcaaacggacggagttcgctgagtcccgggatcactcgcgttctttccaatggtgaggaaaagcgacggaaaaaggtggtgatctccagccaaacgcacaattgcattggcaggaaactcaaagcggcagacaaaaaggagagacctttgggggatggaaaaaagagaaagcgatcagacaaaatgatcactgattttgatcaacaaaaagtgatcataatagccaaaaaagtttttgcctataatttatactactgtagaattgtcattggtcataccgtaatggaagctaaacgctgaaggctctccggcggcatttggcttcatccgaggagccatttcatcgtcgacgatgcaaatgacctgcagcactccgaccaaaacaaccaaaccttaaggaatcataatttgattttgattttgaatgccaaaaatgggggaaataccgccgaaaacgtatagaattgcggcacaaacgcttttccaactctgctcagaatgaccgacgagtgaacacaaaaggccaaaggcggtgagaagggagccggaacagtgcaaaatggtggggatgagaagacggactttggcaaaaatggaaacgaaatgaaaaagattagaaaaataggaaaaaaagaaaagaaaatcaccggtgacggcattcgtcgcgacactgaaaagggaaggcaattcaaaaacagaatgaggccaaaaacggaccttttcaatttttcaaaattttttacttacaaat

SEQ ID NO: 24485 - DNA, 1800 bp, Heterodera glycines
  misc_feature (11)..(11): n is a, c, g, or t
cctcagacctnagcctcacccaaattttccaagaaatgtcgctaattttttcaaaaaatccacaaatttttaatgaaaatctgctaaaaatggctcaaaatcacaaaatttggtcacttttttggacaaaatctgttaacaaaccgcatttaaaaccgcaaaaattttcccggcggcgccgcgcctatcggcaccgccggccccctgtccccaaaaattgttttggaaaaaccgcgccacataaaaaacgggtgtgaaaagcaaacaaaaaaaaaaggtcgtcgcccggggggaggtgccccccccccaagccaaaatcctgggaacgtccctgattcctacatgacgctttttcagatatttggaggcttgtcgtcgtcgggttgtggacgacttgcgcctcgtcagaacgtcgctttctgcgtgttttccacccgagtacaacatttacgatcgatacgtcaaatattatcatgacagtatatcacttcatgtaaaaatggtatttttaaacccaattttttaaattgaattttagatcaagaaattagcttccgatgcgcttgaaaagaatgaacttgtgcaattgctcagttggatccaaagctatacgtgagtgagattacttttgacaatttacattaaaccggacacgccgaagttcttggataataatcggaattgttgatgaaatttttttattttctgagatttctttgtcattatcttgtagttttttaaatttataaaattgccttttcttctcgtacgaattggtccctcttcattctatgatttacaacataattttagaggggagcaaatgttgggccatcccaaattgggaatccaagcgcaagcacttgtccacgagtttccattgctacccaaatcgaccaccaatcatttgcacgaccgattcatcgaaatgactcggagagatatgcacgaatggctggacaagacaatgatgcaggaaaaagacgtagtgaaaaaaaaaatctgtggtttaatttctgtatttttaggattggtataaacaggtgccacccgagacggacagcaacaaattcttttacactcagttgcccagcattttatttggaatggtcgaggatacggtgagttcgctgttcgtttttgagtttaattccgcgtaattttaaggtgtctctttccaaagaaatttcccaagaaattgttccgcgagtgattgatgttgccgtcgatgagtttattattttttcaaacaaatacaaagaggcggcaacggcgtacaaaggcaaacactttgaggatcggtcgcatttccaaagttacacttcgacagtggtgggcattggcattgattaaaactcactaattgtagaataaaagtgcagattgcaattgccaataatttggacatttgtgtggactccactgacaaactcgaaaagcacattcgtcttaccatggaaagcggctccatcgacggcctttcctcgcccgaaccgaccattgcctatggccccccttcagcacgttccgtcggattttctgtgattaatcgccaggagttgattggaaaaatggagcagctgaagaaaaaatggcaatttggcattcaatttgcgtaagtcgtaaaatttgtcaatttttatatgcaaatgtgattaattaatgaaagtgtatcagcattgcttgaagaagtggtggaggatgttcaaaagcatatggagcagttgatgactctgatctatggcgaagtcattctcggaaattaagcagttttaaaagttaaatagaaatggcgcgttt

SEQ ID NO: 24486 - DNA, 1411 bp, Heterodera glycines
  misc_feature (1295)..(1295): n is a, c, g, or t
  misc_feature (1341)..(1341): n is a, c, g, or t
  misc_feature (1395)..(1395): n is a, c, g, or t
ttaggcccgaaatttttgaatggaatttgattgaaataagagaattcaacaaaggtatgccaatactattcctctcgtccgttttgatgttcttcagaacagaaaagactgattcacaaaacgcattagaagggaaaattgacagaattgcagagactatgtaaaaatcaccccaaattcatcactcgagacagaaacggctaaatctgaaattgcttcctcagcgctggaaatttgagttgaagatgattgttgaaatgtaactttggaaatgaaatcagaaatagatttttgggacattctgcagactagaaaatgaagatcaaaaatgaataaaataaacctgaacattaacgaaaactatatttggctcttaattttggcaaaatattgagttggccagacggagttggccagacggagttggccagacggagttggcccgttccgcatttggcatactttttaatttttttacatttaactttgatttgttgagaagtgatcgatcaatttagaattatggaattattggcatactcataaaaattgttcttttactgttattggaatgatcaacttgtgttttttttctctattattagaacttgcaaaaaactgattttgaaaaataaagcgattctctttgggttgccgttgtacgccaaaaggtgcgaatcaaaatttacgctttcaaggagtttaataaatccattaggattaagtaaatcgtccaattctgggtatgccaaacggtcaagtttgggggattcttttgtggcctgatcatttttcgataaatacgtcttatttttctctgatcattatttatcttttccttgaccaattcttccggtagttttggcaattctaaaccttacccatccgatcattttcatttttccctgctgatcagtgttaatttttgtaagagatgacccgtgaaaatatggttagtttatttgagtaattattaaaatataggcaattagcaaaaattttcccttttatttatgccgatgaaattgcctcgtacctcattaaaagccccccagagatgagataagagcatgggattattttattgtagttggagtaaatcttttcgatgacaattttaccatccaaaaattgtggcccaccaaaaaatgcccgttgaattcgtctttaagttgtgaaataaaacaattgcatttaaaccatcatattagtaatgttaaattatgctttttaatgttttgaccaaattaggtttttaataactacaaaaatcaacagcaagtaattaaaacaanattgaaacattagcggacggcacttttgcattaacgccgccgcttnttcagccaatctatgtgtttttggctaagtaagtctgaaaaacgtatacgctgntgtcccccaatgatca

SEQ ID NO: 24487 - DNA, 2032 bp, Heterodera glycines
  misc_feature (41)..(41): n is a, c, g, or t
  misc_feature (78)..(80): n is a, c, g, or t
  misc_feature (82)..(82): n is a, c, g, or t
  misc_feature (122)..(122): n is a, c, g, or t
  misc_feature (134)..(134): n is a, c, g, or t
  misc_feature (1950)..(1950): n is a, c, g, or t
  misc_feature (1978)..(1978): n is a, c, g, or t
  misc_feature (1990)..(1990): n is a, c, g, or t
ttttgggaagtgtcattcatttgtggctttccaaacgtatncgctgagggaatggcacattcgggacaaaatatgccnnnancaatgccaattgggtggcactttcaaaatgcgcagggttntattttatgttntattttattattttgaatattcatttcagacttctgaatcgttttgcatgtttctgctccaaaacagcgtcaacaaaatgctattttctgctgaaaagctccaaattcgcactgattttcctcgtggtttcgagaaacagtacgccattcttggccaaataatgagggtattaattaattaattcaaaaactaaaatttttccggttttcatttatttttagaatgctctccacgtcgattccgaaaagagaacttttgacggaaatggacaattgctgaaattggctgccaacttaatctcccattaattaacaataaatattgcttttatagtaacttagtcatcataatttgtttagacaatttaattctgaagaaatgttcgtgtttaatgctaatatttatccatccttcaaaaaaacgaaataaattcaatgtatttcaaataaaaatgtaaaatatgcattttaattttgctttcaatcacttctttttcctttccttttatttctttagtgcagcaattaacctgagcagctgacacctgcaattaaattctgtcttaattagccaaattagcaaaaaaaaaaattgccgttgctttgcttcttgtagtaagcttggatcagttttcctgaagttgtccagtaggaagacgaaccgacctaaacaaaatttacaaaaatttagcattttccatttcgaggaatgcaatttgccaacacagacagtctcggccattggttaccgttttttgaaattcacaattcatttttcctcacattgctcgccgatgcgctggtggtcaatgccgaacacgactcgcccttgttacagacggaccagttacaataggagattttgtagccgtccaagaaggaccaccatgcgctcatggagctggtcgcaattgtgccgtcgccggacgattcgcacgcgccgtactcagtcacaaaaatgggcagacctgacaattagtgcaaatattcatttttaaaccaattatgaccccaaaaaccactttttgtgtaggcagtcttgagttttgccccgaggccagaaactgtgtgagtgccggcgtaaaagtggaaagtgtacctttgtggaatgtgtcaaaaaagattaactaatgaaatcccaaaatatatcacatcgtagcatttacaattctattcacattaaattcgagtagccactaattggattggcagcggcaacgtccacgtcctttcaaatgttcgttttacaataaattgtatgcaattattgtttatttttacttgtgaccagttgggtgtgcccagaatgatcacattctttgtgtcatatttacgaattgcagcaattacctgcaacacataagcatcaattaattagctaatttgcacaaaatattactattttttacttttttgtggtatgggacaagatcacttgtccacgacaatgccaaaggctcgttgtacgtctcgtaaaggatgtgcgggtaactgccatatgctttggcgatttttgtaaagaaagcaacctcaaaaatatattaataaaattttattattattattattattatattttaaattttaatattaattttccaatttatcttaccgcttgtgttgtgtacgtcgcgctaacatgccaatcaacaatcacgtacatgcctaagctgatcgcagcttcaatcaccgtggtgaccaacttgtattgggtgctttcggtggtaaggtagccgccctggtcaacgcccatcgcggcgcggacgacattggcattccaggtacatttgagtgcctaattgattgagtagaatanatgatttagagcctgaattaattccttnatttgagtattnattaacttgaacagcctaattagtttaatggatttaattaat

SEQ ID NO: 24488 - DNA, 1574 bp, Heterodera glycines
  misc_feature (16)..(16): n is a, c, g, or t
agaacaacttcgaaancagtgccaaatgtacgttgaagtgacctctgcacagacgatgctgagtttttccggaacaacgatgaacaattggaagacgattttgttggggactttgggcgaagtcggtttttggcaggaaaaggattaattgtttttttttgtagtcaacacgaacaattatcagcagccatttcgacggcgcagaagagaggcgacttcggcaattcgcaacaaatacaaataaagaacagaagattaattggataattatttaaatcaactttttgtgtttgaaagtttttctttgacttctgatgtctaaatgttattttctttaaaattcaccgcaatttatttgctgattaaaattggtttgttccataaatatccatataaatgtgaatgcttgaaatagtcgctgcttaaaatctttgttttagatgatggccaacataaatgaagataatacggagtctgaattggtgtccattttgccatcacttggaccgttcgactcgtcttttggcattttgtctgattgttgttatggtcaactgatcctgcttgggttcgtttaaatggtctatggaacgaatgcatttaaaaatttatttaattatctttacgcgtattttatttgtcctttttgggtcaatagtagttcgtataatggcagttcgtacaataggatggatgtccgtacaatgtattgttattttgatgaaaagtatgtgtcactatcggaacccgttagtttgaccttcacggttcggccccagcacttcttcccactatagctttttatttttttattgagaaaaattgaaaatttcgactttttttcttgtgtaacttttttggtaattgtctaatctcggagcaatagcttagaaaaagcttctaaacatgttaagctttcaaataataccaacaatgttggatttgcttgataacgaaaaaagttatagccagaaacttgggctcgtacgaaaccgaccccgacctggggccgaaccgtgggggctaaactgacgtagactggtcactatatcacatatcttttaaaatttgattattgtacgaaacgccaaattgaaacattgtacgaactgcctttgtacgaactgcccattgtacgaactgccatgaccccgtcctttttggttaaaggtacggcggtgtctccgaaacatacagtaaccaccggagcactacgaacggtaatttatcaccaaaaaagcgaaaaatattattggcagccacagactcttcaggtcgaaaacattttgtcaaaatgtttttcaaacgacggaaggaaccaaatggaattcgaaaggggtcggcgatgacattgagcagaggagcgaacgaagcgccggcagtaaaggacgccacacggcacaccgtttcatattcatacggaaaatcgggcacagtactggtggaatatttgcctgactcgagtcgcgacatgtttcaagtgggcccatggggggagaacggagagagtaaaccaaagaatggacaatcatttcgccaaatgtcctctttgaggagggatatttactaaataa

SEQ ID NO: 24489 - DNA, 350 bp, Heterodera glycines
tataataacgctgcggacatctacatttttgaattgaccataattggtaattactctttctttttctccatattgaccatcatactcatactccccccacccttttcttcttccgccacccacctcccccgctacgcgccgctcccctcccctttgtgctcctctcggagccgatgaatagggcgaggaaatgggcctaagaggacgctactcctccgatccttcagagacacgtgacctttcttctcttgatagttcaaactgaaggcgggaaacgacgatctgatccccatcaagctagagttcggcagggcctgctcgagcggccgcccggggatcgatccccgatc

SEQ ID NO: 24490 - DNA, 877 bp, Heterodera glycines
gtcctggtgtaacccaacattttgcgctaaatgtccaaggtgcaatttgtcctagacacgccgtcaatagacagacattttgtcaacaaaaaaaattttttttttgatcaatgatcaaaaatttcaaaaatatttgttccaatgaaaaatccaagaatttattatatttcgaaaaaaaaattgcaaagatttttatgtacattgatggtaatgcctgttgaatttgtaaatttgataacaaaaattctttaaaatttcatttccgctgtcctaaaaattaaaaaaaaaattcgcttttcccaacaaaattccatcaattttgcatatgtgtacacatagttagttaatcatcatcatcatttccatttcgcttatcagcagcagcagcagtggtttgttgttgactttgttgggtacgttcgttgtgtttattgctcattcattttccgtccattttcccatttcccccccattagtaatgggtgaaaatgtaaaaacccttcccccccccctttttacggctgatttcaaattgcgataattgaattaaattaatttaaattggataaattgaaaaacaaaatttttcactcatcgctcacaaattttcgccacattgagtagacgactctcacttctctttgttcatttcttcaatttttttgtaacctttttcctttgatataattttgtgaatttcacctttttataaatatacagtatgctacaaaagtataagctaaagagcaggcatactgtaagtgttgaaattctaaaaactgcttaaatataaaaaattcgtacttttctgatttttccaagattagtgtctctatttttaggcccattttcccatattttttattggtgttttttt

SEQ ID NO: 24491 - DNA, 2384 bp, Heterodera glycines
aactcgttttgcatagtccccaaatttaccaaaataaaattttaattttcccattacggtacttatttatttttgaactggttttttaacaattcaataaattttttttaacttttgggaaagtattaaaacccaatacgaattcactgatcggaaagtacagaaaattggcagagagtgcatgtgtggaaactgattgttaaatcgttaccaaaaaggataaaattgacaagtgaattgtggtcagagtgatcacgatcaagagaaaaacagtaaaaattgtgcggaaaagtgagtgtgcccgttggattgtgagtaatcacggcattatttggcaaacaaattggtgttagacagagagtgtaccgtcccgactgatcagagagtgatcagggtttatcatacaaaagaggccgagagggcgatacaatacataactttggcttaacatattactaaccaaaatcaaaatacatcacactcctgactacctcgaaaggcgtttcaagcataagccaataagcgaccttgagcgggaaagacgtaagcttgagagagaccgaaaaagaaaaagtggaaaaaacttaggagaaaaccgaaatatggccgatgatgatttagaagataaatatgtggcattaaaggcaaaggtccaagacttagaggatcgcttggccaatcgggtcccgaattatcttccccctggagttaaaatcccgaaatatgatgcgagcggtgattttttcaagtttttaaaggaatttaatgtgcttgcgacagcgagcaactggcatccgccggattgtgtccgctttttacctctgtttttggaaggggaagctaaggaaatttaccagaatatttcggcagataagaaaacaaattggaggacccttaccagtgaaatagcggaactgaccaagaaacttgatggaccaatgtgggcgagaaaaatgctgaataagacgaaaatgggaataaatggatcagtaactgagtttgcgaataaaattcgtgagttagttgagcaggcaagcccggacccgaactatacagttgaggcaagagaaagtgagagcgtacactattttttgaatggattaccaaccaaactaaaacggaaattattttttatggaaaagcccgatagtttaattgaggcaattgcgcaagcaaaaaaagttatccaagtgaatgaggaaattgagaaagatgaaaaaggggatgaaatgaaacaataaatagctgagctaacggaacaagtcaatgcaatttcgttccagaataaagtgaataatgagagaaatgatcgagaaaatggtcgtgaatttgtgaattcagcatggagaagggacgacagaaactcaggaaaaggaaatttcagaggaaatagaggaaataattggagaggcaaccaaaattcttttagaggcagacaatttggaggatacgtgcaaaggaatccaaattttattccattgggacaaaatcggacttggaatgggaattttggaaataatacggggagatttgagaatttccgacctcaaaggggaaattttgggaatttccgagggaattcaagaggaagaggaagtgaaaggcaaaaatacaaaataaatgcgatttcggatgaggcggctcagccttcggtatccaactctcgaaggtccctgaccccgacaatgacatttttgacaatttcaatgtttctgtgctcatttttcgggactatttctggtcaataccaattatgttctgatcgagttcccaccacacccatttggttaccaaacgtaacagaatgttcagtaccggagtaccaaaaagctgacgagagaaaagttacactctttttaccggtccaaatcccaaagcaattcccagtttataactgctatcagaaaatgatgaaaatttgtacgggaaattttctttttttctggaaagacataaaaagtcaggattcgtacgtgaagggagtaagtcaccgagcttgtcagggatttaaagataacatgggacatacaatgaagagattgacagagaatttatggacaactgagaggccttcaaaagttgaatatgcatggattggtgaaagatgtgagacaacagtgaatgatttcattgaaaaaggacaaggcggtattctggatttttatttggtaacatcgtttggacataactttaatccgtacaacggatgggaagaaggacaaaaatggacatttatttgggaaattccggaaccaagtgaggcttattgggcaactcatttcccggtcggtgattttgtggcagaagtaacggagaacgcaattgtgttagaaagcgaacaaagcgtgttttattttgaaaaagaaaagggcgatgaaagagag

SEQ ID NO: 24492 - DNA, 2034 bp, Heterodera glycines
cctccgactgtctggccccgttaaggttggactatagtaaagtttttataaaaattgttcttggcaatgccaaattctttccgttttcgtacgaattctgctttttagcatgcaagcattgccagctgagcccgagtctttgatggtgatggaaacgtcgagcgaggagacgggcacgacgagcattgtccacctgaacattgggctgcagaatggctgtctgctgaggacaacattggaccagggcaagcaaagggcgggggtggggatgggaggttgaccaattaatggttgaactttttagtgaccggcgatttgacggacaatcggacgaggtatttgggcactaagccggtgaagctgttccgtgtcagcattcagaagagagaggcggtgagttttcgatgggggaatcctaaagttacgtgaaaaagggttctgacttttcggaaaatggggaagggactagcgataattaagccactgatccgaaaagctttgaaaattcatcttaattttgtaaattattttctaatgaattttacgaaactcacaatcaatcgaatattttatcaacaaatcgtcattgcaaaaatgaactttaattttgctaaaatgttttttgcttaccattagctcttcgcctgctccagccgtgcctggctgttctacagttaccagagccgtttccacctgactccgctcagttacagttcgctcgagtacgcttcgagtttctcttccgagcaatgccccgagggtattgtggcaatttcagaaaacactctcaggtttttttctgtaactattttttggtattgcccattacatttttttagaattttggcgctggaaaaacttggcgttgtgttcaatcaggtggtgcacaaactcaaatacacgccacggaaggcgattgtgcacgccccgtcacaaaacatggtcatcatcgaaacggaccacgcggcattcactgagaaggccaaacggcgaaggcgcgaggaaatggccaatgttggcattttcaatgacaataatagcaatgttgttgtaactgattctaccctatccttaggacctaattgaaatggcaaaggattcggaggagaaagcgcttgcagaagaaatggcacattcgctgcgcaattatgagccggacgaatccatttttggcgctcctcgggcacaatacggtgaattctttgacagactgacattttggcacttcattttcactacttttttttaggaaaatgggcttctgcagttcgtttgttggtcccaaagacgggccaaacactttgccaatacgaattgcccgagggagaggcggcattttggtattttttacataatgccaaaataacttttattcaattatagcattgaactggtccaattccgttctcaatccgactccacctttgtgcttgtcggctgtgccgttgggttggagttgcgaccaaaacggtcccacgggggttgtgtttacacctttttactcaccgccaatgggactcgattcgaatttattcatcggacggcaacgagtgcggtaagtttttagatttaaatattacatttacattaattgaagaaaactgcttttggctataggaagtgtacgcaatccacgactttcgcggcatggcgttgatcggagttggcaatttggtgcgcatgtacgactttggcaagaagaaactactggccaaatgtgaaaatcgggtacattttgaataaataattacagaaaaagtaaagcaaatttatatgcccaaaactttttgcgctttggaatgtgaattcataaggctgaaattggcaatagacaaaaaatcaaaatgaaatcaaatccaacaaaaataggaataaaaatgtatgggcattctgttgccagtgttctgacaatgagtgagttgagttttttgtgtgttttggctgagatcgttcggcttggctttttgttattagccctcttccgattgttccccgggctggcgcctgaccatcgcgtcgttgccaattcgcagt

SEQ ID NO: 24493 - DNA, 885 bp, Heterodera glycines
gggggggggggggtggttttttttttttttttcctcctccccctccctccccccccccccccccttttttttttttttttttttgggtggggggggggggggggcggcccccccccccccccttttttgaaggagggggggggggggggggccttctaagaaaagaaaaacacccccccccccccccccccccccccccccccccttttttttttgtgggtgggggggggcgcccccccccacccaaaaacacccccccccctttttttttttttttttttttttcccccccccccccacaaaaaaaaaaaaaaaaacttttttttttttttttttttttttttttttttggggggggggggggggtttttttttttttttttttttttttttttttttttgggggggggggggaggaggtaggggggggagaaaaaaacaaaagggggcggggggggtggtggtgtttttttttttttttttttttttttttttttttttaaacaaaaaaaaaagggggggggcgggggggggggggggcgggggggcggggtgggggttttttatttataaaaaataaaaacaccccctcttttttttttttttttttttcttttttttttttttttttttggtggggggggggggggggcggcggcgcggcgcccacaaaaaataaaaaaagaagggagaagagggggggtggtttttttttttttttttttttttttttttttttttatgtttttttttttttttgtttaaatatacatctaaatctatgtggggggggggggggtggggggggtgttgttttttttgttttttttttttttttttttttttgtgtttttttttttttgttgtttgtttttttttgttttt

SEQ ID NO: 24494 - DNA, 1532 bp, Heterodera glycines
ttttgggcaccagggtttttctgggcctagattcttctagcattgtatttcaaattacgaaaaaatgattaaataaattaaaaaaaataaatcactaaattattctcaataatatttttaaattactttatgaatgcttccgaatatgtttgatcaatttgcattccaatgttcatttttatgctgctgatcggctcaaagtcatcgctgtttgacagtttctcaagcacaaattttaaatgatcagatgagcgactgatcaattggcaatgatatttgaaaaaggttttatcgtcctgatttagagcctcctccattttgtccatctccgttttttccagttcaattttttcaacttttccaccacaagcggcagcagttttttgttgaattttatttagttttttcttgtttttctcttttttatttaggtatttgtgcttggcaagttcctcatcaatttttattttcaaattttcaatttcatttttgtacaaatttttgatttcggttggcatttcgtcaagaaattctttgacaaccgaaaaaaatgccttggcatcattatcaatgacaatccaatgacgcatataaattttcacaaatttttcttttcgtctcaacaaaaaatagatttgttcaagcagttctgcattttgttgagggtgcgcaatttttggtcttttattgcttgtacttggctaaaaaatattttaaaattattaattaaaattaatttctgacgaaaaaaaaatttgcgcatttattaaaaatgacttagtgaaaggatttaatttttttttaatttaaaattataaattccataatttagagcaatgttttttagatcaaagcagcagaaaaaatatttaaaaaatctcagcccctagtaatcatgatatttgagagaatttcgtaaaaaaaaaccctaagaggttgccaaattggattggtgttaaaattagggttgaccccccgactagggtgggggggggagaacttcggcttcgaaaacttcgcatttttgtacatcgagcttcggcttccgataaattaaccgaagttttaggaacacccttattacagagttttcatattgaaaaaccggcgtaaagagcgcttttaatgtgaatgacttttgttttcattttttttttttttgaaattttattctgaaacagcttgccaaaaacggggtagaggagcaggtacaaaaatgtcgggaaccggacggacgctcgagctcgaggaccaacccttgttcaattcatacatacattaacaattaaaaaaatgaatttcgtccatttttcaataaaaaaatctattaaaaaaaatccgtttttggcatcgagctatggtaatctggggagataaatgttttctgtggtggtaagcttgttctacaagggatggcttaatcctttttttcctagaataattttcatcccctaaagtttcgaaaatcatcacgatttttaggcgtttcctaaatgccattaaatgatcaatcgaatcaacatggtgatgat

SEQ ID NO: 24495 - DNA, 2041 bp, Heterodera glycines
attaattttcagcgaacttattactaagtgatcaatgattaactgaattttcaaactttttcgttttttaactcacttagcaacgatttttggtccatccatttgaccgggttcacatttttgtacttggcaaacactttggcatcttcatcagacaattcaactttccatataaattcatagttcggaaaatgggcaaatgcttccaaaaatgccattttcatttcccttttcattgagttaatatcggcaaatgtgccgaaggaaacgatcactgcgccatccctggaattgtccacgatacttttttttcttatgatttttaaaattgaatatatgaaaacattgaaattatcgaaatagaccttctctattttctaaattataattaaccaaattgattaaattaattaattaaatgtcttccccctttgttggcacattcctcatttgtcacgtaactgctcagcgttgggatgccaaagggacggacaaccgtttgatacaacggcaccgctaaagtgccaagttttgttttggcgccaattcgatggaaaagtgccgagggacactggttgtaaagttcgcaagtacaacatcaaattattctgcttgaagacggcggagcaactcatcgtcatttacgagttcgaaaagtggtggaaaggaacaattaaattactaatttaattaaataattagtattgccactaattacctcggcaaatttcgcttgtaattttagcaaattgttcgtttaatttctataatttttatttaattacaatttagcttttccaaggcttaacacaaaaataaaagttaaaaaattactgtatgattcattaatcatttacttctcacgcgggatcattcataatttagggttcagcgttctttagcctatagacttgatctaccggcaaaatcttccacaatttatttcccggcccaagtaaccattatttaaaaaaaaaacttaaattttttacgaaattgctactgtataaacaggctccgaattgcggagattcaagaataattactaaattatttatcaataaaaatgagaaaatgcaatatttgattcggtaaaaataccttacttatatttcacacatgttaatttttttcaataaattaccgaaataataatttgagactccattttaagcataaatatctgtgccgaactctgatgatgtcgtcaattttttgatgaattaccggttttgtgccgattactaaatcaatcattttattgtttctgtcaattcatcggatttagacaaatatgttaataatttgaaattatggaaaaatttattgcaaaattttgacaaacggagtttaattgtgcattgattgtttaaattaattaacataattaatattaaatttaaatatttaaaaagagaattttttttattcgtttaattttaaaaatggtataaaaatccgatgaaattaatttaaaaaattattattttcacttttccttctttgcccattttgcacttttctttttttttgctttgtatttgccggtgttcaatattcaaaaaatcatttttgtattcgttaattttaattaaaaaatttttgactgtctgaaaataaaaatgcctatagaaattttcgttccttcgttgttcaatttaaatttcaaaatatattgcttattcatcatttttaatttataattaaaaatatgaaaatccgtctcgtatttaagcggtgaaaaaataaaactattttatttttcattgaaaaactgggccttcctaaccattggggaggttagtgaaaattttaatttttaaatgtttttatgcttttatttcgatcccatagagccctaaatactgtgatatgtgagcattcatccgaaatcattaaaaaagcaaaacaaccaagcactttttccgataagacaagctttcatgtgccattttaaggatgtccttggaaaaagcatttctttactgagttttttgttgcgacggctttttcgtcatttgaataaattttgaaataaaat

SEQ ID NO: 24496 - DNA, 1176 bp, Heterodera glycines
taatattcggcgaaacaatgcgcaattccttcgggattgcatatggtaacagatgtttgtaatcaatcgataattttcgacgccttttcaaaatttccttaatagggtatatcattcctttctccgtctataagcaatccctaaaagcattcattcgttcacattcatttcctacacactaaaaattcccaaaatgaacaagcgcttgccgaatgagcttatttgggaaattgttgctgcaattccgataatgtacattttcggaggtgttgcaaaaaagccaggtaattttttaaaagtatttttaaaaaattcaaaattaaaggagctacgcgtccaccatctggcatcaccgttgtcaaccgggcgttcgagattttccgttccaagcgccatttttacttcttaaaaatagttggtaatatttaaaataacaataaatctaaatttttagatcgatcttgctcgaaattttgagaggctctgcgcactgaggaagttaccgtgcggagaattgttcatacagttcggcttcattcaatttggattcgaaaatgaactggaagacgccaagtgtttcgccgactttttggtgtacctatattatggacgatctggccctaccgttacgacgagagtcgtgacttactcggcggtaagaaaaaaatataataataatattaatattatttagccgattaaaattggagagctattcggtgccattctgacgcatgtgttgggaagcgcaaatccgctgaccatgaagaagcggactgcaggcggttatttgctgcgtcaacactttccgcggcttctccaactctcggcaacagaaatggcatcaggtggcattggtcaactggtccgctccgatgggatggaaatgtaccggctgatgaatccgcaccacaaaggagatgttggtcaattgattattattgaaacgtctcaacaccccggctcgtactattttaatttttcaatcgaataagtgttttttgtaattgaataaacgatttaaaacttataaaattttgtttatttattaattattttattaaatatgagcatcgcgtacatatcgggacacgtactggtattaagcaaattaagaaatcggtcaaatgaatgtcctagcgaaaggggtaaaggaacacaatacaatgggcgcca

SEQ ID NO: 24497 - DNA, 1755 bp, Heterodera glycines
agggggggggaaagattgagtcgagacgagagaggaagagacgacgagggaaaggggtggggacaaatacaaattcaaaaaaaagtgtaatcaaatcaaatttgaactttatagcctcattgcgcgcaaaggagcggcgagaaatcgagcgactagaggaggaggagcgagagcggcagcgacaggacgaggagagacgagagagggaaaggcgcgagagggagcgactggaggcgatggaacgcgagcggcagcgacaattagaaggtcttaactcgacaatggcggaaaaagctcttacataaatcactgtagaacagcgcgaacgcgaccgaatcgctgctctcgaggcgtccgccattgaaaggcgagcgctccgtgcgcgtgaagagcagcgggcgcgggagcgcgcggatttggacagacgcgcggaagagttgcgggagcaggaaaagcgtgaacgcgagcgcagggatcgcgaacgggcagaagaggagcgacggctggccgaactccgtgaggcggaacagcgcaatgcggggcaacgcgaaagggagcggcgcgaggcacaggagcgcgaggagcgtcgtcgaaatgagggctggcgcagtcgcgaccgcttggagcaattggcacgcgagcgggacgagcgagagcgctgggaggcggagaagcggcgattgctggtgcggcattccgcccaatggcacataatgcataatcaccattccttcagtctgactacgagcagggagcccgcaagcggcaagaactgacttccaaagagacgcttgagcgtctgacgcgcaagccatactattcgcgcgaaaatctgacccaactcggcacgggcggagagccgactgagtaccgcggcaaaggcattgagccgccggaattcaccacgaaggtcggcgaagcttcgtcttggcacttaccatttgtccattctgtgccaggtagaacgacaagtgatcgaacgcgtcgaccgcactttgtggacagagccggagacgacgcgcgtctccgccggattgcctccggcgagctccgcctatttcggcaacaccggcggcatttttccgtctctgttggacgcatcggaagaaagcacgcgcgagcgcatgtacaacccacgcgacgaggactttctgcgccgcgggggttcacaacggacgtcgaaataccgcgcacgaatggaaaaagcacggaaggattttctgcagggaacgggcggaggcgcggaacaatatcagccaagtgcaggtgaatgaatcgctggaaagcttttccctgccgaccgacacggcagtgaatgccgttcattcccccccccccctcacttttcccccgtttagaccccgtctcggaacgtttccgcaaatcgacggaagagttggcacggcgtcgcgtcgaataccgcgggccattgctgcaacgctttaacagtggcgaattcgctcacccgccaattgagccgcagcttacgcattacgcgaccggacttggccgcagtccctacgagcaggtgaccgacccccaggggaaaggggcctaacggagagaccatcagacaaaacacccctgggggggggggggaagggttatctctgctgctatctctattttacccttttgagttccttctctctctctccctctctctgtctcgttctcttcctttctctaactctttcccataccaatgattttatttctttccttcctttctttttcctttactttttgtccctt

SEQ ID NO: 24498 - DNA, 2022 bp, Heterodera glycines
  misc_feature (33)..(34): n is a, c, g, or t
  misc_feature (43)..(44): n is a, c, g, or t
gcaatcgttttctttttcagtgaaatcggtganngttaaaacnncaaaaattgtagccaatttggtctgaaatttttattttttgcacataacgatcgtccagtttcaacgaaaatctgttcgttgcactgtcaaaatgcagaaaacatgcagagtacgctgattggaaaacttttatccatgctgtcatgcctaattctttggtttgatcgagaatcttcctttcttcgtcatccatcagtgcaatttccgcattcaacttttctgttatcagtccctctaagtgttctaaattacggccacgtagacgcaaaaaatatttatcaagctttttctgatattcctcttcagtgtcatcccaattccgcagggggaccttgcttgttgctgcacgtttttctctctcaagtagaccaccactggttgctccgtaaaggtcaagcaacgtgtcaacccccgctaaaagggcgtttaataattgttcttcgttttcgtcatcatcatcatcatcatcatcattaacatttcttttgtctctttgttgttgttgttgtttattgatgtactcggctctgcccaattgacgtgctgtattggccgcttcagtgaattttttctgtacgccttccactttaactgcgaacggtttgttgccttcttcaagcagtttgtaaagacttttccaaagctcaacggggtttgtcacgttagaggatggaattggtatttgaacattctctccaattttccattcaatttgaacaaattggtcctctgttgtgccgagtgagggccacgaatgggggtatatgatcacacctaagcccacatcccattccgaattaaattgaagttttcttggtagtcgaactcgaaaagagtttgtgcgatttccttcaacatttgtgttggaaggaacgatcacatagaatgagtttgatgaaggcattctcatttgaaatttaaaaaaaaaagagcccctttatatatttttccatgtcatcgagcttgcaggaatccagctgttgtgccgttgactgtagcctttccatttcaccaaaacgtattcaacaccttgctttttcctctttcggacgaccttttcaatgtcatatagggtatcatcatcatcatcatcatcatcatcatttttgcgcactagcacacgacagagatcgttggcatagaaacggcccttgatcagggaaccgtcgtcatcacgtattcggtacgtgaccggaaaacggtcagtgtgcacttcggcaacagtgaacacttcgttggtgaagcgtccggtgtagcccttttggaacacgtgtttgtacttctcaatgcgcacacggtcacccaccttaaaacgtggttgtggttgtttccgttttgctgctgctgcttccgctgtcccaccaatagcgttctgcttgagttttttcctgagcttttcggcattctcaaaattcacatcaactgggcgcatttttatgcttgagttgtacgagtggtttattccatgcacaatttgctgtatcacatcaacccatttttgggtaccccgttccgtgaaatagcgataaaggcgttctttgatggttcggttggcccgctctgccatccctgcgtgaattcgcggcgaggtgtacataaaaaagtttttcacgttcttatatttggagcgtttaaaaaagcgttcaaaagcagcaaccatgtcggagctctttttgcttttctccggctcaacaaagagctgtctgctcagtgtgtcgatgcagataagaaggtacttgtagccgtgattctctcgcgacaatttgtcaaagacagacaggtctgcttgccattcggtgtgcagtccagaagcgagtgttggtagttgtttgtagcgcctcttcgcttgtctatgaatggtgtatgtgcgctgtgtggccaaatactcaacaacatcctttctactcatttgattgttcacctttttcgcctcgcgtaaaagcggctcaacgctggtaaagctgaccgatgagttaa

SEQ ID NO: 24499 - DNA, 1591 bp, Heterodera glycines
aaaaaagttaggtactaggaaactgaggggtggtcatccattggacgcctaaagtacaatagagccaacccgaaactcgggccaataggaaaaataagcggacatgcagtgtaaaacataccattcgcccagcattgtgtcaattagatttattgtgcgttggaatccagccttagccgttttgagttgagcggcaatggcactgtttcggtgtgaattgatcaatttaatttcgtcagccacaaaaaaagcatcaaattcgctctctgaaattttattgcagattggtaaaaattgaaaattttaaagtacgaaacttataaactgtttaaatgcgaaatggtttcaaaaacaaataatgaaattttttaccataccgtcttgcaatgcaaaacgagtccagaaacaaaaactcaatctaacagcccgaggattaaatcaaattacctttaatttgtgattcagtgcgaatcttggctaaagatatgtgcgtgaaggaagcagtcaggtaaacgtaaataacaaaaagtgctaacatgctgactggaggcggcgtgtgcaactgagttaaatgataaagattagttaaatataattatgctaatgtcttgtacattttgagaaattttttcgctttgatggccgttggggatgacgataacaaacaggccgggattgacgttatacaaatatattaagctaacggcataaaacctgttatgatactcaaaagctttaaacaaaattttagctttaactaatatttttttaaattgaattattgtgtgtaaaatcgtttaaatattatttaatgcaatgactaaaaaccgagaaaaaaaggcaaaattttggtgtataaatgattcattgcctaaccggatgaacatttacatttcaaatagcagcctttacagcagcaaaatgtcagttagtcaaaattaaaaagggtactaaaagaacaaaggttgggaaggagtccaaggtgggataatgttaactatgccggttaaaaaattgcttcgtggaaggggaaaacaaaaaaaaacagtacgatattccttttttccgatttgccttaaaattccattatttcgggaatcccgcagggacggtaggggcagttgcgtctgagccaagtttagggcattgaatcagaatttttgcagatttttatttataatttttacatgtctaggtatatctttatgatttttggaaattcgagcccatagtttattaacagatttcagcatttaggtttttgcctattttttctgagctcccaaggccttaaacacattttgaaaaacctatttttgcctatttggcgttatgtccaaaatttattaataaaaatgcaaaataacaaaaaagatacattcctctcctaagaagcccaagtttttttgccgaatcccgaataaatttaaatacttttttctgttccacagttaaaattaaaattaattatggatttcttgcgcctttttccatcttcgtcatcttcaactttgtcggcaacaaatgaacagtcacaaattgcgccatcacaacagttgctcttcagcgcttacagaaatttgggtcttct

SEQ ID NO: 24500 - DNA, 1803 bp, Heterodera glycines
gaatccggcatctatttcggccaattctgaaccccggaacccgaattcgaacaaaattcgaaagtccaaattttcgaatttagctattttatttcaaaacggcttaaatgatctcttattgcaggattgatggatttcagtttgttttcatatatttatttattaagccgattttgaacccaaaaatgctaattgcgaaatttgaactttcaaattttttttgagttcgggtccgaggttttcaattcagaagggtcttcttatagaattttacttttatactataatatttaaatctgccaattattttgaagatttgtatctctaatttctgaaactcaaaattttgggccttaaaaaatgttgactactaaaaaccgcgaaatttcaacatcctcaatttttaagacaaaaattttgagaagcaaggatggataaacaaaatttaaaaaaaacaaatgcgtcataatcttttgaaaaaaacgcgccgtaaaaaatgcaacagttggtattcaaaaaaatggaacaaaataattcaaaatgctaaaaaacatttagcaacaatgaaaaacatgaaaatgcacataataattggccttctcaaaaaccatttaatgtaccatatttctttatccacactttcagtggttccataacaaattgataatttaatagaaattttcagtcgctatttttggtaatttatcttccttaatttgtcttcattattataaatttttgccaaaaaaaaaatccgccattccaaaaaatgcaaaaaatcaggttcttctccggcaacttaattgccatgtcggaaaaatctctcaatttttagctaaattacaaaacattttcaagaacatttgccaatttgaaaccaattgttgggaacttatttttttgatttattcaattaacatttttaacttttataataaataaaatttataaataattggtttgaaaatttttctttaaaaataaaataggattatttatattattgaattataaaatattataaaaaattaacttaaaaaatagattaatttgtaattcaaaaatgatcaaataaattaaatgcctatttttgacctttacggacgatttacaaagtaatgactgacttatttgccaaaaaaggacaattggataaatcgaattgactaaatttgaattgtacaaataacacacaaaaaacttatcaaaccaataatataaactccttcaaaaaatcattttcccaaaattgaagcaaattcttttttccatctgagcaatgtgcgaagtccaattcccaattcagttgcaattattttatcattaatttttgaatttccttttttaattttaaatattgcttcatcttttgcaatttgtcctcatttgtgttatgctcttaaataatatttttttgtatattttcgaattaattaaaaaatcccttacttttataatattttgttgccaacatttctcttttccattttcgaaatgtcattgcagaaatgcccaattccttctgaaattctttctgtttgccttggccatataaacacttaagttcgtcaaatcgttgaacaaattctttctttttgtcctcgtaataatctttttcattttgtttttatttaaatttaattcatttttccatttctgtattagatgtagtcatgtgcctaataattttccaattttccacacaatttttgtcctatctttgttttgtaattttcctttttccttcaacttttctttaattgtttcaaattttaattgtttctcttttttgttgatcatttg

SEQ ID NO: 24501 - DNA, 1149 bp, Heterodera glycines
agtccaatcaattaccaacccgggtttttatacaataactttgttcatgtttgaacaaaccctatctttttggtatcattcgaaagcacaaaatctaacgaagctaaaatatataaaatcgcagcgttcaggcaattaccaaaaaagaattggttaattaagtaattgctgattattttcgtttgtaactttcttggaatgttagaattctcttgttttctcgtataattacattattcagactttgtgcattcgaatgataccaaaaagatagggtttgttcgaacatgaacaaagttattgtataaaaacccgggattgtcaattgattggactcataaaagtcgattggactcataaagtgcattagagcccaaaagacaactcgtattatacaaaataaagcttaagcgctattttccctaaactgttgcaaaaaaaaagaggatggacctattagcattgatctgagagatgtgctttattgttgttgttgattcaaaattccataaaaatctgtcctaaattgtgttttgcgatttttgaaacaaaaaatttgaaattctaaaatcgaatttataatgtgtataaatattatataatgaatagagaccgacttttgaggcatatgccttttttctgcgcactagtctatctatctatatattaattttgccgtgtgtgtcacaaagtaaacaaaaaatttaaataaagttttgacgcgattgactttatttggatggaagaaatgaagtgaaaaaacagagataatagagataagttgtattgtaagaaagagtgaagaagagagagagatgaagacagttaggaacaaagagtggagagtaaaggagagaaatgattagagaaacaggaaaaaagagagagaaagtatgggagtgaatgagacagagacaaataagagagagagagataaaaataagagaagcgagagagaggggggggggagagatagaaaagaggagagagagagagagatagaacagaggagagagagaagagaaagaaagagaggagagagagaaaagaggagggagagaagaggagagagagagagaaagaaaaaaggagagagatagaaaagaggaaagagagagagaagaggaagagaaaggagagagaaaaaga

SEQ ID NO: 24502 - DNA, 1510 bp, Heterodera glycines
caaaagggcgcggagcaccctttgaggccgcgaagcggtctaattaaaccttaaatataaaaaatgcgcggagcgcccttttcctgaggccgcgaagcggccaaatgagtccacaatatttagaagcgcaaagcgcccgtctgaggccgcgaagcggccgaatgcacttgctcatcacttaacaaacgcgcatgcactagcaacgaagtcctttgcgcgaagcgctcatgtcagcgcccgcccatatataccaaaagtatactgtctacaccgagcaaatactgtgcaaagcatactgtctacaccgagcaaccactgcgccacacgctagtttatatatatatagaataatgttgcagttcgtagaaaaaattataagtccccgtggtttgctcggagggggctgaaattttgcaggcaggggtaacttttgattgcgcatctgggaaaaataaggaaattccggtccggaagccaactgagcgccagcggcgctgaaacggccaactttgaaaaacgagctcggttttcgggctgtaacttttctcagggaaccgggagcggaaaaagtctgctgagagggcacaccccagacatgttggctacaactttgtcattgatcactttttgatcagatcaaatgccgagcctgtagaaattggcgactgaacggcgctcaaaatgccggttttggcttttcgtgaataactcgctgggggttaagcggagcgggttggcgccgcttgagcatttgtgtagtttttaaagctgcatccgatggcgttttcagattttgaaaattttcaaaatttttcgagctaggccccctcgaaaatttttcgtttttgaattttattattttttgccgatttttcccaggaaaacggagaccactttcaagcaaccgtttttcgagctctatcgattggtggcatttttgaaaaaatttcaaaattttccggaaatagaaaaattttccggaactgagctccccatttccgttcaaggcttataactcgtcaggcgttgattttagcggaaatttgtcttagagcatttttgtagagaattttaagctctatcttatgtgctttatctcatgtttttaccatgagtttaaaaaaagttataaaattaattgtgattttgaaactcaaaaccataggggggaccccatggttttgcatttcatgaaaaaattttttactcttaaattagccaaaatgcatttttatggcataattttaggtgctgaatacgtatatacgctttattttgcgtttcagatttttttgaaggtgtttaaaattttttgaaaaatcgtcaaaatttgagccccggaaaatccagtgaaatttcgaaaattcataactcaatgaaggactgctcaatttaagtgaattaaagctataaaaatagagaaaaattgggagaattttatgggatttatttgggacttctatcttccaaaataaaaaagttattccagaatttctggaaaaattcgatt

SEQ ID NO: 24503 - DNA, 1466 bp, Heterodera glycines
ggggggggggtcgcaaattttggaaattttcttaacaattcattaaaaatccaaaaaaaaatttcccggtggcgcctagcggcaccgccgaaccccaaaaatctcatttttcttaaaaaattggcttaaaatcgaaaaaattggccatttttttgacaaaatttgttaacaaatcgcattaaaaatgtcaaagttttcccggcggcgcctatcggcaccgccggcgccccccccgttctccaaaatttttttttttggaaaaaccgcgccgaaaaaaaggtttttttggccgacccccccccccacctttttttatgtatgttattcattaaaattattttttgattaattagttttattatttaattaaaaattcattgaataattaattaattaattaaaatttgaaaataataaatcaaaacttcgaaaatgcgaatcgtttaattaacggattattagtaagcaccaatttctttgctgtggaacaaagtccggcgggcattggcacattcgttggacgcacgtggcaccgccgtcacaaaagtcgcgcgccccgcagggccggcccgggttcacaattgggttggcaacttacaaattagttattagatagatcaaattaaatctcgattttaatttcaaaagtgaaattttgtaaaaaaaattaatttaataaaagctaataaagaataattttttagaatttaaaaacagacaaaataattattttgttaaaattttatttaaaaaaaaaaattttgcataattattttaaattaaattttttttaatattatttaattaatttctttttaaattcactggaataaatattttttttatataaaaatctttttgattattacaaaaaaatattatttaagaaaaaaaaagattaaatatttattatttcgaaaaattttatatgtttttttgcttatttttaaaatattaatttatataaattatttttcaaatttgactcgaaagacatattaatttttaaattaaaatattttgattatgcatttaattgctttttctgtttaacttattaaatttaattttcatttcctaacaattaaaaaataatagttaaaaaggccaattattattaatttttttttaattttaaaatttttcacttttatttttttggatgcaaattgatgtgccagcttgcacaaattcgtccaaacatcggcaaatgccgtcccggcactgcgcatttccgttggcacacggtgcgccctcctcggcacacggtaggcccaactctcgggccatcgccgatggtactgtattcctattgttgttgttggcatcggcattctgttgcattagcacggcgtcatttggtgacgacgattttttgctgttttaaaatttggcgctgaacagaaaattgtgcataatacaattaagggcagaaattttcgcagttacagtatacctatgaaaat

SEQ ID NO: 24504 - DNA, 1398 bp, Heterodera glycines
aaaaaaatcgcttcgataaacagtcgtccatgtgccgtgccgattctccagccccacctgatgagcgcggacgaccaattcgatgttgagctttttgcaaacactggcgacgacatcggcaccgaacaggatgctcactccacgcgggttgggtgccgtgccttccacagcggttgatggatcagcccacagcaggtcgagctccagggacggaactggcgggtcgatgtacggacggcgcagcatgcggagttgctgaatgttggtcatctccggcgcgattccaccatgcatgccttaaaaaagggtggggggattagagttcgtccgatcgatcagacagccgatcaacggcaaaaaactcacacagaatacagtcgctgaccaatccgacgaacggaagccaggcgaatgtcatgttgaaccgctcccacagaggccgcacattgtggtgtccataacgctcgtttatttcgtcatagaacccatatctgaaaatgggggaaaattttttgttttttgctgaaattgagagttaaaatgtgacacatgggacggcaccacagcactcacgttctgttgatgctggcacattcgtggttgccgcgcagtacatagaatttggttgggtagcgcaccttaaaattgggggggggggaggtaaattggccctgcaaaatgatcaaattctccctcccgcggcacggcatttccacccaccttgtagagcagcagcaggacaatcgtctccacactttgattgccacggtcgaccatgtcacccaggaacatgtatttggtgaacgacgggtagcccatcttgttgaaaatcctcttcaagtcctcaaattggccatggatgtcgccgcacatgaccagcggtggtttcgtctcgacaagtgatccctgttcccgcagcacatggctggcttcctcgcacagttgacaaatggtcccaatgctcacctgtgccgttgaaaacacaattagaaatgtgacaaaaatgccaaaagaatttgcggcgcctcacatcatggacgaactgttcaggggacgggcaatgaagagttgtcgcgatcaacgtatccaattgattggtcgtcaacggcgttgaagtcgtcggcgcaattgatgaaacagccctcaatgacgacgcgccgtgttgctgctcgccaccgtccgccatttcttgttgatgatgttgcatgacgatgaataaacagaagcagcgccggagagcaataggagaaataagaaggacgaaattatggattaatgagtgtgaggagagaaaagccagcacttatatagctatatttttttgcctcttctaccaaaagtttgaaaatttcgaaagtaagagaaacattatgccaaagcttctctattttcaaaaaa

SEQ ID NO: 24505 - DNA, 749 bp, Heterodera glycines
aaaatttcaattaaatttaaaaaatttccaaaacgataaataagtgttccgatatattttttgacaaaaactggtgaaaattaatatgaaaaattgacatcaggaatagaatgaacaagcgcgtcctcatacctaatccatatgtatggcgcccccacaaagtgtccaagccacgaaatgtccaaaagagtaaaaacccacgaaatgtccaaaatttttcaaaatttataaaaacaaaatgagtctaatttaggatttttagggttttcggggtcgctaaatacgaatataccctttatattaccccttgcctaaccttaggcccatctgaataataaaaaactcaaattcgagacttggacatttcgtgggctggacattttgtgggtcagcgatatgtatattataaaaacaaagtttctgtatatttggcattctgtcttagaaatttttttaaaaaatcaataaaatcccgcataatcctgcacaaaaattcaaatttgcgtatcctgttgcaggattggaattcaaaaatgtttgcaggaccggatccggccggattaatcctgcaaaatataggcaattttcgtaacaaaatgcactcaaatttttaaatttttttcaaaaaattttctcttgggaaaagtcccggtcctggcttttctcgtggtcccagtcccgacttttctggtcccggtaagtcccggtcccggtttttgtcaaaattcccggtcccgctcaactctact

SEQ ID NO: 24506 - DNA, 1187 bp, Heterodera glycines
ctttttttttggaaattaagtcaagggcacccgaacaaaacatttgtgggattaaaaaatgtgattacagactttggggtgatcagaagaacatattggtaaaaatattaagaaaaattaaacaaatttatttatataaatttatattgttttacatatctcttaaaaaatttaaattctctaaattcattttattaaactttaaaaagcttttatttaagaacttcaaaaaaactttatttaaaattcctattatattaatagaattgttttttatttaaatttattatttatttcaaaatttttaattagtttggaaatataacaaaatgatattgaaggaagtatttaaaactttttttaaaatattttcgaaatattaagattagttgaaaatatttgtggattttacaaaataatctatttctttatggcaaatcaaaaaacttgaaccatgttacagaacattacactaaaaagattttgtatatattaaatggggcataaaaatgctttacttttttaaacaattttaattaattttagcaaatccaaaaacggtggcatttgtgtcccattgtgggatgaacagtgtgttggagggcatttacaatggtgtgccgatggtttgtgtgccattctttggtgaccaattttacaacgccgaatcattggcacgccaaaacattggcctggtggttgaccgtgaacaggacaagaaagctgtacaacagcagcttactgtagcactggccaaagcattgggacaaaacgaattgctggacgacaaattgaacaaagaattgtgaaataaaatttaaaaattttaattatttttgaattaatttttttttaagcaatcatccggaagacaaaattgatttggtcaaacttgaaaaggtcacgtatgaatttcgtcataaagacattgcaaaaacactgtctgacgtgatgaaagtgattgacgaagaattaaaggaagaaagagcagcttaaaaacggatttaggattggattgttggatttgaactaggattttcaaaaaaaaaaatttggaaccaatttaaataaagctagaacccttttatatgatattttattgtatgttttggcttatgcttttgaacatttcttctcctcaaaattttttgtttattgtcaaaatttctgcaaaaaacctttttttt

SEQ ID NO: 24507 - DNA, 1618 bp, Heterodera glycines
  misc_feature (1602)..(1602): n is a, c, g, or t
attcttttttttgttttaaatttttattttataaaataggtaactatgatgcccaaattcgggtgccgaaaagcttccccctgcgactgctacccgaattaatataaataaaattttttggatagaagaagccttaaaccaagtaggaaattatataatacaattatccagagtaaaaatttaattgataaattctttcgttctaattctccctgatttatatgaattgaagacaatacaatacatatagtacctagtaaaataaattaataacagaaattataaactggaagaaaacaatttccatttttgccatttttaggagtttgtgccgaaaattgtgaccgaacaaaacgccaaggcgcggagaaccaatgggccggcattgcagggacaatcagcgaacggagcgcaaaattggaagtggaactaagccaaataaaagaacgattatcaaagctcgaaaaagcggaggaaattccaaatgagtgatgctaatgaatgataatgatggcacttatactcataatggaattgaatattcatttgatcacaaaaagacaatcgtttacataatttgattggagtctccaattattttttgttccgacttacagagttacgtaccggaaaaatttcctaggggctggataaattcttcgtggaagtcgaaaagagggacagaaaggggagcagctcgttcccccccgagaaattttttttttaaatttgctaacagaactttttcaagaaaaaaaatcttagaaagttttttcataagaaacttctaagaaaaaaaattttcgaaaatttttccaaaaaatcgctgagaatttctcgaaaacgacaatcttttgaatgatccgacttccgaaaagtttgagggctcagaatgccatccctgcgctataaacttaaaataaacattcatcccgttcaaacattttattgagtggactataaacgacctaatatattatcagagagaataaattgcaaattgcatcatctaaaggcataattaggtaatttacataatttattttgaaaacacatcaaataaaatgattgattccttcgttcgtttgtccattttcaataggtcgtcctaattctcgtcgcctgagcatgggcaaagagcagctcaaccagcagccgcacttccaagtgcgctttggcgtcgttgagccaatcgctgaaaatccgagccgactcgcctctgaaaatgaggagggtttttaaaatttttcgaaattgcaaatcctataattccagggggggacgggacgaaatctcgctggccgaaatctcgccggctgaaatctcgccggccgaaatctcgccgcagaaatttcaaaaaaaaatttcaaacttagaaatttttcaaggaaaaaattttagaaaatttttttataagaaaattccaaaaaaaaaaaaaactatttgctaagtttttttgaaaacttttcaaaaaaacagtaaattttcataaaatttcaaaaaaaaattgctgaaaaatttttcaacaatttttactttaaattttcttataaaaaaaattttctaagaacttaggagatgaaaaatttctaaatgactcanaaattagtcatttttt

SEQ ID NO: 24508 - DNA, 1298 bp, Heterodera glycines
taatgtgtgcaaatatgtacaaaatcacttgcgacgggcgccggcattcacacagacgctacaaaaaaaagaactgtgtgtgctgtgccgtccgtgccgagtgcaaaatatgccgacaaattacttcgttcagaacaaactaattaatgccaatttgtttccagacaaatgggcaatgctaattattgtcaagatgagcaaaatgacttttttgtggccttgtttggctggtccttaaaatttgctgaattaggtatcctaaattttggcttcgtgggaaaaatgtgaaatttttagccattttcgccaaatttggcattttgagacaaatggcactgaccaataaaggtcctggacttatatttgttgccaaccgctatttaataaagctggggaaccattgaaaggtgcctgacaagctttattattctcaaaaaattcaaaatttttcaatggatacaaaaaaaatcggccaaaaattaaaaaaaattaatcccatcttattaataagtaataaaatatttattatcgctcaacaatttgtttgtggaaactgaatatcaaccaaccggaaacattggcatgagaaaatgttttaaccatatttggtgccaaatattttgattaaatttattttggcatattaaagagagagagagtgccttaggcaaagaaatgaattcaaagaattagcccgaggcacatcaaaccaaattctttaaactctcacgcacagccaacgcttttcttcacaatgaaactcaaacaaaatgccaaacaaaaattttctaattttggattttgtgccggaaatgtttatgtgaacaattttacaaaaaaaaacaatgagaaatattccaaaaataataggcattttcatgaaattacaaatgtaaaatttagagattttcgaaattttaaaagccaatatttttgatcaattgattaatcagtcaatgaacaacactatgaatgccacaatggcagtggccaaattgtacgcaattttggcacggcaaaaatcgtcgtcggactatgatggggaggacggacaactgatggacgacattgactacgagaaagtggccacaaatcccatgatcgatgcggcagcgaagcaattcatggtaaggaggacaaaatgccagaattaaagtgccaaaacatggattttaaataattttttgatcaaaaataattaatttagattaattttatataaaatgtttttattttggattttaaaccattatatttttttggttgaatgttcttatattggaatttttgatcgcatc

SEQ ID NO: 24509 - DNA, 1241 bp, Heterodera glycines
  misc_feature (1154)..(1154): n is a, c, g, or t
atgatcaaagaccaaatccttgatttaatccaatccgagatcagccattactgtaactatcttttcatcgcgagaagtgaatgccaatatttgctggagaaaattgtcttaggctctttggttagaaaaaaaattccgctattttctattctagctaggaaatttgggcaaatttcatcctgcagtgctttgtaaacgacattttaacatttgcacagccttgagcggtgggttcgaaaaacggaatttgttatcagcatcaccatcaccgtcaccatcatcatgatcattcaatcattgaatgctcccagacaaagattcaccatacttcaagcaaatgatggagatgttcaacctcctggctctttgcttgttttaaacgaaataacatatgaaattcttgtccaagaattcatggagaggatggaccggctggttaaaaatatttttattttgaatctatttaattgttaagggaatggaatgctaattaaatggttggctcggtatggtttgattgcaaatgcgctaacttgtcctgaatgccaaaaccaccgagcatcgattgttaaatatgaccaaaatccggagggttatactgtaagcaaattcacttatcatgcatcaagtgctcaaagttgcatatttttgggccgtccacccgacaagtacaatggacatggtgatgcgtgaaactggatggagtgtcgtcaaagcattcaattatagatttctataattatttatagatctttgccaagcatgggcttattcgggtggaaacggataaaaaattaggaggggttggttggtacggtggtcgagattgatgagaccaaggtgtatagggcaaaataccatcggggtcgaatgttaaatcgcccatacgaatgggtctttggcatgattcaaagagggtctaataaggtccggggcttccctgtgcccgacctgtttgatttgaattaactccaaaaattttacaaaaaattaattttttatgaatgatgtgatggctccacattcctttagtcaatgtatcgcctcaattcaattccttttggcataaattacacagattttgtctaaagaattaccaaattttagagatttttggctaattttttaagaaaaaataggtttttggggggccncgcggtgccggataggccgcctaggcagattttgaaatttaagctcgatttctaacagatgtttacaaaaaaaaataagatttttac

SEQ ID NO: 24510 - DNA, 1130 bp, Heterodera glycines
atagcgccaaccctaactcttcgcgaatttcgtttctgggcgagatcgatagggaaaatctgggaagcacgcttatcttattttgtgcatcatcactgtagacaattccaagcgcatatacggaatgatagcgccgaacgtaatgtttacggaatttcgtttctggggcgagtttgattgtgaaaattttggaaagtcgcctatatgtctttttctgctcaacactctagacaattccaaccccatttacggaatgatagcgccaaccctaatttttccggaacggaatttctttctgggcgagtttgattttgaaaattttggaaaaacgcctatctctttttctgctcaacactctagacaattccaaccccatttacggaatgatagcgccaaccctaatttttccggaatttctttctgggcgagtttgattgtgaaaattttggaaaaacgcctatctctttttctgctcaacactctagacaattccaaccccatttacggaataatagcgccaaccctaatttttccggaatttctttctgggcgagtttgattgtgaaaattttggaaaaacgcctatctctttttctgctcaacactctagacaattccaaccccatttacggaatgatagcgccaaccctaatttttccggaatttctttctgggcgagtttgattgtgaaaattttggaaaaacgcctatctctttttctgctcaacactctagacaattccaaccccatttacggaataatagcgccaaccctaatttttccggaatttctttctgggcgagtttgattgtgaaaattttggaaaaacgcctatctctttttctgctcaacactctagacaattccaaccccatttacggaatgatagcgccaaccctaatttttccggaatttctttctgggcgagtttgattgtgaaaattttggaaaaacgcctatctctttttctgctcaacactctacacaattccaaccccatttacggaatgatagcgccaaccctaatttttccggaatttctttctgggcgagtttgattgtgaaaattttggaaaaacgcctatctctttttctgctctacactctagaccattccaaccccatttac

SEQ ID NO: 24511 - DNA, 1638 bp, Heterodera glycines
  misc_feature (60)..(60): n is a, c, g, or t
  misc_feature (1608)..(1608): n is a, c, g, or t
gagggagttttaaaagacgctgggattcgagcactaaaagcgtggctttttacccaatcnccgtttccaggggataaggctttgaatatccgcactgtaaagtccgtcatccaaaagccctctacgagtattctgggtgaccccaagaagatccgcattcggcttcgtcatttttggttttatcttttttctcaatgtgaattaaatttaaacacttatggcgcgcggtgctagaaaggccagttaaaagtcacagaagttttttggctattttttaatattttgctttcaaccaattaattacttcccaataaatcaatgtaatttcatcaaaaaatttttatcaaagataaaaaaggagagaaagaaacagaaaagacacacaagaaaaaagagaagagagaaaaagagacagaagagacacaaacatatactcccactgaaaaatttgatcagaaaattgattagaaaattaaatagtcgagcaatgatgactgacatataaaattatcaaaatatgtcatcatcatccagcaatccaaccttgggaaaacgttaccatggcttcgcttgaaataggagacaattcgcaataaaattatcacaaaaaaccaaaaaaattatgtgaaaaaataattgatcagttcgatgaaaatggatcaaatagaacatcaccatagtataagcgattaaaaggatgcacgtggtgaccaaatcaacgtcaagcataagctgatcagctggagaagaatcgacggcacgttttgatcgttgtttattgtaaggtatgccatggcctgtaaataaaatacattgtttaattaaattattttcattttttaattttaattcaaaaaaatttaaataaaaattatgacgaaacatttaaaaataaattttttaaacctttcatttgctttgccatttcgccaaacttcaaataaacaatattcttgagttgatcctttgttaatttcttgaaatttgaagaatttttgtttttttcgataatttcttttaattttgtaatattttttgcattttcacttaattgcacatttctattagcttccatcttcttcattagtccaatggcttgtttctccgccatttttactgcttgtacaattaattccatgtccttttttaaaattttggcagaattcgtccaacaatttttgtccaaattttattgtctcagtttcgtcattttttgtatttgtttcacttttttcaaattttgtgcaacataaaatgccagcagtgaatttgttcagccatttttcgaatagaatgccatcgaaaacattagaaggtagcttcttttgtctccaattgctaatttaatattattataaaatagaaaaaatataaataattttttggacaaattcatttgacccatcaataaggtgaatttataaaatttagtgtttattgaaatagttttaaaataaataataatattataaattaaatcaatgatatgtatgtaaatatacgtcataacatttttatttaacatattgaaattatatataatataatacacagaacctgcggaatacttctgctgttgaatgcgaccccgaggcgctttcaaattgncgcccagcaagaaagtcttgctaagctcca

SEQ ID NO: 24512 - DNA, 2188 bp, Heterodera glycines
  misc_feature (30)..(30): n is a, c, g, or t
aaaggatcgaagcggaaagccagtttttgnatcgcagataaaggctgatcgacaataatttttgaaacgattgcccctcccattatttgcaatggttgcgccaaagcaggcgaaagggggggggcaaaggatggttgcgcatatccgccacctaagcccattcctggcaaggcgactctcggggaaagtgatcgaaacacaatcgacacattctgatttgtaagcacatggcaccgatcactccgtaaacttccgatcacccgtcctttgccaatctcggccaaccaatccaaaatctctactgcttgatgatcaccgctgttcatctgtcccagctgatcagcaccgaccatccttcctgccccgatcacttccgctgatcagggcgaaccgctgaatgattactttttgccacctttcctcaaaatgatctgtcctccgctttcacttcggccttttttgcgatttttgttgctgtttttgatgcaaatgcgtccctttacattttttgtcggctctttgaacaaacgaaatgtcccccacggccccaacagaacactaattgttctcgcagcgccctcaatttggtaatggcaaaatgaattcatttctctacacggaattgcaatttttaagggatttaaattatgcggaagatttcgttccaattgtccaattccaagtgagaaggaaatttaattgtctaattaatctgtgccctttcatttcaattagtttaattactccccataaaaacagattaaattggtccgtcttctgaatggtcagttggttggccattctccgccattttgttcacttttccctcgtcatttgctcaacagaattcgaaagtgcccttctgatcgccgaccgacacacaattcccttcataaacgggcaaaacaaattactcagtgacaagttgccagccgaacatttattaggtgcgcagattgaacagtagaaaaggcgaaatggctaattacgtaattaatttgcagaagcgaccatttacggcataaatttgcacgacttcgccccgttgggcaatgttcggcgggtgaaattcgtttatcggtacggagggggggggggggacgagcagcagatgagagagaagggaaagaggggagagagagaaagagaggagacagaaaagagagatagcagaagtgaattggtcggcatttgtgccagaaatgaaaattgggcgtcggtggcctcgcgacaaatcgacgacagcatcaatcgctttctgatcaaaagtcggctgagagtggacaaacgagagccgaacattgtgctgatgggaaagtcagtcagcgaacggacggagggacaattaaatggcgattaatgaattaattaccattgccatttagggacgttgtggacaacggcgttaatcgggcactgatttccaacgttgaaataatgaaaataaatgacaagcaaaaaacatcattctcaccatttcccctccttttgcacagataacttttgccaaaaatattcgcaaaattccgagacaatcgctgatgatcaaattgcaaaatgccttccgaaaagtgcgtttggtcatttgcctttttagtcataaattagtgcaagaaatcggtttgattagcccaagtcagtcaatttcaattaattagggagcgatcatcccccacaatgtcattaaccgatcactcactccccgcccccatatatttttgccccgtcccttaggttatcgtcgtccctccgcccgcccctttcgtcggtcggcgccatcagttgcgtctcgacgacgttctgtgcttcattgacgatgctgtgttggttatgtccgctctgagcccgtcaattgcgaacaaagttcatatggaagtgttcaagcggcagaaaaaagaagtacggtaccaaaggcattaccgtatttatcgtaattgggcgttactgtatctttcactttccgagacttttgactaacagtgccaataaacattgtatattttcatacatctgttcacaaaaggtgacagtcgtcgaattgcccgtcgatggcatgccagaaaatggcccatcggccagcggtgagcctccctaccatagtgactatggaaactgtgggctgtacagtgccattttggtcactgatcggtaaaggtccaattaaactagattgcagaaagtcgatttt

SEQ ID NO: 24513 - DNA, 1152 bp, Heterodera glycines
  misc_feature (1104)..(1104): n is a, c, g, or t
  misc_feature (1108)..(1108): n is a, c, g, or t
tcttttggtcatgccattctccattttattgtttgatcaaaattgcgcgcaatccttctaattatttacatcctttcccaaatttatttttgatcagtcccaccctgaggggcccacaaatggcacctttcggtcaatcagtgccatgcctttttctgatcaaatgtgcacattctcttttgatcagtgccatttccccattcttctcttcatcaaattgccccaatttattttggtcaatcgtcttttggctatttcttttgatcagtgtcacccctccccatttatattgatcaattgacgcatatttcggctgatcagtcccatcgccatttttgatcaaattgtgcaaatttatttgatctgtcccattttccccatttccatttgatcatttgtaccatttttcattgctcaaattgcgcacatttcttttgatcagtgccacgtctccccatctttcattgatcaggtacattgatcagtgccatttccccttttgatcaattggcacatattatctgttgatcagtgccattcctcaatttaattggcacatactatcttttgatcaataccattccccaatttttctttgatcattaggcacacattctcttttgatcagtgccattctccttttagtcaattggcacacatttttttttttgatgctcgtcttacccatgccaattgtcaatcatgagtctatcgtgtatggcctctccattcattcattagtcaacaaacattcattcaattacgtattaattcattcatacatgtagaaaagcacgcatgttcactcatgcttgccacattcatttacttattcatgccatgtgctttcatagagtcatgtgttcataaattattcatccattatttatatatgtgttaatattataaaatggtccaaaataagtttatctcattcagatgagaaccaaaaatctgccttctaagctttccaatccgaagttttaacaagtgatgagagttcagcaagttttgaaagcccctgcgggaccatttatgaatcattcgagggcgtgagcattgatagctcaaaagtagctttcaacctcgaggggtacactaatngtgnggctgaaatcgttattgaagggactgaatccaaatgaaaaccct

SEQ ID NO: 24514 - DNA, 953 bp, Heterodera glycines
ttattaaaaaatcattgggactcataaagtgtcatataggactcataaatatatgattggactcataaaactctgattggactcataaagtgcattagagccaaatatttttcgccagcaaaaaaaggtcttaggattccgccctccgaaattttttttttggctacgggcttccatttaaatgcctatctttaagatttttgttgcctgaaaaccagaagctttatttatgcctttgataaaaaaaaatcagatgctcattaagctaccatttgttattttagaatcggatgcgcaacaattcctttccttttgcttcacttttgcttgagtcacaaagttcgtccagtcaaacattgccaagggtgccggagaacggtaattgtgataatattctaacagttcttttcttttttcgcagacaccgtttcggggaaaaccggcgaaagtgacaatctctccaaaagaggggccaattttttgcacacgaaagtgcattcggcccaggaattgacaatgcggcggaactcatccctttccatggacactttcggggatttaagcaccaaaatcgcttcaactcaaagtggtaaaactaggcatttattaaacaatgcaaaacaataatagaaattgttgactcatcccattcttaatttttttttcctttttcaattattctattttaaaatgcaaatttgacctttttttagccgagaaagttcattttgcttgtggcgaacaggaccaacggttggaaaatgaaggagaagccataagtcggggggaggaggaggaagacgaagaggaagtggagggcggacagtccagcgacagttcgtacgtcaaggtcattgcctttgcggacggagtcagcagcgatgaattgggcacggatctcagcgaatttgtcaaaggagtcaaattgggcaccggacgatttgcgctccttt

SEQ ID NO: 24515 - DNA, 1077 bp, Heterodera glycines
tcttgtgcactttatgagtccaatcaattgaaaatactcggtttttatacaataactttgttcatgttcgaacaaaccctatctttttggtatcatttgaaagtacaaagtctaacgaagctaaaatatataaaatcgcagcgtttaggcaattaccaaaaaagattcgattaattaagtaaatacttattattttcgtttgtaactttcttgaaatattagaattttcttgttttctcatattattacattatttagactttgtactttcgaatgataccaaaaagatagggtttgttcgagcatgaacaatgttattgtataaaaaccattgattggactcataaagtgcactagagccgaaaaaaatgccaaagcaaaaaaacgtcccaaaatattccataacaatttagttcacgcaagacgaacacggcactggcctagcttatttgacgatgattgacaacgatgcgccctgttgcatttgcaatggtaagcaagtttggattcacaactgccggcttgcaattagcgcgaaaaattggcgcatttgtgcgtaagaactcaaaaggaggtggccctttcaaaaaaatttttacatgttgttcacaaattttctgattattttggataaggcgttcgaggggcgatatgttagaaatgtgccgaaaaatacaatcaaattccggtaaacaaaatcgcattttctttttttttgaaattgaccccttggggtttgaaaattattttttttttaaattaaatttattctttgctaaaaaattgttcactttgttttcttcataattcgtgtttagacggcgaggacagcaatgccaatcagatcattttttgcgatatttgcaacattgctgtgcatcaggttttctggcacttttcccacgctcaactttctgtacgattttttttttgttgccaggaatgttatggcgtgccgtacattccggagggccaatggctttgccgtaggtgtcaaatgtcgccgtcaatccccgtcaattgtgccctctgtccgtgcagttcgggcgcattcaaacaaacatcggatggtcgctg

SEQ ID NO: 24516 - DNA, 1408 bp, Heterodera glycines
gtttttgcgggcggtgtgttgggtaatcggcggaaaacaaaataaataaaacaaaaatgtatctaatatgttgctaggccaagcggaggaagaaaagctgactaaatgagtgccataaatgcgaatcgactcagtcccttgtctaatcaccaagaaatagctttaaaaaagctactaacttttgaatggtttggatttggacttctggtaaaaaatttatggcttcttaaacctccttgacacggaaacatgcgcatggaaatgagaccaatcgccataaatgcgttttttcccgtcgctaaattaattttcccaaattgtcacatttttcctttaaaaatgtttcgttttttttttttgttggaattttaacatttctcaacttttctctgttcattcagccattcctttccattattactcatttttcgattcacacaatttttgtcgttgtgcacattttttgcattttttttcttcatggtgccatttgtttttgttttccactccatcagcgcggaaaggaaaggaacggagggattcgtcggtcgatttacacgacgcattcattcacacgtaattacccctccctccctcccccccccccataattcccccaaaattatgtatacttgaaataataaaacaaaattcattttttaaatgtgtttcccttccgtttgtctcctcacagattggtgctggacaacgcaaaacaattgcagcagcggcatcaaccgaagcagcggcagcagaacacgcagaaaacgccgacagcagtggcgccgcctgcgccgtcgacgacatattcgcccgcttcttcgagcaacgaagagcaacagttccaccacttttaccaccatcagcaacaacgcgagaagaagcggcaccgacagcaacagcagaggccacagagggaacagaacgagcagaagctgaagcagtacaacagcaacgctccccaacggacgacgacggcgacagcaccgacggaaaggcagacggaagcgccagcagtgggggaggcggtgcagcaacagttggagaggcggagacgccaattggtgcggaacggcggacggcgaagcggcaaaagcggaggcacaccacgggcgatgcccaaatttttgcacgcgctgtgctgctgtctccggccgaaagcatacaaaagtgagcagccgagtgacctaactgattagcgtggccaatttgtatttacctttctagattataaattgggtcccctttttgttgtgtttttcagaaaattttatgatctccccccactgcacccaatttaacaactccaaatctgtaaaaattaaaaaaaaaatggcgttgccgataaactaattgtaagcagggaggactttgttatcacttctccaaaatggttgtttttttaggg

SEQ ID NO: 24517 - DNA, 989 bp, Heterodera glycines
  misc_feature (6)..(6): n is a, c, g, or t
agtccntttgattcaaaaaaaagtataaaaaaccaaagtaattaattaattaatatgcatcatatgggagaaaacggcggagcaaatgaaaagccaaccgatggagcgaaagtgcagcactttctgttgccacttatcacttttgtcaccccgaaaaacgacgcgtttaaatgattttcagatgccgaacaggaaaagcattttgtgattaaaaaagaagggagtttttaggtatataaaatatttttaatttggtggttacaaaatttgaaatggccccagaaatgttccgtttttgccattacaaatttaaccatggcataaatgtaagtcagctgacaatgtctctttttccgtttcttattcgtccaaatgaccaccactctttcatccgttccatcggtcggattgacctccgccgtccgtccgtcatttaaccactgacttggcgctgtccgtccgacgccatctctgcagcggacgatggcggtggtcgtaggggaggaggggcgacaaggggacgagttgccactgccggcggtgcccactgcggtcggtgctcgcccccgtcgtcgcccattgccccgttatcgcttcccctcgccgccgcttgtccccctcccctcgatatcaacgggacattctccgttttgccctccaacatcgacattttcccccttttcacttttatttggtcacataataattagttttgtgtgtgtggatgagttcgttttagggaataatcagcaaaaaggcggaggacacaacgacagattggtggaaggcatacacacatttcaattctcttcgacgtgaggccatttccccaccctctcttcccacaccaaacacttatcgattgaataggcaattgaaaatggaaagacaattgggaatttgctgcaagccttcttcggtatcaacagaacacttgtcaacaaaagccagttgttacagaaactaaaaatgatttttctaatctttat

SEQ ID NO: 24518 - DNA, 2082 bp, Heterodera glycines
gatcagggctgggcgaagctcggctttgcactcgaagccgaagccgaaggcgaagcccaatttttattcgaagccgaagtccgaagctcgaagcccaaaacccccgaagttttcgaagccgaagccgaagtttttttcaaaattttttttaattccaaaaaattttttcatcacaaaatttcggttaaatatcaaatagaccaaccaacaacccctttcgataaataaatataatgatttttttaacaatgtattttctaaatttttataattcttagaatactcacagtttttgagtcaatttaaaaaataaagggaattttggaactccggcggtgccgataggcgccgacgggaaaaatttgaaattttagtgacagatttagttcaaaaatgaaaagattttgcgattttaattgttaaatttatattaaatttccgtcgaaaaaagaataattttgaaaaattagaagaaaagaaagtacttggatgggaactgatccaaagtaaacataatgaaaagagcaaagagcactaccactcgaccatgcgtgtgaacaaaaaaaaaacaaaaaattaataaatatatattaatttaagtttatcaaaagcccatcactaagggtgcattttcacattgaaaactcaatctttaggggtgtatttttcccgaaacttcgggtaagatagccgaagccgaagcacgaagttcgaagctcaaaaaccccgaagttttcgaagccgaagtttcgcccagccctggtttagatagggagaaaagaggagatatagataaagggaaaagaggagatagagagagagagagaaggggagagagagaaagagaaaagagtgggagatagagaggaggggggggggggagaaaatgagcgagagagagtaataaatggttttcaagtcttggctagcgcgaggtgcgcgagcgaagcgagcgcgcctgcgtagttttaattctagggggttgggaaaaattttccgtagaagatgattatgacgaacagaaagagcacaaaattctctacaaaatggccttggaatgattgctctatagcaagtattcgctgaggggtgccttgttaaataccgactatccaaaaaatggctcaatttaagccatttttcctcatttttgagacatccattttcaacaagacgcgccttcgcggagacgcgacgtagagtaatcattcaaaggccattttgtagagaattttgtgctctttctgttcgtcataatcatcttatacggaaaatttttcccaaccccctagaatttttttttcgaatttacccagatttttacattttttgcccacaaaaaatttgtgtttaatgaattttttcttacataaagtgaatagaaaatgcttaagggaggtctataagttattttagtgttaagtgcttccagtttaattcagtgggtcacatgtttgaggtgatttaagccttatggcccttaatttctccggaaaacttggaaaattcaacacaactccgcctaaaagacagatttctgtctgcaaaagaaatagaaatgtgaaaaaagatttgttctttcttatttagcttattttatcagtttctttttggtagttattgagattttgttcgtttttcacaggtggctctattttaaatcaacacccttttttcggaaaactggtcataaaatttttttctcgtcattcttttgctctctctcttctggaatcttaatattttcagaattgctacgtatggtaaaaatttcagttcaatcggttcactagaagctgagaaacacccgaaaatggggtggctctattttaaatcaacacactgtatgtacccaaaaagttaaaactttttaagtgcagctgttaagctatttttcgactttcaatgcttatttaggcttttattttatatcagaaaaacataattggtatttgcccttaatttctttgcctaaaaaaccttttataaaattcttcattttattattttttgttaacttttttgcatttaaacggtctaaatatcattaataagcatatatttttcccaatatttggtatc

SEQ ID NO: 24519 - DNA, 994 bp, Heterodera glycines
caaaatcggttagaaatgcagcgaaaagcaaaaacgaacaaaccaaaaaaaacaaatgatttgtgtgacggccaaatgattgaacaaatccctttcttttaatgacgcctaccatagcaatgattaataacccccacaaagccgacaaaagcaaataaaatggaaatggccgtaacaattattgttgtcacagccaacgccgggaggtgctgatttggttgcgattgatcagagttaccaaatgaaaacattgaaaacaccgccacatgacctctgtgtaagatgatgccaaacaaagtgctcacggtggtgcaataagcgaacaccacaaaggaaagaaggcattctctcaaatcacgcggccgtgcccttttcgttcgtcgtgacggcatcccattatgctgatcagataaagctgacgtttgatcagaggagacattttgtccactagcgaacaaagtcggtggtaatcgctcatctaaaagggttaaatgcttcattatataattaataaccatttttaattaacaataccggtgatgaattctcggaatattttcaacgcggcaatgcaatgtttgacaaatgttccaattgctgtttgattttcagggctcacaatttttaatttcgtcaattttcgaaatccttcgtatgtttgggggttaactttcacatttctcgccgctgttacaatggcattccccgccgaactttccagcgcttcccaaatgttttggccctttttcaattcttggcaaaaattgcgctgatttgcttcaaattccccaattatttctgctaattcatcccttttcatgacatctttttcagctttgattgtaatacaacacaatgtgtcaaatgctttttctaaaaattttccatttttcatttgtgtttgagtcacagcaaaaaatgccggtgccatttcttgcaaccggtggaccgttgcaaaaaagtctgaaaatggtaatgtttgatttgaaaattt

SEQ ID NO: 24520 - DNA, 2192 bp, Heterodera glycines
  misc_feature (2115)..(2115): n is a, c, g, or t
cccgaccccctcccctttttgattggctcatccgggcgagtaccgatcaggggctcggcggttccgtccactccggcgcggcgcttgttgcggcggtgtcgggcttcgaggggcctgctcgggttcgatctcgtcctggtgaccatcgttgatcgggtcaggccttggctcaaggtcctgccctacaattccaacgttcggtgcggtgattggcagatggaatgcctcatttaaaattgccaatggttcgtggccattttcggtgttttcccggtttctcaattgattcgcatgaaagcgatttgtcgaaccgtcggggaatttgaccgtgtagatgactccggagcaatcacaaattgtcccagctctccaattctgcgagagtcggtgtctagcccaaactggcttatttgacacaaatttctgtggtcgggcgccaaaccggcgattgaaatggtgctccatttttgtgtctctctccgttggctgtggaagaggcggcattaggagatcaatcgttgtgcgcggttttcggccaaggagcatttcggcaggggttttttcgtccggcagcgaatcgttcggagtcgtgcggtaagttaccaggaatgtgttgatgatttctttattcggcactccctccccttttatttttcgaaatgctctgttaaaagtgtccacgaaccgttccgcttgtccattggacattgggttgtacggtgcggaaaagagatgtgcaattccatttgcttctgtgaattttgcgaattcactggcggcgaactgcgttccgttgtcggttaccaatgtttccggtataccgtgacgcgtgaagagataacgcagtcgttcgattgttgcggccgctgatttagtggccatttcgaatacctccgggtacttcgaatatgagtccacaacaatcagaaattcttttccgaagaaagggcccgcataatcggcatgaattcgttgccatggccgcgttgattttggccatgagtgcaaatccgttttcgtcggtgccttagcggccaattgacacggtgcacaattcttgacgaattcctcaattcgttgatccaattttggccaaaagacatactgccgggcgagttgtttcatccttttaattccaggatggcccttgtgtagcagtgtcaaaattttggtccggaatttttcagggatcacaattcgttcgccatacatcagacagtctttcagaattgtcagatcggcttttcgtctgccgaaaagctcaatttcttctgattgtggcgtcaatttgcgttcatcaggccaaccgtctctgacgaatttcataacaatttgcattgttttgtcctttttggactctgagaccaaattttcaaatttgattggcagaatttgctttgccatatccaaaacagttccaagatcctcgtcgatgttacacgcggcgatcactcgttcatcatcacattcaaattctttggcaatcaggcgagacagtgcgtcggcttgaccaaactcgttggtattgacatactcaatgtcgaagtcgtaggccagcaaagtaagtgaccagcgaagcagccgatttgcgctgcactgccgaatgccttttttgcttccgaagatgttgatcagcggtttgtgatcagtttgcaatgtgaagtgtctgccgtagatcattttgtggaacttttgcactgcaaaaattaatgccaggccctccttttcaatttgagagtaatttttctctgctggagtgagcgaccttgaggcatgtgcaattgctttactttgaccgttcgggaatttgtgggagatgacggccccaattccgagttccgacgcatcggctgccataattatgtcaaatttaggatcataatgggtgagtagcagttccgatgtaagcacttccttcaatttttggaatgctttttgtcgttcttccgtccacttccattcgatgtcatcctttagcatgtcgtccaaaggcttccgagtgaagcgcatgttcttgacaaactgttggtaatggtttaccatgccgaggaatgatcggagtgacgaaatgtcttttggagacggcatttggacaattgcatgaatttttgctgngtccggtcggcgtccatttcgatcgattatttgacccaaatatttgatttggtctcggaagaaggttgatttttcca

SEQ ID NO: 24521 - DNA, 1329 bp, Heterodera glycines
  misc_feature (173)..(173): n is a, c, g, or t
  misc_feature (175)..(177): n is a, c, g, or t
aagcgccccagattttgccggggccttaaaaagtcaaggaaaggcgtctctgcggtgatttaccagtagtacctattaaattaaattttttagaaatttttaaagttttttgaaattttttaagtcaaaaagtgtggtgtctgcaaaaaattttcccgggttttaaaaatggngnnngaattgtaagcatttgtagtgtccggataggtatccctgcaaaatttggtgagcccctgatcaattacaaattatttatggacgatcaaatttttagaaatttttatttatttttgcataattaattcataaatatttttttcagaaaatgctctgaaacgcaccaaattttatttacatgctagtttaggcactctgatgctttttctatcaaaaagggagatgaataaatttttaaaaatttttaattcctttttaaacaggccaaaaagtttaggcttaacttttaatgaaaattcaatcactcatttttcgagtagtgatcagaagcgcaccagattttgcaggggcctaaaaaggtcaaggaaaggcgtctctgcgttgatttagcagtagtacctatgaatttaaattttctatgaatttttaaagttttttgaaatttttttaagtgcaaaagtggtggtgtctgcaaaaaattttcaccgggtttaaaaaatctaggaaaattagtaagcatttgtagtgttccgatacgtatccctgcaaaatttggtgagcccctgatcaattacaaattatttatggacgatcaaatttttagaaatttttatttatttttgcataattaattcataaatatttttttcagaaaatgctctgaaacgcaccaaattttatttacatgctagtttaggcactctgatgctttttctatcaaaaagggagatgaataaatttttaaaaatttttaattcctttttaaacaggccaaaaagtttaggcttaacttttaatgaaaattcaatcactcatttttcgagtagtgatcagaagcgcaccagattttgcaggggcctaaaaaggtcaaggaaaggcgtctctgcgttgatttagcagtagtacctatgaatttaaattttctatgaatttttaaagttttttgaaatttttttaagtgcaaaagtggtggtgtctgcaaaaaattttcaccgggtttaaaaaatctaggaaaattagtaagcatttgtagtgttccgatacgtatccctgcaaaatttggtgagcccctgatcaattacaaattatttatggacgatcaaattttagaaatttttatttattttgcataataattcataaatatttttt

SEQ ID NO: 24522 - DNA, 1753 bp, Heterodera glycines
aaaaaatgaaggatttgtttaaaaaaatatgcgtgtctaatcaaacccataataaatgaatccgacagctttttctgtctaaatttttaagtggactcaaaatagcccatttttaacagttttcgtcaaaaaattacccaatatctgtatttttgggtaaattaaggcaattcagtctctctttttggaggcgccgccttggcaaagttttgcaaatttatttggatgaaaatggttgtgggaaatcaggactgattataaagcacagaaaacaatgaaaagatgctgtaattcaacagtcgtttcaaaatcactatttctaactggaaattttcggtatttatagagcataatttgtttccttttccccaattttcgctttatttatcagtgacactttccctttgccctttaagaaaatcacccgaatcggaaagataaaacaatggccactgttctgtcaaaggatttgctcaacaaatggtcgtgcagcgtatggtaatcaaatggaaaatgattttttattgcaacaatttccccgtttttttggtaacatcatttcaccaacttttcatttttcagcacttttgacaattggccaaccgccccaaagtgcacaatttgcggccgtttgcgttccggcggcagcgcaaatgaaagcgaagtgcggcaaattcaacaacagaagcagcagaaggcgcaacagctgaacatcggtcgcaccgggcgtcagcgatcggtgggaaaaaattaaaagcaaaacaatagtttcggggggggggaataaaattgggggtccgacggcgccaagtttttatatttaattctttcgacactttcctttatgccctcccccgtaaaaataccaagatcccaacaaaggaatgcacttttcttgggtggttttatgcgctaaccaagaatatggagtcaaaaaatatcaccgtcttaatttgaaaaagtgatccgcccgtccgttccggcacaaaatttgttgggttttaactttttgatagagaaaagtcgagaatgctgaaactaaattaatcgattcctctcgatgaaagaacgattgataaagaaatgatatacctatgttatttctttttaaattcatagacaaaagcatatattttgcagtgttgagccatattgttgatcaacgcctgaaattaccatagaaaagtgctttcctttgttgggcttttgattttattatggggaggacggtataacggaaaaatgccattttttcatggactaacacaattttttagtaatttttttcaaattactgagcttggtaatatgccacaatgtctaaaatggtgtgcaattttcagtttgcattgtctgcgaatggtcggaaacagcaacagcacaaggacgacgccgacgatgagcaacaccaccaccacaagcacagtgaccaggacgacgagtgatcggcgcgacgacgacgacgacgacggaggggggaggagggcatttttgcttctctgcggctgaccaatcatttaaaaagcacacaccgaccgacctcttcgcccaaaccgtacacagactttggcttgcttatcgtatcggttgatattgattgaaatgagtcccacccatgtttcgttttcgacattattctcacaccttttctttttcatgctttcatcatgtgatttcccctcgaaaccataaattctctttctgagcttcgcacaacaaattaatcggctaaatgcatttattattattatta

SEQ ID NO: 24523 - DNA, 1574 bp, Heterodera glycines
  misc_feature (1404)..(1404): n is a, c, g, or t
  misc_feature (1490)..(1490): n is a, c, g, or t
gcaacttttagtgaaaaaactttttttttctcaattgttttaaagaaaggagctcaaaaaacgcattactgcattaaatttttcgattctgatgtcattatcagtcactagaaatcactattttggcgtttcgtcactaaaatagttaaaaatcactattttggcattttgtcactattttttcactatttcgacattttttggaaaattccttaacaaaaatgcaataaaaccaaaaaatacacccctaagaatcgacctaaaatttttcaaaatatactcctatgaaatgaaaaaaaaattttctcaaaaatttactttcttggcaaaaatttttaatttaaaaattttttttaggtaactcttttgggttttttggtcttacaaatcccagtcctactcatttgcaactgcaatcagtgaataaaaattatttttgctcaatttttggctgaaaattatgtgactatttgtcactatttcggactttttgtcactattcttcactattttggcatttctactcactattttagttaactattttgggatttttcgtcattaaaagttgcttcctaataattagagataatacggtacatttacctaccggtcacttgccattgcgatttgagtgccgacgacgcacaggaaaagcacctgaaatgcaaatgcaaaatgtgtagcatttagcatttgaaatcaaattaaaaataattaattaattgaatgataaattgttgccttggccctgtcactttgttcgattgttgcgccattccgtccgctaataacaaaatgaacaaaaatgaaagaaagaattgaggaaaaagcattgcgcaaaatgtttctgtttttacaatagaaaaatgccaaagtatgaaatgactaaaaatttgcacaacattaccacaccaagaaacagtaaaaataaataattttaataaaaattatttaaataataaaataattgttgcattttgtcgactgattttggcatttaatagtgaaagacttttcgccaaatgtgtgcctaaatctcatggctaaacacttttatggagacaaatgctttctttcttcattctttcccttttcaactccatttttgtttgttttatgaatgaatttacacatttgtgtacgtgaatggatgattcattcatttcttggctttttctgtgccgtttcttcacaaagtttgctgatcggataagatggtattatttttttcttctttttttgcatatttctcaacaaaatctcaaaaatttttccaaattggggcaaaaaaaagaaagaaaaacccctaaaaattcaaaataagaaaaagcacccaacgttaaattatctgcgaaaaatatttattcatcaaatacaaattaaatgaattgaagtaattanactcacatctttcacttaatcctatcactttatcacactatcagagtccttttttattgctttcttaaatttgaaaatttacattnaaagaatgaaaaatattgaaaaattttgacaatttgctgatcggataacatggtatttactatctttttcttttttcttttgca

SEQ ID NO: 24524 - DNA, 1369 bp, Heterodera glycines
tatttgattaaaaaagctatttttaatagtagaaaaatcatttttaattaaaaagtttttaaaatgttaataattaaattattaatttaaaaaaatgacgacaaagttccggactccgtaagttgggccccgaactctaactttttctttgtcaaccaaacccaacattgtttctatcaatcgaatgctcttcacatgctctattagcctacatggctggggcccaaccgaagtgaaccccaaaattcactaatttttttaaatcgcaaaatattttgtaaaacggaattttcattactgacggattgttcttcactgacagattggtcttgattgattgtctattaaataattttctggagactttctgctgagtgggctaggaatgaaagagacgctgcaaaagttatgaatttgaattgaattgagttttttagttaattggttttttaaataaaaaaattccaaaaatttttaatttgtttttcaaaaactttttattactttttatatattgttcaggaagcaacttgatatgcacggaggaaatgcaaatttagccgacattactcatgggattagtgccgattcaaatttcaatttcatggttggccataatcactggcgccaaatggtcatattacataacagaaagtggtttgcacaggtcgaataaaaactcaccagaactgaatttattttttgggcaatcatcaagaattggtatcccgatgaaaaaaatgctgaaatttggcggcattttttctaggcttataaaatgcgttaacctcgaatctgaaagattttgaaaaatcatttattttgtctataactttttaaaaatgaagtttcttgcaaaatgagagcacagattcatgacctacgcattttttatcccaaacccattgaaaataaaatctttacgagtaattgataaaactttatagacaaaataaatgatttttcaaaaacgagttcaaattcgtggtcagcgcattttttaaaaccgataaaaaatgcctgctacatttttaaacagatgaatttgataatgaacgaaaatttttgtattttaaaatatctaaaaatattttttagacatttttaatgtaaaaagtcgtatttagagttgtgtcattcctgtcgggttttctggatccaagattatgggaatgcatgcctatgacaatggcacagaagtctttatgacatcttcgttcagtgttgccaatcgatacaaactattcttgctgatataacaccaattgatcactagggatggcaaaaatatgcacatgcatatttttttcctggactgcgtgggggaagactgaaacgcacgaaaaacatgtttttagcttgatttgaa

SEQ ID NO: 24525 - DNA, 2540 bp, Heterodera glycines
  misc_feature (618)..(618): n is a, c, g, or t
  misc_feature (696)..(696): n is a, c, g, or t
tgaaaacgcctacaaaatgtcaaatgatgcttttattgccttctgcaaaactgaaatacgggaaaaacgagaaacacctaaaattgagccgaaaagaaaggaaaggccggtaaaacagaaagttcaactgaaaagtgaaatcaataaaaaggaaaatgttttgaaaactaaggaacaaaatgctacagtatctgttttaccgaaaagcactgtaaagctggtcaaggacagccaacaaaaaatgtcaaatccaattaaaattttacctcaaagtacacaaagtacagtgatcacaacttctaaacctcaagtcaaactctccacaacagtaatgcctgttacgacaagcaccactccgaagccaattactgttcaaagggttataacatctaccagttatccaaatgttaattatgatggacattttgagacaatttcagtgaaaaggcctcagaatgagcgaatttatcaggcaaagggaagagagtttaaaaatttcggaagtcgttctgaaagcactaccacaaaaaagcctattactgtcacaaaagttgggacgaatattccaaaaaatttgaccgtgtctaaacctgttaaaattcacaaaattgaaaggcncgttggtgtcaactgcgacaccaacaaaaatctaacaattacacaaaaacccaaaaatggagtcaaaaaatctcatcntcgtgccggagttcagaaaaattgttaccacaaccataaccacttcaacggtaaagcccatggtaacaagtacttctgtcactacgatttctacaaaagtcacgcaaaatgcgagtgaaataacagtgttgccaactgacaaaacaaatacaagtttaatgattggctcaccaattaattcaaatattttctcgggattggagaatgccaccgaagttattaagtcagaaatgggtgagaacattgggactgaatatgaaactgaaagcgagattgagatacgtacagaaaatagttctgaaaattagagccttgaggaaatggaaatgaattttataaatgaggaagatgaagggagtaatgagggagagtacgttgaatttgaagtattagaaaataacaggaaaaacggacaacagtgaccacgcctgatgcgcaatggcttaaaaaagttgaaaaaagtaaaaaaaaggggtaaagcgggacaggaaaataagaacatgaacacccgcgttaattatgcgatgtataggctggatgaagccagaaagcaacaatatgatcagatatacattcaggcatgtgaaagcaccaaatttcaaatgcaattgactagggcaatcttacagataaatccaaatgagggggttagaaggatttttgatagagatgatttggtcgcgcattgggaaggtgataatttggaagttggattttgcgcaccactaacacctgaaaaaatattttgggataaaaaaattggtaatgaatgttacgaatggacaccagtttttgcagaggataccgtattttttgttaaacctggcacaagggagttgagcattttggggaaaaagtcggaatgtgtggaaaatggcagtgtaaaggaaatgcagaatgagactcaaaggggaataatacaaaaaatgggtgaaaatattgagaaaattcgacccaagtaccgaaatatataaaacccgttaattttaaaagccggagcgctttttgaatcagacaatgtgcgaattgaggaaacaattcgtggatatcgctcaaaaattaataatttgcccacaccgatattacgattagttgaaaaaccaaacattacggaagttattaagttggttaaaagtgaggaaaatgaaacgcttggtgtgataattggtagatccggagattggttggaaatagtaaagaaaattccggagaaaaccaaggaagcaataagttatttaaaaggcctatcatatgtactgattgcgataccattattaattcttttggcattgatgggatacattggaattaaatacagactgataatatttgccggggttcgtgctgggtcagtattggcaagagtgttaagagcaatcctgggaacgaaaaaacgaagtactcgggttttggcggtaccaaccgcaccagaattggattcaatcgatgaagaagcttatgttctggattatcttcctccgagacgggttgcagcgattacgaatgacccgaggagactcccatccattagtatccgtcttaatgatttgttaacagcagccttggttgattcatgtgctactgtatcctactgtagagaaagaacagcaagaaaagcaggacttaaaattttggagcaaaatgacggaaaaggaaatttgaccgcggcaaacgattcaagtatagaaatattggggaaaacaatggcaaaacttcgaattaaggataatgtgactggaaatgtcggagaatgggaagttatattgcttgtctcagtggacgaacattgtcccggtcccttgattattggattaccacttcttatggaattaaagaggtgtaat

SEQ ID NO: 24526 - DNA, 1080 bp, Heterodera glycines
ataattagggcttctttttttaggcaattcctaaaattttttgcgcacttgatacgctcagataagctcaaaaaacgcgttttccgctttggggtgtctacgatgacttttataatgtagtaaaaaagaaaaatacacacctaagaatcgaccctaaaaaatttcgaaatacacccctaaaaattgaataattgtcacaaaaattgatcgccaaaatctaattttatttttttcttgataaatgttttagatttaaaaattgtccttattagcaaaaactttaaaacaattaaaaatgaaaaaaaaaattgtgcaacattataaatagggcagggaattatatggaaattcatattttttcctggactgtgagaggcctgaaacaaacgaaattttacgagcaaaaagtccaaaatatgttttttatgtgctaaaaactcactctgattgctttgaaaacaggtaaaaatgctatttatgagcttttcatgcgatagaatgttcgcaaaaaatatatgtaaaaacatataaatccgttccctgattattacattacagacacaaagacaccgattggtattattgcatccggtctggctctatgaacgatatatgtatagctatttctgaatctttaattttggttccaagtttgatctttttgggttttgattcggcttttaatttgtgcctttttagactatttcataaattattttttacggatttttcaattatttgcatctatgtctaactgtccattttcagtaatattctgttttattcattttgctctcactctctctctgtcaactgtcacttttttatacttttttgatttcaaatatatttcttaagcataaagtctaaacttttaaaaaaattgaaaagtctaaaaaaaatactcttgaagtatttttaagggatgtgctgcacctggagttgattctcgcacagaatcaaatcggtgagcagcgcacatgaacaaattgacagggtgatcacagtcaaattgtttttggccgccttcagcacttccaactgcttcaattggtctgcaaaaaagggggacatgaattt

SEQ ID NO: 24527 - DNA, 458 bp, Heterodera glycines
tctagagtcacattttgcacaaccaacaaatgtgttcaagaaggtaaaaccatttaatttttttcacatatatgaaaatgctatgatccgaatgtttagagctttccattttcttccattatgagcgacaatttcttcggcggtgccgacaccaccgtgccaacaattgttgaccaacatgaacacgcccaatcgcccataactgctctctcatcacctcaaccaccaatgggagattgtgtaacaaaatacaacgtggaatttccggcgtcagaaacaatggtgaaacctccattggtactgcccagcgatccgtcccattggttgaaaaagtacccaccgccgaagcagaaccgtccgatgaatgaaatggcagaggatttgtactgctgggaatcggtgcttggttggaaggtgatgaggagatatgaaattaaactacacttgttgttcaagag

SEQ ID NO: 24528 - DNA, 1168 bp, Heterodera glycines
gagtacgtaccccgagtaccccccccccccccctgggaccgtccctgcgcggtgggtgggggatgatagcttgctgacaatgagccccctgcccacccggaacgcctttttcccggcactctgctgacgccaatccgaccgttttaaagagttcgttgacagtgtctttcgtaactccattctcatagaaattatcgcccaaattcagcatcaaattcagtccttctttctcggccagttcggccatcagtttggccacactttgttgtcccttcgtcggactgtgctttttattttcgtcctcttttccgcccgcgtcggcgactacaaaaatgcgcaatttctcactcttctcatcacaaccgtagtcagtcttcccatcatagtaatttgtgcagggagtgccaatttgttggattttgttgggtttttgtccattggaagggaggaaaagtgggaaaaacgaaggacagaggaaaagcacacttctcaaaaaggcaggcatcaaaagctgatataataagaagtactaaagtccaccccaaaatggcattttaaaatgccaaaaggcacacgtgtgttaaggcattggcacgcatacaaagcgtgaatggttgtaagtgaagtgcgcaattgccaaattaaaagaccttgtgacagccacgctaattgatcagaataaaaaaagagaaaaaagaaattgccagaaatacaaatatataagccttccttcatcactagggctggaaatttaagtcactaaaaatcttcaaaaagtctactaaaaaagtcataaaaaatcgccaaaaagtcataaaaaaggcaaaaaagtcacgaaaaattgaaaaaagtcctgaaaaaatagccaaaaagtcacaaaaaatccaaaaaaacacgtaaaaatgcaaaaaagtcctgaaaaattaggcgaaagttaaaaaaatccaatttttaataatttatagaataacattttgatcgtatttttaggcacttattttataaataggtcctaaaataggcataaaaaagagattcttccaacaattaagaaaaaattctccaggtttcattgcctttttatcgatagaaattttattcgctaaaattcaaattttgcctcaaaaagtaaaaaaaatctcgaaaaaagtcgcaaaaactcgaaaaa

SEQ ID NO: 24529 - DNA, 1740 bp, Heterodera glycines
aaaacacctttgggcccatcccccaattcacctttccataattataggagttccccggaccccgaagagcatattcccatcttttattagtgcttgattaaactatgtatttttgcggggtttagtatatacataataaattctatggcatgaatacagaagtttttcatccgtaatttttttggtaaaagtctcaattattattcctgctgagaaaataaaatatatttattctagtaattagattgatcaaaattacatacatataatgttagtattaacctatatgcgaaatgcagaaagccaattattcgaaagtcaataaaatttcctttgttataagctgttttgaaagaatgcaatgttgcgataaaaagcaactgttgaagactatatgtttgtctaccgatagggggtattatttatctaaatattttcgattcgataattgttaatacgctttatggtacatctgctgtcatatctcatgattgtataaatatcaatgaagaatttcaacgcgtttataaatttgttggtctattaagaacgcttcgcgtcctcagacgggagcttcgcgcccgttttttagcttgttaggccgcttcgcggcctcagtcgggcgcttcgcgccggtttttcaatttttgttggccttgaacgggcgcttcgcgcccgttttttaaatccgttgaactcatcagcgattagaagagtgattagaagaggtacaacagtgattagaagtggtacaacagtgattagaagaggtacaacagcgattagaagaggtacaacagcgattagaagagtgattacaacagcgattagaagaggtacaacagtgattagaagaggtacaacagcgattagaagaagtgattagaagaggtacaacagcgattagaagtggtacaacagtgattagaagaggtacaacagcgattagaagaggtacaaaagtgattagaagaggtacaacattggtcagaagaggtacaacggtgattagaagaggtacaacggtgattaaaagaggtacaaaagtaaatggaagaggtacaacagtgataagaacatacaacagtgattaaaagaggaagaacagtgattagaagaggtacaactgtgattagaagaggtacaactgtgcttgattagaagaggcacaacagtgatgagaagaggtacaacggtgattaaaagaggtacaaaagtaaatggaagaggtacaacagtgataagaacatacaacagtgattaggagaggtacaacagtgattaaaagaggaagaacagtgattagaagaggcacaacagtgatgagaagaggtacaacagtgatgagaagaggtacaacagtgtgagaagaggtacaacagtgattaaaagaggtacaactgtgattaaaagaggtacaactgtgattaaaagaggtacaatagtgattaaaagaggcacaacagtgattaaaagaggaagaacagtgattagaagaggtacaaatgtgatttaaagaggtacaaaagtgataaaagatacaatagtgattagaagaggtacaatactgattagaagaggaagaacagtgattagaagaggtacaactgtgattaaaagaggtacaactgtgattaaaagaggaagaacagtgattgaagaggtacaaaagtgatgagaagaggcacaacagtgattaaaagaggaagacagtgattaaaaagatacaatgtgatttaa

SEQ ID NO: 24530 - DNA, 947 bp, Heterodera glycines
aaaattccagaacaatagtatcgcgtcatatgctgagaatgcggtggaaattcccttgactgtagaccagaaaagagatagccattttccaaaattttcacgatcaaatgcgctgagaaaaaaattccagaacaattagtatcggcgtcattatgctgagaatgcggttggaattcccttgactgtagaccagaaaaagagatagccatttttccaaatttttcacgatcaaatgcgctgagaaaaaaattccagaacaattagtatcggcgtcattatgctgagaatgcggttggaattcccttgactgtagaccagaaaaagagatagccatttttccaaaattttcacgatcaaatgcgctgagaaaataattccagaacaattagtatcggcgtcattatgctgagagtgcggttggaattcccttgactgtagaccagaaaaagagatagccatttttccaaaattttcacgatcaaatgcgctgagaaaataattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagaatgcggttggaattcccttgactgtagaccagaaaaagagatagccatttttccaaaattttcacgatcaaatgcgctgagaaaaaaattccagaacaattagtatcggcgtcattatgctgagaatgcggttggaattcccttgactgtagaccagaaaaagagatagccatttttccaaatttttcacgatcaaatgcgctgagaaaaaaattccagaacaattagtatcggcgtcattatgctgagagtgcggttggaattcccttgactgtagaccagaaaa

SEQ ID NO: 24531 - DNA, 1265 bp, Heterodera glycines
ggatgtagtgttggtcgaggagaatgacactcctcgatccgtctggacaatggccagaattcttaagcttcagaggggacgagacggggaaactcgttccaccctcattttgcttaatggaaagggaaaatggagggcaacgaaccaacttttcccaatggaagttcaatccgaaattccagaaactcagctcatcgcattcatcatggacatcgacatggactcagtctcactgcccggaagtgaagacgaagcttcagagcgatcggcacccaaatttaaaattccaaagaaacgccgcgccttcttgcgaccgatcggtcaacagcatagccctttgcaagggcctcgtcgaaaaaagatggaactcggcgactccggactacgcaagctctttgcggcgataagcgaagagcaaggcggcagcaaggcgacgacaaatgcgataacggagagccgacagatggaaaaggccccggagcacgtcagaaaggagcacgacaaggaaatggccagaagacaaagagaaaaggtccaacgaataccaacggaggaaatcaggcagaaattggccgctctcccacacatcacggtttcttcggaaaatgccgaaacacagagaaaggaacgaaaggagaacgaagtgcgtcgcaaaaacaatcagcagtccacaagcgaaggatggaagcaactcgccaagcaactggattacgacttgatggatgagcccgatgaaccagccctggaacggcgaaaggctaccgaagaacagtcggtaaaatgaagagaagccgaacgacgtcaaattgcacggaaaaaaggcatcgtgcaaatgaagaagcgcgcaaaaccgctgaagtttcccaccgaagatgaaaccttgctgagctacgtaaagcggttttatgacaaggataattgggttctctcttggaaaagccgacgtattctggacgaacttcatgacttggagaacgaaggacgttggttcttataccacgcagcaaatggcgctcaactcactatctcacgaacgttcgatggaacacgaccattgccgaatttcgatatgtggaggaaggacacctcgtgaatctgactccaaaccaagtcatcatccgccaaacggttccagatgagcccgaagagagtccagcgagaaataataaaaagttggatgagaaggcagaaaaaccggcacggaacgataaacgaacaactctggccgctcggaaggtggaggagtattgcacggcagagatgaa

SEQ ID NO: 24532 - DNA, 1355 bp, Heterodera glycines
cgccgcagcgcaacagtcgccacgaagttaaagcatcgtgccaatgaaatggcgggcgagggcggcggcggcagagcgcgcgtgacgagggcggcggcgacattcatcaccggcactgaccacggcaatggtcgccctgtgccgctatgccctgacggacacctgcgaccgttgctcatcaccgtactgttggacatgacactgtcctcgtcagcaacggtaaacgatttgataaatggttgagtaaattacctcccccccccgcatcgccccgccccctcgattttaaaaaaagagcgttatttttgggtgcaccccaaaatctcgccggccgaaatctcgccgcagaaatttcaaaaaaaaaatttcaaacagaaatttttcaaggaaaaaattcttagaaaattttttttataataaaatttaaagaaaaaaattgttgaaaaatttttcagcaatttttttttgaaattttatgaaaatttactgtttttttttttgaaaaattttcaaaaaaaactaagcaaatagtttttttttggaatttcttataaaaaattttctaaaattttttccttgaaaaatttctgtttgaatttttttttttttgaaatttcggcggcgagatttcgtcccgtccccttatttttcgggttcgagtcccatccgcgtgggtttgacggtgccattagttgtccagacatggacaggttcattccttggtatatttttagcatattgaccaaaaataggttatgggattttaagccgctttaacaccgtttctcttaattacacagagtcgtgcggattttgacattgttttgtcccatttggctgcctttttggagcgccatttttctgtcgcatcgcaacgattgcgactgaatctgatcggagtggatgaaatggggctgatcgcaccggtggagcagctcatccccgtggaacagttcagcaacaaaacgaagaggctgaaagagtggcgaacattcggcggagtaatgggcaaaaagtcagtgggagaaaatgatggaacagttggccgagatttatcgggttaatggaagccctcgggattagttagccaaccagattattaaaacaggctttatcagctatattatgattagtcagtcgttatttttggcacgtttagtttgatcatgagtttcggtaattgccaattgaattttggctccttccgggtcgccattctgatcatttagcgagggaaagtgtgtgaaacagaatttttgtaaaaacactagtcaaatgctttgattagatgagttttattcctccccgaaaggttaaagccgtcagcggctccaaatctaagcaaaggtttacaa

SEQ ID NO: 24533 - DNA, 1433 bp, Heterodera glycines
ttgcggagactcaacaaaaaacatcattcaaaagctattttgtagggaattttgtgctttaatgagcagattgtttttaccaggatatttttccagcccactagaaattttttcccaaaatttatgaatttcccaatttcaagtcattttgggcttttcagacccccatgaatgagtgatctgattaacttgtttaagtgacttttttgttctgcacaaaagctcggctagcagtaattagttcaagagtcaaatttcttagcctttgcttagaaaaagattcttctttttaatatctttcgaataataaaaaattattcgatttagttggaaatgaagtgagttatggctgatcaaatgtgaccaaaactaaataacgaaaataaggcactggaactttcgtaaatgttgtaaattcaatctattatttctattatcctaaaaaacatctaattaacttatttgaagtgaattggaagctttgagctctgattatgaatttgatcagattaaatatactttgtatttcatttgagtgtattggcgttttgttttttacgccaatttaataattagggccggatttatatgggtttccatattttatacttatttcggccgaaaaatcacgtaaatagtattttagcttgatttgttgcttctagggtgtctttttattccctatttttcatattttttgtttttgtctatacatagttccattattttacattcatatttttggcattaataaaaaaaaccaaaaatttgtgtaaaaaactcataaaatgcgtttggactcataatgtgcaatttgataatatttattttattataatttttccattaaataatccgcactcatattttggtgcgcattgattgacctttcttagtatcataaatcttcctttgaaaagcaattaattaaccattcttggtatcatttggtgtagccctgacaaatgagcggcccacaagtgaccatgaaatttcgggattttaatcagccaaaaagagggggatttcgtgcagtggtggcgtagttgctttatttcctttttaaaatttcccctaaaagtacactccaacaattttaatcgctttatcttttttcattcaattattttcattaaacctcatttaaatgtattaaattttttaaaaaatttatttgtttaatgatcacattgtcaaaaggtaaattatatgcgttgatgaaattaagagcatccaacacataaattttatcccgaaattttggccaaaaacgcgtgataaaatttatttaataatctttctcttaatgcacatctcaaatttgtaatactattttaattgatcattttaatatgttttctttttatttcggaacttttaatgagacgataaatgtttaatctcctaacatatctgccgactccctatattta

SEQ ID NO: 24534 - DNA, 985 bp, Heterodera glycines
  misc_feature (974)..(975): n is a, c, g, or t
gctgtgcttgcccactgcatttcaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcacttagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatgactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggccnntgactctaga

SEQ ID NO: 24535 - DNA, 2265 bp, Heterodera glycines
caatcaatcagccaaggctcacatatcccatctgccctaagggcattgagtgcagagttatcattattggtctatgaactcatagataatcattgtaatccacaaatcttccgaaaaagcaggtcctataatcacaattcccaaaggttaggtctttattatcatcaaagcattggctcgataagctgtgcgaacgatcgatatcctatattacttatcggcattacactatttatgccatagcttggcaacagattggcgacggatatgacgccgtatcagagtcagtcccttcacaatggacttctcccccccccccccctcgccaaccgattgatcgcggtacaatttaatgattgattgttgttgtccgttttgtgtcttctcgtcttcgccagaccctccctccctccgacacatttgctttgtgtgtgaccatcgcgcttcaatgagaaaacgggtcccccgttgcgcctccctatccattttcagtattttttgagccgtttagggtaattattggcttaatttgtcgccgatcccccacccaaatccatctgaacacattgctcggctcggggcattttgtcagctaataaattaagtaacgatctgtcgaattcatttacaatgcatcctcatttattttgttgcttttgaaattttgtagttcataatgtaaggactaatgttggggtaaattcgatgccaattccaaaaaaaatgccgatgcatttttctcgactccactcacaattctactaataattatattcatccatccgtctgcctgcattttcggccttttgtccctcttgggaccaaatctttggcactggactaaacattttggcatttcatccatccatgaccattcattcattctttgtattttttaaatccgaatgcttctctcatttttccaaattccaattcttccgcttccttcagcggatcaaatcagtcgagtcactcactcactcactaattgactgatttcatcaaatttaattatttcttgaattgaattatgcctttgtttgtcttgtcattgtttctttcttcttcccccgctgggttcattcattacattacgcttaattgggtcaaactttgttcattttcattttatccctcccaatttgtgtatttattatatgtgcatgtacacatgcgcaagacaacggacaacatccccaccaaattccgatcaaagcgtcaaatcactgctgattatgattgatggcgatctctgtgccctttccctctccctccgtctcccccatttgcattcgcgcgcacacaaacatttcgccaacaacacacatgaatttggaatgaatttgtgctgtgcactttgtgccgccgtcgcgttggcgttctgtcttggattccgttccgagattagctgcacttttttttcttactgaattagctttttgatcagcgatgattttgcgcgaaataaaatgcgcgcactcaattgattgacgcacttgtaaatgaaaaaaaacacttaattcacttttcttaaaaattttttttaagaaaagaaatgtttctgaaggcaattgtgatcaattaattaattaattaatttttattaatgatgatgttcacatgaaatgagcgattcattttattcaatatataaatttgttacatattttcttttgtttcttaatttttcatttgtaagtattgtttccttcctccacttgctttttttttcttaaataccgtcattaaataattaactgcattggcttaatagcctaccaaatttccatccgattggcttgacagtacacagaattcacaaaatttttcatcattcgaacaataatttttctgttcaaaaacgttcatcaagtcaaatggtccagtttgacgttttgtcttacaaaaaattgtcatttgtttcatcaaaaaatttttctttttgaccattattttttcgtaatgcctgcctttgatttttcgattcacagtttttctccaatttacattcacaaatccgcttttgattgtaattttgacgttttgtcttacaaaaattttgtctttgtcacatatttattttgtttttctgaccattatttcttaaatgccgcctttaatttttcactatacttttttggggtcatcaaatctttaagcattcttttttttccgaatttccattcacaaatccgctttaattgtcatgctaagtattcattaccaaattgccctcctttgtcctcttgttgctggtgacatttt

SEQ ID NO: 24536 - DNA, 1635 bp, Heterodera glycines
ctaattagttgtcatgatcttttttcattttaatacgtattttttggcaatgccatttttctgcacgtataaccacggcaaacccatttttaacgtggcattttctgctatgggctgagtaagtcaggaaaattcaatcccgtgatttgaaataaattccgtcatttaaaaaaaaaatttttctgacccttctagtggacaaattttgaaaaaaatcactgaaataaacggagctaatttttgggcattaattaaatatttaggtcggccacttaatgagctttgcataacgaaattgtattttattttatcatcgtcattttttccccttttcttccgcgttataatttttaatttttgtgtagggtttttcatttttaactttgctttaatatgtatcaacatttttttttgtttttttttgtacttgtttatttgtccgggctttttctttttttgggttaattatcggcattcgtactgagcagcccaaacctttcccttatttccatttccacttttgtattatctttacccctcatcccactcaaaatctctttccattgggcaagtccaccccatatgcccattctgcaattgtctgggtgggtcatcagtgtgctcatttgtcagtgctattatttgccttgagacaaaattttcccaattaactaattgcactgacccatccctctgagatgttattgattcaatttattccggggtttgaatgcaaatttattatgtccgtgtttctgctgattattataaattttttccacaaaacgttagtagagaaaaattttattgatatatatatttagggctgcaaattttatgtaaatacatatttttttcctggcttctccttgctctaaatagcaggaaaaacactttcttttttgtgtttgcgaacaaaaaccgggacttttatttacatatttttacatatttcggggtttttatacatatttcgggattttcttacatatttgtacatattttagatttttttcatatatattttcatttttttttacatattttgagtattttttacggaatttttggaaatcctcaaaaaaaatccaaaatttcggcaaatatttttgtacatattttcgtttttttacatattttgaaaatttataaagaaaaaataagtttgaaaatgttgcctaaaaataccaaaaaaaaagtaatttttatgtcattttgtggctatgtcataaagctctcgacaaggataagctttttctacgcaatgctaatcaatttgatgagttagaaaaaagatatgagcgttcgaaattttgttttttttgaataactttttaatgggaattatttttgcaaaaaccttcatttagaacaatttcgaatctcggacgcgaattcgaacaaaaatattttgaaaattctcacttttgttcctaaattagtttgtaatgaagcgagaaaaattcttaacttaaaatgaattttatctttctgagacggagttggccccttatacaataagaaggagttggccagacggagttgcctaccggtttttcgatacttttgttcatcgaccgattatttgtctgtttctgtcaatcattggcacattttgcgctatttgccaggtgt

SEQ ID NO: 24537 - DNA, 2473 bp, Heterodera glycines
aaatttgtccgcataatgaaattttttgccaattatacagacgaataataacagcagcaatttggcaaacattttttgtaagattttttctacaaaaaaattaataaacaaaaaaaaataaaaaattattttcataagaattatgatatagaatttttatggttgtaaaaaagaagctgatatttataggaaaatagtataaaagaattcttttgctccttttaaatgattacaaaaaaaggtgaattgaaaagccaaaatatttcacaaaggaaatgagaaaaacatatttattttaaggttttactttacgaatcatttatattatttttttagttttcatttaacgaatttttatgaaaaattttgccttttcaatataagaaaaattttaagtagatttttttaaatttgcttttaatgattagttatcggattcttttttttatatgaaagttttcgatttcacattattatcaataaattaaaaaattattttggttcttaatattatacatattattcaaaacaaataaatattcttcataaataatcaacaaaatgttttctgtactatgaattttccttctaattaattccttttttctatttcctcaaaagtcgaaatcggatgacaacggttcgtcttcctttccatggccaaccgaactttgttggccagggttggtaatcacatggctcggactcggcacattttggtgcgcggaatttccttgaaaataatcttttaagttttcaaataaatatttatttaaaattatttggtttgcctttgcttgggtgtccaaaatgcacagtaacttcaatgttcagtgcttggctaattgctttgattgtttggctttcctgctcaaattgacttttcaaactgtgccattctgtgccggtgcccgcatggccagcagcagcagcggccaagtcgaacatggcacgggcaaagcccaaattgtacggacactcgtcctcataagtgatctccattttcgcaatatcttaatggggtaatttgggcaatcattgtgtattaattagtctctcataaaaaatttcctgcaaaaaatattcctttaattaattccaaatttgcatttgccataatttgatcatataattactcctcagctgccgatcgatttcgtccacaatttgtgcttctcccccgctgggacatccgccgcgagaggatagatcactttttaacccatccacagtacttttcgtcattgaacatactgtagacgcgtcctcaccggcagcagagaaagtgccaatgtatttggacatcacagaaaccacttgctgactgcccgggcagcacgggaaatctgtgaaatttaaatatattaattaattattttctttttgaagattttggtttacttggcattgcattgcaacagaccaaaaagacaatcgagaagatggagagcagtagagaagacatagcaaaaaatattttgttttatttaataatgaataatttggtattttgttgtttttctgcccgtttaaatacccccctttttatttccttaatagacgtggtttttattagactaaaacatacaaaaaatctttttgcggaaattggtggatttttttataagctttcacgtgaattttaaaagaaaccgaaaatcgttgacaattttttttatttatttagcttttattttaatgtgtgactttatcaatctatttgcttcatgtcgaaattttatcttattgtctaaattttgctgcaaaatatttttcaataaaaaatatcttttaataaaaaaaattctttaaatcgtccatttaagaattgaacaaaagtgagtaaaaaaaaaattatttaagggattaagaattcaattttaatacttaaaaatttctaaatcttcataaaattttctcggtggcgtctgctagcactgttgaccgacccccttcttcccagaaatttgtcgctctgcaaaatttttgcgaaaaccaaagcaaaaaaaaacatcaaattttggcttttaataaattaggttcaaaagctaaattttcatacattgatttgttctgaatttgaaaaataaaagactcgtaaacttttgttttactttttcataaaaattttcacggcgcctccacccatcagagtcattaaaaattaagccttttaaagaaattatctcaagcccaaaaataaaataacgtaaaaattgtgattttgattttacactttcaactacgaactttgttgaaattatcccaataaaattgatgaataccgtattgttcgttgtggcattcatttggaactttagattttgttttgaaatttaacagtgccaatgatgaatgagctttttgtttgccccttatttccatttacgatacatttaatgtcaattggtgggcatggaaacaagttgaaactaatcccactattcacctgattaatttagggttcggaccc

SEQ ID NO: 24538 - DNA, 1339 bp, Heterodera glycines
tttttggtgcgaaccacaatcccccgaatgggtaggtccagcaaccatttttggtgcgacaaatgccccgaagggcctgtcagcgaacctcattggtgcgacaaatgccccgaaggcctgtcagcgaaccactggtgcgacacattccccgaagggactgtcagcgaaccacattggtgcgacacatgcctcgaaaggcttttcagcgaaccacattggtgcgaaaatgccccgaaggcctgtctgcgaaccacattggtgcgacacaagccccgaagggccagtcagcgaaccgtcttggtgcgacacatgccccgaaggcctgtctgcgaaccacattggtgcgacacaagccccgaagggccagtcagcgaaccgtcttggtgcgacacatgccccagaagggccagtcagcgaaccgctttggtgcgacacatgcccaaagggccagtcagcgaaccgttttggtgcgacacataccccgaagggccagtcagcgaaccacattggtgcgacacgtgccgcgaagggccagtcagcgaaccacattggtgcgacacgtgccgcgaagggccagtcagcgaaccacattggtgcgacacgtgccgcgaagggccagtcagcgaaccgctttggtgcgacacatgccacaaagggccagtcagcgaaccgctttggtgcgacacgtgcctcgaagggccagtcagcgaaccatatttgcaaaaaatcaaatataaatgttagtattgggaattaataaaggacagaacaattaaaaatgacaagaatttgcaaaaattattattttttaatttggcagttttaattgttcttgagtattctaggaaagaacttaaggcgtacctctgctatattatatttattatctattccatcctcagatttgggacagaaaaactattcctatatatagcaaggtataatttaaaataaatagaactctgaaaatttttcaatgtcttaagagggatggaaagtttctgctttgtttagtatataagatgcattgataaagtattagtataaaatcatagctgccagatgaatattcaaaatcattttgccataaaaaatcaaaataatatttgaaaaatcaaatcaaaaatcaatccaaaactttttttgcggcgctctttttaattcagttttttggatgtttaatattctaacaaatactaaaataggaacaacattcgaaagcagaaactttcattggcaaattataaaaaaattttacattccaccagtaataatggttggaactaacggcatttcatttttattgccatcaaaatgtttgtccaccagcgcattgaaa

SEQ ID NO: 24539 - DNA, 1170 bp, Heterodera glycines
  misc_feature (463)..(463): n is a, c, g, or t
ttaatgttgatggtgggtttgtgagtaagccgagtggagtcgatgaatgactgaattagatcagatcagatcagaaaggggccggggaaggtagaagcaacggggaagaaagagggggcaacggatgccaaatgctctcccatccccgcggggctcccaattcatcggatgggcggtccccagggcctccgtgtccagggacagccgtatcagccacttgtcaaatgtttgttggcactaatgccccagggaaagtgttgtttgtccacgagcattcattccttgcggcaaagtcaaaagtcaaaaagttctttgaacgagttacactcagcaggtcaaattgacgattaaaggaggacattaaaagggacaaaggagccgagggaataattaattgcctttgaaaatctgtgcattttgagcatttggtggggcaaagggacggggagggggcgggaggggngggggggggggtaacacatcactccccccggggggggggggacgggggaaagattaattggccgcatcaatgcaaaacggagaatgatcggactaagagcacaaaaaaaggaagtcagcccaatgggcgatcgctatttattcgtcccttctcacatcagcagcagaatttgtctatcctagtggaagaaaatgcgggcgaatgtttgtggcgactgagaagcagtgggaattttaggatggaaaagcgaagaaaaacaaaaataaatattaaataaatggcgaaatttgcaattggacaaacccattattagcatctccaaacaatggatttttaactaacgatgaaaagcgatttttgatattgtgtctatggaagaatgggcactaaacacattttatccagcaaaaaatgttaaaaggccataaaatgacgaaacggccaacgaatggccgaggaaaaggaaggagagacattgaccgattaatcggtccgggaaagaaagagaaatttattaatttgggatgtcagcgaatttggcaaaagtctgcagtaaaataaaaggaaaaattggattaaattgttcaaaatattttaaaaagttagaaagaccgttttctttattatgactgactaatttattcatcggtttcatgaaaaatgagcgaattcaaatcggaataatcggagggggggggggagagaaa

SEQ ID NO: 24540 - DNA, 712 bp, Heterodera glycines
tgccgcccgcctgatgtttgaactttacattttttaaattttttcacgtaaaatttcacgtaactcacgcaaaactcatgatagctaaaaatgaacgtcatattcgtgttcagcgcataaaaatgccctagaaaaaattattaaaaaaaaatttcaggggggtcacaaaagggataagaaccagaaaacccccataaacatgtttccaggacttttcagaaccaaaaaacactatagtatattaccgaaagtaggaattgagccggggtttatccaaataaataaaatagtccacgacaaaataataataataaacacaaatcaatcggcgacaaacaaaacgcctaaaaatatcaccaacgacaactaaatccaccaactgaaacttgaataaaacaaaatatttgggtcgaattaaaataaacattatgccaaactaatacaaacaatcaaataaagggtcaaaaggtcaattttttttttttgaattttttttttgttattttatttttgatttttttctttttatttttttttaaattttttttgattccacatccccggcctctaatgctggtatgcacaatggtaaggataattatccgcagctatagattagcggatagggtagctgcagataaaaaaatctgcagataaaattcgcatgcacaatgctaaggatacttatctgcagctaacgatttttttatct

SEQ ID NO: 24541 - DNA, 1423 bp, Heterodera glycines
  misc_feature (1387)..(1387): n is a, c, g, or t
  misc_feature (1400)..(1400): n is a, c, g, or t
caatgtttctatctaaataatttaatgtttacaaaaaataataattttttaataaatttacaagtaaaactcttacaaattggcaataaataatattagctaaaattgaatgaatttgatgccggaaattgggaaattttagctttaataataaatatttatttaatgagaaaatgagaatttattattgatttggatgagtaaaatttaaacattttagaaattataaagaaaaattatacaaaatttgaagaaaataattaaagaaaatgaaattattattattattttgttttattttaattttaataccctaattattccaattaaatagaaaataaaaaactgcaatgaaaaagatataatgaaattaaattttagtggaaatgatttttttatcatttttttattattgctattattgtttaacaaattataaaaaaggtgtctttaaaattgtaatttgactttaaaaaaatttaatttaataaattatgaaactttctgattcattttccttaaatccaacaaaaattttgaaaataataatcgacaaattttaatttttttttaattttcaaatagaaattaattaattttatttatgcgattaattttaataaaatatgataaatacaaaaatggccgcataatttattgcgttggattgattgtcaaagcaaaaatattattgaaaaatggatattttcaatgtttcgggttgaatttccggaaatcagggcaaatataattaataaatcaggacataatgattaatgtaattacaaaaattattattaaaatttttttcgttaactaaaaaatctgtttgttaaccgtaaataacaaaatttttgtctgaattattttgtgatttatgccaaaaagcatttttcttcggcttatcctccttcagattttaaaacaaaatttgtcaaactcgactttactcagccgcaacaaaatcaaacgcaaatttattttgaaaaaataaacagacaaacagaaaatgaaaatgaaaataagtcaaagtgccagctgaaaggtgtgaggctggtcaggtaggacaaagactctgccggaaaatttttccataaatttggtaaaattttaaaatgtgtttaactttaattgaatttattgtaaatttgcgcagaaaatattttcaaaatgcaatggaaatattaacattttcattaagttaaaaaatctgaacagaacacctatagaaagttttatgcaaatacaaatagaatttttttgacaaaatataataataagtctttttttcaagcactgataattttttaaacaaatttgtccaatttttcgtagctttttcccattcaatccttcaaaattttaacgccaaaattgtttcttccanatttaaaattganttttttacttaattggacctgca

SEQ ID NO: 24542 - DNA, 1639 bp, Heterodera glycines
  misc_feature (28)..(28): n is a, c, g, or t
  misc_feature (33)..(33): n is a, c, g, or t
  misc_feature (136)..(136): n is a, c, g, or t
ggggaaatgactcatgctaatggacacntaatntagtgacactaattattagcaaattgccattatgaacatgcaaatggaaatcccaaaaaaaccaaacataacgaacaaaaaagttttttgtttgattccaatntatgccgatggacgattcatgtgaaacattcattcgtcagtttgcgtcattttttgagtgcaatttgcgtgttcactctaattaggtcactaattagcccatggccatgagtcttttccctctgtccgtttaatgttgtctcattaaggtcatttatgattcaaataaatgttcgacctgatcaattttcattacaaattaagaaaagagttggggttgaccatttcaaatttgttcacccgtaaaatgtcaaaaagttgcttttcatcgtaaaagatttgcctttcaattaagctaattaagacaatttccatttcaattttctgttttctccacggttctcaattaacatctttttttgggttcattttgacaaagcgcccgcggcacatatcctcaacaaaattgctgaaaatatgtaataaaaaatttatttctgaaaaatgttttttttctttttttagttatataccgagtgatgttgtacacgacgttttcaaatgggtaccaatgaaagtacttgccgaaaaaatttctgatgccaattaccggttcaattggttaacatgtgcacggcgatggcacataaaagtattggagataagaaataggaaggacaacaatggaatggaagtggtcgatgaacgagggcaacccttgccaatcgccgacgaaccggtgccaccgaacgtcattggattcaaactgatgaaaatcaggtggtttaaaccaattccgttcttgagtcaattgatatttcctttttcacaccatttcagttacctcgaccagcacgccatcaattttatccatctttttgatccacttttctcccgcatttcaacatgcttggcaatttcggcgagcacagtggacacatcatcatttattacccaagaattaatgccattgctcaacgagaggatttttgctatgaacttctgggagtccaacgacttcagtctgttgcgccaactcgagccgcacattctcatgcagtgcccttttctccgctacattgaattcaacgacatatttttcttccattttccgggccaagacattgagacggcgttggacagtgaagccgtggccaattggttaattatgccacgtccgagagaggcggcgccaaagttgcttcagtgttatttcactggtaaaatgaaattggaggccccgatcatggcagcgagagcggtgaataattcttttggcttaccgtattttattagaaatgggcaccccgcggggggtcctttttcactccctttgagtctcacacacatttagcgccttatttggggagggtgaattactgtattttcaagtacagtatgctttggatggtaatttaggtggtgtttcttttcaggcatttaccgagacaaagtcagcagcgcctttcatcattgccatttatcgtcgttttttcgggtctcgggaatttttgtttttgagcacagcagtaaacattcgattttgacttgggttatgcgatca

SEQ ID NO: 24543 - DNA, 1694 bp, Heterodera glycines
tcgtactcagcgcctcaaaacacccgtagaaaagtgttattatggatttcagaaaagttaaagaaaattttttcaagactaatgaatggaaagacatggttgctcatttaaatttatttttttacagaattttgggactcagaaaattccaagaaccccctctgaaaacaaaatttttaaaaattttcctcgaactcgtcccccaaaacgtaaatacaaaattttattggtgcatttttgaatactggcaattttcgtaacaaagtgcacttaaattttcaatttttttcaaaaaaaattttcacttgggaaaagtcccggttggtcccggtcccgggttttttcgctgtcccggtcccggtcgaaaaacttggtcccagtcccggtcccgacttttctggttccggtcccggtttttgtcaaatttcccggtcccgctcaacgctattcataaccccagtacaaagaaaaaaattaacttaaattagacaattaggtattccctaaggtgttttggcaagttcaatcctagacacacaattcttttattctgattcatgcattacagacaatttgcctacgcctctttcaattattaaattattccaaatgatcaatcgtggtaatgacactgacgaatgggctgtccaaaaaggagatgaacgaggcatcgtagcggaggtaaattgtgcatttttcattgaaatgaatctaacgaatggattgctcgcatttctttctgaaatggtcaccccctccccttggaagaattttttggtaatatgtagtaaggctggtctccctcctttttcgaaaattttttttatgttttcaaaagtcatgaaaaatgtttccaaggcctcgggggtcgcctgatcacgaatccggcatcaatttcgccaattccggacccgaattcgaacaaaaagtcgaaaattcaaattttcgaattttaggtttttgtttcaaacttcagaaatgaagtaaaagtcaataatgattcaataaaagatcatttaaactacttttagaccaaaaatgataaatttaaattttcgctttgttcgaattcgggccttgaattctgaataggtcgaaatggatgccggattcgtgatcagcgatccagaaaagcctttgaaacatgttttcattttcatgactttgaaaacataaaaaaaatttcgaaatgggggggggggcatgaaaatttcttgcactttttttggtctaatttttttttgggtttttacccaatgataaataccctggggtttacgaggtcgctgatcgcgaatatggcatccatttatactaaatcgggattccggccccgaacttgaacaagaaatcgaaaaattttttcaaaatagtactccttgtaaatagcgccaaaattctcacttttttctaaactaaaaaagggtaaacataaaaaaatagtcattttgttcgggtccggggatcgaaatggttaaaatgagtgtcagattcgtgaacagcagccctgaaagcccgcaaaaatgttttcaagacttcttcagaacaaaagaaaagttttttccaaaaaagataggggcctaccgacagtattaccatgacctggaatggtcatgataatttccatatcgccattcatttagttttttcacaggaacaacagccgaaagccagacgcggtaattctccatttt

SEQ ID NO: 24544 - DNA, 1826 bp, Heterodera glycines
atttttcctctcccagtttcttaggcaattctttctcagtttttgcacaccctgttttgccctgtgcgaacacttcttcccttgcaccatcctcggcacattcattcggcatgatggtcattgacacttccgttccaccgccagcagtatatgctcggactggacgagcaagaccaaatgtacgcatgacgccttatccaccacaacgagagccacgaacgagttacgcagaagcagtcgaacatggccgaccagcaccgaaagaacgaaggacggatgttgtatgccgcagatgtggaagattcggacacattgaaaaacgatgccgaacgtgattttttttttctgttctctatatttctcactcattcctttttcatcattttcacctctgggctttatcaaaagtgatttaaaaaaaattttaattttcggataccatcaaattttactcatcgatcggggacgatcgcttcaagggatggaggtgtaaaagggatttcttaattggatttttggccttttccgggacaaattccttcccgcattttccttcactttcccatctctttatctccgttcaatcagtcattttcttatccatttcattttctatccttcgccatccgcgttatatccatcattcacttcattttcacatttcgttttattcaccaatacgtgtggtttaattacccaagtttgagatgggagaataaagtaattctggataatatttggtcgccaatgatcctgggagggcccgcccgtttcactataataatgaaatcgcaatgaatgctttctattgcatttcttaagagaaaaagtttttgtttttgttattattaaaaagcgtttggaaatgaatgctcttaacacttttgtaaagaaaaagaattgtttttgtatatgcaaagtcaatggaaatgatcttacacttagttttgatattgtagtgaaaaagttttggttcgagagattgtttgaccttgaaatggagtttttttgtttttgtaattaaagcggatgtcaattatgcctcttttaatggatacggttttaattggatggatttatcgcacttattgtttgttttgacaaaaataagtttcttttaacgatataaggtcagtttatttgttctttttttgtatgtacatagatgtttatgtaaaataaattattaaaatgtaagagaacaagtatttataatgaaaaggattttctacgcaaattgtatttcataatagaaatacgtttttaaaattccaaaattatgctgacaggtctgaattaagtcccgtgattgacatgccgatgaatccgaaaattgagttcattgtttggaatagtgaaggattgagtcctcggtgattggaatggcggagaactgagtcctcggttattacgatgccgaagaatccgtgaaaagtgaaggattgagtcccagtgattggaatgctggtgggattgagtcccgggaataggaatgatggagaattgagtcccagtgattggaatgctggtgggattgagtcccgggaattggaatgatggagaattgagtcccagttattggaatgtcgcagaattgagtcccggtgattggaatatcgcagaattgagtctcgatgattgcgatgccgaaggaccaggtgaggttaggtcccagtgattgaagtcctggagaattgagtcccggtgattgaaatgctggtgtcttgagtccctgtgattgaaatgcaagagaattgagtcccagtgattggaatgcaggagaattgagtctcggtggttgcgataccgaagaatcaggtgaggtt

SEQ ID NO: 24545 - DNA, 1803 bp, Heterodera glycines
attcctccgatagggactgtaaaaaacttccatatttggatttctaataaattttgtgtagtatatttctgtttttgttggctggtttaaatgatttattgcacatgcttgaatttttttaaacaattcatccacattgtttcggagactttttatctgttttctaattttgaaacattttataaaacttttttttgatttaatttcattttcttgacattttttaagactacatttttcaacctcgcttaaagaattggaaatgtttttatattcgttggacatttgtagatatagcacccgaatttttataacagaatctaaaaaattctcatacaacacatgtattcctggtgcaccaaaggcaataattgtaaaaattttcgcatatttagaaatattattacagtaaataactacactatctgcctctttgatcatttttctttcccttttccaccagtttacaattcgattttttataaaattcatttcttggtcaattgtcgtcattttttacatttagagatacaatgattatttcaaaaattacagtatcatccaatggaaaaaagtttgaaaatataggctgttctagcagaacgtcaattgtattttcctgtggtaaccgtaatggcaaggctactagaaaattagaatattgtagttttagaattgatttgaagtttgctaattcttttatatatgcattttctaatattttttctagagattgtttaaattcataatcagatgtaccggaaaaaataaactttgtaatatgttttttgatcccaaatttgttaattacgtgacaattatactgaattgcctccattttactcgtgaagctcaataaatcccaacactatagactgaactctgctttcttgctccaatattttagtatgaatccgacgggactcgaaatgcaacttcttggtttcgtttaaactcttaaatactttctcctcaagttttgtggtctgatcgaaatctttagaatgttcaatctcacgccacatcgtctcaaccctttcagactctgcattaattttatccagaacggtgtaaatttcccagatacaatctgacatttttacgaaccattctcgaacccctggggcatagggggccttttctcgggatttaattgcccgattaagggctccacgagcagatttggaataatcatcagcttcctctaccaatactgaaacttccttccatgccctttcagcctctttttttgaggcttccaacaaaattgctgttcctttttctgttctttgaatcatttttaaaaatttattattatctttccattctcttttatacattaatcagatataaattggtctttaaatgttggtcttggggaaggtccggggcgggataaatattccttcattgtttccttaactttatcggccaattccccaatcccgaggtcagattgagtataggcgttacggtacgcagtaccgacgtcctgtctatactgcttaacaatttcaaatgctcccttcgcttcgtctgccaattcacgacacattaaaacatcttttggtccaaacacttatccatttcttttctaatgtggcctattttctgcctttcttcgttaattttttcggaaattccttgtacttttctcaccccttctaataacctaccgaaccacgttttcatacccggtgcctcaggatgacgaactttaattttttctgcctccgtaattgccctatgagaagcagcagcaaaatgccgtgcttcgttatttaatctggtggtatcccgaaa

SEQ ID NO: 24546 - DNA, 845 bp, Heterodera glycines
  misc_feature (812)..(812): n is a, c, g, or t
caaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctctttcgcggcctcgtgggtgggccttcgccccccccctcccacgcccttcagaacacgacaaatatttcaacaaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccggtttgagtagattagactagaaaaaattgaaaattttgaaatcatgtttcccacttcccttctcccaggggtattattttgtaaagtctttttttccccaataaacttgtcaaaccccatttttcgcaccgtgaatggtatttttattgaattctgaaacgttttgagtagattagactagaanaaattgaaaattttgaaatcatgtttcccactc

SEQ ID NO: 24547 - DNA, 2035 bp, Heterodera glycines
aggggaaattcatcatcatatgatggagaaagctcttataattcatgcgcatggtgtgtgcttgtggggagggattttgtccatttattttgccatttccccctaatttcgcattcatttgatttttttatttttttcatggccccttttctgtggagcattcccttgttggccattgtgtgctttttaagtgttggcataacagcgccaaacagtgacaacgagcagccaaacgatggagcaacaactgctgttgagcaaaaacacatagaaagtatggaaattagcaaggggcaattaggaatttaatcattttaatctcttaattgaagcatcctggaattaataattaatttggtcagttttaattagccaattagaatttgcgggccccaaaaaaattgcaataaattaattgggacacacaaaaagaccccaatttcggatttttgcaaatgtaaattattggagaattttatttaccttttgaaaaagtttgaacttttaaaccgcgtttttttggcctcgaaattcgtgcatcgaaaatttggcctaattttcgagcatcggcttcgagaagtaagccgagcttcgcccgtctgtccctgttttctatagcggatttctacagtataattgggcgcatgttttgtccattgttctttattttggattttctaataaaacattccttcatcaaataaaatggtataattctaggttaccgaattgcatattaaaaataattagtcctaattcacaccccaagatgaggaaaaggaagtgcaaattggaaaccatttggacaagaaggaagtggagaaggggaaagaggaagaggaagaagatgatgattgcaaaaagaaaaaatacaaaaagaaaaaaggagaagaagacaaaaagaagaaagataagaaaagagaaaaaagaagaagacgatgaagatgaaggaaaaataggaaaaaaaggacaaagagaaaaaagataagggcaaaaaagataaggacaaagagaaaaaagataagggcaaaaaagataaggacaagaaagagaaaaaaacaacaagaaagtaaaaaaggaagagcacgaaaaagagtaaaggcgaacaacagacaagaagaacggaagtatttatctcttcaagctcttttcatcatagttttcatgtgcctatctttctatcggcttcttcttttcttccggccttttctccttcctttctttgcttccaattctctttttctgtaactcttctttttttggtacgcataaattgaaaattctgctggtgctttttagtgctgtccgaaagtctcggttccgactcaagaaaagtcgggtttttggtctcgaatcgctactagagaaaatagtctcgaatagagcttctcgagaaagttacgagttcaaagaggggcggagagttttttttaatgagtttcaattactttctgtgcatttgaaaattccacttctcctttcctctctttttatggaaaataatttctatgctcctgaaaattttgataagccgcacaactaaattattccttctggcgtagtatcaaagatcccatacattataagagacaatctggaaatatgtcccagacatatgtgaacaaattgtctctaatggggatcttttgaaaatcaaattcatggtcaagagtgacataggcacaaacgtggcgtaagcagctcatataatcgcatgcagatgagtagagctgaacattaaataaggagaacatcatcggcatcattatagataatattgataataattttcaagagttcccagagtgatcatcagaacggacaataatcagaaacaaaagcagacaatgtcaatgagtccgagcaaattcagcatattacataacaaaatattcatatacgtgaataaaacgataaagattgacagcactaataaataaggtactagtatgtatattatcgcgtaagtatgcgcttggaaacacccaccggggatatgtataattagataaatatatgtcataatatttgttag

SEQ ID NO: 24548 - DNA, 1141 bp, Heterodera glycines
aagttttatggggaaaaagactttacaaaataatcccctgggagaagggagtgggaaacatgatttcaaaattttcaattttttctagtctaatctactcaaaacggctcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattgggaaaaaaagactttacaaaataatacccctgggagaagggagtgggaaacatgatttcaaaattttcaattttttatagtctaatctactcaaaccggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtatgaaaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtatgaaaagtttattagggaaaaaaagactttacaaaataatactcctgggagaaaggggtggggaaaatgatttcaaaatttttcattttttttagtctaatctcctcaaaaccggtcagaattcaaaaaaaaaaaattcacggggcgaaaaaagggggttggaaaagttatttggggaaaaaaaaatttt

SEQ ID NO: 24549 - DNA, 905 bp, Heterodera glycines
agagaacggcacggtcgtgtgccaaatggtaatgccctgaaaaagcgcaccaaattggagaggaaataaacactcgttgtttaagtgatttattggccaaattcaaaagaatgaaatccaacgctttaaaattgctaattgtaaatgttaccgatgaagaaaaagcgatatgtggtgtacatcagagtcagaggcacggtgaacagaatgcagctgaagacgatcagtcggccaatggcgcggtcgcgcgttttcgccgcgtagggcggcgcttcgtcgtccaaaagggcgtcctccgccgcttcgtcctcgtcaaactgttcgatttccttcgcactgctcccgcggctaaacgacccgtcgccccgtctctttttcctttttcgtcctccgtcgcccgccccgcctttgggaacaaatgaaatgcacttattaaatagggaatgaaaaaataatcattttcggaccaaaaaacccctcgaattgtatgtcttgtatcactgcaagcacaaatcgtaaatttaacatttaataataaaaaggatttatccgaccccgaaaacttatgtaacaaaaaacatcgattaacacctccctcctcattccccaatctctccactcactttcgccctccgtgtccgtcgtcgccgtgctgctgctcaacgacgaactcaacgagttgatggtcagctgatcgtcgccttcgcccccttcggcgccgcgttcgtcggcctcaacgagggaaattccattgtccgtgctcgtcgtggtagtggcactgtttgaggacattttcaccaaaaaaaacgaaaacaaaaattgagaaatgtccaattaaagcaataaaatagttgaaaaacaaatatcatactaaataagcaattatatgaaatgaataggtattt

SEQ ID NO: 24550 - DNA, 1900 bp, Heterodera glycines
  misc_feature (807)..(807): n is a, c, g, or t
  misc_feature (1847)..(1847): n is a, c, g, or t
aatacataaaaaaatttggatagcaaatttactgatcaaatttcgaattattactttaataactaaatctttcagttttttgtcccttatactaacatttttaagatttttttaaagaaattttctttaatgccaaaataaaccgaaagttcgcaatttttcgtacgattttttttattacataatttgagcttttgagaataggaatttcaaaaaaatcttatcgtttatataagtcactttgtgccctaattcatgctttcctaacaatcatgccagatgtgctgatttgtcaacattttgcttgtttcaagacaaattgtacaaaaaaaaaaaaaaattttttttgattttttggcgtgggaaaattgatgttatcaattttatttaaacatagtctcgttcattaagttccggcatcccccttcctcccaaatagtgtaatgcaattatggcataatgcatcattaaactgtgatcaaacaataaacttaaaattttaattgctgacgttgtccaagtggtgtaccggtatttgcgccgcagaaacttgcgcctcggcctttgcgccgagacacttgcgcactatgggtactttccactgtgcagagaaaagcctagtactatctcgtcgtttctctttttctttgttctttctctcactctggcatactatctctccattttttaatagaaaaaacaacatttatttcgctctatacacctttttttcgccttacagattatcttcaaattttgcatagcgatagagaaaaaaattctgcatcgatttctatgtttattttntaattttatctgttagttcaaaagtaacaaaataaaacatacaaatgcatttctttttctctcgttttggcgtactattttcatgtctaacacatgaaaaacataaattcgcaaattctaataattttgattataagggtacaaaatcactttgagcatttagaatcaatagaaaaaaataaatttagcattttggttagaaagagctgcctaggacttgagttataacatgataaaagtttgaaactcccacaacttttttttgagatgacaaattacttaacattcgcttagaaaaagattctccttttcaaaatctttttttagataccaaatttgttcaatttgattgggtatgaagcgagttatggctgatcaaaataaactgcaaaaaaggcatttaccagtataaattttgaattagcgcgcaaaaaattacgccaattacgctatttggcgttatgagtaattttgtctgacactggggcgtacccatagtgctcatctaaacctatgttcgtattttagcctacaccgactcaaaaaacgagacatgtgtcaataaagagagagtgcagagaaaaaacaaatatcttttttgggtatatgagaaatatttgaagcccagattcaaaaaacaaattttaatcgcttatatcttttttcaaatgcttataattgcttaatatttgtttagaaaaagctggatccaggaaaaatacaggcctggatccaggtacaggccgatctctagtaaatacatattttttcctggcttctccttgctctaaatagcaggaaaaacactttcttttttgtgtttgcgaacaaaaaccgggacttttatttacatattttttcatatttcggggtttttatacatatttacatatttcgggattttcttacatatttggtacatattttggactttttcttacataatttcatttttttactattttgaggattttttacggaaatttttggaaatattcaaaaaaaaattcaaaatttcggcaaatatttttgtacatatntttcatttttttttacatatttttgaaattttataagaaaaataagtttgaaa

SEQ ID NO: 24551 - DNA, 2408 bp, Heterodera glycines
  misc_feature (27)..(27): n is a, c, g, or t
ccatataaattcaaaaataataaaatnttgtcacaaaaaacttttttcttccgaaaacgttaaaaaaataataaactatatatgaccagcctaaattttattaaattcatacaaattatcttatttaaatattttatggattctatatgatttctccagtttaagaaaggaattctgccaacaaaaatgccgatacctcgtgttccatcatctatttaatttacaaaaataaaaatttatacccaacaaacatttatgttttaaaaagcaatatagtttataaggaaatgataaaataaaaatgaaaaatgccttcaagcaaaaacaaagatgtaaattataaacaaattaattaaaaaatttatctttactaacatattaattcaaacaaataatagcttaattttttaaaaatttagagaaaaatatatttttcaaagttaaaaattttaaaaaaagtaatttctaaatgaaaatattacattttttcattttattcaaatcgatgataattgaaaaaagtatttaacttttttctcaatttgcttttaactatgttataatatttaatagaaaaaatataataattcattttactgcaaggttttcaaaaataattgtttcataatacatcttctgactcagctgtacctggagtgcaaaataatttttcattaaaaaaactattatcatctaaagcgagatttaaaataaaaaaactttattgagcattcaaagtagtgaatagtgaagaaataataaaaagaaaataatgttaaatgaaaatgaaaatatatcgtattaaattaaattataaaaatatacaaacaataataatttgaaagaactttatatattatttatcatatatattacaaaaaaaaatacattgattttaacaaactaaagaataaaaaaattctggatatcaaagatggtaatcaataactttctgaaaaaaaacagataaatggttattatgcaaatcgaataaatacaagatgaaaatccttcaatattatcaaacagaaacgcaataaaataatacaataaatataacaaatattgcgaaagcatgtcatccgtttgatatattaaccatatttgtttatgcaaaagttatcttcatatcaatttattattaataatttttagctttccatctattgctttttaaaaatatttagccattttttagaggtgcccttaaaattgaggaaaaaattaatgaaccccacggggtctaataataaatcgtttaacgctacggtgcctggcttctcccgcccatccactggcgtctcctccccaagccattcccactgtcatcattcaacattctattctgctatcaggcagccggcatttcaatcagcttccatcaaattccccctccaaattcaattaatttatgaagtgctgatcatttcttccctcatttcatctctgtctcttgatcaaattgtcccctattttatttttgacttgccccaatttccattctgcctaaattccttatttaaatttagcaaaataagaggagccaagaagcaaaacctttttcaatattttttgtggatatcttcgaagtaactttaaaaatttaacaatacaaaattcatttaaactggaaaataccataataaaatttaattatttataaatgaaataaatataaaaaataaagtcttaatttaccatgaaattaagttcttaaccgtaaaatagcatactaatttctcaaaaacggggattcacgtgtatggccatcctacgaggataagtgaagcaaaagttagataaaaagattaatacttaaaccaaatgaataaatggatggtgaattttaaatgaacaaaaacaaaatactttattataaaaaagcttttgtaaatgtaggtatgtgcgagagtctcggttctcggtttccgactctggaaatttctcgggtttttcgcttcagagtctcgggtttttaatctcggaaaccgagaaatttttacactaaaattatcgggatttttaatctcgggtctcatatcgtttcccggggtcatttctcggttctcgtatcgtttctcgcgataattctaggtctaggtctcgtttatcggttcctgctaaaaatcacttctcgcacatcccaaatcaaatgacagtagattttcaactttctaatttctgttcattttggttaattaagataaatttgtaacaaaaaataattattttaaaaataaataatgagaaaacatattgaaaactcaaaatcctataaaaataaataaataatgaaaaatcatttttttatttaaaattaaatttacatcttaaatttgttgaaggagaaatttttgagaaaaaattaattatttcttttaaagccaattgttcttatggttgtgtgg

SEQ ID NO: 24552 - DNA, 2329 bp, Heterodera glycines
  misc_feature (1534)..(1534): n is a, c, g, or t
  misc_feature (2310)..(2310): n is a, c, g, or t
taccgagaaaagcaaagatatttcaattgtattgaatgttgtctattttagtccataatttatttctagagctgtaaattgtatttaaaaaaaaatatatatatatataaaaatttcaagatatgcaagaatatgtatgacaaaaacccctaatatgtacataccaaaatatgtaaataaattttttttttgctttcataaaaaaattatttaaaaagagtgaataagaataaaatgccgtaaaaaatctctttttttaaaaatcggttttaaagctattttttcaaaataaattgaatttttcatgaaatttctataaatcacaaaaattttaaaataaaatccggaacattgctaagtaaataaaagtctctcaaactcaaccataaacattcttggcatcactcgataggcctaaaactctattagctcaccaaattccaaaaaaaaaaaaattggccaagtttgaacaaagttatggccaaaagtacacaagcaaccaggttttcacatctttttaaccataactttttgaaacctaactaaattttttgaaattttgcaggttgatagactgaaataggcgccataaataagcataaacaacccaaataataaataccaaagtaacaaagatcggaattagattttatggtccatcaagttcaggctgtttcctactactaaataccgaattggcacggcggctaaccgccggcttttccacgcgcttaagcttttctcgaagttgcgacatagcccgcgcggacttcgctgaccagctgctgctttcgcttttgacctgcttgctctcgaacaacttgctcatttccatatggatcattgtgtacagcagtgcggcacccactcgctcggcttgtgccattattttctttcgctttggcatttcccgccaaatttgttcctcttcaatttccaaaaattctctcctctgctcttcattgtacaacctttcccatctgtcgtactgatcatgatggaacaaacaactttgaaacaattttaagccatgcgcaccgccgccgtcactgtcgtcaaacattggtcgactggatttgctgctgctggcgcagctgctgcggttgtcctgggtgccagtgactgtttggcacattatttctggcacaattcgtgtttcgaaactgcaaaatcaaaccgataaaaaaaacgaaaaattttggaagggcatttttagaagaagaagtatacttaaattgcaatggaccgacccaattaaaacataaccattcagtttttagcaaaacttaaaaaagtttttcaaaataaaaaatgattaaattgttaatactattttagctaacgaattcaattttttaatataaatttaattttttttaatagttttttagggtgtctgtaattttttgatttttaacagattttttaagatcgataaggaatttgggtccgtcagtgctggaaaatttatctagtaaattttggaactaattaattttaagtgaaaaaccttatgttgtcaattgattctttnaacgaattccagaaaacattcggtttcttcttgaaattctttttcaaaaaattatgcacattcgtaaagccaattaacaaaatcagttctacaaaatttgacaaaatcatgtcaagtgtatctaaaattgacgtctttaagaaatattcatggcatcggattaattcggcatttgtttgctcatcgaacagctgatcgtcgttgccgttgatcagaaagcttgtttcaatcacttcattcaaagttttgatgctaaccgcagaaccgacaataacacaacgccaaactgtaacaatcgcaatatattgtataataaaataagtattaattaccgattagaaacattatgatggtcgtcgtgaaacagttcaaaaggacgtgcataataggatggaagaattataaaaataaatgctttatttatattatttattgaatagaatttttgtaaaagttttactaagaatttggtatttgaaataggtgaaatacagtttttaaggattacctgccatttacactgattaaaagaacgctttaagtaaatgttcagcttaactaaattcactaattttgaaaaattttaattataccctttttaaaaatgatgatgttgtataattattatttctttcataagggaaatatacatacatatagaaacagttataatttaattcccattttaaacaaatagaaattaaaagctacacgtaagcagtaaaatatttcatatttcgcctacgcttaaataacctaatgattttttaatcganttaatctttatgtcattat

SEQ ID NO: 24553 - DNA, 1548 bp, Heterodera glycines
  misc_feature (18)..(18): n is a, c, g, or t
  misc_feature (43)..(44): n is a, c, g, or t
  misc_feature (46)..(46): n is a, c, g, or t
gaagagacggattccaancctcccggaggcgtatccaataagnncntaatataagttttatataacgtaatccaaatcttagacgatttggatttaattattcgaaacaaggaacgcatacgtaaatacgcattccttgttatttggttaatatgatcggaaaattgtaatttgttatcaatgattactcctaaatccctagttgtatccacagcatttattgtatttccatcaaatttatatgtttcttttgggttttttgaacccaaatataatacaaaagttttttgaattgaaacttttatttgccatttatttgcccattcgaataaattatgcaatgctttatgcataatttccgtgtcggctcttgctttataacaaatatataatttaacatcatcagcatataattttattttcactcctgatggcaaggcatcaggaagatcgttaatataaatcaaaaataataaagggcccaggacagagccctgggggacgccagaggtaacttttttacttgaggataaagaatccccaattttaactcgaaaagtcctattactcaaaaagccctttatccacattaaaagtttgccctttataccaattttttccaatttgtataaaagtaaattatggggcactgagtcaaatgctttttgaaaatcaatataaatacagtcaacattttttccatttataattgcctcgtaccaatcttccacaactgttattagttgacttgtcgtagacctatttctaacaaaaccaaattggtattccgaaattttattgttttttaggagaaagttgtaaatattttggctaagaattctttccataaccctgcaaagtgagcaggttatagaaataggcctataattttcaggattaaatttgtccccttttttgaaaagaggaaaaactattgattccttccagatatctggaagagaaccagagtctaatgaaatcctgaatagatcagtaataacagttgctaatgaagaatggcagtttttcaatattttatagctaatattatccggggaggtcccgtttttattcggaagttttttcaaaagtttttgtgtctctatgatgttaaggcctatatctgatataaagcattgattaacaacagtgttgcccaagcttaggtagcctgggtcaacttcagaattgttaaacgaatttgaaaataagttggcaaataattcaaatttttcatcaccactattatagcattttttttcaaaaactaaatttggtatttcaaaggcattaacatcgtatttctgtatgtatttaaaaatcgaattttttccctttgaaatagccttttttcaatttgagaatgaaatttatttgtttgtattttatgtgtaaactaatgctatcatatagtgttttttttgatgtatcagttttacattgcctatacagtctggctttctctttgatggatgcaattaaatgctttgaatatttagggtcatatcttttttggtaattcttttcattggaatacactcgtttaag

SEQ ID NO: 24554 - DNA, 1778 bp, Heterodera glycines
ccgaaggattcgatctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatcaaccgatatgtattcgattcccgaaattttttggataaagcgtgccgcaacaaaagcggttttgaagaaaaaaaaactcgcaaaaataaggatgatgcattttttagctatttcttggacaaaaaaaatattttgtaattaattcatcataaaatttttcttacaattagattttttttgataaaattttgtgtctagggatggtgatgtgcctgctctcctacggtgccggactcgacgagcaggcggacgacagtgacaaaatgacggcactgcattttgcggtgtccaggcgcaacctgcagatcacgcgcttgctgctctgcctgggcgccgacccgaacgtggccaatgcgcacggggacacgccacggcatttggccgccaaattgaacgagtaaattttttttttggggggcggggaggttaataattcatttttgggcctaaattttcggtacttcgtgttttgctacccctcccccctcgagggcgggtagcaaacaaaggagtatcaaatttttgttattcttcacccaaataaaggaccccaaaagtccaactctcgtttttgtcctcttaaatatgtcaaaatttttcagggttgatttgctgaaaagtctgatcatatgcgatgctcggcgttgtccactcaccaaggtaacaagcacagattttgctatatatataaaaaaaaaatttttttctttgccttccaaaaattttttcatggtttcaaattgggtaaacacatccatctctcacgttttgtgaatccacaaatacgcatttttgtgttaaaaaaattcgtttttttccccgtattttaggttggctgtgtgtccggttgtgtcaacgagaagcagttgcacgagctgaagaggacgtccaccagttcaatgcaatcatccgccaccggcaacaccacttcaacatcttcgacggcatcgtcatcgtcgtcaagcagttcaacaacatcggcagtggcgtcggccaccgcagctgctgctgctgctacggcaccaccagctcaaccagcaacctcttcacaaccagcagcaggagcatcaacaacggcaccaaagccggccagctacacgtcggtgacggtggaggattttgagaaccgggcatttgacaaggaacatttccgcttcaacaaactgttggacattcagcacaatgtaaatagtttgttaagcctcttttcttggtggtgttgggaaacaacagatagcttctgattgagcgatatttcgccagaacagccgccttcccgcatttcaccgattcccgaagatgtcggagtatcgacgcgttggcaggatgaattcaacgaaatattcagggagcgggcaatgactgattggacactcggatccagagcggatgatcgtagagataataagggaagggaggggga

SEQ ID NO: 24555 - DNA, 2163 bp, Heterodera glycines
  misc_feature (74)..(74): n is a, c, g, or t
  misc_feature (2124)..(2124): n is a, c, g, or t
attaaaaattcgaatttgtcaaaaactaaagaaattcatttttatttagctggttatttgcttgcacatcatcntgctgcatgttcggagcacaaactgtcgcaagtgttgacaacgaggtgactatagaagcataaaatttctaataaatatctaattaattgaaatatattttttattttacattttaattttttttaaatattttaaattgattaattttctcccccctttagaattggccaacaacgtggcgaccacacagcagcgccattcgtcggctgtatgagagcggtggcactgaatggggctgaaccggtcagcgctgacgatcaccagtgagttttcatggggccatggctttcgaaaatgcccaagacgtattgcaccgagatttttgttcacaaaccgagactaggcccctaaaataaatcggcatttcgttggcccctatagaatcggcattttgtggcccgtgtataatcggcatttttgccaacagtgttggacccgcgatatttttggcgatgccggcctgatccctcaattggcaccgacagagtttcccgaaatttgatttttttttccagagcgcgtgccatcaacgtccagccgggatgccacagacagcaacaatgcgtgccatcgtcatcattggccttgtctcgagacatgttgtcggcacagcagcagccctgtgccaatggtggagtgtgcgttgatctgtgggatcggtttatgtgccgttgtccgagaccatttttgccgccacgttgcgcggaacagccgcccgaggcaacgtttggccatggcgaccagccgtccaattgcgttgtgagacggaataaattttttaaaatttaaatttaaattttttggatttctggtcccgtgattcgggtatattttttgaaaaaataatccggattaggagttcgtcctgaaaaacaggatttttaatcctgaaaccatctaatttatagaatttttgccataaaaacctattaaaaatttcaaatttatgcatgttttggatcaatttttgaaactctgtcattagtaaagcttttctgggatgccaaaccgaaaaatttgttttttgaagctttaggcacatcccattttattttcccgaaaaaaaaaaacttaaaaattataatttatttttgatttcaattttttaaaatattctttcagtatgcgttgagcacggaggacaaacacgtggtggccgagaagacgcaaatcagtgtgagcaattaaaatgtttgttataatttgcgaaaaattgaaatttaatgggggcgggggtcagttacggtaccacaaagtgcacgacatactgtctcaaattcgcactaaaaaattcaatataacgataaattaatgattggttacggtacccatagtgccaggacctactgtctggaagttcatattacgaaattaatttaaatattttgtgccattttatagtctttaagtgatttatgtatttgattttgcatttcattttttcacaacaaaaaaatcccggattttatgttatttttggaattgatagaaatttgacaaaaaaaaaattttttttttgaattttagaaaatttattttgaaatatgaattagtctttttgtcccacagtttttgctgcgcacggctgaccatcggcacggtccaccatcctctccagcgcttccgggcacaatgccattgttttatattggcgaaacatttggcgcaggcgccagcaccggcgctgaaccggacaccagcacattcattgcggcacagctgcgcaatggtgtgccacaactgaacgcacggctgggcggaaaacaggcgcggaatttgttaccttttttaataaattttatacatccgccgccagtgggaatcgaacccacgaaatgcttcacccacactcaattaattccgactgagctacgtcggccgggttccggaaatttgaaattttttgaattttctataaattgcgtgtgacgccttaaatttttcttagtaccctaatagggccattttttttttgaatggtataaaataattttaatgcgggaatttaaatttttgtttttatcaaatttaattgaattttttccccanaattttagatttattcaattgatgcgcaagaacgggtgt

SEQ ID NO: 24556 - DNA, 1177 bp, Heterodera glycines
caagaaattggatgggctatatgtggttataaaaaacttttgggtatggaattattttttgaagtgagtcaaaccccttattagtgctttgctgtgccgagacccggcaggcaatggatagctttaaatctgcaagaaattagattggcaataagtggttgtaaaaaacttttgggtaatgaattattttttgaagtgagtcaaacaccctattagtgctttgctgtgccgagaaccggtatgcaatggatggctttcaatctgcaagaaattagattggcaatatgtggtagtaaaaccccactcggccgcttcgcggccgagtgagtactttaggctcaggaaaataattaactggggttcattatttatttattttttgcaaaattaattcataaatattttttagaacgtgctctgaaacgcaccaaatgttaattaaaagttaaacaaggctctctgatgctttttctatcaaaagggagatgaataaaatttttaaaaattttaattgctttttaaataagccaaaaagtttaggcttatattttaaaaagtttcatcgaacttagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttagaacgtgctctgaaacgcaccaaatgttaattaaaagttaaacaaggctctctgatgctttttctatcaaaagggagatgaataaaatttttaaaaatttttaattcctttttaaacaagccaaaaagtttaggcttatattttaaaaagtttcatcgaacttagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttagaacgtgctctgaaacgcaccaaatgttaattaaaagttaaataaggctctctgatgctttttctatcaaagggagatgaataaaatttttaaaaattttta

SEQ ID NO: 24557 - DNA, 1086 bp, Heterodera glycines
aatccaagacttaaaactggggagaagcaaggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaacgatttcgttttgttttggcattatgataccgaataactttcggaaatatggaaacaaatttggagaaattcgaataattttttgactgcaaatttttttcctttttt

SEQ ID NO: 24558 - DNA, 1250 bp, Heterodera glycines
cgtttgagtaatgctcccgcaccagcggcgaaaagtggcgtttcgtttccaccggtggtgtacggcgtcattcgggtcgcagtgcgttagcaatgagtggtccatggatattttgtaccctggtgaaggcaccactaacgtgacgattccgttggcctcggcctcattcctgtgttttcgacgtttctttaagttgtcaagccgcatcggtaggacttttcattcgcggtttcaccgccacggtccggatgatctccactgatggcgctggttcgaccagttgtacttcttcctggtgtggtcttctgattggcgaaatggagtacggtaggcgccgtcggtttcttggaaactgcgagaccggtgatctcgaacgttctcttccttgcttccatctccgatcaggagaaatcgagtagttggggcgcttccgctttccgaactggtttggcattggccgctctccacggatttctgccacgatttccacttctccttcctcagtacgtatcggagatatggagtgtcgtctcgggtcactctgtgtggagttccgttccctttgagcagttggcgccttcttcaaccattccatccgttcggcatgcgtcttcattcttcgttcttcccaatcttttcgagtttcgcacttgtcttgctcctctgtctgtgcggtctttgtcttttctttcgcacgtttggcttccgcacgtgccacggccttgacatcctttctcatgaagcggttcttttcctgttgaatccgcttctccttcatttccgggttcctctgttcttggagttctcgtcgaaccacattcttccctccaattgctctgagcagagcttcaaggcctggccccgcaatgcttttccggttggtttgggtccggcgtttcgctttccctgttgactttgtcctttcttctcagggcctttctttcccttcgttttcgaacttgatggcttcgaacttgatggctggtcggccttcggctggccttgtggtcggaggctcgattccatggtaacttggatttccggattttggctttctgcttccgccattgcgacggcttacgtgtcatccactcggacactcgccacgatttgggccatttcacctctacctttttttgtaagtgaggagactatcacttccatgttgtacagctggttgatagccctttgaaaattttttccgtttcggatagtgttcgccacgcgaacaagtccatctctccccctta

SEQ ID NO: 24559 - DNA, 1277 bp, Heterodera glycines
ctgctattatgtggtgaccagcgcacaaatgaacgtgccgtgttcaccggtgacacgctgttcatcggcggttgtggtcgcttttttgagggcaccgccgagcaaatgcatcacgcgctcaacgaacgccttgccgctttgcccgacgaaacggtaattaacaaaaaatcgggccaatcataaaacactttcataaggtaattcgtgaaaaaaaaaaattttttttttctcagcctttagaaattgttttaaattttagatgttttcaattggtaatcggcagggaagttcccctcccccaccgaaatgaaattttttcgaattggcaattagaaaattttgtattataacctttaaaattgcaaaaaaaaaaaatttttttttaccggcggcacctagcggtaccatctgaccccaattttaccttacaaattcgttttttttaattttaaccccgaaatggcaatttttggcacaaaacaaatgcatattcctattttttcgacggtacaaaattcttcaaacattaaagttaaaaaaaaatttccaaactttttatacgtatatcaaaattcaatgttgttttagttggtttactgcggtcacgagtacacggtggcgaatctgcgcttcgcgcgtacgatggagccgtccaacgaagccatccatcaaaagttggactgggcacagggccaacgggaggccgaccgctggacggtgccgtccaccattggggaggagaagcggcacaacgtgttcatgcgtgtgcactgcagcgccgaggtgcagcaacggtgcggcaccggcaccgacccggtggcagcgatgggccgactgcgcgagttgaagaacgcgttcaaggaaaaatgatgatggaataatgacattttgtgtttgttcaatgacggatttttttttgtcctttccgtttaactaccactgctattttttgagcccatccacccacacatttccataacatattttgggcggataaaaatttacaatagccaatttaaaagtgaaacgataaattggaattttgcgcttttttttcttccactgctgtccttctattggctgctgctgccgatggggagagtagagagagagagtgaaaaggggagacgctaaaagtgggaaattgaagtgtgggccgaccgacagaggagagagaagcgagcgattggctgtctcccagccccaccaccactaattactatattttagggggggggggtgggttaataattttaaaaatttggactttcaaattt

SEQ ID NO: 24560 - DNA, 1324 bp, Heterodera glycines
attgagagaattggcgggagtttgaatgaaaaaagaggaataatcttaaaaattaaattttaattaatttgttttttcattttaattggcccacccattcgttggccattcttcgtcaagaagatcagtcgagtatccaagaaaatgccacatccgaccacgtcaccagtggaaaactccgatgatttgtatgccatttccacgtccgccgattgcattgccacgggggaaaatgacgaaccaaataatgacattggcattttgcacggccgattgatgccattacagccaaatgagccatcgcttcggtacccgtaactgttcaaaatttgaccaattgacccgtccaatggcacttccttcgtggcgaatccaatcgtgacaaaactgttaaaataaattcaaaattataaataaaacgctaagaaatcatcaaaatgaacaccttttcaatttgaacactttcatttcgaagtagaaaattccgggacgacaaaagttcgtaattggaaatttcgcaaaaacagagcgccatcctaattaagaaagtaattaattaattacattttttaatttttatattaaataccaaatctgttgcccttgcaattgatcgtcaattgcttttccccaatgatttcgatgtctttgtggcaaactttggcatcccagccattttgttgctgcgaattaggcacttcctgaaattaaatggcatttgtgaaataattaaggtttccttcccacctttgcaactttcgctgagacaaccgccggcggcgaatggtcgcccgatgacgtcactaaagcaactaaattagcaataaatacattttaaaaagaaaaattaattttttaacacctaaatatttataattagggctgtaaaaaatatgtacaaaaagtggtcatatatgtacataaatatgtaaaaaaaaatcccgaaatatgtacgaaaatatgtaaataaaattttttttaattgttattttttggaaaattttttttcataaagtgttaaataggcacaaaatgccataaaaatgaccaaaatgtttaaaatcaccttttaacatttaaaaattatttttggaggggtacattaaaaaaaaagattttttaattttttcacaagaaatttctaaaaattttcaaaaattctcagaatagctatgtaaaaaaatgaaaaatttgccgaaatttttggatttttttttgagaatttccaaaaatttccgtaaaaaatcctcaaatatgtaaaaaaatgaaaatatgtaagaaaaaagtccgaaatatgtaccaaatatgtataatcccgatataa

SEQ ID NO: 24561 - DNA, 2488 bp, Heterodera glycines
  misc_feature (29)..(29): n is a, c, g, or t
cctccgccgttgggcccgggaaaaaagancagctcaaggtggccaccgatcgttctaataaatcaattaataaaaataatatagtgctaaaaaaaaactaagcaaatttatagatagttttcctttgttgtaaattttttaatttttctaaaaaagatattttaaaggaaatcaattaaataaataatttataaggcagggatgaacacggataccgcgcgatagggaattaaataggcacaaaaatgaaaaattggcagaaatttttaaagacagatttcttttcaattctattgcaaaaaaaaatattcattaaaaaaatttgttttaaaaaatgttttaaaaattaatgtgcatattttgtgtctttttcgtgcctaactcaatgaacaggagaatagaaaatcggcatttccttaataatacatataatgtcagccaaaatattcatgttttcttaatgttaatcaatttttccaaattttattgggcaattcaaaaaacagaaaatattttttcataattacaaaaaaaaacacctgtaaacaaaatgcggtcccggcccagtgacatattcttgtgcatttgaattcaaaatcagaacaccatgggcttttccgcttggctccaaaccaacgtaaaagggatgtacccctaaattttgtagattcaagaaatttacaaaaaaaaacattaccgtatccattgtatgagcccggtacataatattcatttccttgatcgcgtgaaaatgcactccacgttttatagatggaaaaatcatgctaaatttcaaatttaaaaattattattataacccatattttatttaactatttaatttcattggtcaaaatatgtttgttgcatactgtagttagttttaaaattcaggtgcatactgtaattacctttaattcatggtgcatattctcgcctaacccataaaggcgatcggatgacaaaaaagttgcaatttgtatgaattggtcaccaaaaacaaggccacctaaaaaagattttttaaaaaacaataatttttttttgttagttttaccaatcgatgtgtcccaaatgctttgtttgtttgaatcatttcgttgaattttaaatgagaaaggctcattggcattaccaagttcaaaactcagtgaatttgatgaaatcacttgttcaaaattggacggattgcgaagctcattcagtgggggaagccatctaaaattcaattttaaatttataattaaaaaatcttaaaaattgggaatcaatttataatttcgttttttgcacttctcatattaatttttttttaaaaatttgtataacaacaataattagtaataattttattatgttaattttaataatttaggcattccaagaattgttgatggatttttaaattgcttcaaataattgaaattgattttagtaataattaaaacaatatttaatctatttttatatattttatcattataataattttgcttgttcacctgtcttctgttccaatgcgcacataaattccatctcccattttttgatattgcacttcaatgtccaaatttggacgactgtacggattgttcagtgtgtttgatgtccatttcagtttcaaattgcccggcacgtttgactggattgtgtaacccttatttggcggataataacacattggcacggtcggattgtactgtaaacaattaattaatttgctatggattacataaaatggaataacacgacgcaaatgtttttagtactataatttccaaattttgcgatttgcttggcttaaaaaaggaaatggtacaatgataaaggtcaattagcttttttttgtcattattatgtgttgaatataaaaaaagttgttttaagaacaatttttagtgaaaaaactttgttaacaaaacaataaaatcacttaaaaacagttaagttaagcatcattgaaaatttaaataattttaaatgatggtcttaatttttcatttttttaaatatattttttaatttattacttcatcagattggccatcccatatacaccctgtttcaatgcagtcatcttttgagtttttatatgggctaaacattgaattataaagtacaataattattatgaaaaataaaaaaataaaaaatttcttcccaaatgagtcaaaaaacgaattgagaaatttctataaaattttgttgatttatgaattcattactttggcaaacagtcgacacgttggcccgggtcgacaacggcatcacttaaaatgatggactcgcagagcagaaaaaataataaaaacatttaatatttttgctttatataaaaaatatatataatattatattataaaaaataataaaattaaaaaactaaaaaataatgtaaatttacgattactttattatgtcggaattaaatagttcttaattatatctttcttaaatatttctctgtacaacgaaattaaatgtaaaa

SEQ ID NO: 24562 - DNA, 937 bp, Heterodera glycines
tgttgaaagattgttaaactaatttatccgcgggccttttgtacattaacttgtattctttccgttttttactttcttttaaatattttattttaaactttcagctcataaattatgtaatgaatttttatgtccgccatcatttatttaatgattttcttataaaataaatgtaccatccggtcggaaactagtcgtttttcaattcattagatacttttttttgtaaatatgctcagcagcatttttaattttttaacattcagtgatttgaaaatccatttgggtcacggttttaccatttctagattttattacatttaaattttttggattattcttcttttttttatatttacctcttttaccgatgaaaagaagtttttttcacatagataactgttttaaatgttttaatttggcccttttttagattaaaatttatttttgtaacaattataatttcgtttaaatttcaagccttaagtgtaatgtttaaactatacgtaatatttgtttcttataaatttagtttatttaggtttatttctgaattactagtttaattttgataattataataaccaaattttttcaccaatcgataatcattttataatctgacaaaaaaaatattgaaatattcttttttggaaaaatcgacaatttgattctatgcaaataaatttctgttatcccgttaaattttttatgtattatttggttataataaaatcatagaaaccgttttaaaggcgaagggttattttttcatacatttttaaaataatttaaaaatataggacttttggtgtcagtttggcagcaaaccatggtcgaaaagcacaattcgttggttgggattttggtatcggttatgacaccgacgtcgaaatcataggttttttcctatctaaatatatatttaaaaattttt

SEQ ID NO: 24563 - DNA, 1816 bp, Heterodera glycines
gcagttcgtacaataaaattttttacaaaataaagcctaagcctaagcttaggcctaaacccaagcaagcctaagcttaggcctaagcctaggctcaaggcttaatccgaaagcttatgcttattttaagcctttataaaaactgcctattgtacgaactgcctttgtacgaattgacatgaccccatagggagagataaggggcgggagggagggatgagacagcttagacgatctgtcggattggggaagggccgctttaaagtgccatctccgttttctcgagttaatgttcaataagccgaactgacaaatgaattcccaggaagggagcagttggaagcacgcagaccaaattgtgacgctgccggacactttggcacctcacgcgatggattcactgatggcattggtccaccccggacataatgacgaacatccggtgagaaagtcgcatctgaacgagcggagcagcggccttcgaatgaccaatgttcagctgattttgcatattggtgggcaaaattaaagagacccaattagggattaaacgataaaaagcaattaggggacatagcgtacgatatgcacgagtaccgtatgaagcaaaagattaggcaggaggacgaagatgaagtgtacaatttgggagatcgctttatgcaagtcgttgaggacattgcggcttatgtgccttatatggtgaaaaattggaaaataaaaaacatttacaagaatattgtaattatgttgaaaaggttgttgcgggaaaccacgaaaatgaggagaaatcggccgattatcacaagaagcgccgggaaatgcagaacgccgaaggatatgagccgcagtacgaacattacgaaagcagattcaaaatgccacgcaatttcaaagggcacgacacaagccaatattacgagtaaaaggggggggaaggcaatcaaaagtgggaaatggcacttctttagcttcacctacggcccaatttggttcatttgcgtgtccacagaatattactattcgtacgctgtcaaatcgcccactttccgttgggtgccggattgggaaaatgtgagaaaacaatacgaattcatcgaacacagtctcaaggcaataatcgggactcatttaaattaaagcaataaaataaacattgacagaaagccaacaaaaatcggcacaaaaatccgtgggtaattgcactgctgcaccgccccttttactgcacctccataaacaaagttacgtgccgtttcaacaaatcggtaggactatgaagtggttttaacggtgataggtccgtttcataaaaagttgccatcgttggcgtttcacagaaaatgccacatttgacgtttagtaaaaagtgccacattcggcgtctctcctaaaccgaaaaaaagtatcaatgaacctaaaatttgattaaagatatggctgcttgcagtgaaaattttactttaaaatgcgcgattcgtgatgacattcttatcaaatgctaatttctgtgatgattaatcacactccgattaatattttgctaattatttcggtaattagtttccgcttttgctcattgtcagcacaaacacggtctccccacggaagatgacccgaaaaagtttgtgtacggattggaggagttgttcaacaagtacaatgtcgacttcgtcattacgggccatgagcacatttttgagttttttccgcccattgaattgttcgacggaatgccaaaagttgtaccggacaaattttggtgtgagcacgcaaaatgaaaaaatagaatttgaaaacttaggtgaaagtgcag

SEQ ID NO: 24564 - DNA, 1745 bp, Heterodera glycines
tttatttttcgttaactaatgaaatattatttttaagtttttggcctcgccaggagctcaggtccaagaaaaggatcgggcctagagtcccggaaaatgggatttttagtcccgggaatcccgatccatcgtcaaatcccggtcttagtccagttcaatttagaagcgagtttagcaaataaaaatgcgctgccgtcgtggccacaaatttttgtttctgcgattttgttcttcggttccttgtcaggggaatcagcgatctgttgattattctcaaaggccattacgtccacttcttaaatatgtgccaggtcataataatattcttaatttaattaaattggattaatatttttaatttaatttggattttagaaaaaattcgaaattttgccataattgctcacgttgaccatggttcgaatctttgaattttgctattcaatcgcacaaactatctattgaaggaaagagtactttggctgatcgctttctgcagttaaccaacgtgatttctaccgaatctgatgcccaatacctcgacaaacttgaggtcgagcgcgaaagagggatcaccgtaagtaaatgaacggctaatttatagaggtggccactcgaataaaaagtcaaaatcatttttcaaaattcacatttatgttcgaatctacatcgaaaacattgagagatttttttagatcaaagctcaaacttgctccatgttccataaggtaaagaaagatatgcgtatttcatttttatattttatttacatttaaggattttatgctcaatttggtgtaagttgaagactgcttgccttgccttttgtcgtctaatcagccattcattcgtatcgcggtcataatgggtttttaagcgaaccaattgggtaaatggtatcatttgattggcttatgaacaactttagaaattacaattactacctaattattagtattagcaaatcagtaaagaaaattaatgaatggaatggcagttagatgataaaaattatcggacacttttttttcacatttaagcgatactcctggccatgttgactttgggtcggttagtactttgattttcatttatttttgtttttttagcttcgaggttaaacgttctctcataacctgcgacggagcaattttgctagttgctgctaatgaagtgatgaaaataaaacattttctctaattttacaattttagggtatccaagcgcagacccttttcaattttcattcagcctttgagaataatttgagcatcattccagtcatcaataaaatagacatgaaggcaaatattgccaaagttgaggaagaattacaacaatcgtttgggtttcatgccgtcgaaatttttaaagtgtctgcaaagacgggaagaaatgtaccgaaacttttggaggcaattattcagaggtagaatggggggggaaagtgatgggtatgttgcgggcggtgggtggacggacactttggacacgcagcgcccccgaggggacgagcgcgggcgggacgagggagaaaaagcgtcggctgtcagaaagatcggccatggactggtaggagatgaacgaggatgaaaaaagcggctgtcatcaaagaaagggaaagctagcggatgaaaaagtgtggggtgaccgaccaccagggatcgcacggaattccggtttcagatttccgaaatttttgataaaaggtcggaaattttcggaaatttttttgaatttttttt

SEQ ID NO: 24565 - DNA, 1791 bp, Heterodera glycines
tgttttttagacttagctcatcaagagctttcgaatgataccaaatttgtccgaatttgggcgttttaaaaggtcaggagccccccttttcactcaaattttcgagttttaaaccggttttttggcatttccgcaactggagacttactttttcgtgcatagctcgtcgagacgaatcgattgttatatcatttatgtcattttttccggggggttgactacagtacaccccaaaaaaaacccgctaaacaagtaccaacttctgaaattgaaataggcaatcaattttccagtcttctttgcaacgacataaatgttttctcatttatcacaccacacaatacatatgaacaattgatacaaattttgaataatgtgaataatggaacatcattgtgcttaggaattcaaccttatatacagacagacatggaacaaaatgcctaacattacaatacatatgacattatggggcctaagattcacacatctgacatcggacggcatcgtcacaggctgttcacgctcccacaagacgattcatccgcaatgcgaccgctgctgcgactgctgcgcctcgtccacttccgtcctcgctgagcaccatgaagaactgaaattaggggaaaattaatcattccgaaatgatattagaacttgaaactcacttcgcatttgacggccaacagcgccttgatcttctggtccaggttgaatttgaaggtcgggtggaagcggaacacggagccgtcgacgccgatcgtcacgcggggcctctgcatgcggttgaggatggcggcaagcccacaggcacagagatgggcggcgcgcgtgccaatcaacgagctgacgtaggcgacatttgcacagtcggcggccgatgagttcgaaatgcctgaaatgggatattgggatgttgaatgactaaaaatgatcaaatgacaactcaccaatggcacgcagcatctcgccgactttggcgaatgggttcccgtcggtgctgtgcataaacctgcaaatgaagtgaaattaagcaattttttagaacaaacagttttacccttcgatgtcggacaccatcttggtggagatgcagccgcgttcagaaattcgagtgaagtcgccgctgaacaataggccgcgacgtgccaagtcctccagcgcaagacggacgatctcaccctgaaaattctttttaacataaattgttgttcaatttgaaaactttcccaccatgtacatgccggagatggtcttctcgaagcgttgtcggccggggttgaggctctgctggtccaactgctggtcgtagatggtgaggaattggtccagtgcgccgtcgtcgccgaatcctccccattccgtgttgacgcacatctccgccggcagaccatctgaaattgtttcaaaaattagtgccttttacggccacccttcacctcccatttctaccttccgcggagttgacaattcccttgagtttcggcacattctccagtcgctccatgtatgcggcattgcagcctgaaaagaaaaaataggggatttaaatgaaaatcaacaaaaaattagttttcttacccgtcccgacaatgaccccgacgtagcagtgttgttcaatgaaggagcaggcgagcatcgtccccgtggtgtcgttgagcagtgcgaccacgtcgatgtccacgtcgcctcgtcgcttgaacgcgtcgcgcagcatgtggacgacgttctccccaacaacgccagaagcctgaaaaaaagggagtttagaaaatattcagaaatcaattt

SEQ ID NO: 24566 - DNA, 476 bp, Heterodera glycines
taccatcgcggcaaattaccaggcccacaacagtggtattttggaggagttgagcgtggcagtggacgttgcttcatcgtgccagtggaaagaagagatgccgacacgttggtgccactcatttacacgcattacgtggtgaaccactcggagcacttcaaggatcctgtcagtgggcagcatacaaacacaatagaatcgacgtggcagaagttcaagcaggaacacaaaacgagatttggcagtcacagatcacttttttccacatacatttctgattttttgtggcgtaagcactttggaggaccggacattttttataatttgtggacccaaatcgcggaattgtacccaataagcacgtaaatctccttttatttgttatttaaagcaatttcgacaataaaaaaaaaaaaaaaaattttgaaaaaatttgacccaaaagtaggatacaaacgcaatgagtaccctgatca

SEQ ID NO: 24567 - DNA, 1192 bp, Heterodera glycines
  misc_feature (1089)..(1089): n is a, c, g, or t
  misc_feature (1181)..(1181): n is a, c, g, or t
tgtttcggtgttcggtgaaggggcgaagtgtccgtgcgtcgaaatgctttcaaaggggcgaatttgttgtggagtacaaaggttttccgggcaaaaaaaaatgcatttttatttccaagttttttgttcatttaggcgacttaatcagtgtgaagacggcccaactccgcgaacaacggtatgccaaagatgagaacgtgggctccttcatgtactactttcggcaccgggacaatggtacggattggatcatttgtttttggagtcgatatttcgaacaatttcgaagtcgaacctaaattgttacgggtccaaatttgagacactacctttgtttcaaaattttagggtagtttaggccgatccattatgaattttaaaccgattttggacatgggcacaagtcatattttgtgtaaacatcaaaacaaattttagtgttttgtatcgacgcgaccgatgaaacgccgtacaaaggccgactgatcaaccacagctatttgaagcccaacctcaagacgagggtattcataatcgggcggacatgtttaataccccgatagtttcttaatccgctccatgaactccatattttcttcccaattcgctattttgccaggtggccgacttcggctgtgacggcttccatttggtgctcgtcgccatgcgcgacattgacaacggcgaggagttgttgtacgactacggggagcggcggccctccgtgctggcggttaacccgtggattttgggctcataggtggcgagcagtgtgcctctatttattcttttcattcactactcttttttctttcctttccttttgtccttttttgaaacgttgatgatactcattcactcactcatgtcattaattcatcatcattttgttgtttaatgtataatatggttgagtgcccttttttctgcctggcatttccctaccaatttatgaaccaaatttttatcggaagtatattccctgggtttaagttcgaatttttccatggccaagattagggttcatttttgaacaattccctgggttagaattgacgattcctctcgaaaagcatattttatatttanatataaaattcgatattaggccagaaaagggactctccctccatttgtcttatttcatctcactcctttttatgttttatttaacacatgtnctttcggacgc

SEQ ID NO: 24568 - DNA, 1881 bp, Heterodera glycines
ttctttttttgaaatttaacgaaaatatttttcggcacgctttaaaattggcacactcaaattttgaattgttcagaaaggctaccgacggatcacacttcgttacccgaggggcaagttttgatcacaggggatggatgagcctctaaataaaacaaaaaaaaaggcgtcaattattttgccaattttttttaatgtccgaataatggggccaggaaaattaactttgtgaaaatttaaaaactttccatttttttcaagaatacgtcacaattggacgcgttccacgacgaaattacagtgtcggaaatttgtaagggctcatggaatcagagaaattatatttattttttatgtattattcaattagcgaatttactaaaaatgaaaataaatcatacggtggttattttgtttaagaatacggtactttttaaattttaagaaataaattttaatttgttgcttttttacaggaatttggtgctccaatatccaaatgaagctcacatcgacgagctcaaaggcatttgaatgaatgaggaattttttgaaaaaaaaacgatggaaccgttaattgacaaacaattgaaatgcgtaaaaaacagcttgggaataaatgaaaattttatttgattataattccttaccgtcgattcattttgactttttcccaattaattaatgatacaaaatgcagaataaatacttaattgtcttgaaatacgccatttattttttggcaatttttttcttttttttaccgtccatgatgaatatatgtataagctgaattcacatacagaaaaaaatacaatggaaatggacgcatttgcgagcaagcaaaggtcaaataaatacatacagacaaattggacacaatacaataatacaatattgaaatggcaaagtgcacacatcatttaggttacataatcgcaccaattaaccatcaattaattcatttctgcttctgttgctgatcagtgatcactcggcccgggagaagcggcgtcgagaagactgaaaagaaacgatgattctattgaactttaagccaattcaacaactattataagtccaaccaactaactacttaaccatccctttttttctaccataattctgtccattaaccgtacattttttggtaacatttgaaagcacaaagtctaattgtaagcaaaaatggtgattggactcatatgtaaaatcattttaaaattgttttgttcacccgtcgtcgtatccgccatcttcgatccaaatgtcaattgagttcgttcgagcatcactcaattcgttcaatacattgtcccatttcctctcatcccatccaattggacaacggtcgagccaaaaaccaccttcatattcttcaagtgtcaattgctccccagtcgcttggttgatcagatcaaattccacaacgaagtcaagcggagaagacgacggaaagtgaatgcgaaaagtagccggagaagaagcattggaaaatgcctaaaaaatgggacaaaaaatcatcgaaaacccaattaaatagggataatccaccgttttgaattgttccatcgttgacgtccattgctcctcctccattgaattaacagagcatttgaaccgcttcggcacaccgttcggatggggcgtcaacaaccatttggccaccgcttgaccatccgacgccatggcactgtcatcgggcggaaaagcgggcacaatgtcgttatttgacacggcaacacagaagagagatggacaatcgctgagcattgacggggccaattgacggaaacggcgaaaaatgaaggcgttcaaaaacagaaaacgaatggaatcgcgaaacattggccaaatgtggagcaaaaagtagtccaaaat

SEQ ID NO: 24569 - DNA, 1510 bp, Heterodera glycines
taatcttacttcctgtaattaacggattgggcaaatgcataagaagtttgaggccttcaagttttgccaatacgggaccccaacatttactatgccagacttttaattagtttccagcttttacgactcactttttgagtagggtccggaattgttctctgttatcacattttattttacaacattttcagctcaacgacatcggtctgtaccacgacagcgcaccgcaccggtccatgtgggagctgaagccggagtaccgcaactacagcaaacagttggccaagaatgtggagcaaaaaatgcagcaacaacagcagaaggacggatgatggcgagaaatgttcataaaatgcaatggaaaatgaatggatttttttaaatttggacgggttcatttgcacgaaaaagtgttgcctaaaatggatggaacgagggcgagaaaacagcactaaaaatatttaattaaattcaaaattcaaaaaattgacatggagaagagagaagcattggttaatttcacccattttacaataattatagctaattttttgtgggtcccaaaaaccattttcttattaaattccacaagttaacattcttaaaaaaataatcctcttcattcaggcgagcaacacttttaagtgttaatccaacaacattatgatttgctattgtgcatattgactataaaatcggaaagattgcattttttttaattttaaatgtttaaatttcgagtgttttcaataattatttttatttataattttattttgtatgattatataaattccatttgcgttggtttcccgttgaatgtcatttgttgtgccaccaatttttgccattttttcctccccaaatgttttctctgttccgcggggcgtacggcgaaatgacgcgcaaagaggaatattttgtcgcactgttcggcttggacggtgcaggaaaaacggtgtttgcttaaataattatgtaaaaattccttatttttggatggcattttccacaaaaaagtgatacgtgccggccgtatttataaaaaggaatacaaatttaattaaaaaattaacaatgggccaccaaattcagcgtcgatttaaatgcctatttctaaaatctttcctaacaatttttccattggattaggcttatgttgagcgactgaaagcgcactttgaccggcactaccggtgccggaatttggccaaactgtcctccaccgtcgggctgaatcgtaagtttttacattttgccaaaatttacatgttttgtaaccgatttgccattttgttcacagatgtccgtgtccctctcgctggtgccgtgctcaatgtgtgggacctcggcggtcaggcggaactccgtcccctgtggcactcttatttggcggaatgccatgccctcatttttgtggtcgactcgtctgatgtgcagcggttgcccgaagtgtgcagcgcattgggtgggggcactgaaaaagcgaaaaaatggggggggggggggg

SEQ ID NO: 24570 - DNA, 1212 bp, Heterodera glycines
  misc_feature (66)..(66): n is a, c, g, or t
tttttttgccattaaaatgcattaaaaatgtcatttgttaggcattttttggccttatcacgggangatcggaaacaaactgaatcctgactgagatggtggtcagaagtaaatttttgtgaaaaccctttttttgttcttcgtttgagaaaatgtttcagatatttattgccgacaatttcatggatttttattcaaaactctcgaagagctaaaacaactattggttcctagatttgagctatggcgtctttttcgcaaaaaaatatccggtctttatttttttttacaagatactgatcgactacttaccgtacaccatggtaacatcgttgacagccaaaaacacggtgatgatccctaccaaccaatagcacatggcattaccaatgacaaccgtcatgatttgctaaaaatttaaatcccaaattactttgtttattttaaaataataaaaataattggctttggtttggataaaaatatgcttttgctgttgaatgtaattttttgcataatttatttgtggtaaataaatcattttcacaacaaaatgagcgccaccgatgataaaatcaaaccaccacattcactcttttgtgcaagctttaatagagcccatcaacagcagaagtgattcatcgtcggttttagcgtatgaatcgaataaaaattatggaaaaataaaaatatatatataaaaatgatatagattattatatttttttaattaaattattattatggggagacggccaaattgaagggatacaagttggtttgaattttcttaacctaaattaattgttttttattccgtaaacaccaacttcatcaaaaaacaaaaagattttcgtaaaaatttgaattttagattttttgacagagatttttgaaaaagccatcgtactctatctgtaaaaattcatgaaaaataattttaatcagagtctttttcaaaaatatattttttattatttatttgtttattatgattcatttaattggtccttttccatgtatttgtgcagcccaaatgatggtggtaaagacgtcaacaaaagggataaaattaaattagtaatttaacacaaaataatttaatatttattaatttatttggttgtgttggttactgtacaacaagttcacctgttttgacgaatgaaaagacaataaattaacacctgcccactcattaaggccttttag

SEQ ID NO: 24571 - DNA, 1736 bp, Heterodera glycines
ctccgtatgccatcaattggtgctccgttcggctaattggcaaatttcgcccaaattggagcagagcatttactggaacgttgaccgaatttttgtggacctcaattggagccagaacagatcctgcccaaaccccgaagtgatccaagtgcaacacacgccaatgcccagcaaagagaaagtggggacaaaaagagacggacgaattgaccttttaattctgttaaaggcaatcgaataccttcgtcatatcctcgacaattcgtttcgcatccgtcgtttggacctgaacatccaagtctcaaccgaattggtggtcaatgacattttggacgttttgaatggccatggtgaggagttattttgtagcattgttaatgataaacctttattctttttagctaaagtacaacttgaagaactgttcgtccgacgtcgttatgtgggcagcaaattctccggtctcgtgccgctcattcggtcgaatgccaaaacgttgaaacaaattggcaaaattggtttgggcgaggctatcaaagcactcagtgacgaggtgagtcacttttacagtatttgtacaatcctatcccattttgtgccgtttcagatccacctcgaacgtctctcgttaatcaacttcgacctggtcgaacaagaccagcgtttggacagcgaagaattggcccaaaactcgcgcttttacattcgtcggttggctggcattggcaccacctttgaccacttgtcctacacttgtttcaccggtttcgagatcaccaaaatgccagccctcaacatgctccgtcagtgcaaggtgtgccattcaaaatcaacatttgctgtaacggcaattcttttgatgccatttgcaggtcaaaagtcttcgtctgacgatgcaaagcggcgtggccatcaaagacccggaactccctcgcccgctgttgccgatgatgcagcgaattcaattggtcggcggaatggacgcgtcgtcggagagactgtcgttgctgtttcccgccctggaggagctcgaaattgaaaagcaggacctgatcactggccaccgactggaaaagcgagcgcgcgtcctctccaattacgcgcccgactttgtcggtgacgcatataattctgtcgcggccgcttgctgaaccatcggtggacgacgtaaagccatggaagacggagaagcgagcacattcctttcttttgacatttctttgtcagtatcgttccattgatcttattcattcgttacattatatgctcatttaactgtaaaatcaggacatgatcttcaccatccgtttgatatgtatgttttttaaatcattttccttttgacaaataaatcgaaaaaaattatgaaccaataaagttgcagtgttttaagactctcaaagttctttctggagaaaaagtacaatggggtcgggctaacagtgagaaatcgctaccagtaaattgtgcggctctattgcagttcacacaaccattaaaaaaagatacggcaataataagtctaacaaactaatggaccataagaacgtccaaattctgttttcacaatcctcttactttccacaattgccaattttcattagacctctgtgtttgctgggcctcaacatctccaaaaaaaagaaaaattttgtattgtcgactaacgttattcttttcctacaatatttgtttactttttctctgctggtttgtgagtaaagaaatagtgacaa

SEQ ID NO: 24572 - DNA, 1112 bp, Heterodera glycines
ggggggggggggggtccggcggtgaagacaggcgccgctggagaaaactttgaatttaatgaatttaaaaaaagcgaggcgcgtgaggggaagggaagtggcttttttacgtaagattccaaatcactcctccgaagaccaacccaaggcaatgcccgctttctcagcagctgctcgctgttcactgtagtcatacccctcgaacatgtacagcgttcttccctccgcttcatcttctatttgctcatcctcaatgttttctttgtcgtcgccctgtcaaaaagtaaaattatcaaaaaataaataaataaaatatggccaacctttatttgccaatgtccgttttggtcggttcgacccaaccgctcttcaagctgtttgtcggtcagaatgtgaaactgtgtgtgcttcttctgctctttctccaggtcggtgagcccctctagcaacagtttggacaggtcaaacattagtgaagggcctgaaaatattttgaaaaaaaaacctaggaacaagaaatactcgaaaaccttccttttcgtcggttcccaagacattctcggacagcttcagcttctttgcggctctctgctttatcagctcctccaccgtatgttttgccacgagacgaatgattttaacaggtctaaatcgaaaaatggagaagggatccgaagaatttttgttctttatgagggaatctaaaggttttgttacagagttttgagaaaaaaaaagtcaaacatttttgattaaaaaaatttatttattttttgtataaataaaaaaaaataaatataagacccacttgtcctgcccgatgcggtggcatcgtgcagccgcttgtttgtcgttctgcggattgaagtcccaatcgagaaaaatagcagtgtctgcggcggttaaattcagaccaagaccacccgctttggttgtcagaagaaaagcgaacacgtccgaatcaggccgttgaaagttttgaatggctttctgacgatccggttgactaacggttccatccaattgctcacagatgtatcctgtgcaaaaatgaaagtttaaatgcttattgtaatgtaaagaaaattggagcctggaaaggcaacatccaa

SEQ ID NO: 24573 - DNA, 2406 bp, Heterodera glycines
  misc_feature (843)..(843): n is a, c, g, or t
tcatattaaataaattttttattgaaataataaaaagttttttgaaaagtgaggaaatgtcactatatataaaatgctaaataaaaataattaaactgttttaaaactctatagaaaaatgaataattaagaagataaatttctttaaaatatttaatcataaattaacaagttttcttcaaatgattataaaaatgatatttccaacattagcatagcaaaataaaagaaacataccaaaaataattctaaagagaaataggaaaaaacaaataagatttattatcatttaaaataaatatcaaataaaaactatttaaatttgacaaaaaaaataaaagaaattaatatattatgtatctatgaagtaatattaatatatctatttaaaagaatagtaatttaaacaaatgacaagcgagatttaaaattaaaaaggctgctaaaaatagaatttaaagttaaaataaaatacataattatttttatctttgttacaattaaccatagctaaactgtttattccaattaatattcaaatggacaaataaaattttttttaaaatgtgaaaaattattcaaaaaacgaaataaagggcataaagtgatcagattatcacttttcataattattttaaaaattttagagagatttttcagcaaccgaaaaaattttaattgcattttcaaattgatttaaataaataaatattaaatttatttttaagattcaacaaatggaggaataaataataaaacataaaaaaggaaaaagtaaagaaataaaacaaagttgttaaaggaagttttaaagttcaacattccaagaaattaaccaattanaattttataagatataataaataattgaaaatatatttaattatttacagtgaaaattatttatgcataattttaataattgacagcaatatttgtgataaaattgatttaatgcattaacttaaagcaataaagtcttaaataaatctattttttgttctattaattaaccaatggaggtaaaagttaattgaatttgtaattttaacataaagttattactttaattcttaaaactaaatccctaaaattttggacaagcttcctaatattgttatgaattaacgaaaaattttaaaaataattagttaaaacagcgtaaatgattaaaaccaaatcgaattttaatgaaataataaacaaaaaattacacatataatcgtcacagtaaattgtcactaatgcgtgagatcagacacgaattttaagaaaataagaaaattaaaataaattatagcttcattaaaaatattcatttaaaaataaaattaacaatattgtaaaataaattaatgtaaaaaggaaaataaaatttgatgaagattaatatatatttataaattgtacaaaatgatttactaaataatttatgaataaaaggaatgcaaaaagtaagaaaaataaaaactaactttcttaaagaaatataaaatgttcgggttttgtaattaacggttggggaggaaccctaacttaaagtctttttaaatttgttaggaaacgattgtcacggtttcggtaatgagattttcgtccatataacttttaattctattttgaattattaaaatcgtgcttaaatccatagaatttcaatttttaaatattctattctattcaattgggaggaaaacgagaaattttcagtttttttcagccctttactagacataaaaccaccggagaaaaccctgctctgaatatatatatatattggagaggcaaccaaaattcttttagaggcagacaatttggaggatacgtgcaaaggaatccaaattttattccattgggacaaaatcggacttggaatgggaattttggaaataatacggggagatttgagaatttccgacctcaaaggggaaattttgggaatttccgagggaattcaagaggaagaggaagtgaaaggcaaaaatacaaaataaatgccatttcggatgaggcggctcagccttcggtatccaactcccgaaggtccctgaccccgacaatgacatttttgacaatttcaatgattctgtgctcatttttcgggactatttctggtcaataccaattatgttctgatcgagttcccaccacacccatttggttaccaaacgtaacagaatgttcagtaccggagtaccaaaaagctgacgagagaaaagttacactttttttagctgttcgaatgccaaagcaattcccagtttataactgctatcagaaaatgatgaaaatttgtacgggaaattttctttttttctggaaagacataaaaagtcaggattcgtacgtgaagggagtaagtcaccgagcttgtcatggatttaaaaataacatgggacatacaat

SEQ ID NO: 24574 - DNA, 1561 bp, Heterodera glycines
ttttatgtgcatatttcacgatttttggtgcatattttatgcgcatattttgcgattttatgtgcatatttttgccaactctattaataaatatgacgataatcattttttgatacttttttgtgaaaatttttggttttagctaaaatttcttaacaaaaatgcaataaaaacaaaatgatctaactttttttcttcaaaaacattcatcattaatattgatttgttcaaaaaaaaatttgaccaaaaatttacacacgcctaaatttgtggctatttttagataattttctattttcgcgcatatttttgtgcttttatttgacggttttctaaatttaaaatatctaaatatggataacaatttttaaaattgataaaaaatagtcaaaactactatttgggctgaaccatccaataggtagaaacgcgataatggctagcaaaatatatatcaatcggttccttttgcatttcaattacgaatccgaaagaattttcggacaaaaaggaattgacaaaaggaattgtcaacgaaaaccttcgcaaatgaatttgataaaaaaatttaggtgagccaaaaacactcaaaatcacttgaagattttgaactatgtaaaaagcaaattaaataaatccttataaaagcttttggctcgcctaaattattattttttatcaaagtaattttcggaggtttttgaggataagtcagtttgattttgtcagaaaattctttcgggtgcgtaattgaaatgctgggagaaattgtttgataagtaatttgttgatcatttatgcgtctttattgttttttcttcttttttaatgtttggtttttcctttctttattaataattttttgcttgaaactttctttttgccgacccattatttatttatttaatgtaatcactgattttgactttcttcagtccccgtgaaaatcgtatagaattttacaacatgatggccaataaaatttttaaaaataccgttttataaagcgataacgcatagaatttccaaaaattttcattttaaatctgtaagcaagatttagaaagataattatcaaggattatcctaagattttaaagatttaactgactatcattgagattactgtaaaggttttaagcagggtttttaaaggctcaacacagcagcgcttgttctgaacttttttcggttcatattaaaatccaaaaaaaatttaaaaatgcaactatcttagcaccatcctttttctacgcattttttttataaaactttattcaaaaaaagaaaaagtggacgccccggacggtgtgaatgagtacgagtgcgaaatacaacaaccgcatccgggtgcggaggaagaacaagtggaagatgggaaacattggaaacacaaaatttatttttatttatcgagcaaaccaaagtgtacattagtgctcttacagggtgcgaatgagaaacaaagtggtcggtgccaaacagtggcgccgggatatccttcgccccaacaattcattagtaataacctccctcccgacattatcttcagggccttcgt

SEQ ID NO: 24575 - DNA, 740 bp, Heterodera glycines
caaacattttataagtaaatcaattccgtaaatttccttttatttgaaagtttcattttatgaagctattgttaagccttaagaacaattataaaaatcacaatttaaatgaaaagtattttaaaaaatcagaattataaggtaacttcatcaaattattgaatttattttgacattttaaaggccctgacaaagcaaatgggaggggttcttggcgttattttgccgatggatttcccccggaagattggagcgattgatcagagatgcttatcgggcggcagtgtgtaaattgaattgaaaagcccggcgacggattattcccaggcttttgcatgggaaaagctaaacaaaatatcgggttaaagcgactgatcggaacagaacaataaaaacagggacaaggcaaagagtgatcgaaacagtcgcttcaaaagtgtaatgtgcaattaattgatgggttccaccggcttttcctccgtccaacccattgggaaatgaaataaataaataaataattgcattgtgtgaataaatgtttcattttaaaatttaaaacactttacatttgttgacctgatttatccaattttgaagtggaaaagaaatttataatgatcggaaatcaacgcaataattggggtagaactgaagagatttgatggggaaatgcagggaaaacaaagaattggaaaatggggtcaaaatttgggcgacgagcaaaaaaaaaatggtacgac

SEQ ID NO: 24576 - DNA, 941 bp, Heterodera glycines
ttcagtgcactcttgagcgatgcccacggcactgcgtccagtttcggctggtgtccattttctggttccaatttaccggtccccgactaatgttgttatgcacaatgctaaatacctgcagacaaatcgctatttcagcaaataaatccgcatgaacttaagattaaaatccatatcatttaaattataaaaagaatttgaaaaacaaaaaattaattgattaattatacgaatgattttttgaattttggtaaaaattttaagatgtgaagagaatttttctattagagaatataatttaaaaaatgcttagaaatataaaacacactcgaaatttagaagaaaatgaaaaaagcatatattttaataaaattcgttttccgattaatttacaagaatgaatattttttaaataaattcaagtcaaaaataaaatttaattaattatttttattttgaaaacgttaaaaaatagagggattcattttgaaactaaaaaaattaataataaaaaatattcgttcaatttttcgaggatttatcataacaatcgattaaataaattccaaaatctttcacggcggagaatatcggcacaaattacttgaccactaaatttgcctgattgaatttttggaattttgtaaaatggcgattttcatggaaaataagatttttgaggattttagtgtcaaaagaggattttaagactaatgagttatgaagaattttgaaataggagtctttcctataagattattagaataaaattttaatagatcatctgactaattgtaccaaaaccagtcaattagcataaaaatatcttaatttctttgagttttttcatttttttttttgatttttaaattaattagctgtgtttgcggtcgttttcagagtatcatcccgctttatgtccatttttttgtctcattttc

SEQ ID NO: 24577 - DNA, 1689 bp, Heterodera glycines
  misc_feature (1680)..(1680): n is a, c, g, or t
ccgcacttctgctggagaaatgcctgcccatttgctggacgaggcggtcgctcgacagatcagcgcgtcggcagtgtttccactgatcaacgcccatttgagtgagttggccaaattaaggcatcgatcactgatcggttgcctgggaataattttgtgatctttaaaatgccgtcgctctcttaggcaatgattcggtgttggacgtctcccaacacatgccctttttccaaattctgttggaattgtgcgccgcgttggcttccgtcccggcactgctcccaaagattgttttgccgcaagacgcacacggaaaatcaatcgcgaaacagctgatcccgcagtttcggaacaacctgaacaattaccccacactgatgagtggaatcagcgaagctgacttatcattcatggactttattcgcaaagtcaacgattattcggaggttggggaagacaaaaaaatgatttccaatttaaattttaacttttcaggtcatcattcgtttggcacggcaatttgaacgtcaaattccagcggaaaagcgcgtcaaaacgtcccattcccatcgctatttcacccgcattggcgccgaccgcgtgcgacgactgcgtaacgcgtcggcgactgtgccatcgtcgacgggtccgagttcggcggttggcagtgccattgcgtcaccgcaagccgacggcttcggctcgcagttgtcgtctccttcagcccaatcgctggtctttttcggcaacttcgacgtctccgcgactgtctctgtcgtagcgcgacagcgaagcgtcgcaactgcaacgcaaagacaacggacagccgcggcacggcgattgagcacgcaacaattggcggaattggacggacagtcgccgagcgagcagtacagggaggtgctcagagagttgcagatgagcacatacaggtgtgggcaagcctaaagggtgcattcatgcttattggatcgtgaaatggctttaggttgctcaacgatgccgggaagctggtccacgggttcagcttcaaacgcgaactccgctccgtgaaccccttctccagctcaaacaaagacaggaccaaacggatcgcaaagtgagttttccggcgagtggggcagagcatcggcgtgtgatcgctcactgactgatcgctgatttctgatcaccgctgggattgcctctgggttctactctgatcactcccccccccctctcccctcagggaactcgcttccatgcacaattcgctccctttgaatgcttccaatgcgattttcgtctgtatggacgagacacgatgtgacattctcaaggtgagcatggtgtgctgatcagttgacaattgaccaacccttttcttccctttggccaggttttggtcaccggtcccgacgacactccgtacgaaaacggactcttcgaattcgacgtgtttttcccgtccaattacccgcaacagccaccgaaggtgagggcatggcaggggacggtgcatgcactggaaggcacttacagtacacataagccattttagcctgtccgatcaatattttttgtcttattcattatcaaatgggattgaggggttgttgatcactttgggctgatcattggctctgtcttacatttgtctctgatcactcgatcactttcgtttttttttgtcttttcagntgctctttt

SEQ ID NO: 24578 - DNA, 1537 bp, Heterodera glycines
  misc_feature (163)..(163): n is a, c, g, or t
ccggtccgttttgctgttgcggcgtcccttcaacggctgttggtagcggtggcgagggcggcggcgttggtggtggcaccggctcaagcgtatacgtccaacagcaggagccgtccctggaaagcggagaaggggaggaggtatagttagaatcttcataatntaaaaaattgagaggcatcgaagtgccgcagaaaggtcaccggccgcctaaaatgtgcccgagggaactacgccaaaaataagaaatctctggtaaaaattcaagaaaaaaatttttagtggcctattcaattttttgaatttttgcagggatattttgtcccggagatttttttgggttgtaccgacaaaatcgggttttattgtgctatgcgcatgtgttctttatgatttgaaaaaataaataattcagcttaaatttttttcaaaattaaattctttaagtatgtgcaacaggttgtgcgtgcccaatgccatgccccaaactcaccggtgttccaacgcggccaccacgtagccgtgagaggccaatgatgcgcacaccgtcgtgtagacgaaccgactgccactgatgccatgcgagaaaatgaccagtggaaagcgctgctcacccggcacgaccggcgcatgccaatggacgggcgatcgaaaaaacaaaaaaaactactgtgttaatgtttgattattggcatttatttagtaattatgttgtcccttcttaatttttgtctcattgtctgtcattgtagtctctcgcctaacctatattttgccattcccttcccagcagaaaatgtcccccccgtcttcccttcaattcattctgttggcagagcactttttatattgttgtcgtcagttattttcctcggacttcccccccatttttattgttgctgagtgaattgtctccactttggaaatattgttgaaggaaagcagtgaataggccccgacccaaacagcttatttagcacgctacattaaaagatggagatgaaaaagggatgggggggggggctggtccctgaccgatgaagctgaaataacggtaaattttttttgaaaatttcatttaaaaagtaagatttttgcggaaatttttcaaaattcagtttattttttggtttgcgctgggaaaaaaagatccaaaatttgcaccaaaaaaactcactttttgtcgccgacgacccaatcgagaaagaagttcatcttgaccatactcatgccctggtaatttgccaagccgaccatgtactcggtgtccggacgccaacgcatgaactaaaaaagtgggagaatggcactgagcaaaggggaggggaaagagggaaagaggcgaggggggggggggtagaaaaacgcactaaatggcatacataaattggcgcaaaccaatttgttcgactatattttcgccacaaatcgtttcaccaaaaaataacaaaaaacaataaaaaaaaggggtgcaatgatgctgaggtgaactgattcaagggcacaaatctccactccctaatttgaatttaattcg

SEQ ID NO: 24579 - DNA, 894 bp, Heterodera glycines
tctgaaaaaatatctttatttattttactatttaaattactaaataaatttacgttaaccacaactcgagttgtggttaagatttcttaagaaagattaaaccacggttaccttaaccacggttaaaaaggaaaggacgagcataccggttaaggattcttaattgaaattattgttacgacatttaacatctataatttcgaaaatattttcagctttgttaatgaatatgttatataaattgcaaggccacttataggctcccgcttttcctcttcatcaatgagactaatccaactagggtcttcctttggtgacatgttagccttgtcctgttccatttccgggtaagcgttattcatccaatcagtggcgagaattaaatccattttttttaaattaacaaaattaaaagttatatatagagttttaaatctaaatgtaattaaaaatggaggaaacttttgatcatacggatgtacagtttcgtcatccattcacaatgattgtgtcaggaagtacgcgaagtggaaagtcggaatggataatgagattattacgtaacttgaacaaaattatttcagtaccaattgagcgtgtattgtattgttacggggagctgaatccgaatattttaaatttacaacgcaatgggagaattgacaatataacagtcactgttcacaatggagttcctactgaatactacattaaaggaaatgccaaaaaggaaaaattgttgttggtgttggacgatttattggttggtatgagacagcaatatttagacacacttgtagtataagacgtattaatccggtgtaaaatccccccccccttcccttaccaaaacccaccaccccctgaaaaattccggcccaaatttggtcccaa

SEQ ID NO: 24580 - DNA, 1066 bp, Heterodera glycines
  misc_feature (63)..(65): n is a, c, g, or t
  misc_feature (67)..(67): n is a, c, g, or t
  misc_feature (71)..(71): n is a, c, g, or t
  misc_feature (75)..(75): n is a, c, g, or t
  misc_feature (77)..(79): n is a, c, g, or t
  misc_feature (81)..(83): n is a, c, g, or t
  misc_feature (85)..(86): n is a, c, g, or t
  misc_feature (104)..(104): n is a, c, g, or t
  misc_feature (114)..(114): n is a, c, g, or t
  misc_feature (138)..(138): n is a, c, g, or t
ggggacctctagagctgaattcatcctcaaattaaggggcattgacgacatacaagggggggnnnanttangggnannnannngnncctcttaaggggggattnttaagtgaanaaaagtaataaggtttaattaggntgagagaaaaatgtgaaaaaattttatttaaggtaatgttttgatagtaatgataaaaaatggattttattaatttgattagattattttttttaatgaatttgaaatatggaaaattgagaaaattttaagaaaaataatttgttaaggatggaaaatttgaaagtgaatttttttaattgaattaattatttaagatttgtattttaatttatgtttttgagttattttatatttacccaaattattggttattgtaataaatattcttaaaaattatggcaaaatgaaaatgaatattttaataaaaaccaaaaatattatataaaagatcattgtaattaataaattcctaaaaatttgtggtcaaataaaatataatataaattgaaaaattaaattttctcgtaaaaaaaattgtaatacttttttaaaatttgagcaaaatttgcaaatgattgaatgattaaaataatcatacaaatattttttttgaccgggggtcataagccgggataattgaattttcccgggaatcccgagcctttgttttactaaaatcttgttctgatctgagaatcctgaaaaagggaactacatttttgaaattgcaaaacttcttcgaatttttcaaaatttcgccttccaattaaaaagaaaattttagccacttataatagagttgagcggttagccgacttttgcgccgcagacatctgcgccgcaccatttgcgccgcgacacttgcgccgctcagcaaaaaagacttttgcgccggggacatctgcgccgcaccatttgcgccgcgacacttgcgccgctcagcaaaaaagacttttgcgccggggacatttgcgccgcaccatttgcgctgcgacacttgcgccgctcagcaaaaaagacttttgcgccggggacatttgcgccg

SEQ ID NO: 24581 - DNA, 1971 bp, Heterodera glycines
tgcttatgatttggaaacggtgacaaaaaacaaagaaccgttaaaaaaatgtttaattttactgtaatttaaattatttttaaaataaaatattttaatattaaagaaaatatttaatttaaaaatttaagaataaaaaattgtttttttattgtaatccaactaaaattatttatattaaaaaataaatttaattcattaaatgaatggataaaaaaattttaatgtaaaattaagaatttattcaaaaataatttttaaattaaattaattcatttaataataaatcagctagttcaaacttcgtgaaatttttgtacttaaatccgttttctaataatcttttttcctttatttctgaagatgaatgaattggattcggtgtgcaatttcgaatggcgaattttcgatttcagtcaaatggtggaaggacgggttcgccaccttaaaagtttcgcgtggaagttttttgtgtgggcggtaaattttttaaattttgaatttaaaatgattcgttaaaatggtaaagcacgttttattggagtatgacactgtggtttggcttgacacttcagtggttttccataaaaatgatttcaaacgattttttgaaccgatgcaaaacggcaaaattggcacggtgcaaatcccaagctgtgagtgaaaagaatggaccttttaaaattaatgagtgaattataaactaattatcattttttagttgctctccacacaatgaatatgtcaactcatcctggtaaaacaaaaaacattttcaatggccttactttgtaattcaccgcatattcccaggaatgtacgaatatttgccaatgtacaccaattttgagccgaacagaacatacgaactgattggaacttataagcccatcatcaaaaccgaccccccacagttcgagacaaactttgtgattatgcacaaatccgagcaaacgcggcaagtgatgaaatggtaaaaggataataaattgagaattaaaacttcgaactttttttgtaattcattaaaaaatcgtccattttacatcaattttgggctaatatccggtaatattattccataggactgggcccgatattcggatattttcatgtttgggtcaagttttttcaaaaaataaaggtcgattccgatcccttttaaccctctaaaataaaatatcacagaatttttctccctatgaaagttaaaataaaataatttaaatttgcatggctttgctttgtgccgccgagcccgactgtatggtgccaattggacagacgtaggcgtgcatttacacggcaactgctccgaatttgacttgccatcgacaggatcagagtctgatggaaattctccgctacaacatggaatatcgacaacaaattgagagtttgttttaaaatcaaagtgccgatcccaactttttcggcatttcttatgcccggttttgtttttcaaaaattccggtccaaaattactcattttttcccaataatttatgtatttttaaatcagacccatcatttttgacccaactgaaccctgcccacccgcgcagttcaaaccgaccgttgcaatcgtcgggaatcagcggattttttgatttgctccgtggtaagcattttggcggttctcaaagtgaatggcttcaaagagttcaatgttgctgatgaacatcatcattatcttttgttttttattcattttcgtataaatttgggcataaatggaaaatcgttaaatgattgccaatttgggaaattaacatttaaataagattttttcattttgtctccatttgttaggttttgcaccaaagtgatttatttttaaagattctgaaccaatatttaaaaaaattagttattttttactgaaatgtcctttaaacgatcctacaaaaattaattttgaaaatattttgcattaaaagagttttagaattcaagaaataataaattttc

SEQ ID NO: 24582 - DNA, 1761 bp, Heterodera glycines
  misc_feature (1731)..(1731): n is a, c, g, or t
gggcgctttgagccgaggtaaggctaactttttttgcgctaactttgcgcagcgccgggcgctggaagtcaagggggcttggctccgcttggcgaaagtttgcgccgtgccatggggagcatcataaaagaaaatttggcgcgattctaaaagtctaaagggtcgaaatgacgtttcgcttgacagatagggggttagcgcgggtaccacgcatgcccattcgccaatccctcgggtttccactgtagcgcgggtaccgcgcatacccatcccccatcagagcgggtttgcactgtgagagcgcatgtcttcgtactcactttcctccctccctttcctcctgtcccgacagcagccgccgacaactgcgccgcccgcccgttcgtgccgtcgactcttggccctgtccgttcgtgcgccgacttctgtgccatgccgatccgtgccctgccgtgcccgactaccgccttgacacaccgcccgctcaatgccgcccgtcccgtgccgttgacgtgtgccgagccgaccactcccgttcggtccccaaattgtgccgtcctccgatttgtgccgtcccccattttcccccattgtgccgtccccatttctgtgccatcccccattttgtgccgtcccccatttttcccccattgtgccgtccccatttctgtgccgtcccccatttgtgccgtcccccttttttgtgccgtcccccattttccctccattgtgccgtccccatttctgtgccgtcccccattttgtgccgttcccccatttcccccttcggtttaattacccaagtttgaggactccaataaagtgtattttgaatcgctttcccgcctcacttgacccccagcaattccaccatccccgattgaccgccaagcgtccaccccaaaatttcgccacaaccagtccctctcctggtcaccattgcgccagccgcccccaccccgccgactcgcactactcgtccacaactcaaagcccagcaccaccaagcagcgccggccctctaccaaccactgaactcatcagcacccccacatctcgccaaattcctacccctcccatttgtgcgccatcgaaagcgtacaggtaatacgaaataatgccaaaataaatggacgtccttggaaaaaataattgctgactccctaacgaatacctggattggttttgctcgttataattttttttcaaaaaacgactatctcttttttcggggtaatacgaaataatgccaaaataaatggacgtccttggaaaaaataattgctgactccctaacgaatacctggattggttttgctcgttataattttttttcaaaaaacgactatctcttttttcggggtaatacgaaataatgccaaaataaatggacgtccttggaaaaaataattgctgactccctaacgaatacctggattggttttgctcgttataattttttttcaaaaaacgactatctcttttttcggggtaatacgaaataatgccaaaataaatggacgtccttggaaaaaataattgctgactccctaacgaatacctggattggttttgctcgttataattttttttcaaaaaacgactatctcttttttcggggtaatacgaaataatgccaaaataaatggacgtccttggaaaaaataattgctgactccctaacgaatacctggattggttttgctcgttataatttttaaaagaaaacgnactatctcttttttcggggtaatacgaaat

SEQ ID NO: 24583 - DNA, 1135 bp, Heterodera glycines
agacgacaagaagcgctacgagcagggtaaaagatggcatgcattgcgacattgaaagactgatttttttagaaatgactcagtacagagctcgccagaagtagacgattgggcagtgaatgacgttttatctttgacttccttttccgctgttctctcctatatttaaaagtcaacaaaaatcgaccttccatttgtcgtccttttcgacattctgatttatttctctcagtttaacttttattctgatcatgtacgtatacattgcatctggaaaatgatgatcaaataaatggaaatcatcaatctcgttgacaagcctaattgtgttttaccacttattttgattagaatgctacattggtccatagtttagtgcgcccgttagaataagtcagaatttaaccattttaattaccgggtcagcgattggataatcgatagaatagaactaggtatccatccgggagcgggagtcccgccattagctcacacagtgggattttttactggagtagtgttgattcccgctcccgaaaacttttcgactcccgctctcctttctacaatctcatcaaattcggagtaaatacaccggtggggatggatgtgattttttcaaaacacgagtaagaatgaaaattttctaaattttaaattattttgcgtaacccttcgcttcggaattgtgtccggaagagaaaaaaaattttctttgcacaatttcaaattgtaaggtaaaaaatatggttctagtcggttttacgcgtcccatggcattttacgcgtcccatgacatttttttgtgtccatggcggggatggcatcccgaggccacaaattttcggaaatcggaattccgtgccatccctaactaagaggaaacctatttttttgtcgtgtatttcgtaaattttcaactaaaaatttcgttgctaaaccaaagtatcatgtcaactcacacaggcaactcgatcaatggcttagactaggcgtaggcttttttgcaaatttcttttatgtgtttactgactgttgacattaataagactgcttagggttgctgttgcacatttccataatcaaggcatacaatcaagaacaagtagacgattcggagggtatatagatttga

SEQ ID NO: 24584 - DNA, 1012 bp, Heterodera glycines
ccgtttctttcacccgtttaaacaggtcattcataatattccatttcccctgttgtcttcctcagttgccatggctggtttggccgtttccctcgtgcgcaccttcgccccgtacgcttgtgggtcgggaattcccgagatcaaatgcattctgtccggatttgtcatccgcggatacctcggcaaatggacctttgtcatcaaatccgttggtcttatcctggcctctgcttccggtgcgtgttcattggtggaggatttatttattttttgcttctttgagacttaccagataaattcataaaacattgatcaaagcaattcaaattcagggctcagtcttggtaaggaggggcccatggtgcatttggcctgctgtatcggcaacattttctcctatcttttcccaaaatatgggctaaatgaggcgaaaaagcgcgaaattctgagcgcttccgctgccgccggtgtttctgttgcatttggcgcgccaatcggaggagtgatgttcaggtgatgatttcggtttaacaggcttatttattaaaaaaaccaaaacctactcattctctttgaccaatggttttttttagtctggaggaggcgagttattattttccgctcaaaacgatgtggcgctcgtttttctgcgctttggtcgccggtgttatccttcgttttgtcaacccgttcggaagtgatcaggtgaatgttttcttggaaagcaaataaaaaatagtgtattttcttcttttatagacttcgctgtttcacgtggactattccatgcgttggacattcatggaactgattccgttcgcaatgttgggcattttcggcggtgttcttggcagtttgttcatttggtaggctaatttttttttttttttttgctctgagctgcagccggggaaaattttttgaaaatttaagtgcgttttaacagcttttgtccaaaaaatgataattttatgtttttggaaaaatttagtcaaaataaattggattaggg

SEQ ID NO: 24585 - DNA, 1304 bp, Heterodera glycines
ggtgtgagctataaacaatcatgaagtcagcagtaaagaaacaaggaatggtgaaaagggatcgccgcatggcatcattccaatgaacgggacggggaggggtgatattgatattacacacgaagtgatcataggaagcgtgggagagcgtgtgaaaattctgccaatctgatggttgatgattgtggcaaaagaacaatactgggaaattgtgaaatgtttgattgaggaaaaatttgggaatgggagggggaattcatgggataactatagacaaattgcgtcaaagactactcgtagtgatggacaatcggtgagaatagccgagtgcccgaaacgtcgcaaacggttgagatccattggccacaaaagtatcacgcgaatttcgtctttgagcaatggccaaacgttgagcaagaagcgttcaaaaagacgatcattttttgtttgaacactcaaattaattccataatttgcaaaaaccgaagagaaacggcgcagaaattcgatggcatttcggtcgatgtaactgaaaaagtcatcagaaaaaaaattattatttttttttcgttttcaccttatcaaaaggtgttggaatccaatgactttctttggcaccgatttttgcggaatttccattgcttcgccacggccattgaaaatttgcatttcctttgtgccattcgtttcctttttgcagcgccaaatttgcacatatccaaacgaccatcgacgagttttgaagtgttcatcaacgtaacaatcaaaacgattgctgatcagagcaatgccatggccaagttgacgtggcggaagcaattcgaacactgaaagccaacagtcggcggagataaaactgaaaaattaggggaaatattccgacaattttttttattttacattttctttttgtgaatgcgtcgttttttgaagcggtcccaatgatgccaaagaaatgtgaaacagcagaccatcaaaggcacagcaaatacactgaaaatggaattgataaaagaataacaaatgaacaacgaaaaatgagacgcaaagaagcaaaaatgagggacaacgaattcattggtgcttcggtttgactgaaaaaagtaaaaaatttttgtaatggaaattaaaatttgatgatcaaaagcaactcagagagtgcaggcaaaagccaaaggagaaaagcaatgggacgaagaaaaaagaatttggggcataaaaacggaagacatttcgaacacaaataaaagcaaaaaatgagggcgaatgaatgactgagaagagtaggaggaagtaccttttat

SEQ ID NO: 24586 - DNA, 1319 bp, Heterodera glycines
ctccatctcaccagcttatgtgttttttgttttttgggtagaatatggatgagttagcactttcattaacggaattcttcaataatgatgctcgagagtctcgacttgaaaagtcttttttgcctcttggcacttttgagtcttgaaattgtcacatcggtctcgaggctgggctcggttcttttcgtattgatgccaaattcggtcacgctcaatcatcattagtcaataaaatcccaccgatagtaccgatttttgcttgccagcagatgaacattgcgtgccgtacggtgtgtgcgaagctgcggtttgtttggtgggactgctccgagcgaacaatgcaggtcagtcagtcacagtcccgacaatacgagaagagagcaaagtgtgctgttttcaagagtcgggttcattgttagttttttgggtctctgtctcgattctgggctcaattttcagtctcgaatcggaatctcgatcaaaaattgctgtttccgacctcctaaagattaccgtaacacggcacgcgtatatacagtataaccccgtggtgttgtgacttttgggtttgggaaattagacattttttcaccatttcccccattttgttgcccattttcagtgatccgaacgtgcggcaacgaagcgcttggctgccaacgcaatttggaccggtgggctcacatctgctcgtgcgaagaacacttttgcaacactttcctcttccttcggttggacaaaaaaaaaatgccgtgcgtttttcgatgcccaaaaaaatcaaaaaacgcagggcgaacacaaacattgacattgggatgagaaagaacccacgagaatcactgaaaccaaatctaaacatcggcggccaaaaattggacagaataaactctcacagagtccccatcctttcggctttttgccctaattcgggcagagaatggacaaatttcaaaaaaccgtcaaatattcgcaaatgccaagaattgccacgtgggtttgccccgggggcattttgccactgtttccttggcattcccttttcgccgttgatgaactgaacagctccaacttcgcgtgtcattcccatttcccataacagatggcgacgaacggaccatcaagaactccaacatgctcacgcttctgctcgtcattgtgccgttgtccgtcggtgcggcggccgtcgtcgtcgtggcgattaattactattgccacctgtgctgacactggttgaagaaggcacaacgccacactcagcattcaaatgatcacttatttatttgcctatgaaaaatttgtgtgccttccctaattactaa

SEQ ID NO: 24587 - DNA, 1706 bp, Heterodera glycines
  misc_feature (1626)..(1626): n is a, c, g, or t
ataatttgggtttggctaatgagtatattggtaaactgagtcgagacaatgcaatccgtaaggaagcggaaatgcaggaattaatgcaggagttacaaattaatgagaaacaaaaggcagctgacgttctcattccaattttgagggacaaaattgaggcattagaagagaagttagacataactcacaacacggatggtgacactacctccggcattggacccctctcaaggagcgtgccaatgcgtaaaaatttgccaaaaactgagcttaagagatttgatggtagtccatctcagtggataccattttgggattactttcgtacaataattcatgaggactctcatgtcccaaaaattgataagttcagttatttagactcatgcattgaaggcaaagccagtgcaatcattcagggtattccaattagtgagagtgggtatgatgatgccatagatttacttttaaaaacctacggggaaaccaaacgtctaattcgaacgttgaaccgggaacttatgtcgcttccaattagtgagtcatttgaagacgacgagtccttgtacttgaagtctgaaaagatttttcgacaactgatttcaatgaatcagaatgtcgaagatggtatgtattacagtaacctggagggcaaaatgtctccagaggtgttagataagtactgtgttatcaaggatgccgaagataatgatgattgggatacgtcaaagtttcggaatgcattctcacgtgcattggaccaaataaagcataggcaggaattaaggaaaaatgtgattgagcccaaaagggacaaacatgaactgaccatgtctttcacggcattttccaagaatgataagtaccaagggaggaataaatttcctcaaaggaattcggatcaatcgccccctcgtgggcggaaatttgaaccaaggaaatttcgtgatcagaggcacgataatagtgactcatcagtcagccattcaccaatgagggataggaggaattctccttatcccaaaagggattggtcaagttcaccagagcgtgaaaaatggaagaaggatgagcagagaaaatgccaattgtgccaaggtgagcacagtgcgagtaaatgccataaatatatggatgccctctcacggcgcaacaaagtattaaaaatggaattatgttttatttgtctaaggactggtcattgggcaagtcaatgtacgttaaagggatataagtgcaacatttgcaatcgggcgggtcatcacatctcattgtgtagatccaaagacatacccaaggataggaggaatagtagttcagaaaattcaccagttcggtcgaagataaatacgactcaagacttctcagagtctgaagaagttgaaaaggaaataacatcggtcacttcgtgtgttacaagtaaaacaacgaaattgtctttgctgaaatgtaaatatgttaccatttataatccagaaaatccaaggcaaaggaaaaggattttggttttcatggacgatggaagtcaaaagacatacatttcgactaaattggctcaaattttgggtttgaagccaattggtaatcaaaggtttgaactctcaggtttatcgaatgtcgaattgngtaattcgaatctccatttatgagtttggcctcaaaagggcaactttgacattctgatgaaatgtcgagcccttgataaa

SEQ ID NO: 24588 - DNA, 2018 bp, Heterodera glycines
  misc_feature (926)..(926): n is a, c, g, or t
tcccgaatgctgtttgccatttgttttttaaattcaactttcttgaaaaattttatgatatactggggtcgcaaatcaatgtttattccgttattgagattttttgaattctgttcgttgaattgttattcttgtattttaatttttaaagttttcaaatgcgattaagttgcgcgaggtcagctataaccatttccacctcacgtacatttgtgttgaaccagctatttccaccaactcttgttgacacgattggttctgtcgtgaggagcaccttgtcaatccctgctgagcttcaaggtaattaagcagcgactgaaattcatttcggtagaaaagacaatgagaagaaatatgtaaaatgtatggctttggattttgatgctaaattaagttttcatttgaactgtctattgcctaaaaagcgtgccaaaattcgaactaaaccgtttttttaacctgagctgaatctgttttaacaagttatcaatgatattttgctttggtttacggcttgttggtctgtgttcaattgagaccactgaatcgaagtcgaaatttttatttgtttggtttttagctattgttcaaaaaattacgctttgctatacattctttaaatttaaaattagagattggaccgggccggccctgtatcggcaatttgaaaatccgggttgattgttttttgagaggctgtgcccggaaaccgttcgttttcaaaaatgtcagcccggcccggcagatttgaaagtccggtctctatttaaaatcaatttacccaaacaaatggctgtgatgctcagttttgtaatttttcagattccgatatggtggaggaacaacagccaataatttcgccggcacattgtggtagtggtgccgaagaattttcgccagacgcgcagtgcgcacagcaatggaanaagcccaatgagtcgctgtttgtggtccaacaattggcccgccaagggcttggcccgcgtcaaattttggcaacgctttatcctcgctattgttccaccatttcggacgacatccccgatgagtggataatgcagttactccgtgaactgtgcgagcaccggacacgccaaaaattgtccaattacaacacatttgaggacgcagtggagttattcaggttttacataaaaatttttttggcaaataaaatatctatgatttttggaattttaaaaatttcgaaggagggcgggtagcaaaacaagggagtaccctgcattttccaataaaatattgcccgtcccataattttttctccaaggaagagcaagcgcattttggtgatcaccggtgccggtgtgtccgtcagctgtggcattcccgactttcgctccgagaatggggtttatgcacggctcaaaaaggactttcccgagttgccaacccccacggcgatgttcgacattgacttctttcggcagaatccgaggcccttctacaactttgccagggcatgtgtctaatttttggggttttgtgtcgcttatttgttagttagttggcccgttttttcttttaatttgaaattgcgcaccctccttccccttccgaaaaattagaaaacaacccattttttccaggaaattttccccggccaatttcgaccctctctgtcgcacatgttcatcaagtttttggacgatgaaaagaaactgttgcgcaactatacacaaaacattgacacattggaacgcattgcgggaatttcaaatttggtggaatgtcatggtaaaaaataacatgaaattctcaaagattttgattttttatggcaaatttaaattattggcgtgttgggctgtcattcattgaaatcaatttcaggctcatttgcgcgtgcaacatgtttggactgcaaacaccaagtggatgctgaagagattcgtggcgatgtctttgcccaggtatcacaattcgccagcgacaattatatggatttgggattttcgagagctttggaagataaaaaccactaactatccgaaagtcct

SEQ ID NO: 24589 - DNA, 2504 bp, Heterodera glycines
ttttgtaaaatacacctcttaattcgggatttcaaaaacaaaaaatacacccctaaaaatcgaattttcgacttcagccccccccccccccgaaggcaagggcctgactacgctcttgggtcattagaccgaccatgatcggatgccccgaacccagacaagacatttagacaattaaaacatctttcaaacaatcccaccgccatttgtacagttcgtccttcaggcaaatgggccgggtcgatggtaatcaccacagcaaatgtcttcgactcgacatgtgtctcctcatcggtactcaaatgcatgtatctgttgtaatgccctgaaagctcggataagaacaagcccgaatatgagtgccaacgcgggatcagtggaaacatctgaaatcatggaatattatagcattagcgaaaagcagttttgtgcacataattcggtgtagggaaaatctgccggcattttgaacttgaaaacttttcccaaaacttaattaatggcatttgtaaccttaaatccggtcaaatttttgtggaagaaggtgttgtccagggcctgtaattaaattagaattaattagcataatctttgtatttcataaatgagaaatgtaagtgagtgaaagtgaaaaggatgagagatgacaaacgcgaaatgaaagaaaaattaattacttaatatcataaaaaattgaaaattagtttatttttcagtgttttagcttattccaaaatttcattgcttttcaaaatggttattttggttggaaaagcatttatttgcccgaggcaaacaccgcaaacgcccccaaccgtcgttcgtgccattacaataccataattggcaaaggctttcgccaattttgtgtctttttactgtccgcaataatacggtaaacaagtgaagaagtgagcagcagttgccgtccgggccatttggtactcggcacacacaaaaccaactcaaaaatcagttcgtttggaagcagtcgccgatttcgatgtccattttcgtcgtctgccgttgttccgttctgttttggcgatttgtccattttgttctttgtgtttgttggcatgggaatgagtgaaggtggcagatgttgaacgatggcactttctgttggcacttcggtcttggcacggcaccgtctcggtttcagcgaacaaaacccagcgacaatggcatttgttgaccaaagatgttggacgatggcactttctgttggaacttcggtcttggcacggcaccgtctcggtttcagcgaacaaagtccagcgtcaatggcatttgttgaccagcgaaggttgtcgtcattccgcgcactgataaacgaagcaaattaaacattggtgatcaaattgacaagtgcccatttctattgatcaaagaacagtaaattgattgatcatccatcgtccaagagagaggcgtggcaaaaggtgtgccgccttcgcctttgttcttgcgcagcgactgtcgactgctttcgatggcgtcaattttgcgaaacaaatttttaaaaaatcgcgagaaaaattgagttaatagctgctcgagaccgaaaattcccgagactctcgagcagcactaccgactttgtattcggggtaaccaatttttgaaatgcccgttcggtttttgggtcgaacaaaagatatgcctttagtcggctgattgtcccatgtcaacagcaaaatgccacaatttaacaaaaatcaggacataattaaagcaggaaactgtaaaacaaaaatagaaaattttcacttacttttatgtcggcagagttcgaatgggcaaagttagtgaaatcgaattggtataaattaattgaaattgtattaatctgaaaaattttaaaaaaattttgttgctgattccccacaatcatttagtctcggaaatatcaatttgataggtcaagagtgggatgggatgggctgtaaaaccaaaaaacaaaagatttatagcggcgaatttttgaggataacagagattagcattttgagaaatagaaattttttggtggaaatgaggccaagcaagagcaaagagaatggcttagcaattatgcttaattagagcaattatggctaattagccattttgtgatttgaaacaaaatcattgaaataaatgggaaaaaggaggataggctgatgagatagccacggacaacaaaaaaccatagaaatggataaattcaaatggaaatggatgaaatgatgatggagttgagaatgtacaaatggatccccatccttgtacaaaaaagaaaggagtgcctgtcgaagaacacaaaaattgtcaattttgaaaaaacggcaaaccgacaaatcacacaatcattatgtatcctttctttgtctttgtgtaaaatttgtgagaaaattgccttgctaatcattataccattattgagcatgagaaaattgcctgtggttcatcagctttttgttggcatttgattggtgccactccttttttttagtagtaaa

SEQ ID NO: 24590 - DNA, 1252 bp, Heterodera glycines
tcatttttaaatctgaatagtcagtaaaacccgtaccggtcggaaaaatacggttactacgggtcgctaaacctgtgtacgggtccgcccgtattcgacctcgtttttaatagccgttcactttggtcagattactgtatttttttaatctttttaatttcctgatgtttttatagaaaaaacaactatttgtaagaaggttggaaaacaaagaaaaagtaaattgcttttttctgttttttatcgttttcggagggaggaggaattagaaaccatgacgaaggaaaaattctcagggagaatgcaaaaacaaattaagaatcgggggtagagtaccaattctcattgtcaaataacaaagattgggccaggaaccaaagcagaaagggaagaaaaatttaccggaaattccttgttgcccgaggacagcacacagtcggcgaagaagcccttctcgaacagaatgcccatgtcgtccgagaggcgacagggcggcacccgaaattgcatcatgttggactggccggtgacattcacctagaagggggaaaattggccaccgaatggaacattggggacggaaaatgaattcaatccggaaatgccgagaattcagtaggagccgcccaaaaaatgtggcacttacagtgtccgcgacgacggacacttcgcaaaagatggacagccggtcgtccggcagcagtccgttctgttcgtccagcaaaaagtcgcggcggatgaacttcttgaagccccagtctttgccctgcacaaatcggtaggcgcgctgcgactctgaaattttttgaaaaatttaatgatttatttttttatttgaaaatttgggtgactgaagtcttggagggggtacaccgacaaggaaactcgcaaattcaacataaaaactataaaatactatttttccttaaaatttcgagtgtggggtatcttagggggccaatgggaccgtcgctgatttattttatcgcgtaataaatgcccaatttaacttatttttagttggaaattaaatttttttaaaatatggcaatttctgtgccgtcccaattccctccgcccgtcactcacccatcgctttggtctcctcccgtttggcgttcagaatggagaatttgaatttggcgcgcacctccgtcttgttgcattggacgagcagcacatacagggacaagtagtccttggattcttcgtcgaggcctttcggatcgatgcgcaggcaccacttcagctt

SEQ ID NO: 24591 - DNA, 3027 bp, Heterodera glycines
tgccttatttaattccaactttcaccaaatattaacttctctaaggtccacaaaaggggaatgcgaatggttttttcgtgtttaagaattaagcaaaggaagaaggatcaaaagtaaaagattttttataattttaatttaataatttattggatattttgaaaatgtgttcttataaaaatcccgccatcattttaccaattccaagcgatgtttggcatacgagaagaatgacaaaaaacattatcttaaactgaattttataatttatttcaatgtaattaaaaaataattgaatattttttcacattcttactgattttcgtttatttatctgggaatttattctcatcaaatttcgtaatgatttcctggaaacaattgaaattaaaataattgactgtattttcaaaaacaaatttttaaacagactaaattgcttttttcgttaatgagcctaccatttacgttaaggaaaatggtttaaggcatctcgaattttttatttcaaaaattcaaattgtttgtccgttatttataaaaataaaataaaaaatgacacagaagatattcttaattttaaaattttatgcctatttcaggaattcttgatgatcatttgggtgcttaattatccgcttcctatttataatccaggaaaaagctatttacaaaaaatgtttatttatttttttatcaattattcctaatttttgaagcgttttgttattcgtgataaaccaattccttcctttaaccataggcaacacattcgataaatgtcttgcgatttcattacttcctttacataactatggaaacgaaaaagcaattaaagaaaggcatttttttattaatcatataaaatattaatcaccgcttttcgaaaacattttacgtgaaaaatgaaacattttttggcgctaaagaaaaacgaaaaaaaagaaagtgattaaccgaatcggtgcgatgggccattgttatttgttgtatttttgttgttgttgttgttgtaattttggccatttttaattacaaaaccagagacccagcagaaaagataaaaatcatttttttatacatattaactacttattatataagataaaaactattgaacagcatttaagcttgacaaaatgttctttgaattttcatcatttttcgtattttttcaattatccatcacatttctttaaataattatttaaacatttttgtttcgattttatgtatttacaatttgctttttctacaggaaatttttatgatggtttcatatagagactttttgtgcctttttcagtgccattttgcgctttttggtgccttaattgtgagctcaagccataactttagggccggcggtgctgataagagccgccgggaaattttgtaattttaatgctatttgttagcagattttgtctaaaaataccaaattttgaaattttgggctaattttttaagaaaagatagctttttggggggtcggcggtgccgataggcgcagccggaggaaaattttaagaatttttaatcaattttgttaaaaaaatggccaactgatttgtcaaaaaagtcggtcgattgtttcggttttttaattatttcggtcgaacggtttcggttaaaaaaccgaaaaaaccgaaaccgaaaaaaaccgaaaaactcaaaaatttctcggtcggtttttttcggttaaaaaccgaaaccgaaaatcgactttcttatgcaattgctttttagcagttttattctaaaagattttctctgcaattttattttttacaatttatttatgtttgcccgtatttacctcttttttcattaatgtaatgtattattcaattttataaaaacatattttgccaaatatttggcataaataatcgttaataaaaaaaatatgtttacgtttttacaatattgaatgcgtggcatttgtcggtctgatgtaagcaaatgcaatggcataatttgcagcatatttaagtcaaaaataaagatttaatttttaataattttacaaaaaaagaatattttttaataaaaaccattaagcaactaacataatggcctttctgctgaagtttgttctgctcctctcaataatggcaattttctgcgactgtatggaccccggcaaaaatgggaaaaccaaaaaaaaaggtacagaaattagctggagaaaaagaataaattcaaaataaaataaaaagaaatttagaaaaataattttttttcttttgaaattttagacgttgtaaaacaaaaagttgacgaaacgaaagttgagcgtaaggaagaggaggggaaaggtgaaaaaattaatttaaaaaataaatattttaggcgccagtgaaatgaacaaaggcaaaagcatcgttatggctgactccaaaaaggaaggtgaaaatattgttaattaattattaaaattatatttttaactgaaggcacaacgacagtgaaaattccgcaccgttatggagcagtgtcggggatgagtggccaaaatgccagtccaaaagcctctcaaattggcagtccaaaaaacagtccaaagggcactcaaattggcagtccaagatccattagcagtcctaaatcaacacaaattggaagcccaaaaggcattcaaattggcagtccacgaaaggaaaagaccaaattatcttcagctgttggctcttctgatttcaatgttatcgacgaatgtaggaagtcataaagaagcaattagaagacacatatataatttatttaatttagcaaaagaagcgaaaaaaccaagccaattcaaaccgagtccgtccagaagccaaaataaacgcgaacagcagcgactcaatgttactattggagaagcgggaagaggtaattaatgaaataaatattaattgtttctttgttatggcctaacgacatatttgggaacgtttatttaaaaaagtaaaaaactcaaagttcactgctaatgccaatctcagacgctatgtttattatgattgattagggctggta

SEQ ID NO: 24592 - DNA, 2265 bp, Heterodera glycines
atgctacagtcaatacagccgcaatacgcgcccttgcgcatcatgacgcgatttgcgcaacatcagcagacgcgacgggacagtgatggattgtgatgtgattttatggttctattttccaatcaaatttttatgagtccaatcaaattattttttcaaatgcgtaaaagctgttatttagtatatgctggttcttttcattaagtgctttaaaatgatagcaaaaatgtatggttttcttcaggttaaatttgttctaaaatattcataataagtagttaaaaacttatatgaattgtctctttttattcttcttaaattgtcatgcctccgagcggactcgaaattttgggtttatatattttttgtttcgactaacttccggtggggtgcttggtacagtggaatcatgcgctagcgtccgatctggcaagttaggcaacgctgagcttaacttggcctaaaggtcgggtgccgtgatgaagccaaagccagcactgcttaccccgcggtacccggcacggacccccggaggtttggatttaattaaattctctccctccggggttttttcttattaggttaaccgttagctctcgattggtctatttatgattttttgggttttttggctttgaaaatgtttttatagctcacaacaaactaggaatggaatggaaatgatttggaaatgctgtacaattgaaaagtacatacaggacagagattggccgggcaaaatggatagttgcggtactccttttatgcctgaggtccaatcactgttttatattatttatttccttgctgaacattaccgaaaaaatcacattcctgttccatcattatgataaaccctaatttggtagatggggagctgctcggacaccccaccgtacttatggatttaagttaaattactttttcggcaaaaaatattacataattgatgaaaagaattcaggattggaaaatcatcaaactttatctttcaggcaaaaagttgaatttaatctcgcccaatttcatgtcccatttttatatattatgatttttctatgaaacggaaaatgcatgcgtcagtgatacaaatatttaaaataaagttctgtggcagtaaatatcgtagtaaaaaagtattctataggaaaatcgttccctgacccatacttcaatccttaaataagagatcacttacccatttttgaaacaaaaaagctaaattcgaaaatttgaactttcgaacccctcttttgcaagcactcatcttcgctacccaacagtcagcattcatcgtcgctattccacgttttgctcagcattcatcgtcgctattccactttttgctcagcattcatcgtcgctatcccactttttgctaagcacccatcgtcgctatcccacgttttgctcagcattcatcgtcgctatcccactttttgctcagcattcatcgtcgctatcccactttttgctcagcacccatcatcgctatcccactttttgctcagcacccatctgggtgaattgtgcaatggtttcgggtccgtgttgactcgagctgggggtcggtggcggtcgcgtgcgacacgtaccagcaaccagttcggtccagctcgggctctcagttgtgcgttctcggtgtaaaagccggtcatctgttcgacccgtcttgaaacacggaccaaggagtttagcgtatgcgcaagtcattgggtgttcaaaacccaaaggcgcaatgaaagtgaaggcttcttacggagctgatgtgtgatccctggcactgcggtgttggggcgcaacatagtcccgtctcgatcgcatgcgatggggcggagacagagcgtatgcgctgagacccgaaagatggtgaactattcctgagcaggatgaagccagaggaaactctggtggaagtccgaagcgattctgacgtgcaaatcgatcgtctgacttgggtataggggcgaaagactaatcgaaccatctagtagctggttccctccgaagtttcccccaggatagctggagctcgttaagcagttatactcggtaaagcgaatgattagaggacttggggacgaaatgtccttaacctattctcaaactctaaatgggtatgaagccagggttgcttgactctgaacccaggcgttgaatgtttgagctccaagtgggccatttttggtaagcagaactggcgatgtgggatgaaccaaacgtggagttaaggtgccaaagtgcccgctcattagaccccataaa

SEQ ID NO: 24593 - DNA, 1407 bp, Heterodera glycines
agaagagggcaaaaacggaagggaagaggagcaactggcgagagcaacggaataggaagagagcgcggtgaattctaagccaatgcaaaacttttgtctcaatgaatttttgatctcattttactcaataaaaactgtttttttaatataattaattttattttgttctcctcgttacattaattactttatttggattcggcatagtttcttttaattatgaaattccttaagataatggctgagagtatggaagaaatggacagatcgacagatgttgaccgagaaattgacaagggcgagtttcgccaagcgcaggtcaattaacctcatattaaaagtgtgtggaaagccaagtgagtttgtttgcagtttgccacattcaaacatgatttccttgagtcatttgacgagtcggggtatgccaagttggaacatttgacgctggataataacctgaagaaagaggtggtcaacatggcgagacgcttgcagaaggctcgcatttccttgaattcgtaattatacatttaatttaattttgaaattttagcttatctaaacaatcttaaggcaatatatttgaattgccaccaataaaattaacaattttcggtaatagtaaagctggtgcccccccccccccccttgtcagtttgccggacactgaggccattgcgccggtaattgcgaaaattgatgaaacgttcggccagctgatcgcactttccaaggagtccagcgaattttccgctcgaaacatcaaattaccggagtacagcagggcggacgtggaagcactgctcggcaaaatgggacctgagaaaagcaatcagatgaaggagaaggaaatgggaggagagaaccaaagcaacaaattgacaggttgggaacggacagcgaaaagggaatgattttgactacattttgccaaataatttccccaaatggtggccatgcaaccaactcttttaaaatattttttaggtttttaagacccttccacacgttgaacacatttattaaaaataaatgtcagatttttgcccataatcagcatctcaattttgccctagaaaagaaaaattcagggtttctccaagcccacacttacccaaatgtttgcacacctacccccccccccccccacctttttttctattttcatctttacgcccacttaattatatcatattaatccaaatttctgattcatctatttcataattctgtttattcgcctattatccctggaattttagcgcccaattgttcgttttcttcaggcgacgtaagggaacaaacggagggacccgtcgaatggttgtgccgctccaatgaagagtatgagaagcggatcgaagcattgcttgggggccgggggaactgatgcttaaacgaatggca

SEQ ID NO: 24594 - DNA, 1444 bp, Heterodera glycines
tttttttttttgaaaatttttcctttattttttccccattttttacgttgcaaaatcacagaaatgggtgggcaaaatgtgccggtccgtgacagaacggtgttctgaaggcattggcatcggcccgcctggcaaacagaattgcccagacaaatggttgccggtgtgcaggtttgggttggctaagataaattagaaatttaaaaaaataaataaataaaattacaaattttgaatttaagtaaattataaaatttttaattaaattaaaaataaaataaataatatattgaatatttaaaattttaatttatattatgaaaaaaatttaaacatagaaataaaaattgtatctttgttgattttcattaaagtattataatatttcgcatcttttttaaattataaaattgtaaatatttttaaaaattaaaaaacatttttagaataatttattattttattttatttgaaatttaattttaattttttatttatattaaattaaaaaaattaaatatccattcaattaaaaaaatatgtattcctgattttttctttttaccaattgtgtggcgattgttactgttgcgcattggccattcagcgacacttgctgatatgggcaagtgctgaaagaatttggcaaaatttcaaaaaaaaaaattggcattccgtttaaatgttttaatttgatgacatttcaaaaaaaaacgtgccaaaatccgttagtgcacacggaattgccagtacatttggtcaaacttgcgatgcacggctcacccggcgaagctgacaaaattggatttaaactatttaaaattaaaataaattaaataaaatattatttaaaagtgaaaaatgtgccaaaaaagcaacaaaaaaaattataaaaaaaagtcgaaaagtcgaaaattcaaaaaataggaaattctataatttttacgaattattaaaataaattttctgagaaaatcttttttcatttgtcaaacgagaaattcaaaagcgggttttcgaggctttattaaaatgaggaattttaggtaccatgcaaaaaaattttttactgataaatgcaaaagtttaatcggtcttatgatcagtgataacttttaatggaaatatgtatgaagtgatcaatgaatgaataaaaaaattgataaaaaaagaggaaatgcaaaaaaaaaaaattttttttaaattgtaggcctgaaattctgtgctatgttaattttcggtgcaccccaaaactcagccgagacataattcagccgtgaataaatttttaaaaaattttcaaacttaaatttttcaagaaaaaaatcttagaaaaatttttcttagaaaattctatgagaaaaaatttttttaaagaattttcagcgatttttttgaaaattttttgaaatttcttagaaatagtccataaattttgaaaaaa

SEQ ID NO: 24595 - DNA, 1254 bp, Heterodera glycines
aaattatttgagctgtttcttaaggatgattgataatttataaaatacataaatggattaattaatatattttattaaatggtaacatttttttatgctctgtccaccctttgccgtaaacaatggcaattggcgcgccgttcggatgttttatttggcttaaagcgtcgaaagctctcttagcaaaatgcattgaatgctccaaatcttcaaaatgttattcattaaggaatcaatcagaaagaatgccgaattgaataccaatttgattttgttcactttcctcaaaggcaattaaaagtgccgaaattgcatgaaaattgcaagttccgtcttcaaacctaaacattcatttttgttcaagagttttgggttaatgagtcaaaaagtagcctttcttcgatgggttcgcggaattcgactttggacgaagtcagagaaacgaatttgacagttccgccgccaaaataaccgtttttttgaagaaaatgggcggaagaacggcggacaatgagagcaccaatgccaaaaatgggaagaaattggcaaaattaacaaaatgccaaaagagcaaataaataaacaaataaacggaactaccggagggataaccgaacattttgtagaaggaaatgacggcaaagtcgcaaaaggataggccaatgtcggacgaatgcggggccaaagcggcggagtccaaacagacgaacaatgggagcccaaaactgagcaaaaagcgaattcattttccaacaattcttattttaggaaagttgcaaaattttgcataatttatttaattttaattatttaattcatttttaattttatattttttgtttaatgttttataaatgcttattggcctctgtttcggccaaaaattgtcttaactcttcgtaagtgaccacaacaattcgttcgaagctttcagcacttcgcattccgacgacggaagtgtgggaatcgcgcagcatcagaagggtgctcaaaggagcaactgaaaggggggggggggcaatttgagagaaatgggaaaaccagaaaaagaaagtgccaaagcgaaactgactgaaaaagccaattaattaaacggaaagaactaattaccatccgacagacaattcacatcacttgaaaagtgttttttcgtcgtgcgacttttgcgagtttcgtctccaaagttttcgacgagcagtttcaaagcgtttgttgcatttgaagtgaaatcacagcgaattcttccaaattatt

SEQ ID NO: 24596 - DNA, 1480 bp, Heterodera glycines
ccggagagcattcgacagttttgtcaggcgcactttttgctgaaggccaaaatgagtccccgacggactgtttttgtttgcaaatttaataggtgaacaatggaaattggaccataaattgggcaatttaaaatattgtattttgtttgatcgatctttagccttaagtaaagcgacactttcaggggctttttgtcgctgatcaaaaaacggccaattccggacccgaattctaacaaaaaatcgaaattggcaatctttcggttcattggtcccgaattttttttttaaataaaaattttggaaacacatttctaaagcaaatttgagccgctgagtacgaatctgaccaccttttcgaccaacttcaaatcccggacccgaattcgaacattttttaaaatttcaatttcatcaaatacgcctaattaaaaaaaaaattcgggacaaatgaatcgaaagattgcctcgaaattctatttgatttcgaccttttattttaatccgtgcatttgttcaaaatttagcagaatgaattccataggcgtggtcagcgaacacggaaactcgcgggaaaacacgtcattcaaattagacaatttttggccaaaagggagggagggccgtgagaattttattttcaggggtccggcggtgccgattggcgccatcgggataaattttttaatgattttttaaaagaaaatgtatttggaatttcactaactttctcccctttcatcccttagccggcgacccgccccccgcccacctctttcacaccggcccccctcactgcgaagggatcccccattttgggggcctttgcgggcgaaagagggtgggagggtcggggctacccgactttttgggacaaaatgacattttgatgattttaaaaataaaattttattaataaaacaaaaaaaaagaatgctactttctatctgttgagtccggaaacagagttaattttaaatatttttatttttcacaaatggaaattaactttggtaactttgggctgaatacttaattattaattatgtataatatttttatccattaaaatcctcaaatgtcggattccctaagtgtcgagtccccaaattgcaaaccaaaaagtcgcgccacgatgggtcaatctccccttattttttgcttgtcgaaatcctttgcttatttttgaaaaattagtccaatcccgtcgtggtaaattttattgtttttagcgagaattagtttttcagtttttcgccaattgccaattttgttgaatcttttgttcctgcacagacgcagttccattcgtgccattgtccggtgcccttatcgtgccgtgtttgtggcggaacgatgcgcgatgttcgctcttcagtcgcacaaccatccgccgccggatgaggagggcaacgacaccgcggcaaatgaagccgctggctgtttcctgccatgccgaccgcagcagcagctacaacag

SEQ ID NO: 24597 - DNA, 1934 bp, Heterodera glycines
aaaaaaattcaattgcagatggacaattcattcaaaaaaacaattctgattcaataagtgccgccgtaaaaaaattgccaggataaagggtggatttggatgcttacaactttctaatcgccggaatttatgcccaaaaaagcttcaaatgcggaaccaccactgctatggggccttaaatccgttaaaaaatcatgcccattcatttgcacgcttaactatgacaaatcaatattgataataataaaatgacaatattaatatgaattgaaggttttttggtcgatcgtgcggctgatgagagaaaggaaaaaacatcgattgaaaaataattactacaattatttaattgattgaaaacgatcatcaaaagtgttgtttgtgcgctctctctctcatttatttgccctttgccacgggcgtcgcagcggacgaaatgggcgacgatttttgcggagagccgacgaccgaactgggcccggaagagccgggcgacgaggagggcgaagtgccaaacgcagcgaccaccgaactgcgcgggctctgtcggattgggctgtacacctgagcaaaatggggggggggaggtgtccatttaaaaaaatattaattccaataaatttgtaaatttaaattaaattttttaagttttcttgttgaagaaaacgatctgttccattttgggttcattcttttgcgcaaaaaatttaaaatacaatttaacggtattgaataatgaatgaaacgtaaaacattaaatttcttgttttagaaaactgattgagaaaatgaggcacagttgtaccggtataaaaaaggtacgatttcccctctagaaaataatttttagtaaagacatgaaccaaatatatatatcctataacaatacccacttttgccaagctgtccgccccggaagagccgatcagttgccgtgagggatggaaagcgacggccatcactccggcaccaaatttcttacgatgggcagcaatttcctggaatttaaggccacacgttgaaaaagagtgtcaaagaaaaaatagtgataagaaagagatggtgacagaaaagaaaaagtaaaaaagaacagagacggagaaaaagataatgaaggggaaagacgaaagaaaaagagacaggaagaaaggaaaggaaaagaaaaacagaaaagaagataatgcaggggcgagaacgacaggggaaaagacggaagaaaagtgtgcacatatttcagcgccgccctctcaccacctgcagacagacgcgcttctccgcgttccaaagtcgcattgagccgtcatgggaaccgctgagcatgtacagtccgttggggtcgatggccagcgtggacacgccctccacgtgtgccatgggcgcactgatcagtttgcctgaaggcgaaaaaatgccattggacaaattgactgtttataccaacattaaaagtcattggaccggagtaaatgaagaaaggctttttagatccaaaagaattggttttaatcgcacaaaacgattaaaaaaaaaagtaaattaggggtggggtaaagactgacttatttgaccattagttttgtctattttttaagcgattttgctatacaaatagtcttcccagcttctcacccgtgttgttgtcgaagaaacggattttgcggtcctcgcccgcggcgatgctcaccggcattgtcggatgggaaaggattttgttcaaggcgctcggctgatcatcacctaattacaaatttttttaaatgtgcagaaaattttttataaaaaattctataaaatttcaagaaaaaaatttcttgaaattttcttatagattttttctaaaattttttgcaaaataatctaggttagaagtttaaattttccggggggggggggggtgaattgatccctttgggctatcccttcagatatatttc

SEQ ID NO: 24598 - DNA, 975 bp, Heterodera glycines
aatcccggtaaaataaagacaaaaataaagttacggatgcattaattagacattttaaagcgccttaaaaataaaggaaaatttagtgaaccccacggggtctaaaaaaaaaaaaatgttattcttctcactaaaaaaaaaaatcaaaatctgttcaattttaattcgaattctgattgccctgaggggctcaattaatcgaaagaaaataataataataatatataaaaataaaaaaaagaaagaaaaagaaagaaaagagatttaatttaaaaataattatttaaaaacaaacaaaaataaaacacttaaaatacttaaatcgaaaaagggagagaggcagtgaaaatgcaattcacgtgcacggcagcgcagcactaactgtacagtgacaaagagatgcccatctcttcgccctttctcaccccgttgggccatctcttccgtcgcttcgttttcccccccccccccgtcccatctcacatcgcttctcccgttccatcgcttcatccctccttgccccgtcccatcatctgcagcagattatgcatttaatggccaaagtgtccattccgcaacaaagtgtaagggatgggaatggacacaatggcgacacccgattggctgccgttaaaccccttgtgtactacagtggcttggcttctcccgcccatccactgacgtcccctccccaagccattcccagcttcatttgtatttcattttcatcattctgctccgaagtcagcagccggcgccttaatgcctatcaaatccctcccccaaattcaactctttcccacatttgatcagttcttttctttattttatttccctagttgatcaaattattccccatttttgatcgtccccaattctctctgtgccacctctacttgacctcatttactcattttttttttctcgtctggtcaattcttgccattttcattttctaattataatttttttttt

SEQ ID NO: 24599 - DNA, 1235 bp, Heterodera glycines
  misc_feature (17)..(17): n is a, c, g, or t
  misc_feature (84)..(84): n is a, c, g, or t
aaaaattaattttcaantatatcattttctaggggtgggaatttcgcatttcgcgccaaaaagcgaaatgcgaaacgccaaaanaatgcgaaaggcgaaatgcgaaacctcggcccatccctgatgtgcaccccctttggtcccgaatcccaaaatcacttttatttttgtaactattcgtaagaaactgataaaaaagtcaattaaaatgtatataatagagcaaaaaattgcgtatttttgtagtattttacttttccagaatgacttttcagaactgaggtataaattttttttctgaaaatttgaatttttccagacattctggaataactttttactttttagagaaagaaatcccaaataaatcccataaaattctcctgattttttgctatttttaaagctttaattcacttaaatttaccaaaactgaagttagttatgaattttccaatattagcccaaatttccaagggccaaaaaattgccaaaaaataaagaatttttaaaaaattctaaaatttccgaaacttaaaataaacatcatattcgtattcagcacctcaaaatagcccagaaaaatatttttgactcccattttcgtccgaaaaaaattccggaaatttctaggaggcctagctcgaaaatttttgaaatttgctcgacctatactacaccattcgatagcttttcaaaggctctacaattttgctctaagacactttttggctaaaactgctagtcaatataacatatatagtaattccttggaaaatttcatatcaaaagaaaagagagtaattaatgtattgatgatgaagaaaaaataattttttgtcaatttcctggttggctttttaaaaagcagaaaatttttatattatttggaatatttttgttaatttaggacattttagaattcttagataaataacgaacaatataacaattaaatatataaaaaaaaaattttatcacaaggtccgaaatgcaattaattacaaacattttttccaaggaatggtcaaatttaaggctaaatttgatcagcttaattaaagcttttattcttcaccttaccaatctgtttagcatagaaccaaaattgcttagtttttaaacgtagtgagcagcagaagtgacaaaagtatcaattttgtagtaatttaaaaataaaaaataattattattttaattttatttgctaaataataaatcataacttagcttaa

SEQ ID NO: 24600 - DNA, 1567 bp, Heterodera glycines
  misc_feature (1503)..(1503): n is a, c, g, or t
  misc_feature (1557)..(1557): n is a, c, g, or t
aaatcactatctctttttttggaattattttacgtgtcaaagggtgtgcatttaagcgactcgctgtgcttgcccaatgcatttcaaatagctggtaatttttatttctccggcataatccagaaaaaatcactatctctttttttggaatattttacgtgtcaaagggtgtgcatttaagcgactcgctgtgcttgcccactgcatttcaaatagctggtaatttttatttgtccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccggagatatgagggggagggtgtacggacatttcgcctactcgacatctcgcctaccgacatctcgcctactgacatttcgcctactaacccaaaaacattcatttcgcctaccaagccaaaaacattcatttcgcctactaagccaaaaacattcattttacctactaattagtaggcgaaatgaatgtttttgggttagtaggcgaaatgtcgagtaggcgaaatgtccgattttgggttagtaggcgaaatgaatgtttttgggttagtaggcgaaatgtcagtaggcgagatgtcgagtaggcgaaatgtccgtacagccctttaaatttattttttgggatttcaaaaaattgctgatcattaaaatcacagcacctgctgctattgttgttgttgttttgtttctgatgacagagccatcgttgagaagcaatgagacgatgatgagaagaagaaaaagcaacagagaattatttttgttggaagccatggcaaaaaaaggagaaggaaattggaattctgtcgaatttgaaaaaaatgattagaaaaaaaggaatgacgaaaagttgagaaaacaactcaattaaataggaaatgaattgtcaatgtggtggaaaaatgaaaagagtacgaccaaaactctcttatcaatccgaatgaaaagaaagcaaattttattggacagcgaaaatcccaaaatttgtaaccaatttgaagagagagttcagcttctgatccaacgccctaaagcaattttaaatttaagaattcaataaaagtatcaaatataaatatgtagcataatgataggcgcgacatatattttttcgttcagttaatcaaattcattcccttctgtctattttcgatcttttgtccttttttataaccctcattcacattttttcggcaattcctctcncatccacaacttttcactccccgagggtcggggaggagccctttgtctttattntgttcattaa

SEQ ID NO: 24601 - DNA, 2344 bp, Heterodera glycines
  misc_feature (565)..(565): n is a, c, g, or t
aacaaatcagcgagaaaattctgtgtgaaaagtcaagagcactgacagttagagaaggacaagaaaaaagtgatcagagtcttactctgtgaaaaattcggcgatacattgaaaggaaagttggcgatctaagaaataaagtgataggaaatgttttaagaatgttcagagtcataaatggtaagtagtaattcgtattagtcatcaaatttaggaggaaattagtgatcagatcgctgtggttgatcagaaaattagcgaaaagtgatcagaattgatcggagagattggtcagagtcaagcaaaaccgaatatttggaaagtgatcagaaagggatgaattggcacagcactcagagttggtccggtaatcccaaaaacgatacagtatgatcaaaagcaccaaccaaaaattggctccaccaccgccgggtatttccggtaattttccttcacggtctgcaccagtcgggaggtattcctctccaccctggagttgatcagcaccaccttcagcagatcaggcgagctgaaatggccgccctcagattggtactgatcaggncggcactcccccggagccccttcctgccccgccccctcacttttgcaggttttcaatgcgttttccgggcgtgtaactggcaattccgcctgaacagaccaacaattaatcatttatttggctgaaactgattcttaattaaatttcgacagtttttggtcggctaatgcctccccaaaagcctttctcttcgctttccccgcgcccccaaaaaaaactgaccataagtgcaaatggccgcgtccaggccagaggcgcggccgtggatcagcgactcggctgcggaagaccacttgcggatgatgtccagcactgactcgtcccaagtgagttcgtccgattcggcggacaccgaaggcggggggattaggccggccgtctgaaggagggcggccgcaatgcaaacgcaataagcacctgaggagggaagggattggcattttgggtggaacacaaatttggacggatatttttggctaaaatatttgcccgaatctattgagagaaaaaatcaggcaccaagactaagttcgaggccgggaattgaattttggtcaaagtgccttcaccccaattttgtcggatgggcaaaaacggcactgaccggaagagccgagtccgacgcaggaaggcaatttgaagcgaacagtgactttgacagctaacagatccctgcaaaaaaaaagaaatttgaattttgaaagataatgcttttgggacaattggacagaatatcacagaaaagtcagacagagagagacactactgctgttagggatagacagacagacagacagacagacataaaattctaatcaattaataagattttatgactgtgcaactgcactttgctaagtagggctgatcgagagccggaattttcagagagagggcgagcaggaattggtgaccgagactctcgagcagcacaaatattaacgactaagaacttagagaaacaacagcaggcaaacaaaaaatacaactgatctaataaagcaaataaacattaaagacaccgtaacccgaacagagtaagacagtaattcgtctataaactggttagactgtactctagcccggtccaggccaaggacccttggctgattaagaagtggacctatcgggactgaatgaatcgaaaaacatgattagatatccgtgagaagatgaacagcacagtatgcattagtactgtaacactgaggccacaaatgaagcaggacacggaccaattgagaagagaaaaaatgacgaacaaaaatcagaaaaaaacaatcaaaaggccaaaagtacggcgctgaaatggccattctcagtcagactgaattgggccgcgcccaaaaatcgcaccgcaaaaaacacgtaccaaacggacaacacgctgttgctaacagactttcgcttagagtccagcagtggacaggggccaatgattgtcgccggtgttggtggagcagtaccagcaacaccaccactggcccaattcgaggattgcagctgcgacggtcgtgggtgggagaacgcggacggcgacgggggcggcgacgcgttgtcgcgcggcgttgcactgccacggtcatcatggcacggctgctgttgctggtccgtcgtctccagcaagtccaacgcgctaaaagtcaatcactaaacgccacaacgaatacgccacgggagcaccacccaacgagaagactttggacacgccacaaaagacaaagggttgggggagcacacatttaaaacaatttgggcgacatgccccccagggaaaaa

SEQ ID NO: 24602 - DNA, 1550 bp, Heterodera glycines
acgtcgacaaccggtacaacttctaaggctccaacttcgacaataagtacaacttctacggctccaacgtcgacaacaggtacaacttctaaggctccaacttcgacaataagtacaacttctacggctccaacgtcgacaacaggtacaacttctacggccccaacttcgacaacaagttcaacgactaaaacttctactgttccaacatcgaaatcaaccagggcaacttcagcttctatggacacaacttctagatcaagaaaaacttcaacttctacagttccaacctcgacaaaaactatccaaaatcccaaccttgtacaaagaacccattcttgtcgggatggttggtgtgaaacaatgggatatggagcaacgattggcagtaaattaaattaactaattacaccttggtttatcccttaattaagttactcgttctgatggaacttgtggaggcgacactgttgcgttaaagggttgttgttgctctcttcctactactactacacttgcaacaagcagaagtccgacaacagcttcaacgtacattccctggctttatgtaaatggtcaacgagtgatcagtttgtttgaataatttaaatttcaaaattcaaaccaaaaaatcgtaattttaccaaaagtaattagaaaaattttcttttaaggatgcctagataaaatggagcaatggacttgtgaatctgctgcatccattggattgtgtaaagtgagtattaaaaaagataattcgatttaaaaaacaatttttaataccgagtttatatgaaatagttccgcaagaaatttaaattttcacaatttatatacgctttttggacctaaaaagttcccattataacctaaaagacaacttcaaggaaatttcaaaaatatatctcatcttttatataatatatctccatgcaatacttctcttattgaaagtcgctaaccaaagcaatggcattcaattgttgttggacatgttggaagaaagcagcagattttctaccactactttaatgaagaattcctaagggtgattttgtatataaatttttacattttttactactatatggtgcggaacaatttaatgagtttcataggttgttctgaagaaattatttgtctttgtctaattttccataaaaagtaaatttttaattttagctaaattacattagattatacatttaatatttattttacatttaattttatttttgaataaaaattaaatcaatgtacatcatattagtctgcatgtggttttacaatttattacgtctattccaccattacatgctatgaatgtctgaaattaaatttatatcaaatcaatcataaaaaaatggcgccataaagtatcccattaaggcataagccaaaattagccattaatattttttattaaatattaactccaaaattgttttaattgctccctttaaaaataagttttagctcatagattttattgtgctaaaaataagtttgtttcagaatattttaaattatattttcgatgatcattttga

SEQ ID NO: 24603 - DNA, 2433 bp, Heterodera glycines
  misc_feature (2332)..(2332): n is a, c, g, or t
  misc_feature (2377)..(2377): n is a, c, g, or t
tttcgctcggatgggaaccatttgaatttgcgctttaaatatgaataacaaatttatttaattggtattgattagacaaaaaattgaaggtttaaaaaaacgcgccgcaaaaaaggtaggtttacaacttcgtaattttgtttttctaaaaatttttccaaaaaatcgctttatttttattcaaaaaaattttaattgaaattttcttacgaaaaaattttgagggggaaatgaaacgcatgcttaatttgtgaaaattcggtgagaatttaatgttttttaaatgcacgatccgcggcatttttctgtccgcctcccacccttgcaaaaggactcactccgttggccctcacaaatgcgtcgatggaaatggaaaggcgcgtcagttcggaaagcgacttactcatgtccttctgcacaactccgaattcatcctcatgaagagagtgagagatcactttggaaagagctaaatgccaatcggttattaaaatgaacttttttcaaaactttcaaggacagacggacctttaatcgcatataaagtgcaaagggtgtcgtaggaagagacaatcggtgcaggagcaaaaagcaattctttgcatctgttgacaatgaaatcacaaaaaagcggcacaacaatcagacgacgacggcaatggacgcgttcggaaagaaaagcatctaaaataaacgttggggatggaacagcttttcggcattaaaaaaggaccagctgagcgcgggttgagcgaagggggaacaaaaaaggagtgtttggcctcgtaaagttcgttcagtacgccggttgagcccgtcgaggagttcaacaaaaggctgccatttctgttcaccaatgatttattagcattatcttcgtcaatttcctccaaagtgtcgaaaacggacgcatcggccaaagacttgctcatgtgacgcacttccaacccccggcgaatgcaccagaattttactatgagtggctatttggaaaatatttcggacattgcgtacgtgcgcaatggcgacatcacggagagaatgccaatttcgtggatgtccaccttaataaacaatcaaaaccatgaaaagacatattatcaccaccaggttgactcaatgcgaagaagggtttccgcgtcgaagtgttggctgaacacattcgttgaagcagataaagcgcaaaaaactgaaaaattgtaatttaccggacaaaaaatggcattgcattcgaaagtaaaacctttgtcaacggatcgtttgactcgagtgcatttgtcagtgtcattgtcgaactcaatccttctgtggcagcataaaaaacagttggcatgacaaattcaatgggctaaatttaaacgtttctccacagttaaattgaccaaacaccttcatgagaaaattagtgacaacaaacggagttaaacgaaggattaaaacccgcgcaaagagagggaggaaaaagtcggaaaagtgccaaaaagcaaaaagtgacggaagcgacgcatggaaaggacgcaaaagcaaagctaaaagagcaattatggaaaggaatgaataattgcaaaatatcaacaaaaaaagaccgaaattaaacgcgatgacccaagcgaagcaaaatacttttgccgtgctgaaagaatgacgaatgattggtcgaactaacgccgaaacgacgtcctttttcattttgaagataacaaaactctgaattatataaatgaaatcgaaaagacaaatggattaaaattgtacgttatcttcaaaacgaagctgaaaattggtggagaaagcgcaataaaaggccaaaacaattgaagacatcagccagagcagaaaagaagagctgtatggaaaagaaagaatgaaaaagagacaagaaaccattcgttaccccgaggaaaaccaaaaaagatgtttggggatggctaaggacagcagaaagtacagcgaaacatttgctgcgaaaatggctgaggccgcaagtaaacaatcgaatttaataaggttcagattcgtctcgaaagtaactgaacaaatcgaaacattggaaattatgcgaaaagcgagttcacctgagaatatccaagtcgaaagcaacaaacattccaaaaataccactgccatttgcaggaaaagaacgaacagaaatttgggcgacatcattgaccaacagtctaaaagaaagaagtcgcaacgattttaacaggccagagaagcagtgccccttaaaggcttttataaaaaaaacactggccgtggaaaattggattttgagtttcatcaagagttttacgaatatcactcctaatacccgtagtggctggctcanatgttttgataatactgcagatgcctccctccccccccccagggnggatcagctgcagtatattaccaatattttttttaactataatgctgctcaaaaat

SEQ ID NO: 24604 - DNA, 793 bp, Heterodera glycines
caaaaaatgccacgacgacgactcggatgcttcctagggccacgacgacgaatcgtatgactaaagaatgcttttacgacgaatcgtatgacaaaaaatgccacgacgacgactcggatgacaaaaaaatgccacgacgacgaatcgtatgacaaaaaatgccacgacgacgaatcgtatgacaaaaaatgccacgacgacgaatcgtatgacaaaaaatgccacgacgacgaatcgtatgacaaaaaatgccacgacgacgactcggatgacaaaaaaatgccacgacgacgaatcgtatgactaaagaatgccacgacgacgaatcgtatgacaaaaaatgccacgacgacgactcgtatgacaaaaaaatgccacgacgacgaatcgtatgacaaaaaatgccacgacgacgactcggatgacaaaaaaatgccacgacgacgaatcgtatgactaaagaatgccacgacgacgactctatgactaaaaaatgccacgacgacgaatcgtatgacaaaaaatgccacgacgacgaatcgtatgacaaaaaatgccacgacgacgactcgtatgacaaaaaaatgccacgacgacgaatcgtatgactaaagaatgccacgacgacgaatcgtatgacaaaaaatgccacgacgacgaatcgtatgacaaaaaatgccatgacgacgactcgtatgacaaaaaaatgccacgacgacgaatcgtatgacaaaaaaatgccacgacgacgaatcgtatgactaaagaatgccacgacgacgaatcgtatgac

SEQ ID NO: 24605 - DNA, 1104 bp, Heterodera glycines
agtgaaaagacaaactccgtcaatatgagatcagagacactcaacgttcgaatgatcaaactcaaagagaattaactgcccttttacgataaaagagaatgaaagagaatttattgtgggcgatctcactttgttctcaattgcttcagttctatttattaaacttaataatcgtaattctcttctagagcagacatattcgtccatttgacaaaatgtccagaaataaaaccaattgtccgtacaattcatcatgaattttgtccgaatccctccgcccttaacggcgtttccgtttcagtccccaaatgttcggcaagcgcgcaaaaagtcaaaaagttaaaagccacgtggacggacaaactgaaaatgttcattttcgcgacagtcgccattttatgtacggacaaaaaaaccaaataatttcattttttggcattaaaaagaccaaatgttcatttgtcagtgcttctgcttccgattcgaattgtggtcgctaccattgcgactcttttcgacgaccacagaacgttgggacgggcaatacacagatggaaagtgacacgcaatggggggacgaccgccggcggaaatgccatgagcacaaatggggacggagccagaaactgacgaacacggcacgggaaaggaggaaattaggaggaaggaagaggaggagacggaggaggaaggagaggagaaggaggaggaagaggagaaatgagaaggaggaggaagaggagaaaatgaggaggaggagaagaggaggaaggggaggagaggagaaggaagaagaggaagaaaatgaggaggagaaggaggaagaagaggagaaatgagaaggaggaggaagaaaataaaacggtggaggaggaaagaagcgagttgaaaagctaaaaaaggaaaaccatttataaaacattttgtacacagaaaatatgcaaattccgaaataaaaaattgtgtcgaagtggtcagcggtgggcgcgccgtagaaaacttagaaaaattttgcatttcatagaattttttcccaccctcttattcccgctttgatcacgtatgcttggcgtctcgggaaaaatggaaaaaaatcaaaactta

SEQ ID NO: 24606 - DNA, 2359 bp, Heterodera glycines
  misc_feature (102)..(102): n is a, c, g, or t
  misc_feature (2178)..(2178): n is a, c, g, or t
  misc_feature (2332)..(2332): n is a, c, g, or t
cgcgcgcgcacctgaaagacgttaccacgcagatttgctgccatccagggttgctgtattacccgattcgggagtgctagtattattattttttgataattntcataattattttgtttttttcatttttattatttacgaacgacattaatattttgaaagtcttcgtcatgtataaaaaagatttgtttaatgttactagttttctaatttttaaaatatagatataattattttcaatttttggtcttctatagacagataaatatttacagaaaaaaatcccaattcattatcgataatttttacataataaatacacttatttattatataaattattattttattttatcctctccaacttaattaatttatctttgaaattgaatgtttataatacgaataatgagtgaaagtttcgatttacctatttaaattttttctaaaattttaattattaattgttttttcatttttatgatttcaattttattttctgttttggtgctgaatttattttactttaattatcttttatatttattcttttatttaacaaacaattaaggtattaactttgttattataattttaaattgagtatataatcaattatacatgttttagtgcatttggataattgataaaattatatttataaattaaaaaccataatagaaaataaatatgtttatcactaaattttcaattcagaaaatttattttgaaacttcaaattaaaattctttgtatttttaatttttacagcttaatttaattctatttttaagtaccatatttttattattttcgttagaattatttgataagttgccaattcgcttgagtaaatattatttaatgtcatagtatcaatttatttagcaattcttttctttcattttatttaatatcgttttataaaccaattattttaattaaataaatttaaattcaatttcacattcacttttgattttttatatatttaacattttctgtaaaataaaaaatataataaatttatatatcgaaatgataatacggtgatgcgacatttgcggcgcccagtcaaagcgacacttgcggagcaggcacttgcggcgaggacattttcggcgccgacatttgcggcgcgacacttgcggcgccgaaagatgcggcgcccagtcaaaaggacatttgcggcgcagacacttgcggcgcccagtcaaaatgacatttacggcacagaattaaatggccccaaaaatattccaacatttatttaagttaataaaatagttattttaagtttattttttaataatgactagtttaacaataattcttgcaacttaatcacaaagataaaggttaatcggttgccgttgtaacatattcagaaaacgtttcagtgaaacggtttcactttgccccacccagcattttcaaagtataaatgggatattgtaataaaaatatttttacaaggtttattatcgtcattaaaaaagaggaagagcaccaacaaaactgcctgaggcctaaaaaaaatttccggaggcgggattgtacactgcagtacagcctagggatgaaaggctttgaacaataggactgaaagagtgataagtagagaccggatttttatgtttttacatattttttttgcggcttagttatggcgagagaagcccaaaaatagcattatctccgaacaatttttgatttagagcgacttataaaaacataaaaacacatattttggcgttttgtcacataaaatatgttagcacatattttggggtttggcacatattttgcacatattttggcatttttgagaaaaattgcaataaaaatacaagaaaattgaaaaatacacccctaaaaatcgacttttttcctaattattaacataattttcaaattaaaaaattttttcttcgattgtagaacctaatgaaatctcgaattcattaattcgtcattggatttcgaagttctctgctggaactttcaatttatagaaatgatttatcaaaaaaagacaattttaccccaaacacttcgaaatgtatttgatttgcgttgtatgggctaaaaatgataaagaatgagatttttgggaatttttatgcaaaaacacacttattttttcaatttttaacacatattttagcacatattttnggcatttttgggggtttttagcacatatttcagcattttttagcacatattttattacatatttcaggatttttagcacataaaaatccggtctctagtgataagctcaattttacatcgatcgcacagttttatttgcagaatagcaatattnatttttaaattttctcataaatattga

SEQ ID NO: 24607 - DNA, 1660 bp, Heterodera glycines
cgaatccatcggtgtgcggctgcgacccgactgagcatttcggcattgagcagttgggcaggcttagcttcctggagtgctgcgtcaaggaaatcctccgcctctaccccagcgtcccattcgtcgcgcgtcgtctcggctccgacacaatcattggcggaaacaaaatccccgcgaatacccaagtgttgctgaacatctacttgatccatcgggagcctgaacactggccgaacccggagctgttcgacccggacaggtggcatttggcaactctttttgcggttctttttatttgtcattttattaattttaagattttctcgtgagaatatgaagggtcggcacccgtacgccttcgttcccttttccgctggcagtcgaaattgcattggccaacgcttcgcccttctcgaggagaaaacgatgctcgtttggttacttcgcaacttccgtatcgaaagtctgctccgtcgcgaccaaatgggcttgaaacccgaattgatccttcgtccgtccgtcaaaatttctctcaaattaacaccccgactttaattgtttgaaagtccccagcaaaaggcactttcggtgactctttctactgacccgctgcaattcattttgtgatttgttaccatttgctctcaattttattaatgacctcataatttataattattaagaatagcataataaatttatacgaattctaccattttacacaatttataaagttttcagtccgattatttccttttaaattttatttttatctttcgttattctttttgatggccatttagcgtttgctgatgagtgaatcgagcagcagcgatggccatttgttggacgatttcgcagatgcggagaaaattggggagggcacttacggaatcgttttcaaagtgcggatgagggccaacggagagaccaaagcgttgaagcaaattcgactgaacaggtgggctggggcccatcgagttgctccgtctgtctttgttttattgttccgtaccaaaataaatcgttttttgtaccgtttgccaattgttttttcctcctgtgccatgtcaatgaattggcacagatttgtccattaagtgggaatgacggtgtgccgagcacttgcatccgcgagatcagcctgctcaaggagttgtcccatccgaacatcggtctctcctctccccctccctctgtttaaattttcatttccattccttcttcatttcccctcttcagttcgtcttgacgacgtaaaaatacacagtaatgaatggcattaattccttggcattttctccgtgtggcattttcagagggccgtcgtctctttctcgtcttcgaatacattgaccaagacttgaaaatgttgctcgagcgtctctcccctcgttctgtgcccattaattacgttaaggtctttcttctttttttcgattttccattttgcttgaccatttcttcgtcaaattatgccatttcccttccgttcagagtttcgtctggcaattgcttcaggcgctcacttactgccacacccatcgcgtcgtccacagagacctcaaaccccgtgaattgtccgcttcgataatctgttgcttacccccaacacctcttcagagaatctgctggtcaagaatgacgggaccattaaact

SEQ ID NO: 24608 - DNA, 1419 bp, Heterodera glycines
atgacaaatgtttgggcttttatcttttgtgcttccctccgaaaaatggtgaaaatgggagaatttctaattgaattaattaattttgattgccaaagatggaaattggagctgcgaatgttcggcaacccatcgaattgtttcccaaaagaacggaacggaggatttttcgcgaaaatgtgaccatgtttttaacaagaaagagaacgactggggctttccaactttcattgcttttacggtgagtgacagtcaaaagaagagttacggtcgaaatattgaaaaaactcagtttagtacagaaaactcattcgttttacacccaaaaatgtttagcggtcatatttttccgcaatgcttttgggtgaaataaaaacaacaaaatgagtttaaaaatgcaaatatcgcaaccattgccaaactcctttctcgtgaaataaatttaaacttaaggaattgatggatccggacgagggattttacgacaaaagtgaggaaaaagtgacgttggccattgatttaactgttgaagaagaaaaagggacaaaaaaagcggaaatttaccgatgaatcaacccacccaatcactattttctgttaattgatctttttgaaatttatacaataaattcggcagcaaattttttttcgtaattatttattaaggaaattttctcatgaatattaataaatatatttctttattcgttttcgagtagagttgagcgggaacgggacctgaacacggacaactgagtaccgaagttgaccgggaccgggaccagtcccgggtttttccagccaaaaattcgcggtttttcaacccgaaaaggtcccggtcccgggtttgcccaaaattcccggtcccgctcaactctattttcgagatattagattttgtgcttttccatcattccgccctcactaccataaaaatatatgatttacgataaattacaacaaacttttctagggtgatttgatgcgctaattaagaatgacgtcaaaaatttaagagttatctatgattttttcaaaaataaaagctataatggcccgccattatcgagcatgcgataacggagcaagtagtgaggcgcccgagcgagcagcggctccacctactggcgccatagtctttggccaaaatgctaatcaaacaattcagttaaaactaaatacctatatgtattgatgtgttttggccaaaacatcacacactcgactttttgttttagaattttgctatccgcttttgcgttacattgaccaaatgtgagcaaattggtcaaatctgaagcctttttacaaattgatcaaaattgttatgtgaaattctcgaaagatccagctgagaattagtgaaatcgaatttttgaatgcggtaaaataaatattttaaattataaattaattttt

SEQ ID NO: 24609 - DNA, 1989 bp, Heterodera glycines
ttaaaatttgcaatttaatatcggcattaatagggacccccccatcattttgtatttaattttatccttctttttataattatataatggcaccgaaacaaaacgtcgacgggacataacgtagccgcaaaaaaaggaagtatttttttttaaattcaagaaatgattttaaataatttttcgtcacctagccgaattccaaaaaattttgtcaagaaaaaacttaaaggacttaaggaaacaataaaatttttttgcagtaatcagaatataggacaattcactcataccttttttaggggtcagaaaatggcctgtcctatttgtcatcactttgcggacaacagtcacgcgggtttgaacccgggcaaacaattgtaaacagactgaccgctgaaccacagtccgtgggatgtacacagcataaatatcatttttataattttttcctaacaaaattacggcaaaagccactcataatcagcagttagaatttccaaaatttgtattcgatatgttcaaaaaaaatgcattaattccggcttcaaaagcacaatttcttccccttcccgaaaaccgttaattaaatgacaaataaaattaacggctgagaaatgtgccaaaaattgaccaaaagttgtcacacataacctaaaccaaaagatttaagtaaaaaaaaatctaaaggaacaagaaaattttcaaggaatttacattttttaataatttcaggaaaataattttgaatccgggtgaaaacaaatataaaaatagtgacaactgattagaaatgccaaaattgagggaaaaaacaacaacaacaatttacgactggcaataagaaaatataccaaaaactgacccaaagttgcgcccacgcgccctctcctcctcccgtgccaagaacagcggcaaaattggcattggcggaattggcatcatcgttggcattgttgtgcaccatcatttgttgttgatgtgttgggttttgctggtgctgaacactgacactgatcgaggacgatgacgacgacatttttggctttttgatcggttgctaaacggaaattttggaggggtattttaaaaaaattgaaaatttaagaattttttactttatttggacgagactttctttccacctctggctgctttatttgttgtgcgcgaatagcataaaagtaagtaagaaacagaagaatagataaatttgctaaaattaaaaaaaaatttaaaaaaataaaattcatttttttggcagacgtcgatttttataatttataagggtattacatagcattaaattttaattacgaaggtgaagcgagacttattccaatatgcttaaatgatcatttttaaggcgaaatatggtcttattttttcactaaggcctaaatttgaaaaaaataggaaaaaacaacccaaaactgcattttaagtgcctataaaatttttcgtaaatttcttatttaaaaaattaatcattaatcaattaagtcgcttagaaaggatcaaagaacacctccaatttggaaatttatgttaaggatttccgattttaaagaaataaaaaaagaaaaatagagaatttataaatttgcttggcgtaagacaaaacgccaatgccaataattaatttaaatcaatcgcgaaacaaattccgtttcagagagtccttatcaaatgtggtggtatgcgtgtacataaataaagataaactgaacgataaggtgagatgaatgtgatgagtgaaggaaaacagcgccctttttgaagataaacaaaatttgggggggggggaattcattttgtttattttattatgcatttgtatcgattttggggcatcaattaatcgccattttcgtatgcgatgagtcatttacccatttaaaaaattgctgaaaaattaaaaaccaataaaaatgaggtcaaatgattactaacagtttaatcgcagaaaaaaatatttccaaagattaaaag

SEQ ID NO: 24610 - DNA, 2452 bp, Heterodera glycines
  misc_feature (2346)..(2346): n is a, c, g, or t
  misc_feature (2392)..(2392): n is a, c, g, or t
  misc_feature (2401)..(2401): n is a, c, g, or t
tcttttagttgaaagaattgttattgtgggagaacggacccgagaacatgtcaatttatagagcactaacagtttgcattaaaaatgccatctctgaattcaataaaaggttaattaagcaaaaagcgtaaaaaataaattacctatatttgatttaaataaattttacagtaatttttactgcactataattaataattaattgaccttaaaattttgaatctaaaaaatttaaaataaacaaataatgtaaaaacaaattaattttgaaaccgtttaaatttttcctcatatttgtttaaattaacaaatgcaaacacagacaaccaattagtcctggaattaagccctaaaaaatttgcaactctgcctattttaactaaaaacatcaattttatagatataattaacataaaaatctttgaataaatcgacattgaaaacgaaaattttaaatgttcttacattgatttttttaatttattcaatttctgagttagcaccactttttctgatctttttctttcgttaaattaattttgatcataatctccaaaaataaattttgtttgatcatttgatcacttttagattttctccgtcaaaaattcacagttctgaaaaagtgcatgaattgcaacgatcaatctttacaaaattgatcacttgcactgtgaacaaagccaacaaacaccatggcacaacaaatgatgactttttgtccaaattgcattttgacgttttggcacaaatctgtgaagcggatgatcaaatgaaagaaattgtgttgaaaaacagtaagccaaaaagcaaaaacttaaaataaaaaatatagaaattcagaaaagcatttgaaggattttatgaacgcaaattggtataaaaaattatctggtttgcttgagaaggtaagggtaagaattattttattacataattcattagttaatttgaccactttttggccagagctccgttcttcacattttttttttaaatctcattctgctgaagggcaaatcactgatttagttgaaaatagatttttccattttttatctcacattttattgcactaatctctcattgaaatgccgaaagaaaaattaaaataatagtgattttgttaacacatttagccaaacacctagcaaaataaatataaaaattttcaaaatttactataaaaaataaaaaatattttatttaggaggatgaatatttttctgtatccgaaagttttaacgaatctgacggttcagaaaatgaaatatttgatgacccatcagaaacaatcattgaggaaaatgaaaattcaaagaatttaatggaaaaacattcaattaaaaatatgaattttgaatttggtgaaaaaagtgcagaaaaatgtgaaaacaaaaatttcaaaaacaatttaacaacaacaaaaatggatgaaaaaaacagtgacgacgaatttttggcattaaattcagaaaatgaagaacaatggacaaagaaaaaagagcagcagaacaaaaaagcaaaaaatattaatgtaagaaaaaataaaaataataataattcggagaaagaaatgacggaacaaaaaaggaaaggaaaaaatggcaaaaataaattggaagaaaatgatgagaatttaaatttaaataaaaaaaattatggtaaaaagaaaatgatggaaaatttaactcctgaaaatgtacaaccgttaattgagcggaaaaatggaaaactttgcaagaaaatgtttagtgaaattggcgtcaacaaattagcaggcaataatttttcttaaattttttcgtttttcgttttttttaaattttttattttgtttctatttataagattttaattttaaataattttttattagaaagatagatgttaaatttaattttttttttaatttttagatttgctggatgaatcaattttcaaaaagatttttgaaaattttttggaaaaacattgggaaccccaaagcatggagaagcaatgcttggaatatttaggcacaattgcattatttgccagagcaattcaagcaaaaatgaattttattgaacaaatgtcgaaacattgggcaaataaatcggtgaatggaattgccaaaaaatgggaacattttatttttaatgaagaaattttattcgaattcgaacagtttgtacaaatcaaattgtattttctgcaaaatcagcttgatgaatacgcttttgagtaaatatattaataattcacaaattaattcattaaattacaattaattttatttggtttttacgtagttaaaaggtttttttaattaaaaatattattatttaagtaaattattaattntgtctaatcttttttatttaatcccatctatttttattcaggcaantcataattnttgtgaaaatttattcaaatattgacgaaatgagacagacaaatcaaaaat

SEQ ID NO: 24611 - DNA, 997 bp, Heterodera glycines
atgcttttaagccccgccgtgaggctggacagttccaaaatttgtaccacattttactgtggaaagtccaagtaccttaattggacaattaattgtcaacgaacacagtcgcctttggcctcttatggagcagaaaaggggaaatatcagatggggtgcgatcctttcaaaaaattactcttttcgtctaaccatccctccctttttgtgcactatttcgttttaaaaattgggaacatttttttgtttgtttttttgaaactaaaatgtaaaaatttaatagaattatttttgattttaaataatgcttctgtttcgaatcttttgactctaagaaattaaactataaaatttagaacaattaattctctgaagtttttaacttggctttaccatgcttttaagccccgccgtgaggcgggacagttccaaaatttgcaccacattttactgtggaaagtccaagtaccttaattggacaactacgtgtcaatgagcacagtcgccgttggccagttgtgaaacagaaaaatgggaatatcagatggggtgcgtcccatcctaaaaattcctcttttcgtctaaccatcactccctttttgtggagtcgggggcgtttgggccccagtttttgggcccccgcgtttgggcccccgtttttgggccccaagtacagaaaaatttctgtttttcaaaaaatcaatgaaatcctgccggatcctgcacaaaaatcagatttgcggatcctgttgcaggatttgaattcaaaatcttttgccggaccggatccggccggattaatcctgcaaatcctgcattttcaaaaaaacgcaggattgcggattgggatcctgcaaaatcctgcgcaggatccggtcctgctccggtatctaataattaacaaagattttgggtgcaaaaaccgaacgtgtctgtacgtgtgatgacaaaatttggtggcttttccgttgccgaccgtccggctgccaacaatatt

SEQ ID NO: 24612 - DNA, 1261 bp, Heterodera glycines
tcctctaaaccaaattttctctagtttccctttgctggaggtctgaattttctatttttcagcctttccaatccaaatcaattgtcgtctatcacttttacccatttgacctcatttaaacttttcctaatgtattcgtctttaatcatttatcaactatttaaatctaacgtgtaagtggtcaccccttcgttagatattttatttattaataaaaagaagaacacttaattgccctagtcaacaaaaggagaatgaattgattatttgtgccccccccctccactgctcgccctcttttatttttctgctgagtaattttgaaaatacggtactttgcgttatgccacactttcccgccccctcccctggcggtgtgacccacgcgtttgggcgccggcaggtttttccactatagcttttttctttggcatccaaatccaaaaatcttggtatcattcgaaagctcttaacatgctctattagccttaccaaatgcaaaaagattttcaatcctggaaaaaattttatgaagaaaaaacttcaaaaatttcgactttagctctaactttatataaaaaatattgattaaattttataattccaggatattgaagtagctttattcgtttaaacagattaaggaaaatttaaataatgataagtagagcttccatttttaggcacaaaaaatcgcgaaataggcacctaaaaaggcataaaaaaatcgcaaaataggcattaaataggcacaaaaaccctcaaataggctaaaataggcaaataaaattttttattggcactttttaggtatcaaaacacgtaaaaaattaatgaaaaacttaattttgattatatttcaattgtcttaaagtgttttcttctaataaatacaatttttaaactaaaaatttttatcagaaaaaataattaaatttgtggatcaattttgtgaaaaaaaattcaattcttaggggtgtattttctgaaattttttcgggtagattcttaggggtgtaagtttcatttttgttaagaatttttccgaaaatcatgaaaaaggcgccaaaaatggcgaaatagacacaaagataggcatttaggcattaagctcaaaaagtccaaaataggcaaaaataggtataaaagtcatcatagacacaccaaaccaagcggaaaatgcttttttcgtgcttatctatgcgtattaattgcacaaaaattttaggcatttgcctaaaaaaggaagccctaatgataa

SEQ ID NO: 24613 - DNA, 984 bp, Heterodera glycines
ccattttgggcctgttgagctgggattgtccaaaaataccccccgccctccccggggctttttttctgctgagcgcacaatttcgtttcgctgtgaaagacaaacatttcgcgccccctccactccgtaagcagagatgccaccgttttgcaaccacaaacctttgagaattggccttccccccccccccctccgtaccttccgccaccgcattttcccctcgctcgctgactttcactccgtcgcccattggcactcaatgaaagggcaccccgcggctaagccgcatcatccgattccctcccccccctcccattcccattgattgcgttctctttttggctaaagcgacaagcaaaagcatgccacaaagaagaaaacggagggaaagttgagtggggggacggcgaacgacgaaaggaaagttcgtccgaatagcgtggcaccgctgccaaagtccgtcgctgactttgcgcggtgtgccattcattcctttctttgctttttccacgcggcggttgccacggcattttagcataatccgcccaattcggcgctgttctttgctccttaatggctaatcacttgagaacacacacacacactaaatggcgtacggcgaatgggtggcccaatgcctggggcttttaacccagcgaatggtttcgcccccggggcgccgcagcgacggacgtgcgccgcgtccgtcggccgcctgcccatggccatgcccacctcctccgcctccttaagtcggtcgtgccctttccctctcattaaattccctcccctttctcttttccatattccttcgtccctttctcttttcattttgccattcactcgcgcaacaaacgacggattattgccattctcgggcataaaattacgtagaaattcgaactcatagatgatttaacatttcaaaatgcgtcaaattcttttttaatgattacccaattaaataattgcattggcatttta

SEQ ID NO: 24614 - DNA, 1772 bp, Heterodera glycines
  misc_feature (45)..(45): n is a, c, g, or t
  misc_feature (77)..(77): n is a, c, g, or t
  misc_feature (81)..(81): n is a, c, g, or t
  misc_feature (119)..(119): n is a, c, g, or t
  misc_feature (1739)..(1739): n is a, c, g, or t
tggcgttgtgctctctcgctgtctcctcctgctccatttcgtggntgtggtcggttcggatgcaatttgttttgatnaacnttaaatttaaattaaaattaaaataaaaaacaatatanaatgaaattctttttaaatatcaaaaaattttaaatatataaataaaggaattgtgaaatgttttgaaatttagtttgataatcaattaatgaaattttacacatgtttaatttaatttttaattattttttaaattattaatttatttttttaaattattaattagattttttaattattttattttcacccgaatgccctggcgaagctttcgtcaattgcctcaacttcgcgctgcaatttttccacctcttccgccgccgcttcgtcatccccgccgctgtccgtgtagtcaaagggtggcaccatcgcgcggttcagaaacagcggcgaccgatcggcgccgtcggcgtcagccgtgccgagcatcaaatggacgccgttcaaagcggcgccaaaaattgccacatattcggcggacgaaattggcggacatttgtccaacagttgacaagaggagggatctggcaaaaaatagcaaatagatatttttttttaattttataacagaaattttacaaaaaatattcttaagaaatttttagtaaaaaatttcaagaaaaaaaattttggaaaattttcagcgattttttggaaaatttttgaaaaaacttagtaggtaattaaaaaattgctgaaaattgtcaattcattaaaaaaagcaaattaataatttgattcaatgggcaccaatgtgttttttgattgtcggcacaatggctgcaatttgcttcggcatgccggcagttaacaatttgaacagtttgaaacggaagatggtgagatggcgtcgcaaaaatgtgttgatgagatcagtttgggctgttggatcagtgagaatgagcatctttgatgagatcagacgggccaaatggtggtgatggaagtcataaacggacagctgagagaaaattgcaaaattacgcaaaaataattttagtccataaattttattattcgtttaaaaaaattgccggttttaaccccacaataatttattaatgcgcctaatgtgtcgccgccaccacctcgatgcaatactcgcagatgaacaaaattgccacaaatttttcgccccagctctgctgtttatcactgtcgctgctgctgtccaacggaatgattagcgcggccgtctccgcgccagcgccgcccgtctcagtcccatcgatggaagagcactgctgctgctgcttgcacagttgggcctcatcctcgtccaagtacagcatacggtagctgatggccagcgctgtggcacgacggaacagaaacacttcgccaatgccggcggcctcagcagctgcaaaaaaatggcggattataaaaaaggataaaagtatcaatggaagcgatcaattattattgctacgaccaaattggagtatttcaagcaatgtgatcacaaagttgatcaaaaaagaggaccacaaattaagcattttcgaaaaattaatcaaaatagtgttgtcgcattttttcagaaaaagtctcacggcactgccggaccaacaatttgcttatttaacttttcctcaattttggcataaatatggagttctttttggataaggtcaaagaaaatcgtgtcaatttttataaatttaagaatttttttnaaggcatttatttcaaaaaaaaaatttttttta

SEQ ID NO: 24615 - DNA, 1384 bp, Heterodera glycines
gtcggggagtgggtgacaaaaatttagcatccccagggtattggatccgcttcagcaattgtccaacataggaataaaagcaaaaccgccggcagcaaagaaagaatttcaatttaatggtttcagcatattgaaaaaatgtgctagttacaaattcataaggcagctcatttttagtgaatttgatcactttaccaagcataactctttcgcataaatattagggttagacgggtccgggtacccgaccggatccaaaaatacactggtaagaatggggtctgggtcaaaatgttaggcaaagttggaggaaagaaaaaataaaaaagaataatttaatatttattgtaaaaaattcatttattgctcttgtggcctataaattgagccacaattcctcaattaattggtcacaggttccttctatttcgtcgacaattcaccaaattctgttcctgacgaaatgttcccattctttgaagaaacaaaaaaacggaagaaaggcgaaatttcattctttgattaatttttattctctttgtttttaattaattttgggttttttttattacgctaattacttttcttattaatgatcttgatttacaaattgacaattgatttatttgctatagtaaaatttgtttaaaaaacagtttacgaatggaatgatacagatcgtcatatttaaatgtcttttaaatatactttgaaacgaatccaaaagtgtgatattttttgccattgatgatagctcagaatgatttctgacttgagtttttctccactaaattttgcggctctgaattaaattacctcaaaacaaagattctttattttatatattcatccgtttaattcgttgaagacaaattaagaaagataaagaaatatttcaaaatccaagaaagaaatccgaaaattagcgacaaaaataattgataataaattgcaaattggctatggaacgctaagaatttggaaaaagaaattttcttaagttttggagagtaattctcgagggtgttaatttaacttccctggttttcttttagcacctataacttgaacgaaaattacttcagcaaatctcttaaaattaaaagatataacatttaataacaaattttaatttaaaaaaatataaaatattttgaagaattgatttaattgttcggtttacgtggcagattaatatttgtaaagataaataaaatgagatacttttctgttttggggccaaagtttgatttttttttaaatcaacagcaagctaatagaattgcagatccattcgaagagatattaactcaaatttatgcatttatgcctcagaaaataattttggggtgtagctttagcaattctccgcgccctctgttga

SEQ ID NO: 24616 - DNA, 1277 bp, Heterodera glycines
tgcctaattttcttcttaattgattcatcaaatttctcctgacagcgattaaatcaatgaaactagagtagagcgggaccgggaccgaaacacggacaactgagtaccgaggtcccggttttgaccgggactagtcccggttttttcccggttttcccagccaaaaagtcccggtttttcaaccagaaaaggtcccgggtttgcccaaaattcccggtcccgctctactctaaatgaaacaacaaaatatttacaaaaaaaaggacaaaaagtcgaaattgtacagaagagaaaagtgaattcgaatgaattcgaaccaaaaaattggacggaaaaactccaaattcatcttatttataattttttgaaaatgactggaaattttctgcgtatttaagcgtgaattccacacaaaaatcatccattcaatttgcatctattgtttcccatcggtggaattgtctttctgtacaataaaatacctaattcccgtcatttttttttaatttggcgataagtgactaggtaattttattaaatggattcatcaaatctctccgctgacccacaaattgtccaagtctcgaaattgagttttttattattcagatgggcctaaggttagacaaggcgtaatatacaggttatattcgtattcagcgacctcgaaaaccctaaaaagcccaaattagactcattttgtttttataaatttttaaaaattttggacaattcgtggggttttactcttttggacaattcgtggcttggacactttgtggggatgccaatctctcctaacagcgattgaatcaatgaaacaacagaatagatgttattagtacaatcacaatacacagatggcatatatttaggcattggtaacatcacatgatgatggcattttgggtgaaattatatacatacaaatcggatggatttgacgggggatcaatttcattatacaacacataaaggggagccacactctctaagatgggcacaattatccatgctttttaattagtatcctctgcaaaaatcttcgtccattccgatcgcctcttttctctatgccgttgttattttgttgtaccacgcgtcacgtcgttcagtcactgtcgctgagtgaggcgcttccggtcgcatttcccaccggtcgttctgttgttggcgttcgtcgtcgtcgtcacttccgcgccgcccaacggtctgttcgtcgctgataaacgtgacaattaattatctatgttgctacaacaaaaatgccaaaaaaa

SEQ ID NO: 24617 - DNA, 1201 bp, Heterodera glycines
tggtgggttgagtcccagtgattgacttttggtggattgagtcccgttgattggaatgttggtggcttgagtcccagtgattgaaatgctggtggattgagtcccgttgaatggaatgttggtgggttgagtcccgttgaatggaatgttggtggattgagtcccagtgattggaatgttggtgggttgagtcccgttgattggaatgttggtggattgagtcccagtgattggaatgttggtggattgagtccagtgaaatgctggtgggttgagtcccagcgattggaaagtcagataattgagtctcagagattgaaatgtggtgggttgagtcccagagattggaatgtcattgaaagttggtgggttgagtgagtcccagtgtttagaatgccggagatttgagtccattgtttggaatgccggagatttgagtcccagagattgaaatgctggagggttgagtcccagtgattgaatgctggtgggttgagtcccgttgattggaatgttggtgggttgagtcccagtgattgaaatgcagtagaattgagtcccagtgattgaaatgctggtggattgagtcccgttgattggactgttggtggattgagtcccagtgattgaaatactggtggattgagtcctgttgattggaatgttggtggattgagtcccagtgattggaatgctggagggttgagtcccagtgattggaatgttggtgggttgagtcccagtgattgaaatgtaggagaattgagtgccagtgattggaatgttggtggattgagtcccagtgattggaatgctggtgggttgagtcccgttgaatggaatgttggtggattgagtcccaatgattggaatgttggtgggttgagtcccgttgattggaatgttggtggattgagtcccagtgattggaatgttggtggattgagtcccagtgaaatgttggtgggttgagtcccagtgattgaaatgtaggagaattgagtgccagtgattggaatgctggtggattgagtcccaatgattggaatgttggtgggttgagtcccgttgattggaatgttggtggattgagtcccagagattgaaatgctggagggttgagtcccagggattgaatgctggtgggttgagtcccgttgattcgtgtgggggagggttgagtccccagtgattgaaatgc

SEQ ID NO: 24618 - DNA, 1237 bp, Heterodera glycines
  misc_feature (1195)..(1195): n is a, c, g, or t
aggccgagcagtgcgcgccgattggtgtgtcaccggcgcactggatagcgatggagaagtaaatgaagtcttctgggatcccgtaaaaagtggcggcggcaattatacgattttctgttatatcacccttttaaaggaaattaaattttatttttacaatttttccaaagttttcattttattttcgtaatctcgtcaagaaatattttttattcaaaaaatgtaataacacctaaaacaaatgtgcaacaaagccaacaacaacaaaaaaaagagagaggaattttggcaaattttcaaaaaaccaaagcgttaggtcgtttcataaatattgtcttttaaattttcagacttttcttgccatacgtggtgtcattcgaaagcctaatgggtcgggactattttttggtcacccatttttcggaaaattcttttctaattttttttcgaatttaagaccaacaaaaaaaccacccgaattataagttggagaatacatatgtattattggatagcgcaggtcgatttcgactttgaattttttatagcgaggtgtaaagtaaaactaaaaagttatggggcctcaaaaattttaaattttcccttgtgttttcccgttggactcgaaaaaacctcagaaaaacttgaaaacaaaaaatttatgaaattaattttttaaaccaaaactaaactttaggaaaatcggaggtgccatttccgaatttgccgtcagaaatttttaataaaatctttgatttttaacttttgtttttagggggtgtaaaaaatataacacaacccaaaaatagggcaaaaacgaaccccgtgatgagcacagtgtcgtcgaagacgaagaatttcatgtgctgtaaccccacaatttcgttggtccgttcgggcaacgcacttttgaggaggccgcgcaatttgggcgtatgaaagagacggacctgggaaatgtcgaaaaaataatttccaacgataaaaatgtgagcattttgatttgggaaattttatgaaatttttcaactttttttgatgcaatttcgtagcccaaaaacgcaactatcatccccaaagaatgcactgaatgtcaatacaaaaaagaagcaattttgtaaacattttgttatagcaaaacttgaaaattcgcgggagttaaggcataaaaactaatgaatgctaaagcattganggaaatttttgattaaaaacaaaaaaaactcacattttttca

SEQ ID NO: 24619 - DNA, 1685 bp, Heterodera glycines
  misc_feature (70)..(70): n is a, c, g, or t
gaacgcccacactgagcttttgtggaacgcccacactgagctttttgtggacgcccacactgagcttttntgtggaacgactcaccacgggataaaaggattaatgaaaaaggtatttttattaaacaaaactgatgaaaattttgaattaataattcagttcatttaattaataatgattttgaataaagacactgaaaaattctatgaattaatcaaaatgaattaattcattttattaattagtataatataaattccaaagagtaaaatgaattcaataaaataaataaatattttgttacaaaaaattgactaaaatttaaaaaaaacgaagacaaatttatcacaaaatgattgaagtcatcagacagactgatgacagcagaaactgagaacgaatgaatgactgattgtccttatctccgctaaaagcttctaaggaattaattattttttacccatttttaattaaaaaaaaataataatacattttaaaatgaaaaaataataatttatgattttttgtagtattaattgacaaaataattttgcaatgatgcaattttttgcttccattacacaattttgtgataaaaagttcttctttctgtttttgccaccatttttatcagcaaaatgttttctgctcatcaccaatattcttccacatttgttgaagcaattgggaagaaactttttatgagtaaacaaaaatataaataaaataaaataatataaatttaaaatttaaaaaaatgatgcttcataggctcatgccattcatgaaatgtgaaataattaaaaaaaaaaaagtataaaaacagaaataaatttgttgatttttcaataaataaatcgtactttttagtaaaaaaaatcaaattcatcctattttctatctttaaataaaatgaaaaattaatcaaattataaaatcgagaatttaatttcatcttggtgtgtcttcttttgctaattaacttgtcattgtctcattcatttttaaaatttggcgagcttttaacataataaaattttgggccataaaactttgacccatgagggataaaattcccctaaagttttcaaattttacctataaattggcaaattttcagtgtaaacctgttgaaaaatggtcaaaatttccaatttttcccccgacgcatctattggcaccgcgggacctgatttttgaccccaaatgctgattttttgtaggccaatgctggttttgaaaattttcagttgccagccctggatttaggcttccaggtcaaactttttcatgctgatttttgctcaaaatattaaatgtaagaaatttttatgatttttttaaataaaaatttgatagctttacaaacgaaatatgaaatccaaatctaagattggtgaatccgttcaattaaaatgctatttctcttaattttcatcattcgataattttcctatcactcattttttgttaatctaaaaaccaaaaaacattatatataaaatttgaaatccataatgcttaaagtgtttaaaacgacataaataatatcaaaaaaattatataatataaaatagaaatcagaaaatgccaaaatatgccctaaaaaattagataattaattaaatatagaaaattataaattaattcagctcattgttttttcactgaagaattaacagta

SEQ ID NO: 24620 - DNA, 1084 bp, Heterodera glycines
aaattattttcatttcaaaaaaacaaaaaataaattttataaatttttcgaggaataatgagtagggctttcaaaaatatgcacgaaaaatggctaaaatatgcggtgaaatatgcacaaaaatcgcaaaatatgcaccaaatatgcacaaaaaactaaattagggatggaaattaattaaaaaattttattccttataaaataagttgtttttgcaatttcaactcaaaaaatttctcaagattttcggcagtgaagctcatcgcgcacccattcagtttggatttaattttaggcataatcaaaattttttccgaagagatattcaaatcggaaaatatttgacgaaaaatggcaaaatatgcaaaaaaaacaaaatatgcaaatataagtcccgatttttgttcggaaacacaaaaaagaaagtgtttttcgtactatttagagcatggaaagccaggaaaaaaaatgcatttgcatatttttgacagccatgctaatgaggatcggatgtgtaacgaaaataatggacaaacaaagggtggtgaaagaaagaggcaaaccaaatgtgattttgatcagttacggagctttggagttgttcatggagaaattacaaggaatggcccatacagaacaatacaacagcaaacagtaacaaaaaggtaggccagccgacccttacctttttgaaaaagagggcacattaaaaacacaaaaaagtgccgcttaaaaataagaggttatttggatgatggtccaggccaatgttaaaaaaaacaacaagttcaaggaggttgttgaagaggcattggcgaaacaacaccgtgtaaaatgaaagaagcgcgcaattgaaaaagagtaatgatcaaagtattaaagcaaattgtgcccaaaatttttgttagtcggcaaatatttgaacgggaggagagattgccgaatggacaaacatttcacggttctgttcaacgaaaccacaaacagcagaagaagaaaggacaagatatcatcatcaaaaatggacaaaatcaaaacttataaagggaaataaaaaaaagatcttttgctgtagaaaaataga

SEQ ID NO: 24621 - DNA, 2396 bp, Heterodera glycines
cacatcccacgcactcacacttaaatccatcatccctgcatggccgccccgcaccaattcgaccacattccttacaattcagaatgcatgaacttttgtgagtgtccgcatttttaaagggcaattcgcatgcaaagcagtagtagtcgcgaccaaaaattgctgttccaactccacaacggatgccatcaaaatgatcgttgttgtaatagagcgatattggtgtcaggaattcttctggtccatatttatatttaggtctgtactgacccgttgtgccgaagatgaatactttaaattttagctccgggtatactgcgttccaatggtccactacacgtggtacccacacttcggcgtcatacctttcttggtttagtggaattcctgcatcgagcattaggcgctcagcgtcttgttgttgtgaatgcattttgttaatataattactgaaagtttgttttggcatcaccatgcagtgatagattctgctgatctccaacgcgtagaatagacaataggaattattattattacgaatcctcagcagatttttctcttttatgatgtgatacgctccttttagcgttcggtgttcggatccgcgaccagtaattgtatcccgctgcggtagattgacagtgtccagagtggttactattacactgaagggtgcaccccacagtgaaccttcccgcgactttgattgtgccacatctaagaagcgattcaaaattgtgtccactgtgtttggagttatctgacggatcggaatccaaatgtcagggtccaataactgtgaagtaattgttgcaccaagtcgactcggttcaattccacgtctctgagcttcatctaatgacgattgtatgcaatgtccaaaaatgactcgcaaaagcgactcaggatttgatggtagagtctggatcatgaatgtacttttagcattcattagtctgaattttttgttgaacgctacgtcggtgttcagcgcgcgtacatagtgccgaaaattgcgtcttttgccattgttgttgttgttgttgttgcttccacttttgaggatgtttggcattcttcggcgcttcggtgggctaggttcattgtttgatcgattcctcatgatgatttttgggattggccaataaatgaggttgtattgaatttttcacttaatttataccccgtactagcagtaatttccataaaattatgaatgaatcgtttcgatactcaatacctctctttttacgatactcaatgcctctttttctctaataaattaaggactaaaatgctagacagctgacgcatcaaaatgagatagacacaggagaaatgtgtcagctgacgccttttgaccccaatgcccagagactggcactagctggtatatttttaaatcatgattcggaatcatccacctttactaattgaaggctcccccaagaagataaaacaaaattttattcacgtagtttttaattgcaatgtcacaattataatccacacaatacaatttcagttgtttcaaaatttcatcatataacattccggttgaagccaaataaataaaaaatatgcaatagtgcccacaaacgtctgaggtgggagattgaaatgccattttgtttttactgacatgagggaagtgggacagaaatttctgtacgttaaaaggaacaggaagggccaaactatcaaaataccatatggtgttcaaacgcggaatatacagtgcgacccaatgcgcaccctcttggcgagcctcatccgtgtagatgatcagagatgcgggaaagggtcggtgacgctgttgtaattctatcattttggggatccgatccacgggaaaacatcctctgaagcactctctcgttgtctgacaagtggaaagcatcctctctatttggatgttgttcatttccgctattattgttgttgttgtttttgttgttcctagcttcgttagagttggtgacttggtcttttgtctggtgatttatttttgttttatgtataaaaattgagcggatggcgtacagtataccgcacagcaatgtaagtagaataacaatacagcaaaatacacgtgtccatacccacacgggcgatccgccacatcctccctcctcagagccggcaacactgctgcacaatgatataataaattctccgatccatgtactgctactgccacctccatatgtagagtcaagcgagtcactgtataacaactgaatggttggtttcacggtagttgtagactatcctaatattgcagacaaagatgacactgatatagctgtagtcgttggagaagaagaggaggcggaggctaaccgtctcatatactctttaaactcgagtagggtggtaggagtgattgtaacggt

SEQ ID NO: 24622 - DNA, 1254 bp, Heterodera glycines
ggccctcgggattttggcctaatatttgaaaattcataacaaatcgaagggttgatcaattttacaggaataaagccttaaaaatagagaaaaatcaggagaattttatggactttatttggaatttctatcttctaaagaaaaaaagttattccagaaattctggaaattttagatttttcagaaaaaaattcagaactcccttctgaaaagtcattctgtaaaagtaaaatactacaaaaatccgcaatttttttctctataatataaattttatttggcatttttatcacttttttgagagatgttacaaaaataaaagtgattttgggattcgggaccaaaggggggtgaccaggatttttgagtggaaaaattttttcaccaaaaatcttccagaaacatgttattagggctattttatgacgctgatcacgaatacgtgtgatcagattttacttttgacatcgtttagacctcagaatccctgtgtgattggggattctgagtcatcttttgggggggggggcggcaggttcgaatccggccggtgtaaattatttttctttgtattttttgggttaattttcattacttttaataaatttaaatgtttggttttattttcaatgattttaattaatttaaaatattttgttgagttaataaataaaaaattatatttaatttaattttttttgataaataaattttataagtttaaattaattatttttttaattgatagaatttcatgtatttttttaattaaatttgttaaaaaatattttcgttttaatttaatgaatttactaatcactgttgtacctcttctaatcactgttgtatcaatttatatttaaagatttgttgtaaattaataataaaagaatttatgtaaaaaataataattatcttttaataaagaatttcatattttttttaattgaatttataaaaattaatttcatattaatttaaatattcaattcttgtacatttcaaaattctctttttaattaataaaaggaatgactaatttattttttaaaatttataataaattgcattcaatttttgtacctctcctaatcactgttgcacctcttctaatcactgttgcacctcttttagtcacttttgcacctcttctaatcatttttgtaaatcttctaatctctgttgtacctcttttaatctctgttgtacctcttttaaatcactggtgtacctccttttcatcatttttgtacc

SEQ ID NO: 24623 - DNA, 2164 bp, Heterodera glycines
gactagtaagtaaatgatcggaaattggggtgatgatgcgcgatcataaagataattgaaacattttgttcaaaaaattaagtaattgatcataaagaaaatactgatgaataaagcacacaatgggagtaacattagaaagtggccgtaaagtgatcggaaaaattgctgacaggtgattgatcagaaaccaaatgcttaaatttatttgcacaattaaacaaaatgatggaagaaatgcgatcagaaatatcaacatttatgatcagatattattaacatgcccaaagagaagtggggcgaccggaaagactgactgattagaagcagtgaacaaagcacttttatttcaatttgattatttttattgatcaaattcatttaataataagcatattcattttactttgcactttacaatatttgattagaaaagtgccgaacaaaaaatgatcaattaaactcaacaaaatttaaaaattcttcggggttgatcggggccgggatttagtctgggtcccgactcgaaatccttccggtcccagttggccggtctctactacaaatctgtcagcaaaaataaaaattttgtaatttttaaaaattagtattaaataaatcttagaatcgcttgacctaaagttcctttaaattttaagggtttttacgtgttcaactaaaaaggcagaaaaaaactgcaaaataggcactaaataggcacaaaaatcctcaaataggcaaaaataggcaaataaaattttttgttaacgctttttaggtagcaaaacacataaaaattttcagttgtaaatgaaattattaaatattttaaattccaaaaattttttaagaaaaaatattaaattttctggatcaattaggcacattaggcacaaaaaccttgaaataggcaaaaaaaaggaaaaaaaggagtccctaattattaggtatttgtattataaaaatatttcatttttttttattgccatttattattttattgatcgattcaatttacaattagcatatgcataatccatgccattttcttatgatattgggcctatttctttgtagtttatgcaatttgatgtctttttgacaactacaaactggataagaagatcagaaacaaaatacaaatatttgattagaaaagtgccgaacaaaaaatgatcatttaaatgctataaaatataacatttgaaaagtgccaaacaaaagtgatcatttacatgctacaaaacacgaaatagacgttcggcgttaaagctgatcattttttatggtccatgcagaataattttttgcataatgatcatttaaatgctacaaaatacaatttttttagagtgccgaacaaaaactaataatttaaatgctacaaaatacaaactttgaataaaattctgccccataaaaggggtcccttgacctcagtccccacattcattcattcatccccaatttccccctccccattcgttcaaattaccaacatatttccctcaatgaagaagcattttggcttttcactgttctccgttggcattgctgctgggctaatgccaatgcttttcatgctgatgataatgccttcatccactgatggccatgaggtgttcgtgatgacaatggatgaacagcttctcgaagagcatggcgatcttttaaccattgagttgaaaaagggagcgagcgccatttatgtggcaactttgaagcgcaagatcgcggaagagattgacagttttcactctattcgtactatttatgcacatcaactgacaattagactagacatggtagccattatgacattgcgcttgatgacaacaaaacaatgaaagattatggcattggaagactcggaatcgtttatgcttcgacttttgaatttgaaattttcgttttgcatggtggcaaaccgtacaccatcaagatgaacaatggaaacacggtgcaaacactgaaacaaagaatcaaaagcagaattggcattccgcccgagcgccaaacactgagactcaacaatccatatgccaaagtgcttgaggacaataaagaaacaatggaaaattgtcacattgaaaaagaaacaataattttcttggcattggatgaatgtgaaatcccatgtggattatttatcggagcaaacagt

SEQ ID NO: 24624 - DNA, 1460 bp, Heterodera glycines
  misc_feature (124)..(124): n is a, c, g, or t
  misc_feature (1437)..(1437): n is a, c, g, or t
ggaaacgcagcagcagctaaaaatcagtagaatgtgtgtgatgacacccatggacttaccaaatacatttttcacaattatttcaaataaattgttaaaaattgttactgtatgcaatacggcncagagcagggtttccacgggtcaccattattactagatctgggatttttatttgttagaacataaaaacacatattttagtgttttgacacataaaagtgtatcgcacatatttttgcgtgtcttcaaagatttactaataaaaaaggcattaaattttaaaattatgaaaattttcgtcgatgtaaaaaaatacaatttataacaaattgaacatttttattccataatttacagagaaattgcatttgaacaaaaattggtttttttgtttttatttaccgggtattggccagagatgataatttattttaatgtttttaaactaataatttattttaattattaatatttatttttaatttaattggtatttaaaaagaataatcattaattttaaaaaatttaaaagatatttgcgttattgcaaatactgccaatgtgtcttttgtggcaccccaaaaatatccccaaaccaaaaattaatttaatcaaattttttagagccatttattccttcaaaattatagcaacaataaatttactcgaactcacattcaaaataaacacaaaaaagcaaaaaggggattatggcaaagggtcttctttcaaaaagcaactgttgcacttggttgctttttcgaacaccagaatcgaatgatcaggcccctgattcatcaactttctccgccgatcctgcagaagaagggcttggcaggccgaagcataaaataattaaataaatttgattattcatgttaatgtttttttggataaaattgatcattgtcattgatgttattattttttaaataaatttgatcattcatgataatatattgtttaattaatatatattttaaatttaatttaattattcattaatcattaattaaaaacacttcgaaaacgtacttgcactactgcaagtactgccaagctgtcttcatcatcgttagaaactttcaaaggcacactcatttcaagtttacaagtgggtaattgagctttttttattatttgctcaatgtccgtaaaagaaggcagttggccctgctgctgcttctcaagcttatcccaattccaaatcacaatcgttttttctaacaagtcagcgctcatcgacaaattgcgaacagcacttacgatcttaagagcaattattatgacctaattaatttgttttaactttgccttgaagactttgcttttcaagcgtggtaaggcgtttgaaaggcccaaatgaaagaaaattaaaaaataaataaatatggcattttcgacattatggcaactcgtaaaaaatttttgaanaagtatcatttatattttcaaaa

SEQ ID NO: 24625 - DNA, 1988 bp, Heterodera glycines
atatttcacgtataaaagcaagtaaatttgaatattcttattatatatatatataacaaaacattaaaataataccaaataaatccaattactaataaataaaaaattttgttttatatatttgttaataaaattatttattactaactactttgaattttgaaatgtaagacacctattgaaaaatattttcatttcgagaaaaatgttaaaataatagacaacttccattcttttgctaattctcaacgaaaatgaagaacgtaaacaaaagagcactgttgtgtccaaaggacaaacaaaaataatatttatttgacagagaaaagaaaatataattttaaagtccaaaatcagaaaattgggaaatgcgacgaatgaatgaaaaatgaggtagggttgggaaatgggatacagtatgaaatggatgatgttcattcgtgtcaatacataataaaacatttaaattcctatcaaacatctccccttttaaatcatttgtcctcatttccgttttcgtctttccacgggttcgggtgagtaacgaacaaccggacgccgttcacggactggacgtggagttgggggacaacggacggttttcggcgtttgtgggctcagttcgtcgggttcggctggcaaattttgttcgtggatcagttcaggctgatggatctgatcattttgaacttttcctgcttggtagggaacaaaagaccgtaattgattcacgtgtcgagtgaccgtaattcccaatgttggaatgtttaccttccaaatcaaacctttcccacttaaaattttgccttccaaccaacttggcttactgtgtttaccatagttcaaagcaagaaccgagttaccaggcacaaattgtcgatcttttgtaccgtgatggctgtcgtactgctttttcattccgtcttggtactgacgattttgttccggtttgttttgttgttgtgaaggtgccaaaatcgacaacggagttcttggagaacgaccaagaaaaagctcagctggggaaaacccatttaaaatattattcggtgttgtcctataggcaaagaggaatcccgaaatccaattttgttttttggatgtggaatttttcttagcctgtcttttgaatgtgtcgaccatgcgttcagcctgtccattacaatgaggctgataagggggagaaaatgtgtgtttagtccccttggacttgcaaaattgacgaaattcgtaagatgagaatggcggtccattgtctgacacgagttctttcggcgctccgtagcgatgaaagattttgttcaacatatcgatcgtggccgccgcatttgttgttctcatttgcgttatttcgggccacttcaaaagagcgtccaccaggatcagatatgtgttgccatcatgacaagggcctgcaaaatcaatatgaattcggccaaacacttcttccggtatcggccaaggtctcaatggagctttttggggaagttttgctgctagctggcagtccaagcagctttttaccatgacttcgatttcatgatccaaacccggccaataaacgtgttttcgggccagtgccttcattcgaacaactcccgggtgtgcgaaatggagggtcgtcaacggaattatgactctgtttcctgtcaaaaaggatccgcccacaaaagcgagtgaattacgtctaacgaaataaggcattaattcgttggtggggcacttttgtggccaaccatttcgaacatacgaaaacacttgctgtagaagatcatctgcagcagtttgatcgcgaatttcttcggcttcaacaggcaattgttccaaagttgtcagatgaacataatttgttgctgcttcgtcgacatcaaacacgtcattggatgaagcaaatgcgaccacgacatcttcttcagactgtaaacgcgaggcagtataaattggaaaacgtttcttacttccgaaaatggctaagagaggtttgtgat

SEQ ID NO: 24626 - DNA, 1465 bp, Heterodera glycines
agtgtttggtgccaacatattcgtggtgccaaaaactaaatgataattaattactactttcatctgtttttttaataataatttttcctaattacgtcgagatcaggctgaaggcaaggcgggaatttcttggtccaaggaaagcacggaaaaacattctgaaaaattcaatgaattctaaatttttaaaattcattgcctaaccccctttttagccgctacggaaaaggcaaggcctccaattttccaaaattgcttagcggcaataaacacacgcttggggtgtcaaattgccgtgcaacattttggcattgttgtgcaggtaagagaggccttcgatcagctaaaggacgacgcatttaaatccatttaaatcacttttcgtttgagtgccaaaattatatggacatatcgttttatgaatggcattgactttttgctattaaattatatttgttccgtttgctttgcttttggcttaattagcccaattaatggcctccaaatgggccccgtgcctggagaatgccccgcttcatctccagcttctccaacaagggtccgccggcatcatccggttcgaactgttcgtacagtttgtccaacgtgcattgaacaggttcagtagcaaacgcaagaaggtctctaagattgagaaaataaaaagatgagtcatcaatttgcattgttttggccatgtcaatgtgccattggccatgccaatttggcattgttttgaccatgcaatgccaatattttggccatgccaatgccattccctccccctcatttcccatgctttcacttgctctccgtcaacggcttcaccattcgcacaatacgcggatgttgcaactgttgcagttggttcagatcatagcgcaacaaatcgaccagtgaaagccgacttattctgccgatgcgcgtcggtcccttcacattacattttttgtcgaacaaaaacagagagacatcctaagaaagaggaatgaaatgggaatattgaaaatgcaaatgtttgctgctgccttctcgttgtcctgcgccatgttcgattgtgccaagaaatggtgccaatgtccgccaacaatgagaccggcactttgaatgctgttgaggtgcgcgtccaaaggggtgccgcccgggggcggcatttgcatgggccgatgagcagcagcggaagagggggactgaaaggagggggaagcaatcaattaattaaccaattaacattgattaaggctaattaaatgaattaaaaaatcgaacgattggtgaagagggcggaatggcgccaccattggcgggcagtgtcatggatgaagaggaacaggtggagctccgcttcgaattctatgtaaatcaatgtccttttatggcttcccccctcccctttgattaccatttttgcccattcattccaacgtttcatctcttaccgtattctgttgctgcatggactgtt

SEQ ID NO: 24627 - DNA, 1331 bp, Heterodera glycines
ctgctgcacaattattattattatttatttttttaatcaattaagtgcaaatctcccgaagagaatgacattggcaaaaatggacagcagcaacagcaagccacttcaaccgaatgaatcaaagctccaattaaatttaattagtgtcattagggtgggtcacggcgaccgtttcactgaaccgaaacaaaccggctttttgggccaaaagctgaagcccgacgggtcctaaccagaaaaccggcttattgggccaagagagaggtccaaaactggccttacaaaacattttgggggcttaaaattgatgggtccaaaagcggtctagccgaatagccgacagtgacccaccttaatattcaaatgtaatgtagtggaattttatgttgttaattttaaagtgctatattagtaactttcccgtcgaaccaagttttctgcgtgttttgtttaatcaaaaggccaaaggcatcggcgtgtgctaaaaatgtaaaaattttttttgttaaattcttatgaaaaaaaaccactcaaaaattttcggacatccaatttatctctcctaaattagtttttttttgttttgttgttgcgtactatatgccagaataatttaagatttgatgtattaaaattagaaaaagccaaaaccctggggtgcatttggtgaattagcgccatatttaggggcgaggaacggagcgaatttattctggtttcctctcacaaataacttttttattctcatcaatacgcgggtgaaaatgaagcacttgatgaaaagaaaaatcaatcgttgatgggtcgaaatcataaattagactaatatgtcttatgacagatatcctccggccccgtatgcagcagcggccgccgcgttgtagtaccattgggcgtatgccgcggcagacgcatttgaatacatgggcatttgctggaatgaaaaaaactttattaattatatataccttttaattatgtgggggataatagagtaaaattttaactcccaaaaaagcaccgtattttttccgtaaaatccgtaattgcgtgcagccctgtaaaacacattgtcaacaacaacaaaaaaactaaaactgagtccaaaaaaacaccgaatttgccaaggttcctcaaaccattcaatttgacccaaccttctcccccttgaaaaaagatgacagtatttggaaacacgattcccttacccaatcggatcatggaatcaaagttctccgacacaaataggatattaataaccattccatgaattaacgaatgaatgttttttttaacccaaaaatggaaaaaaacaaataaaaagcgtcccc

SEQ ID NO: 24628 - DNA, 1652 bp, Heterodera glycines
  misc_feature (43)..(45): n is a, c, g, or t
  misc_feature (58)..(58): n is a, c, g, or t
gaaaaatgaaattaatgtgagacaaaagcgattttgtaattannnattcaggaattcnatgaaaagttgccaaattgggaacgggaattgaaatgggcaaaattggaactggaaaatgtgagtttgctataaaaattgagtaaaattataaatgcaaaaatttctaaattattttagaaaggcacttgaacaaaaagttaaagcaccagggaattggtaggcgaacagaaggcattgaaggaaaaagtgaccaaaattgaacagaaaaacggtaacggtagagaattataatactgtaatataatggcttagaatttaattattggaatattaatatttatcattaaaactggcaccacttaaataatttgaccattggataaaaacaaatgggagggattattgtggattttctataaaataatgtttatgaactcaggttatgaaacctgttcccatggattcggaatcactgtgttcacaaattaccatccattttgacaaattttccgaattatttatcccaaattcgaacccgattcaagaatccagaattggtagaaaccataaaaaaagaaataaccataaaataatttgacaactttaaaagctataaccttttataacttgacaacaattttaaaaaattaattgaaaatttgttacaaatttcagtttcggacggtcatttgaaagcaattttggagagaattggtcaattggagaagcagcaacaacagcagacaaaaggcgaggagaaattaaaatgaaaaagtattcaatcgaattaaatgcttccattttaaatttaaaaattaatccgatttttaagctactggggggcaattgtcaaagattttggaaaaaattggtgaaatggaaaaacagaacgaaaacacggacaaaggcgagggaattttagcgaagaataaattatcacttattaaaaattctttttttttgaataagtttcttatatgaattaagaatttcatttaaataaattataacatttttaatttttgaaaattaattttaggaactttggagcaattttcaaagatggaaaatgatcagaagaacattttggaaagaatcttcagtgaattggagaagcagacaaagaaaaaggtgaatgaattggaagagaaaataaaaataaataaatttaacggtaaaaataatttttaatttatttaataaattattatataataattattaaaaaatatcgaattatttatttcaggggtttttaaaattccaagaaaattgttattttgtgtcaactttttggctctaaattttaatgtcttacaattagtaacatttttttggcaaaaaaaaatcgtttaatttcggcagaaggcattccaagaagagcttgagaaaaaggtcacggaacgaattgtggcagtgcagtcgaaggttgacaaaatggaaatggcacatcaacagcaaaagggtaagtaaaattggacaaggattactgtactttaccgtatattattgttattattactgtcaaatattaattgaatttgttccaatttaagttgtcactgaaaaggcaatttttgagcgaatcggtgaattggagggacaacaaaaacaccaaaaacagcaagaggaaagggagacaaacggcgaga

SEQ ID NO: 24629 - DNA, 1637 bp, Heterodera glycines
  misc_feature (1620)..(1620): n is a, c, g, or t
attttaagtaaaaaaagcaacaaaaaaattgttcgaattcgggttcggggttcgaaattggtcgaaatgaatattatattcgtgatcagcgccctcgagaaccctaaaggactttgaagaattgcataaaaccccctttttgcctcttttttgtgggacctgtaaaccatactattacgccaaaaataaattttaagatttattttgtgttacatagttgcatatgaatataaccaatggtcagtagccatcaactatcgatttgtattttaatatttcctgtaggaccagcgaaaatatgacataatgttggtccgataaatatcggcgggttcaaacattttttaaaaccgcttttggaagcaaatgccaaaatatcataaaattaaaacccaacaaaacttaataataatttaaatataacaactttttgccacttaaaacgatatggagacaggggatgaacacatagcagcgatacgacattataacatgaatagaaaaacaataataatgacgaaaacaataacaaaacgctccattcgtcctatgtgactttcgctattcttccactgcaaccaccgattgcatattgtcacggaaccaacgcgcattttcaagcagggcaccaagacggacatgcagctgttcccactgggcacgttggaacactcgctgaaaattttattcattaatacatcaatttaatcaactttttacaaaaaggagcgaatccctggggcatgatactttgccttctccatttccccgttgtaccctccccaaaattgagaacaattatagttttctttgtgaaatcgaaatttaattattttactttcttcgattggaaataattagagaaaattttgttgttcgagtcggaggcttagacctgatgaaaagattggtcacctgttggtagaagctgaccatcagttggtcgtccaactcgttgattttgccttggatggcattcgcgtggatggcatcgacgataaattcctccaaatgatcgcggtccgaaatgtctaacgcgttgaccaaagtggtcaatgggatgtgctgatggattgaagaaaaaatatttatttatagtttgtccttccatttaatggcacggattcatcccatttttgttttttaaaaattttctttaaaatgtttaattttctgcgttttaataaagtttcgaccacaaaaaaagagttctatcgctattgcttaaaataaaaacctgcgccttctcggccaacaaaatcagtgtcaactgtttcatttttgtctccagtgtttgctcgtcctccacccggagttggtcacgcacaaatgtcggatggtcggcgacgaaacggcgatagtccgccaaagagccgtagacgaaaataccgagcatttggaacattaacggatcagtctgttggtgaaaaagtattacttttacgagattaatacggggagacgaactgctcgccaacctttttgaggctgtttaccgcctccaggcccaacaaatggtcaaaacagaaagcttttgggtctacaattgttgtgcggacgcattcgcgcgcgtcttcttgcgcagtcggcgcgtcttcgggcgtgtacgtcttcaagagntgtgcacatcacctgca

SEQ ID NO: 24630 - DNA, 833 bp, Heterodera glycines
aattcatacactaacttgaaataactaatgagtagggcttccttttataggcacaaaaaatcgcgaaataggcacctaaataggcaaaaaaaaatttattaaccctttttaggtagtaaaacacgtaaaaacttaaatatttctatttgcggcgctgacatttgaggcgctgacatttgcggcgcgacacttgcggcgaggaaattagcggcgctgacatttgcggcgcgacacttgcggcgccgacaaatgcggcgcccagtcaaaaggacttttgcggcgccgacacttgcggcgcccattcaaaacgacatttgcggcgcaaaaaaaaataacctcaaaaaatatttcaacaaattatttaagttaacagaattgttattttaatagtttcttttttaacaatgactaataaagaggaagggcaccaacaaaaccgcctgaggccttattgaattgacccaactcgtaggacacaacccgtcagtgggccccggcacgtttgggccccagcggttttttgggtataacttttttctttgtcaaccaaatccgacgacattgttggtagctttctgttcggtccttcaataaccgaagcacaattaaaagtccaataataaacaaatatttattggagaacacaaataataaatattgattggagatgcagagaggtcggaggacaataataatgaacatgcaaaaaggacgggggagaaacatagctggggaatgtagtgtctgacattgacaataataagcagacacaaagaaaatagtgaaataaaaaaagggagagaaaaagaccaaataaataaatttaaataaat

SEQ ID NO: 24631 - DNA, 1652 bp, Heterodera glycines
  misc_feature (38)..(38): n is a, c, g, or t
tttcgccccatgttgattacggacatattatgcttgtntaggacttaccagcacttttgtcggcgccgttctttggtttttggaacagcgcaccgcctttcgtcttaccaccgttttctccgcttgcatcgacgagttgtgccgtcaacacaagtcgcccggggcggcctcgcgttaccgctttttgctctgggcgaccgtgccgtccgcgtcgttgcgacggcgcgcatcactgtccacgcggtggggctccttcacgagtatcggccacgtcgaccaaacggtcggatggaagcgaaggcgacggacgctgcacagagaaccgcgcgagttggacgtgtacgagttgcagcggcgcggtgggctgcgcaaggtgaagagcgcgtcctcgcggcgctggtccttcctcaaccgcacgatcagcccctgctcgggcgcctcgtcgcctggcctcccctccggctccatctctccctctccgtccgacatcgtcgaaaacggaatcacgcccgaggcggaggaaaacgcgctgaacgaggcgatagcggccaactcccacgacagcaccgctacaacaatggcgggcggctcctcctcatccgcttccggctactgctccaacatctccggcgcttcggcatgcactcgcttatcggcatcatttacagagccggaggacccttcggcaccatttgacccgccgccgccaacgccccacccgagggggcccaactcattggtcgtgatgccgagaaatcatccaccaacattcactttcgatcggaatgttttggaacaaaatgaattggacggcgatgacgaaagggcgaaaaaatgaaaggttacccaaaattcaatttacgaatttttattggcttatgcttttttcagattatctcctttcgattgatggacggagatcgattgatcactcggtatggagtagtgatcaatcgatttaccaatcgattgatcactcattttgatccgttggattaaatcgaaaggatttaacggacaaaacattaaaatgaccagcacagaaaaaagaccgaataattaatgaactgggctttgtctggtcacatcgttcgaatttgtgctttgatctcagccgccagatgacataaattaaaccggggaaaaaagcgattctttcaaaaaatttccatgtgtcgttttttgctcaagaaaataaataaaaatcgtttcacacggagagaattaattgaccaaaagaaaattcgagaaaaaattaaaaatttgaatgtgccaaaaaaagcagaaagttttccaaagttttatagtcatttaatttgacgacttaaaatggcaaagggacaaatcattcccaaagcgcataatttttaaatgagaaaacatcgttcctaacaccagtaattaattaattaattacttctcaaaatccgctattgcttcgccccacacattttttttgttaaattgtggccaaacaaaatccatgctgatttgcacggcactgttcgcaatttcaccactcaatttgtttggctttgtccccttttgcgtttcgattttcttcggatgactcactcatcccacccgttccgctgatcgctcaccttcggatggatgaagtgagtaaggttcgaaggcgggactgacggacg

SEQ ID NO: 24632 - DNA, 1660 bp, Heterodera glycines
attttgaaaaaaactatcgaattttccttttttattttaccttatttaagtgaattctaaaccaaagagaaaaaatgcattaaaaattgactatttaattgttttcaaatggagcccttccgcttacgaccataccacgttgaaagcacgccatcccgtccgatctggcaagttaagcaacgttgggccttcttagtacttggaacggagacgtcctgggaatcgaaggtgttgtaagcttttttaatctttcctttttaatttttataggtgaaaaagaattaatttttttgttgaatttatctgctcaacatatgatttattctgtataaagatctatttttcttcatttaataacatttatttgttgtctcagaaagtgagaaaaaataaataaataaataattaaattgttaaaatgtatgatgaaaagtgaacaaaattttttctcaaaataaaatttgttttatccaaagggtcaggaaaatctttttgaattccaaggagcagctataaaagtcatgctaaattttataatttcagttttcttaaaaatcattgaattttccattttatgtccattattttttctccgaatatcttcagattaaaagaatgtcattcactctctgattttatcgggataaggtttaaaaagcgtttttagtttggttttgaaccattagtttgacttttatatccccattttgccttttggcattttgtgccggaatggtttttggatttcttagcggaatacaataaaattggcacctcaaaagaatgactttaaccactaaaaatggttgttggataactttcttaaaatcaccaaacctaattttcttatgaaattttggtttttgaggttttttctaattaaaaaaattgaattgggcctaggaaaaggcttcatatatgatttaaagagaaatttcaaaaatcccgaattttgaaaaaaactatcgaattttccttattatttttaccttatttaagtgaattctaaaccaaagagaaaaaatgcattaaaaattgactatttaattgttttcaaatggagcccttccgcttacgaccataccacgttgaaagcacgccatcccgtccgatctggcaagttaagcaacgttgggccttcttagtacttggaacggagacgtcctgggaatcgaaggtgttgtaagcttttttaatctttcctttttaatttttataggtgaaaaagaattaatttttttgttgaatttatctgctcaacatatgatttattctgtataaagatctatttttcttcatttaataacatttatttgttgtctcagaaagtgagaaaaaataaataaataataattaaattgttaaaatgtatgatgaaaagtgaacaaaattttttctcaaaataaaatttgttttatccaaagggtcaggaaaatctttttgaattccaaggagcagctataaaagtcatgctaaattttaaattcagttttcttaaaaaatcattgaattttccattttatgtccattattttttctccgaatatcttcagattaaaagaatgtcattcactctctgattttatcgggataaagtttaaaaagcatttttagcttggtcttgaaccattagtttgacttttatgtccccatcttgcct

SEQ ID NO: 24633 - DNA, 1866 bp, Heterodera glycines
aggtaaaacagtgattagaagagatacaacagtgattagaagaggtacaacagagattaagaaaggtaaaacagtgattagaaaaggtacaacaatgattagaagaggtacaacagtgattggaagaggtacaacagtgattagtaaattcattaaattaaaatgaaaatattttttaacaaatttaatttaaaaaatacatgaaattctatcaattaaaaaaataattcatttaaacttataaaatttattcattaaaaaaaaattaatttaaatataattttttatttattaactcaaaaaatattttaaatgaataaaaattgaaaaacacgaaaaaaatggtagaaaaataatgtacaccgcccggcttcgaacttcgcccccccccccctcaaaatgatgcctcagaatccccaatcacacagggattctgaggccttaacgatgtcaaaagtaaaatctgatcacgtattcgtgatcagcggccgaaataacccctaaaatcatatttttggaatattttggtgaaaaattttttcattcaaaaaccatgtgctcccccctttggtcccgaaccccaaaatcacttttatttctataacttttttcaaaaaagtgataaaaatgtaaaataaaatttataaaatagagcaaaaaattgcggatttttatattattttacttttccaaaatatcttttcagaaccgagttcagaattttttactgaaaattcgaatttttccagaacttctggaataactttttttagtttcatgatagaaaatctaaataaaacccataaaattctcctgattttttgctatttttaaagctttgttgtatgaaaattaacttaccctgaggttagttatgaattttcaaaatttaccccaaaatcccgagggtcaaaaaaaatgaaaaaaatttcgaatttttaaaaaattctaaaaattatgaaacgaaaaacaaaggtcatattcgtaatcagcatttcaaaataccacagaaaaaaatttttcacccccattttcaacccaaaaaaaattttcaaaaatttctagggggcctagctcgaaaatttttgaaaattttcgaacatgtagtacaccattcgatagcattttaaaagctctacaattttgctctaaggcaatttttggctagaaccaacccccgacgagttatgggcccgggactcaaatgtcccgcttaggccaaaaaatttttctatttcctggaaaaaatcgaaaattttctaaaaacatcactaatcgatagagctcgaaaaacgatgttttggaagtggtcttcgttttccctggaaaaatcgttaaaaaatcataaaattcaaaaaccgaaaaaccgaattttaggcctaactcgaaaaattttgaaaattttcgaaattttaaaatttggaaaaatcaagctcattgagctctacaataagtctgctggcgacccctcgctccgagcaaacccttacgagctattcgcctggtactgaagtgtccaaaaaaagtgattcttacgttgcataacctacaggtcaggcctttgatcagatcaaaaattttttgctggcaaagttgtaggccatagttggggcatttcgcttttggggtccgctaagctatgaaagcaaaagcaaaaaattttgtaacactgagactgacggcaaagtcggtttttgatccgctggtactcagttggtccttggaccggaaaacctatattttttatcggatgcgcctcaaaaagttgtaagacctttccactactttcagggcgctcccggccttcgacctgggagattttgtattaacaatcgaaactcctcgtcaatataacatatatagtaa

SEQ ID NO: 24634 - DNA, 2073 bp, Heterodera glycines
  misc_feature (30)..(30): n is a, c, g, or t
  misc_feature (1951)..(1951): n is a, c, g, or t
  misc_feature (1981)..(1981): n is a, c, g, or t
agcccgatgttctgcttttgaaaaattttncggtcgcatcttgcatttaaacaacaaaataaaattcaaaactaaaaatgaacagaaaaaacaacataaattcaatgtcatacataggcgcagatccattattaattcactgttattttgaagtgttttcatttttcaggtcgattttggcgatcagttcgttgatcagtttgtcggtatgcaaaactaatctttctttggcgacttctcagcctcacgcaatttgtttaattcgttcaaaatcgtttcagttttttcgtgtgcaaatcgatcagatagatggacaagtgcttgggaagcagggctggctgggcgtaactggattttcaattatggaaatccgtaattacggcgaatttctcaattacggattccgtaatccgcagggctcccaagtgtgcttatttctaagatttgtgcttatttcagcattacgtgcttattttgggatttgaaaataaaaaaaatgcaaattttaatgaatgttttgaattatcgtcttttattgaagcgaatatttgaattactaattcgattttgaaaaaattcaaatttatttcgttttattgagtgtaaaatacccaaaatttcagagaaaatctgtaaaaaacagtcaaaatttctatttttcctccggcggcgcttttcggctccgcgggtccccaaaacttatttgttttcttaaaaattggctcaaaatctcaaaaattggtcattttctggcggaactctgttaacaaattgggcgctacttaaaaagagtattcttttgaaaatttcacttttttttggtcaaaaattttttttgttagttttgatacagaatttgttttttttaacagatggaacgaatgacaaaaaaaaacaacaaaaaaagtgaaagattttgaatttatcaaaaaatcatagagacccttttgttttgcaaaattttgtgaaataaaaaattgtgaatatatttttattcgcaaaattatgctcaatgcttaaatgtgtgtaaaagtcaaaaattctctaaaaaaagatcatttatattatttttagaccaaaaatgcgaaaatttgagctttcgactttttgctcgaacccgggttcggggttcgacataggtcgaaattaatgtcagattctgattctccgacccttaaaaccacttatacaatgttttctcgaaaaaaaaaattttttggggggtataaactggaaaagtacctaaatttctaatacattttccccgcattttcagttggctgtgcaacgacatttggatggacattttgccgctttttcgtcgtcctcaactcggccgaaaattggcacttctttcgccacgtttcaacgcgttggtcgacaaacatttcgacagcaaaaacgaactgacaattttgaaacaaatcagaattgacaagatgaaaacaatgccgaaactatgtgtagttaagaggggcattggaatttttaagcaatttccaataccagaccatccgatgcacaacaaactccgttttagcaagcttcagattaagtaaatcaaatcgctgacctacaaaatgtccaggccacgaaatgtcgacaagagtaaaaacccacgaaatgtccagaaaaaaaaacaaaattaaattttataaaaatctggaaaataagttcaccgactccgaaaaccctaaaatagacttacagacttatttttcggatttttataaaatttaatttcgttttttctggacatttcgtggcttggacacttactttgtgggggcgccaatcaaattcaaagaataaagcattcatcattttttaggtacattgaacattctgtcatcacatttctctgtgccaaccagcaaatttttgacaacgccatcaatttggatttgcacgtgtcgcctttctcctatacccccaagaatgtgcacccaantttggagtgtttttgcccgcaaaatttggnccatttttgcgccaaacattcgccatttgaaacctttgctgatggtcgtcaacttgaaaatttgcttcgctacacttcgccgacaattcttt

SEQ ID NO: 24635 - DNA, 1389 bp, Heterodera glycines
  misc_feature (1307)..(1307): n is a, c, g, or t
  misc_feature (1371)..(1371): n is a, c, g, or t
aattttgtagtataatagagatcacttagggctatctaaagattccaagattattggatttggttgacaaagaaaaaagttatagttcaaaatctcgccccacgcgaaaacggccccaacgcgaaaacgaccccgactccccattttcatggtttttgattaatgtcccagcaccgcttcaaacaaaccgtgctaggatgaagtccgaataatgcaaataattaaattgaagcaaaaaaaaaaattatttaaaatgttcaaacactagtaattaatcaatgtttccacgcattgttttattacatcaccatttctttagaaagttcaaaaattaggaattggatacataatgagtaataagaaatgcacagaataatagccagataaattaaggcgcctttcggcaccgccgacgccccaaaatgcgtcactttattttttgttaattgactcaaaaactgcgtaaacattaagaattgaacaatcttttttgaatttaaaaaacacattaatgaataaaatcagaaaataggctgaaaaaatattaataaattggctaagcatcgattgtttcttaatattattaaagaatatttacgtaccacagtttaagatcaatttatttttatcattttaaataataaatttataatatttacggttaaaacatgtttttttaaattatataaataggctttacaatttaaataatgaatatataaatatttatagttaaaatatgtttgtttttttaaactaggtgcttgctaatacattatattaggcattataatctattattcttttaatgacgaaaatggatttaaaataataattgcggccggaagaaagtttcgtatttatgcagaaaattacaatttatttgaaataaaatttgtgtattacaaagggagctctaatttctacatgataatatgaataaaatataaaacaaattttgggccaaaaattcataaacaaaattcctaaaaaatttaaaaccattaaaattccaaaaatagaaacattcccttttttaaaacaaaattttaacatttctgattttttttttttgtttgttttgatttaaacccaaaaatttttggcctagaatatgccataaataattattcataataatgatttcataataatgaaaatgataatgctcgtcgtctagtagagataaagcgaatcgaacacgccaagacccgccccgatgccgccctcgttgctggatgcgcacttggtacggatcatctgggcaggctgtgtgtactctaccagggtgcctgccttggtgtcantaacacagtaggtgtacacgcccaactccgtgatcacatcgctgaagatcggcttttcattggnccaaatcaataattctga

SEQ ID NO: 24636 - DNA, 895 bp, Heterodera glycines
taaaaaaaaccaatacatatgcacatttaatataacgtaccacttcctaagaccaagtgtgttccgattgtccctttctcacctcgcttctgcttcaacaaatcttcattttcgcctcatattcgctgtttttgtgttttgatttgaggtggtttattgcattggatgtgttgcctttcttacatataatattcttacaacattcggcacattcgtactcgaaatcattgttgttgctttttttatgaagcccgatttgccaaatcacacttccagagggcatgttgactattgctgtaatgttttagatcaataaattaaaaaaagaaatgaaaattagtgataaacttttcaaaagtccgaaaacttaatcaaaaaccatcgaatttcaaacagtatattatgccaaaaattgttattaacgggttatgtcgcttcaaatcgccagtcggtttttttcggtttttgaaaaaagtcggtcggttttttcggttttttgattatttcggtcggtcggtttcggtataaaaaccgaaaaactcaaaaatttctcggtcggttgttttcggttaaaaaccgaaaccgaaaaaaaccgaccggtccgatctctaatgtcaatgtgatgcactaacctctacaccacattccaaatgtccgaaattgagcaaattttctttatttaataaaaatttggcaaatggttaaaaaaattcaaatttcgtctaacttttttgcattttctcccacgaaaaagccattcttaggggtgtatatttaaccccgaccccgatcggggttaagggtcggggttcggggttgtcggggtatgaagcgtcggggttcggggttttccccgaaaatggccaaaaatgtcggggtcggggacgcaacccta

SEQ ID NO: 24637 - DNA, 1894 bp, Heterodera glycines
  misc_feature (16)..(17): n is a, c, g, or t
  misc_feature (101)..(101): n is a, c, g, or t
atcaaatggaaatgcnngattcgtggttcattgggcttgctgctgcaattggcgtggcttaccttttagcccagtcttacaagaacatgaagcatgtgtgnaagcatcagtgagtcttcttttgaagccattttcttttttattgcgagtcaaaattatggggtttattttaaaacagaatcgtaattaaacgtggtgacgccattgcccgtgagatgaaccgaattctgtcggatgacaaaaagatgtccaagaaggaaaaggacgaacgcattttgtggaaaaagaacgaagtgggcgactacgaggcgactctttttgccattttctacaacaatttggtctgttttccatctttagcaccattagaccgaaattagaagaattagtcaattaatactatacaatgcttatttcactttccattcctattggtgccccaatctcagctctttttcgtgctgctcgtctttctctcattcttcattctctactccatttcgcccatcttcaactgtcttgtctcgatgtatggcgctgcgggcattgttttgctattctcaacttcaaagaagtaaagtgatgactatcattccgataatgtataatttgttattcgggagtaaacaattaaagattgttgtaatttattttaaaaagaatagcatatacatcatttgaaaatgagttacattcgttcgtacaataaggaggattcagttggcctacattgcttgttgaatgcagccaatgtcttttcccgttttcatatctgaatcccttgtttttcttcatattattgtacaattcgatcaatgccttggtaatagtaccgatggtagcccttactcttcgagaacaacttccaaatttttctcgaatccgggttcggggttcaaaattgagcctaaataaggctagaatcgtactaagcgctcggattacatctgaaaataattttctcaataatttaaaaaaagattttcgggaccaataatctgtagcattgcagccttagttaccctagcgttttaaatccaaattttcgtgtaactttttgcaaaaatctagatatagagttccattgacattgtacaacaccggcaaatttattctataaaagtttcgattgtacaacatttgcgtcgtattcatttgtaattgtccatctccgaatgttaatcatgctttcacactgcaaaattttttgtctgattaagagaaccacaactttgattaggtccaattcatcctcctaaattttgtttattatgctttttgacttcacgcattttcaaataatagcctaaatttccaggggacaaaaattagaaaaaaacccgagaatgaaatacctaatactgaaatttacatttgatttttataggggttgaacaatagaaggcccgggcctttaaatagcgaatttacggatcttgtttttttaaatgattttttttctttttagtcattttctaaaatgatttttttgtcacaaaattaattaaattttctaagcagtgattttaatttgttgattttactggaatattatcgttaaaaataagaatttttgcgctaaaagtgtgtttttcgtgcgtttctctccaacaaagcagtagaaaaaatagttaaatcaataaatgccggcccgactaaattattttaaaattttggatactaattaaacaacactcaaaataagtcaatttaaaaccaacattaattgatcatcatcaaaggagttcgctgctgctcgcaatcaaacgagcaaaagtccgttgcaagtttagcctggtcaaataaaataatgaaataaaattggtaatcggtcaatttgaaggatgagttttccgtttgtttagcaaaaatataatttttcatctaatgaaac

SEQ ID NO: 24638 - DNA, 1702 bp, Heterodera glycines
tggacaatgtttgtcttcttgaacggaagtgagtgggctgacaatgagaatgatgagtaagggaacggaatgaatggaagtgaatgatcagcggaagtaaggcgcatcatccgacggaagagcatttgaggcgagggagtggtatagatggacgtggaagaagcggaaaatgaccaatgaatggtcagcagtagcaggggcatcgctaatgaaggactaatgagtgctctccaactgaatgagcagtattttttaaatctcatttcaattcctattcgaaaggcccggtcccatcgaatttccaatcctttaaccgtctcgggagcctgtaaaagtgtgctttgtcggcctcggtctgattggaacttatcccacgcttgaggtctgatagaacttaggcttaagatgtttaagcggtctttttccgtttctccgattcgactgatttttgagttttgtttcggtttgcccccccccgcccttctgttggttggttcgttttttcattttatccaacaacaattcttccggtccaatccaattacattttgtctttgtactatcttactgtacccttcctcctcccttttcccttcccccatttgttcgtctttgtctttcgcctttcatttcatttctcatcattttgttttgtttcttccctttgcttaagcgtgggaagagcttcgtgttcgaacccttgcaaaaggggcgtgattattcgtttcatttcttgcgaatggtcatgaagatttgattagcccaccgccccactaatgacggcaccgttgtgggaaattggcatttgttggcattgaatggcactcttcttgtcctcctcctcctcctcttcccattccccctgcttcttcttcctcttccctcatcttcatccatccaatggcataacggagtcagttggttgccctggtgatccgctgaaaaaccagcggatgggaggacaaatgaggacaatgttctgccaatgaatgggccacataatgcaataaaaggacggcacaaatgttgggatgagaaaaggaagcatttaatgttggaatgggcacgggcagcgaaaggcgagcagaaggggggaattggaaataggtaatattttaaatcattttttgacattccaaaaaatatatcattcggttggatttcaaaagttgaaagtgtttcggtatattcaatgtgtgatgaggggagctccgtccgtaaagtaaggagaagacgtcgttattagtgcgattcgattgggccaaatgcttggccattcactcgtccgaatgtcctccctccccccccccctccgtcgtcccctgtcactcctcccccaacaaattctcttcggatgatgacatttttctcgtccgtcccaaattcagtccttctctccgcacttttgccctttgtgagttgcccagtgaatggatttggacaggctcgacttgcccctcctttggaatgcaaatttgggcgggaaaaaaagggataagaggcggaggaggggcgaagatgggagggatggaaagggatgggaagaaatgggagggagtcggacggggagtgggacggagtgatcgaaacccctcggggggggatatttcttagtcgttacggatatattctctgatcaacaatgctctcaaaaaaacttttccagactatcttgaacaaatctccaaaggttggttgtctg

SEQ ID NO: 24639 - DNA, 967 bp, Heterodera glycines
  misc_feature (891)..(892): n is a, c, g, or t
  misc_feature (911)..(911): n is a, c, g, or t
  misc_feature (923)..(923): n is a, c, g, or t
ttttctcgctccccatagtttgtttgagtaccccaaacagacacttgaaaaaatctatttttttatttcctaaatattttttcataaaatgctctgaaactcaccaaattttatttacatgatataccacgtgctctgatgatttttctatcaaagagggacaacactcacagtttgaaaaatttttaattcctttttaaacaggccaaaaagtttaggcttaacttttttttcagaaactgatcagaagcgccccaaactttccagggatactgaaaggaaaagaattaacctgttttatcacattagcttgtcatcagtttttataaaaaattttcaaaattctgcgtctcctattattttatttttttttcaaaattttgaagggcggggggggggggggtccggcaccccgttttgcgacgttgttgaaacattgcgcaaaacgcgtgggatggcggactggttagttaaatggtatgtacgtacactggctcgccatgtataaaaggccgactaaaagtggagaaggtaccacattgtttctttcattgagagaacagaaggatgtcgtcattcttttatttcttgctgatcgccttcatttttttcaatgttctccatctatcttccggcgaatggattaatgtagagctgagtgtggacccaccaaacttttttgaccgttcattccgcaccatttccaagacttcacctgcgcaacattggttcggctataaccgggacaccgcatgtcatgttgaactggagaggaatatcaatcggctgtacaccaacccggatacatggaacattgccctgacagatgtggataatttaatgagcttaggacggacaacaattgagataccgtcaaccgcattaccatgnngcatgtttttgggcatggncggccatagttnttgtaattttcaatctttcaaatgacgcggggtgaggtgaccgt

SEQ ID NO: 24640 - DNA, 1504 bp, Heterodera glycines
  misc_feature (1492)..(1492): n is a, c, g, or t
aagatttacgaattaaaaaaaacagctatttttttcgagtctcattttgcaatattaaatatttggaaaaatatgaaattttgttttggaaggtgtccaataattccgggtgaattaagaaaattgatcagggaagtgtcggaatgccgatttcgacatttttgggtttgaaattccgatcaatttttataaattttactttttgttgattgctgcctatcattttgctaccgctatgaaatggtaaaatgatggatgaatttttgtaaggaaaaaatttctcacttttggcaacaatgaacattcgggggggggggggggggggtgaattaattcagcacgcatttagtcaataattgatttgcttttttttcgcatttgctccgctgttgaaaatgcgttatgtagggtcggggtcactttggcgcgggccattttggcgccgcgaactttcaagtgttataacttttttcttatccaaccaaataaaataattttgataccattaaataggcctaagtgttctttattagcctgcaaaatattagaaaaaataaattctgtttgacaaaagatatagcgtgcggcgccaaaatggccagaaaaagtcagttttttgaggttttttggccataacttttttgtgtgtcaattaaattttttgaaattttgcagggtgtacggacatttcgcctactcgacatctcgcctaccgacatctcgcctactgacatttcgcctactaagccaaaaacattcatttcgcctactaacccaaaatcggtcatttcgcctactaagccaaaaactttcatttcgcctactaagccaaaaactttcatttcgcctactaagccaaaaacattcattttgcctactaattagtaggcaaaatgaatgtttttggcttggtaggcgaaatgaaaagtaggcgaaatgtcagtaggcgaaatgaatagtaggcgaaatgacagtaggcgaaatgaccgattttgggttagtaggcgaaatgaatgtttttggcttagtaggcgaaatgaacgtttttggcttagtagggaaatgtcgagtaggcgaaatgtcatgtagcctgtcagtaatggtcgcactcatttatgctgtttttaacgatgcatattattactagggattctttttttatgtaaatacattttttttcctggattctccatagcctaattagtaggaaaaacactttcttttttgggtttgcgaacaaaagttgggacttttatttgcatatttttacacattttgggatttttctacatattacatatgtacatatttttatacatattttggactttttcgtacatatttcgcaatttttcgtacatatttttcattttttttacatattttgaggatttttgagaatttatagaaattttttgtaaaaaattaaaaaaattttttttgaaaatgtatccctaaaaaatcggtttttttcaaaaaatgatatatcaanaaattaattttt

SEQ ID NO: 24641 - DNA, 1634 bp, Heterodera glycines
ttggcattttttcaggttaagttagtcctttacaatgtttaaggcctgcaaaattctggagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcagtttgtgaaaaaataaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattattaaaaatttttagatttttattcatctccctttttgatagtgaaagcatctgagtgcctaaaataacttgtaaataaaattggtgcgtttcagagcagtttgtgaaaaaatatttatgaattaattttgctaaaaaaataaaatagtgaagctttaaaaattaataaaaaattttaaattcagaattactggagttagcatcatagcagtgcttttccttgtctttttgatgccctcgcaaaatctggttcgcttctgatcagtttataaaaaaaaagttaagcctaaaatttttcgcaaatttaaaaagcaattaaaaatttttagattttttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcactttctgaaaaaatacttatgaattaattttgcaaaaaataaataagtaatgaaaaagtcagaatttcgaaaaatttaaaaa

SEQ ID NO: 24642 - DNA, 1077 bp, Heterodera glycines
  misc_feature (927)..(927): n is a, c, g, or t
  misc_feature (932)..(933): n is a, c, g, or t
tttgtttttatatatgatataaataatatttgcttccctagatgatatataattttaacaaataaggttatttctttctcgttttgtgcatcaaattaataatttttttattacgattttttaatactgtgcagtattaaattgcgactaatttttattattaattataaaaaattgttcatttgaatatttaggtgtagattttttatttcttgactgttagagtctgagaaacacgtccttttcgatcgaaattagcgctttaataatcttattaacaattaacattatttttctttggattatgattctcattatgattacattaatagaatcttgttatatattcagaacatacatttcaagagtatttattgtcctttatctgctttgcataataatatatcttgctctctcgctcacgaatgtattatttgtatcattctctattatcttaaataaataacgaataacaataattatttaaatagaatcataatctaagactaatagaatttaaactagttattagaaaagaaatgaatcaagctttttatgttgttataccgagtatgtctatgtgaagaagatttgcacttaatatattttttaaattatttgtaaatttaaatttatttaaatattattaagcaatataattttgtttagtcttttaactatattataatctaaatatgaatttatgcaatcttatgttttgtatttatttgtatcttattaacatgcagagtttataattaagtgtattagtttattttattttttgttgataaattattttatttatagtattttaaaattttcattttgaatcatttattgacttaggtaatattattttttattatttttttgaaaattttaagtttttaaataaattaaaagtaatataatttagtttacatncatannaagcaatttaagttttcaaaaaaattctccataactttaataatcatgacaaaataatgtttgttctaaacaaattaaatttttataattttgttcagtgttgaaaaacaataatttttaaatttttaataaacaataattttt

SEQ ID NO: 24643 - DNA, 1081 bp, Heterodera glycines
  misc_feature (54)..(54): n is a, c, g, or t
aaaattaggaaaattggctatctctttttctgctcaccagtaataggaatccanccgcattctcagaataatgacgccgatactaattgttctggaatttgtttctcggcgcgtttgtttgggaaaaatttggaaaattggctatctctttttctgctcaacagtaatagggattacaaccgcattctcagaataattacgccgatactaattgttctggaatttggttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaagatttggaaattggctatctctttttctgctcacagtaataggaattacaaccgcattctcagaataattacgccgatact

SEQ ID NO: 24644 - DNA, 1607 bp, Heterodera glycines
  misc_feature (24)..(25): n is a, c, g, or t
aatggaatttccatggacgcacannttcccaaggcatctgcttggggctccccactcgacgtgccatttggtcaccgccggtacattcgcaattttacttacattcacaattttctaatttcagccgaggattgccaagctctgatttgggatgtgcatcaaatcccgagggcagttgacgacccaattctcgcctacgcggcagccggggaggtgagaaacgaattccgacatggccatgtgactaaaaaagttcgttgacagatcaaccaggtgcagtggtcgtcggcactaagcgattggatcagcatttgctacgacaaaacactggagttactccgggtgtgaaactgactgattggatgtcactttgtacataatcactgcacaattcattttataaatatatagtcagtaattcatacatcacttgcattttaaataaaattcaaaaagcgcagtgcatttgaaactagcgattcatgttgatttcctcaaccggattatcctcggcttcatttaaagcaataaataatgtatgaaataaatcatttatttgtttgtggtggtaatatttttgaaaatactgaattcacttaaaaggaatggataaaatatacatttaagcaaagcgtgttatttgataaagcattgtaaaaataaccaagcgagactaaataaatggaaatgacccaaaatagcaaaaataaaaacattccttttgtgtcggtggcaattcattcattcgacaccctttctttgaccgggccactgaatcagaggcgagaaaatctcccaacgagtcgcttgcaggagggaccttgagaagaggaataaacggaaggagaggaaaacattacaagtgtggagaacatcgagacaagagtcgatgcaaaaaggcaaacagctgggaaaagaaaggaagtcagcgcaatatttaagtgttcgatggatggactctttccccgtcactaacccaataaacaaagtcttagtaagtcaattaatcggtggattatgtgttggatatattataaagaaatggggttattccaattacattaggggatgcaaataattaagagacgaattgtacaccccagggaaaaaaccgaagaaaaatacaaatcaaacgaactctctgtcggcaacgtaagaatccgaaaaccttttgggcggcacattcccggaaaaaattatatttcgcactatttaacttttggagttgtgattaatataagcgaggagaaaggccctgaaaatcaaagattaccaaaggcaccacggaatgagcaggaaaaagccgagaacgaagcaaacagccataataatccaaggtaaagcactgaacagaaaatgaaaaaaacaacacataaataaaagagcaccgacccggggagttgttgagtgtgagaaactgaagggaaagaaaaaacgaaagaattaactcgaatggaaacgcaaaaaacaaacaaacaaaccgatgtgattgcgacagtacgggctaaatgttatgggaaaagctgacaatgaactgacacattcacttcaaccgaccagtccatttccactggaaatggcccaaaaggggcggtgcgcgcccgaat

SEQ ID NO: 24645 - DNA, 1968 bp, Heterodera glycines
  misc_feature (1864)..(1864): n is a, c, g, or t
  misc_feature (1877)..(1877): n is a, c, g, or t
  misc_feature (1901)..(1901): n is a, c, g, or t
  misc_feature (1915)..(1915): n is a, c, g, or t
  misc_feature (1933)..(1933): n is a, c, g, or t
  misc_feature (1943)..(1943): n is a, c, g, or t
cttgctattttcgctgttctgcgaaaagggggaatttgagcatggcccaaagggaggccttttcaaaagatcattctgataatagaaagccgccgactaaacgaaagagaattttatgggagacattgtggcttcccacagctttcaggattttctccgaaagtatttcaagaattgcttataaacctcaaaatgggttcggaatggctccattcgaataaatccgcctcggtaacttttgataatattttccaccaatcgctgctcacccaaaggagacaaagtgttgagttcgctgaatttaatttagaaaaagaaaaaatttacacaatttttactttttgaagatttccaacagacagttcatctttggtcgaaaaggcgcaattttgggggtttcctgtcgaaatttatataaaataatggtaattaacaataatattaaaaagtaatctgggaattgcgcgattatttacggacagaccttaaagcttccccagacaacagcgaatttaaggagcacaaaatggagtcgatgatgaatgtcatcgtcacacgaattggtggagtcgtagcacaaaagcaaatcgaatttctgaaatgaaatatccgttgcgtcacacataaaatatttcgtgaatttagcaaataaaaaatgactttggagttttttttatggtggtcaaaaaaaatattaggaaaatgacttagaattaaaatattttttaaaaaatggaaaactttttggagcttaaactttcgaatttttactgacgagatgacaaaaattaaaataatttaacaaaaaatgttggaaaaatttaattcaatttggtttttcgccagtatttaacaaatattttggctacaatttctatgataattttttatagtaaaagagacaaacatgtgcacaaaacagttgcccgatataagggttttggcgcaaaacatggacgaatttctctattcggtcgcataaccaatgtccgataagctccccaagtgcaggtcccaaggagtcggaagtgatggcaaaggttaaaaaatttgcacagaattccatggaatgatcagcaagtggcaacaagaactcgtgctgaaaatataaaacctcagaaggacgtggagtcatttggccgatattaaaaaaggaaagaaaatcccaatttcagtgacttatttcacaaaaaacttggcttacaagtcgacggttggttgctgtcatcacaaaaccatcaaccaattcggccacaatttgctccatgtaaacgcattttaactcgtcccgtgtaacctgaatttgtcataacatactcccttaaagcgccgaataagtattgaatatttcaccttgctaacccaatgtgcgacatgttcaaaaagtccataaacggggtattgagtggccaaggaacaaagcttaaccaaaaagtgaacacgcgcttcgtgcagatgagccttaagtgagaagagagaacaattgtaaaatgcgtttggttacctcaccctctcgcccacagaaaatgatttcgaaatgcatgtaacgaagcgccgggtcagtctcacgcgcgacttcccaaaagagcaaagaaaaatgaacagacaaatgaaaaacctttgaaaagtaagtgcagacgatgccgagcagacgaagtcgttgcaagtgattcagccgactttggccacggcgggaagggtcggagctaatggagaaaatgagaaaaaagacaaaataaaagagacgacaaaagggaaaacaaaacggaggaaaacgaaagtgccaatgaagcaaccgaccttaggcaaaacaaatcggcatctatgcatttctgaagttccttttgcttcgtccgattccatncccttatgctganggtgggcaccccattgtcggacanatcgccaatctganaatttttaaattctattngaattatttntgacatgataatctttactattatt

SEQ ID NO: 24646 - DNA, 1963 bp, Heterodera glycines
attttccaattattttgcccaatttcagtccgttccttccgctcactttcaatttcaaaatgttctccgtccgtttcttcgctttccttctgctgctggccgtcctttgcttttccctcgtcgagtgcggtctcatcggtatttcgaccgtttttacgcattaataatatccaaaattcgtccaaatccgtttaggcattggtgccactcccattgaagccgcttggtgcggcgtcgtcggccaagagtccacccattgcccgggaggtgcccttcacggcggatttcccgccgtcggcggaacatacggatttggccgatagaaagcggcgcatttggatacggtaaatcatttagtaaatcgtttaaatgcattgaaatataaatttaaggattcttttggactactgacaaatcgctgagagtgaaataaaataagttgaaataattgaataaatttggatagaatatcaagcttttcactcaaaattgttcatttatttgtggtttcaattacttaaaaatattataatttgtcagtaaattcccaagtgaaagtttgaaaaagaaaaagagattttgtatgaggtgatcggtccgcaattcaattttttcggcccatttgttttctgttcctgtcattattttagttttccttattttggtttaaaattcaaattttcccctaacaaataaggcgtctgtttaattttgcatcgtttgacgaaaatttatacaaaattttatttaaatttcgggtccattaaccgaaaggtgccgtttgtgcatttttgacaatgccatggttggcatttggccgcgttttacgcccccgcgcacatttccgccactttgctgcagcacgccttggcctccctcgtgcacttttcactgacacacattgcgaattcgtcttcctccccccgtttcgtttgtccgtcgcttttccccgctctctttgccccgttttgcttcttttcgtcctcctcgtgctgttcgggttgttctcctgctactgctagccaaggctgaattgtaacctttcgcgcgccttttccgcgcagaagcaattgcagcgaatgcatcagttgccgaagagactgttcattggtcgacggtggtgccattgactcaccgtggagggaggggacggagttgacgagagacacgtgcagaaacacgtcgaagttgtggccgggccatttgctgtaaatgtgcaagtggacgagacggaggttcgggaactgaaagttgggcaattaattggcactgattcgttttttgcttatccttcattaattatttctcctagaaggctctctgtgctttgatcaccacccctttcaaatatatcaccattctcaatcattcgtgtgttgctattaaattgtcctactttcttctcaatttccactttcagttgagtctctttcgccccctttggcacttcacataacaaaaagggcatattttgtttgactgaaaattagtgaaagtgatttatgaagcagttaattaattaataagatacaaatgggaagcacaacggcagaaagcagcacacacattccggcacccaaataacggtccaaacacgaaatcacttcgccagtttcgggactgaatatagtcatcgtttgttataattagagtgctcagttttcagcacaaaaaatcaccgattaagcactgtaaacagcaccaaatttttccaaaataaacatgaaaaaagcacaaaaaaggcaaaatcagcacaaaaaattggaaaaaagcataaaaattaagagattaaaggcaccaaaaattgaaaaaagtcctcaaaaaaacgtttatttgctccctgattataaaaaacctccaaaataggtgctaaaaatggtaatgagatacataatttttaaaaaatcaaaatcttgtcaaaaaataaattttggagatgaattatttttgataaatttttcat

SEQ ID NO: 24647 - DNA, 1184 bp, Heterodera glycines
  misc_feature (1141)..(1141): n is a, c, g, or t
  misc_feature (1177)..(1177): n is a, c, g, or t
tgctctttctgttgcattcgcctcgactttgacaccgaatagtgtcgcaattcggcgctgtattcctcaaagtggggccaatttgtcgaacagtccacgccatggaggagagaccaccgcttcaaatctccgccaatagtcgcatcggtcgtgctgagaaagtgttgacgaagtttggagtgcaattggacgagtctgaagtgtaatttgagacagaaacacccaaagcaaagccaatgattctaccgactttggcgggttgaccaaatccacgaggattttctgcattcccgaaagcatttccaaaatgaagcgaagtcgtttcatttccatttgttggcatttctcaaaaacgaaggccatctgaaaaaacaatgttagaaaaagggagaaaatcatcacaagtgcacattttccatgtaaatgccattgtacgccgttatttccttcagaatttgctcgtacgccgtcctcgcccgcgtcacctgcaaattccgtctttattcattgcctccattttttccacctctttgtggcatttttcaaagcgttcccgtgccttcgcctccgttccgtccgtttgtgcgttgtccgtcttcgtgttcatgtattgaatgtacatagatttttcggtccgggccgctgaatggtaagtgcgtttcgtcacctccacccgatcgaacagtttcttccattgtttttgcgccttttcaaattcgtcttccatttcctttgcctctttaaaaccgcgaaatgtcgaccgatggtaattgtcgcgtttgaacagttcgatggtcttcagcacctgtgaaatcgtgagttccgaattcatttggcattccatgtttgccttttcctacctcgtcgttgaatcgctctttgaccgacgagtgcacttttgtcaattccttactctcgtccaaaatcagcgtgaaggaacgcttcatcgacccatccggcaaatgcttttccgaataatggttccattcgtcgttccatcgctccaattgcttagcgtagctaaaaaaaaaactgggtaaaactgccgttccattgagctttctacttattttcaatggtcattctctccttgataaacccgggaaagttcgtccaattggtccagcccccggtggattcngtgcacatttgctttgtaactaccgatttcccaaantccgttc

SEQ ID NO: 24648 - DNA, 1059 bp, Heterodera glycines
cataataattttttctgtcttaatttttaatttcttggtttttggctcaattctaattccgtagtgtggtgatttcaaatgaatttatataaataatatttagagtaatataaattttaattaaaatttttaaattaattattttaaaaatttatttaaaaatatgttttaaataattcatttgtgctctcgacattatttgatatttaattgcgaccgaatccagacctataataaaaaccgaagggccaagaatccaaagttgaacacgatagtgatttcggtcgcacgtatcaacaaaaatggttcttcaaaaataattcggatttccataatcatggacggcaaaacgatcaaattcattgccgacagtgatcagacatcaatattattgatgaaatcgcatacaaatgcatcggatccccgccgctaggaagaaagcgacgaagagggcatttttttcgatggacgccgctgccaattcatcggcaaaggattcgctaccttcaaattcaaaggaatcgaagtcaagcaaccattttatgttgccaaagcgggagcacttaatttgcttggggcagcaacaatggataagtttggattccttgaaggaatcaaaaatgcaatccgcggaaattccaatcaatcagatcacttccaaaaataatgagacaaaaattcgggaagcgatcaaagaattgccatcaaaatttgagcaagtcttctcagaaggccttggtctttgcaccaaaatgtaagcctctctgatgctcaagtcggacattaaaccggtgttccgacgagcccgtccagtgccgtattcagcgcttccaatcgttaacaacgaattggagagattggagaaaatcaatgtcatcaaaccagtggaacacaccgagtgggccgccccaattttggtggtgaaaaaggccaacggatcaacgaggttgtgtgccgatttctcaactggtctaaacgactgtctccagctgaacaagcatccattgccacttccgtccgacattttttcaactttaaatggctgaaaattcttttcaa

SEQ ID NO: 24649 - DNA, 1452 bp, Heterodera glycines
  misc_feature (45)..(45): n is a, c, g, or t
  misc_feature (992)..(992): n is a, c, g, or t
tggaacgcaattccgcagtcacgaatttcaaaaattcacaaaatntaatggaatagaacaccttttttctgctccatatatgccgcaatcgaacggtcaagcctaaagaatggtagacacgtttaagcgggcattttcaaaaataaaaggggaggggtgtcaggagacactctcgaaattattcctcttaacttttcgcaccactccatcggaaaatctgaatggaaagtgccccgcggaactatttcttggaagaaggcctagaatcgctcttgaccttctccgtccgccgatccgaccaacagaaaaagacctcaaaatggaggcacaatttaatcggagacatggcgcccgatttcgatcatataatgtcggagaccaagtctttgcccgtcataagaaaggcgaagattggagagcgggcaaaatcagtgaacgaaacggtgtaatttacgctgttaatttcactgacaattcaactggacgtttccatgcaaatcaattgcatgcgagagcgatcggggacgaggacatcccgcatccgttggatgcaattgccgcagatcaacgatgtgccgcagccgccagacgagcctgtccgacgctatcccgcacgccaacggaagcaagctgtgcgtttggatattgctgatccgcgccggcccaaatacgatttcgtaccgatcagggcggaaagtgtcaatttaaaaggggaggtgttgggacgacattttaaatgttattcttttggcattttatttatgtccatttcagtccctcacacaattgtttatccgccattgacccagtcaattcattctgtccgcactcatcttctcctccgcattgtttttttttataatttaggtgttttttttgaacgaaagtattattgaaaatatttttaataatataaaactcctggcaattgtaccacgatgcatgtttatcttgttccaatctgcgcaatttatatttgcttcatttaattntaacttgttaatgtttttttacaaagttatcttaattgtggttttataaatttttaaattccaatgttcgaatttttattttttttttcaaataggctgtaataatttatataatatttttaaattttgagatgacaaatgaaatctttatttttcctggttttacagcaccaatagctctcacactttacaaaattgtttccagaagaattcaacatatgtgagcaatattttttcttacaattctcatttttgaaaaattatttttatttttgaatctttttattatttaattgcttattttttaattaaaatagagaattgtcttattatttccaatatatttatttagttttcaaactgcataatttttgtttaattctcaataaaaataattattataggtatatcaaactaagaagtctataattttttattatttttctttattttaatgtat

SEQ ID NO: 24650 - DNA, 1075 bp, Heterodera glycines
  misc_feature (97)..(97): n is a, c, g, or t
  misc_feature (114)..(114): n is a, c, g, or t
agatttgagtcccagagattgacatgttggtgggttgagtctcagagattgaaatgctgctggtgggttgagtcccagagattggaatgccattganagttggtgggtgagtcncagtgtctggaatgccggagatttgagtcccagacatttaaatgctggtgtgttgagtcccagagattgaaatgctggtgggttgagtcccagagattggaatgccattgaaagttggtgggttaagtcccagtgtttggaaagccagaggtttgagtcccattgtttggaatgccggagattttagtcccagagattggaatgccggagaattgagtcccagtattggaatgctggtggcctgattttcagtgattggaatgtcattgaaagttgttgggctgagtcccaatgtttagaatgccgcagatttgagtcccagtgtttggaatgccggagatttgagtcccagtgtttggaatgccagagatttgagttccagtgattggaaagcctgagaattgagtcccagagattgaaatgctggtgggttgagtcccagtgtctggaatgccggagattctgttgagtcaccgagattgaaatgctggtgggttgagtcccagtattgaaatgctggtggcttgagtcccagagattggaatgtcattgaaagttggtgggttgagtcccagtgtttggaatgccggagatttgagtcccagagattggaatgccggagaattgagtcccagtattgaaatgctggtgggttgagtttcagtgattggaatgtcattgaaagttggtgggttgagtcccaatgtttagaatgccgcagatttgagtcccagacattggaatgccggagatttgagtcccagtgattgaaatgctggtgcgttgagtcccagagattggaatgccattgaaagttggtgcgttaagtcccagtgtttggaatgccagagatttgagtcccattgtttgggatgccggagatttagtcccagagattggaatgccggagaattgagtcccagtattggaatgctggtggcctgatttttcgtgattggaa

SEQ ID NO: 24651 - DNA, 1636 bp, Heterodera glycines
ttatttttgtaatttaactaatcaaaataattagtgccattattttttcgacaaaacatatttcaaatatttcctatatttaaattaaaaaatttcattatttttaattctttacaaagaactggaaatcgtaattgtaaaaataataattaattaatacaaaaatcaaatatttgcttgaatatctaattaactaatgatccaaactaatttgagttgcccttacgtccaatgttctccagccggcaaaaatgccagtgaccaaattgccagcactgtccgtacttcccataaactatgacaaaaatttattttttataattaaatttaaatctttttttacctccggtgtgaacaaatgtgaatcggccggtgttggcagtgccgcttctagcgttgaatcccaataaggaattgcaacagttgggtccacttgacggagcgcaacttcaactcttaattggggaacaaaaattaattagtatttttatcattttttaattagggattattaatgcccatcagtcttaattagtgtgctaattggaaacaattagcgcactttctattctccggcattttcgaaaagaatgccaactaaataaacaattaaatgaccttttttcaattaagctatgcatacatattacaaaatataaatattaatttatttgtgttgttacagccgccgccgttgccggcggaatcgaaaagtttggcggttcggccaaggcccttcacctcatcggcacgcgtaaaatttataatttaaaattgaaattaataattaatttttttaaatatatattattttttagttttcatgttacaatgagcatgaatgttgcgagacgtggtcattaaagggggaatgtcaacgaaatccggtgtatatgaacgcgtggtgccaggccagctgcaggcaggtggcatttgataaaaagaaaatttattattaaaattgcaaatttttattaaaaaaagtatttttacaaatatgtattataataaacagattcatgtttttgttttttaaataaccaaatgcaattaaattatctcttatttttcattaaatttttagcttattaagaaaagttacctaaaaaattaaaattttaattaatttttaaaaattttacctcattaaaatttgcatacattaagaaaaagttggacctggcctgaattccgtattggacttagatctgggttttctggtcaaaatccaagaaaatccaggtctaggaaaagtctgggttaccgaaaaatgacctggacatggtccgaaatcacgaaaatccaggtccaggccgatctcgatcatatattattcaacaaaattctatcttttttattcattaattataaaaaaaatttcaatgcatttaatttagataattaaaagaatattaatttatgttttaacatttttagtgccaagttgactacgacatgttcacgggtaacaaattcaaaaattgttctgatcatttcccgctgatcagaatgcaatgatcgccacgtgaactgtgcacaatgggcaatacgaggcgaatgcacacgaaataaattttggatggtaattaaaagcaataaaaaattaattattggttgattttgtaaggccgaaaat

SEQ ID NO: 24652 - DNA, 2901 bp, Heterodera glycines
  misc_feature (2130)..(2130): n is a, c, g, or t
tgattagaacaaaatttttttttgatcaattacgaaaaatgctgaggggagggatggactgatcaaacattgcccaatgattgacgactgactgattgttggcattacaaaaatttccccctcattttgttcattttccggcaacaaaatttttggcgactgtgctgttctttcattcttcattcagcgtcccgagaagtttctcaagagttttactacattattttctgtttgtttgtttgttttttgttaattcccgccacttaaaattgtcgtacattgccctccctcacccatcagcagcatgtaaaattggcttttccttctgcttcaacataatgctttttgcttgcttcaatctttacattagcgcaggtcgccgacttccaatttgtttaaatttaaaattttgaactttcattggatagcggcactgttaagtgccgtcattgtgtttcgaattaaaagggggttccaaaatttgccgcttttaccagtcttgattaaaatttgtgcgattgcggactgcggcaaatttttggaaaattcgaaaccattttttgggatttgctccaaatttcggcatttgattttcatggaaagttctttttaatttatgatactccatcactattctcaagaatattaataaagtcccgataataagttatctgagcgagtaatacattattctggcgcaaaaatttctggaataaataatgccgcaatttcggtccccaacggaataaataatgccgcaatttcggtccccaacggaataaataatgccgaaatttcggtccccgaaaattggcgtaatgcgggatgcaaatctggattatgagcattcactggtcccataaaccggttttaatcaaaattaaaatttaaaaataagaaaataaattttgagttataaacatttggaacaagtcgtgccgtgcccttcattatttaatggaagcaacagcaccaatggccacttcaacggatgagggcggaagtccgagggcaaatatggaggagggattgttgtcattgccccgggactcggtgactttgtcagtgccaagcagcagactgaaaatgccaagacggtccaaaggtaagtaagtacaacttaattggcccatgagcttgatgggcatggcatattcctgcctctcgaaatgaatagtaaaaattttaaattttcgataaattatcaaattttttgtaaatttttgggccaattttttctcagtaaaatttaataaaagttggttttccccagcttttcccatatttgctgtacctttgcactctatccctcaagaattaaatgaaatgaatgtgaaaagagcggaagagagaaaatgaaaattatagatgcagagcggaagtgggaaagagaacggggcgagagagagaagagagggagagagagagagagcgatagaaattgaaaatagagaaagcatagagacaaaagtggcagaaattggagatacaataggcataaagaattgtgaaaataaatagctaattcatagaataaggtagcgagagagagagagatagacgagagaaagaacaaggagagagaaacatagggagagagagattaatatatataaagagagaaataaagagagagtctgagtgcaaagagatgtgtgccaatttatttgctaattgctttgtttgccgccgccactttatgccaatggccatgtaatgaaaagccatctttattattacagaggacaggttgttgtcggcattaggaccattcatttatttgttcctgccaaagtcatcccatcccattaaatcccctaatttatttaaaaaaatgttttttgttcgccaattagaaagcttggcgttccatcgcgacccgttcaatcggccggaattggtgcacaccttgcgcgggcgtgagcttgtactgtttgtgttactgtacgcaatcggtgtgattgccattgtgttcatatttggtgagtgcttttttgtgtggcattttgccgaaattggcattccaaattttttgtttgtagcacttttatattttggtttttgagttgcaacaaaattttttgtcctattttttattttcaatatttcaaaaaattgccaaaaaaacgnaaaaatgttcccttgagaattaatctatttaaaaaattgaattataatttctattttaaaccaatttttcccgtctaaaagtttttagtgattttaatgaattttaagaaattatttttgtctctgtgaaaaaagggtaaaaatttaaatgaaaaatatcaatttttcatttttatgtcaattttaaaatttttaaaatttaatttcaatcaaaaacaaaaaaaatggcaaagtttttcgataacaattacaaaaaacagagtgtacaatgcccgtgttttggatcaatgatcaaagtcgcgcagagcagcgccgtcgtgccgcaattgtggtccgatcggcacagaaagtgatgctggacagagaaatgccatcgtcaattggcccactcagaaagacatgagcaaaaagaactgaaagacaaatcagcaaatttgatcaaaacttttaatgcatgcttatagttaattagatttatttaataaagggtattttttattttcgaaaagattcgtaatgaaacaaatcgaaacataaattaatttttgttataaattcattttgttttttgcattaaaggaaattcatttatttttttataaaattgcttatttttaggctttcataaaatgttgttttagaaatttataaaaaattcttttttttcagaattttttttttttgatttagttatagaaatgatttttttatttattggaaaataaaaaaaggtgtattatatatttttgcatttcaatttttcgcatttaa

SEQ ID NO: 24653 - DNA, 1812 bp, Heterodera glycines
taaggtatgagccaagtccgctgatgttcagcgaacgcatcgacggcattctcaggtgatcgatccgattgatccgttcccgaaaatgagccaaagcaatttaattctgctgatagtctgatcactttttgtgtcttttcttactcttggtctaatcaattctatgcattcatttcgtctggtcaacttttttttttattccgattgaacgcattggcgttttcttctctgatctgttgccactttatttgtgttcttctgatcattctatgccttactctcccatccatgtgatcattatttttaaaatgtttgctctgataacttccatttggtccgctaatttctgatcgctcatttgtgccgtatattttccccttgctgcaggtttctgctccgtcaacccggtctgatgcccggcctgcacatgagtggcgaactgcgcgacaaactgttccgccagggcggcccccatgggttggacttggccgcactgatcgtccaaatgggccgtgaccatggcctgcccgggtacacgcgggtgcgcgaggcgtgcggagaaatgcgggtcagaatttgctttatttattttttgttgattcgaaattggggtttgccatacgtcattaaaatgggtgtcaacaatttaaaaattcatcaaaagttcgccatttctctggcaaagatttaattgccttcaattagcaataccaaaaattttaataggatttaaatataataaattttataaaaaataaatttagtgaacaaagtgggcataaaagcaaatgcctttaagtatccatattcttaaaactctgatcagcaggtgaaatccttcgacgatttggctgaaattgtcgtggagccgaagcgcattttgcccattttggcacgccattttcgccgtgttcaggacgtggaccttttcctgttggggctggccgaacggccccggcggggcgctttggtgggtccaactttcgcctgtctgctgaccgcacaatttcaaagggtaattagctattctaaaatgtaaatttaaaattgaattccacgcagacaaagcgcgccgaccgcttttggtacggccatcggatggacccgtgggcattcactgagcaacaattggccgaactcggcagaaccacattggcacagctgatctgtgccaacagtgaagtgccattttgaaaaatgatttaattgtaccaattcccactttatttaaggtgagagaagtgcaaccacgtgcttttgaactgcccgacaattatgagtcagttttcaaatttataattcattgctaatttttaaattttccattaatttaatcatttttataggcaatttaaatgagagtttataattatttttaattaattaagcattgttactaatttatcgatggcggatttttcaaattgccaatgtggacacagcggcccaattttgggctctcagtgcaaataggtttattatttatttagtaatcagaacgccaaaactttgcaaaacttaaaatttttttgggattttcccttgtaaaattagaagagccgatctcgatttaaaaacttaagttccataaaataaacttggaatcgctagaggaggtcaaaatattggcctatgcaaaattttaagaaaattaaacaataggaaaaaattttttacaagggcaaacatttcaatactttaattcttttttagccaagtccacaatttaagggcaaacccaataaaattttacatattctccagaattttcccctcaaatgagcataaaatggttttatttgctctagtatt

SEQ ID NO: 24654 - DNA, 1740 bp, Heterodera glycines
acttatctctactttatgcccaaattttacccatttccgttatcttgacttccaaagtgtacatcgactgatttccgtatccgattgggtgccacaattggaccgattttgccggaatttccattttcaaactgtccaactccaaatttggtccctttcccgttgaaacaataaattccttaaagcggtgttaattagctaatgaattgaaggacaaataattagggactttgtccattccgagttcgattaagctcaatttgatggaaatttgatggtcgacggcacaaatcaaagaaaggcggacggaaatcacaaaacattcatctaaactaattgtaaaatcacaataaaattttttgggaattttttaaccgttgcccagactgatcaccggggaaaagcgtcgaatggaaagcaaatcgaaaaattctaagcgaattggacgccaaatgccaacggtgggaaaactcaaaaggcaatcgagcaactaattagtgccatttaattggatgccaaatggacagacctcgggccccaatcccagccaaaattggcctgcattttgcgcaaaaattgcacatggcactccccgttgtaaatgggcggggtgcactgctgcaaaacactcgaaagcatttttagttatttaaacaaattttacggggggcaatttgtggccatgaaaagcctaaaataaaaaataaattaaaaataaaatttaatgaatttataaaattttgatttaattattgtttaatgtgagcataaatgaaatcctcttttcaatctgtgctttttctctctcacttcgtatttttccgccctgaaattggcctcctcaacgggcgattcgaattcaattcgaagaatattttcacggggcaaaacatcggaccaaacgtcaacggaattggacacaaattggttgtccaattgggcaattgtccgattgttcagcagaacagaggcgggcgaatcgatgccggacaaatggagaagcaaaaaattagccaaaaattggggaaattaattaaattaaaatggaatttaaaatggcaattattaattcacataaattggtcaatttcgaaatatccaaagtgaaatttctgcgcacgaaatgagcaatttactgcgcattgcctttgaccagtaaaactctcttctcgccttgtgcgcttcgtccggaagttcgaatttcttttcgtaaatccatcggtgccgtggcacccatcggcaaaagccgtcgccgttcccaaacaaagggtcctccaaaattagaaaaaattaaaataaaaaattaatttaaatgaatcaatctacttcaataaatccgttggtgaataaatcggcgtaaatatcgccgggcacttaaaaacgatgattatttaaaaacggcacttatgccgccactcccccccccccggaacctttcgcatttcccgaaaatttagaccaattttgagaagaaaagtgccaaattccatcgagatcaaagaaacgggaggagacaaagtgaaaggggctaattaaggcgaacattaacataattaattggaatggcatttgaaaatggtgccaaaaagcaaaaataaatttgtgcaaatcaatggcagaaagtttattaaaactcttgcactaaaaaattggtttcaaaattaatccctgatgataaaaataaaaatttattatttatatttattatcaaaaatgtaaaaatcgacaaataagcaaaaa

SEQ ID NO: 24655 - DNA, 1819 bp, Heterodera glycines
ctgttgtgtttggtaacacacatacacgataaatttattaaatgaataaacaataaaattagaatcacaaaataataataaaatatcgacggagtcaatttaagagcgtccgaaaataaaacaccgaaatgtaaaataacacaaatgcaaagaatgagtcgatgggagaggaggaggacccatcaacaaataactaatcaaaagtattcgtgtcgaacttaataatattaaatatcaacacatccaacagtgtcttaatcatcacataattttaatttatgcatattgaaaattttcttgtggacattcattgccctttagcggcttgttttgtaataataatattaaaaatatgcgtctgggaaattattaaaaatgttatataatattattctttatttaattattgattttcataaactagttgaactcatggctttttgtttcttgattttaattagtttctttgtttatcctcgtcggattaattcaatctattgttttatttaataatttgattttgtattaaaatgccatctcactttataaagtcttactatttatatacgggaacgtattttggtccactagtcggtgaatgctcatttgcgcctgcaacatttgcgtctccacatttgcgcctactacatttgcgcctccacatttgcgcctgcaacatttgcgcctccacatttgcgtctccacatttgcgcctactacatttgcgcctccacatttgcgcctccacatttgcgcctacacatttgcgcctactacatttgcgcctccacatttgcgcctactacatttgcgcctccacatttgcgcctactacatttgcgcctccacatttgcgcctccacatttgcgcctactacatttgcgcctactacatttgcgcctccacatttgcgcctactacatttgcgcctccacatttgcgcctacacatttgcgcctacacatttgcgcctactacatttgcgcctccacatttgcgcctgcaacatttgcgcctccacatttgcgtctccacatttgcgtctccacatttgcgcctccacatttgcgcctccacatttgcgcctacacatttgcgcctactacatttgcgcctccacatttgcgcctactacatttgcgcctccacatttgcgcctccacatttgcgcctactacatttgcgcctccacatttgcgcctactacatttgcgcctccacatttgcgcctccatattaatataaaataattaaaatactcaaaaatatttgctataatacattaagatggacaaaccacaatacatttatttattaatattttcttgggtctagaacgattttctaggtatattattatctcggctataaataatactggcaataatagaaagaagcacaatctagccaatgaattattccttgaagggaaacaaaaaacgaatgagcgcgtagatgtgccaacaatcgttaatcaacgcatagatttacacctgcctgaaaaaaatggtcaataagagtttggatgaaactattgtttactgaataatttttgaagcgaggcatacaccctattagagctgtgctgtgacgagaaccggcaggcaatggatgtctttcaaactgcactacatcatatagtcaaaatgtgaatgtaaaaaacttttgggtaaagaattattttttgaagtgagtcaaacaccgtattagtgctttgctgggtcaagaccggcaggtaatggatagctgtaaatctgcaataaattaaattggcaataagtgattggaaaaaacttttgggtaatgaattattttttg

SEQ ID NO: 24656 - DNA, 1844 bp, Heterodera glycines
  misc_feature (1008)..(1009): n is a, c, g, or t
tagtttaggcactctgatgctttttctatcaaaaaggcatttgaataaaatttttaaaaatttttaattcctttttaaacaggccaaaaagtttaggcttaactttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaactttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaactttttagtgaaaattcgatcactcatattttttgctaattgagcagaagcgtaccaaactttgcagggatactccccggtaaaggactaacttacactgaaatgagcgccgagctagctggctcaaaaaattttcgaaaatctgagtctttcgtttttctttattttttgcaaaattaattcttaaatatttttttcagaaaggggtctgaaacgcaatagaaggcnncctgacccccccccccccccacattccccagttttttggaaaaagcacaccgcgaaacaaactattttgggattttcacctcaaaaaaacaagcagatattctgatcataaattagtcttaacaatttttagattggattttttaaatttaaaaattttttaaattaaaaaatttttttgaaaattacggattacgtattacggattacgccaaattacggccttttttgacccccgtcatgacggattacggatggccgtaactgaaaaaatcgccgtaatgacggattacggatggccgtaactgaaaatcagttacgtccagccctgcttgtaagcctaatttaatgcacattattaatttcttcgcttttcattttatatttatgaaaagaaatataaataaaaatatgcaagcaaaaagaaatgatgacaaaacgttgggaattttgtggaaatatttaaatgccataaatgataaatgatggtaaaaaacaacgcaaaacccgcgcaaatgatgatgaatgaaggaaatgaaacgaatgaatgtgaacaattataattaaacaaatatgcaaagagagagaaaagtaaaaaatttaaaagggcaaaaatcaaattatgcaattaaaaaaatgcaaaattggaatacaatcaattagcatttaattggcgtgaaattttatgattgagcgtcagtgtatggttgttttatatgctcaaaaatgcttggaatattttattaaattttttttatttcagtaatctcttataataaaataaacatttttgagcataatttcgagagacttttttacaatttttttgatcaaaa

SEQ ID NO: 24657 - DNA, 976 bp, Heterodera glycines
aggtttatgaaactcccactgtggcggatttgtgaaacgcatacgttggcgcatttacgaagcgcccattgtgcggatttatataacgctctcgttggtggatttaggaaacgcccattgtggcggatttacgcatcgtccacgttggtggatttgcgagacgccctggcggctttacgatgcgccctggcaggtttatgaatctccaggtttatgaaacgcctattgtgtcggaattacaaaacgcccccgtaggtggatttacgaaccgcccattgtggcggatttacgaaacgcccatcattggcggattttcgaagcccccattgtggtggatttacggacctccctggtggatttcacgaaacgccctgtcaggtttatgaaactcccactgtgtcggatttacaaaacgtccgcgttggtggatttacgaaacgcccattgtgacggattttcggaacgccctggcggatttacgaaacgccttggcaggtttatgaaactcccactgtggcaagagagaagagagagatagagagagaagagagagagagagagagagagaagagagagagagaggagagagagagaagagagagagagagaagagagagaagagagagagagagagagagaagagagagagattcaaaaaaaagaaaattgcaaatacgaaaagtaaaaataaaaataaacaaaatttttaattcgctcttgaaatttaattttaaatagacttatatttgttttaaaatttcaattttgtttattttctcgtatttctctttctcaaagtccaaaagtatcgaaaaaattttggtctgctcttttattttacaatgtaaatgttggaaataacctttttcaaaattctccaaaaaaattctgattcagtcttaaaatttcttgttgttcatttcgagggaggcttttacggtgtaaaagggctaaagcacaacaacaaatccaaaaa

SEQ ID NO: 24658 - DNA, 2058 bp, Heterodera glycines
cggcgttgcgaccgccggtgaagaagtggaggaaacgatattcagtttgaccattgaaaagaaagaattttgcctatttaactcttttctaaaaaaggaataattgttaaataaattaccagtaaaaccgccaaaaaatacaatgagaaatttactacaaataattcaatcaattcgagtaaagtgaagcggagtgagtctgagaaaaaaaggaacggcagaaacaaaagtatgtaaaaatggaaattctagtttttttttatttggcattgtgttttgtaattttataattaaattaaaaataagttctttccaggaaaaaattttttaattacatatgcccacccgaataaacatattaatataattattatctcccttttgtcaccatctattagtggccccgtccaaaatttcactgtttggaggaggttgacaaatagatagagccccggggaattaacagagtgaatatggtaacgtgtacaatactcagagggaatacggtatcgtgtgtgtacaaaacaaaatcaaaaaagtgggagcccagccgcttcatcgaagcaaaggagacgacactttattgtctgcatcatcgggacggataaaatcctccagtccgctcaccgacgcgtttcttgcccgcgtccctccgcaattatcaacgataattatcctccaggcacaggctgccgccaccataattttttttgtctttttgatgtcgcctcgccgcctccatccctccgcaaacggtcgcacttcgctctccgcacgaatcgcaccgaacgccgattcactgggcccgcgacggacacaaaaacggcaccatttatataaaagaaaagaaaactgggcacattttttgtatgggttaaaaagagggaaagagaaacaaagaaatgcacgcgttttttccgtttgtctctttcttttcctttgtcctatttctcttttcactgtgttcttttccccgtttaactaactgtgtcttaatgactggtaattgttgctcaccactaatttacggtaggggtcaactccgtctggccaactccgtctcagcaatgttcaaaaagctataacttttttctttgttggccaaacttcacaatcatggtatcattcgaaagccctagatgtttagaagatatttataagctatttctcagtgattaatcagctctcaaaaaagttgtcagtttaaaaccgcaaaaaaggcagaattttcaaagttttttatttctatctttttttatagttcaaaattttctgtaatttttagtaggctaatagagcctgtgaagaactttacatttaaaaaattaaaatcatttagttaaattcatttaattaaaacacagaaaaacaattattcgtttgtctaaataaatatttgtaatacacaaaatcaacttcggttagaagaattcgctaaattcgggcgaacgattaatcattggtcaaattgttttttttatttaatttctctcgctcgcttcgaatgaaatatttggtttaatttttgagtcagtaattaattaatttcactaattaattatttttttatttccatttgcgcaaattggtcgagcgagaagtgcgcgaacctgttcaactccattaaagcacattctcttcaacattggagggcaattttggtcaaattgaattgtcattttaataaaaggcgaccaatttgacgaattgatttaatttaatggacaaaaaattattttaaatctttcgatataaaagcgattatttttcaatatttgataatgtaattaattactaacaaaattgcttttaaaaattagaatttcagctttaaaatagatttattaaaagttttttggactgaaatctaatttcaataaatttataaacattttttaaataaaaagtgattaaaatatattttaattcagctaaattattttaaataatttttaaaaatgggtgtttcccattgctttttaaaactgcttttgtgtacttccataatttatttcaaaggcgcaattgcaactccacctggcctagttgcctcaaaca

SEQ ID NO: 24659 - DNA, 1679 bp, Heterodera glycines
  misc_feature (1582)..(1582): n is a, c, g, or t
  misc_feature (1661)..(1662): n is a, c, g, or t
ttgataccgcaataaattttatccaaataaacggttgttgatcatctgataacattttattttgtcaaaaatgaaaattttgaagaaaaaatggtgaatttattgaaaatctctttaattcaataaaaatatttttttataaattttacaattttgcctcttttgaaataaaagtattgttttttcgttatacaataaatacaattactttttgcatagaaacactaaataaaatcttctttaattacaaaaaataatataaattctttacttaacctataaatatttttaaatttatattttaccaatttcgtgggaattttattaggctaatttggcgaacttttcgtcaataacaaattggatgaatttctaaatttctaaattaaaaaaacgttttttgcttcgatttttcgaattttaagacaaaattaaacgagtcaggcaaattttgacgaaaaaataaaaattttaaatgtttttttatcgaaataacaaaaaattgaagatgtttttcgtgaaattataatttcatttcatgggaggcaggtgctgtaaaattttccaaattaaactcgcttctgtcaattttcatttccgtgttattttttgaacagcaggtgacccaaaatggcaacttgtcaatgatcaaattgagaatgatttcttaattttgcaaaaactacattcacaaaaattagttgaattaattaaaatggccgaataaaatttattcattttctcagtcacctaaaaattgaatttatttgaggatcaattttttaatttccactttatttaagtaaatggaattttttaaatgattagctctttttttaaatgttttcccacccttttttacataattaaaattatttttataattcgctgattatttttatttttttaaattaatattttgaaagataattttgtaactattcaaattgaattaaattaattaatttaaattaaattcgcaattttcttttgagcgttctaaatctgtaatcattatttttttgattaccttcaaatgaataatgagagcgcatttctttgatgccaatacgaattattggaaaaaggcaattaacgaaaatgtttaaaaaatataaaaaaatttctttcaaaaatgggggtgccttcctaatcgccaaatttaattcgattttttttgcggaccctcacaatgtgactagcaaatttggcttcgtgtccttatcaaaatttgcacaaaaatcaaaaatgaaaatggcccagtcatctgctgatcaaataatgcattaatttggccttcccccatcttatcatatcattttttaattcatttaacttttctatttaaaattttgaaaaatttttcaaattctttcgccaattcaaaaagatctttgtcttttcaaagttttctattttaaaacaaaaaaaatcatttttcttatcggttcggattgatcttatattactaattgtgaagtgtccttgattttttgcgcgtcacttttgaaataaaattattttactctgaacacatccatttttattcgccaatttcaatttaatatttgtccatttttgngcatatattttttgttgcaatatgcataaaaattaaatcattgcctctacccaatgcatttttgccaactaaaaatttnngtaaatttcaataatac

SEQ ID NO: 24660 - DNA, 1754 bp, Heterodera glycines
acactagcaccaccaccaacaccagcaccaccaccgacaccagcaccactaccaccacaagcagaaggcgaagaagcattggaaaatgcacaagacgacgcatcgagtgggcgagccggcgccgaaaagagaccagtttggaaatttttcaaattataaatttaattacataaattaatcattttaaagtgccgttggccaaaattgtgcttccattggcctttcaatcgactcacaacagcgcaaaccgaaaaggagtaagtatttttcagacatttttctctttctctccccatttggtgagggccctcgcggcactccctcccctctatcttttctatccccaattggtgagggttttcatggcagtccctcccctctctctctttctctccccaattggtgagggcccccgtggcactccctcccctctctctctctccccaattggtgagggccctcgcggcactccctccctctgtctctttctctccccatttggtgagggaccccgtggcactccctcactctgtctctttctctccccaattggtgagggcccccgtggcactgcctctctctctctttctctccccaattggtgagggccttcatggcactccctcccctcccctctctctctttctctcttcccaattggtgagggcacacgcggcactccctcccctctttctcttccccattggtgagggccctcgtggcactccctcccctctctctctttctcttcccaattggtgagggccttcgtggcactccctccctctgtctctttctctcttcccaattggtgagggccaatgccgcactccctcccctctctctctttctcttccctattggtgagggcccccgtggcactcccctcccccctctctctcttttctcgaaattctttatctctttaatcggtttcactgttttaaacgcgaaaccgttcgggacgatagaagcaattacgcaaggccagcaacgatggaacgcacgatgctagttaaccgatttcgatttttgttattttttaaacttattaaataaaatgttgttgattattagctatcaaaaataggtgtcaaaaggtcaaaccaaaaatttaaacaaatgaattttattatagcaaaattaaactgaaaacattaatacatatagaaagggtgataaataaaataaaaaagttgcaaattcatttaaagttttacaaattcacaatggtatggtggacatattaggcaatgctaattacagtacacacttaaattgtcctatttgtcttttttttttttaattcgtcgacagcctactgtaccacgcaaaaaacaccttattccaagccagtgcccattcagtaaggcatgagccaattaatgttgcatgtagtaattggtcaatgccttgcagcatggacattgacttgggttaggtgagttttgcagatggtacagcaggcaacttcggcaaaggccaacatgcccacaacttgcaaaaaatgaggcctcatcaattgaacaaagacacataccaaatttgttcggatagaacaattttgatgggattttgcatccatcctccggatcaccccagcggaacagcgaacgggaatcaccgcctggctgaacagccgcctcaaatggagttgtggcgaacccattttgcgcagtctgcttgcggttcaatgggccgaattccaacgatagtcggccatgcggctttccgattcgtgccaggtcacggtt

SEQ ID NO: 24661 - DNA, 1372 bp, Heterodera glycines
aaggcacgaaacaataattgttcatcaaacttgagataaccatgaagaagcttttttacaaattcaaaaatacacttaattttttgagattatttcggataaaataaatgaattgaaataaattattcttctaatttttaaaattttattcagcaataattaatcgttagaattagccattattaaaccataaaaaattatattataagttatttatcttttcaattagtgaataacatttttctttaaatgtttgcctttttaaaatctttaacatttattttcccattgttcactaatatattttaatgcattcttttattggcagtagattatacgtaattggatcattaaaatcggcagaactcatcactaatttttaggataaccagtttttcacagtgacaaatttgaattgctagcttaattgccaataatatttcattgttgcccaaaattttgagatttgatttttcgaatttttgaaaattttcgtattttgaaccaaaatgagtcaattttcaaatattttatacaaaaatatctttatggtgctaattaggccatggtcatagtccaccggaatgggttgtaaaaattaggcaccgttttcgtttgctttcgccatcctcttccactgctttattcgtccaccatctgtcgtattggcattggcatcaccaccaatgccgccatgcctgttcgttgtcatgattttgttcaggtctgtgttgtcctccatctttggcattttcctttgaactataccgatgccaaattttgctggttccattgatggcattggtgacatcgtctttattttgaacttttatatgatttacaaaaattttggacaaagcttctcctgatcaggaactttcgaatgataccatgattgtccaagttggttggcaaatacctccaaaaataattcccaaaaatcggcgtttttttattttttggacaaaaataaataaaaatattcatgttgcacaacggactcgaacctccgctctctccctccctttgtcccattactatcttacaaaaaccactgagctacatatacaaatcttttctgcattctataacttttttctttgccatccaaatccaacattgttggtatcattcgaaagcttaatgtgtttagaagctttttctatgctattgcttgcgattatacaaataccaaaaaaaacatgaaaattgcgaaaaagtcgaaatttttgaagttttttcgcaataaaacttttccaggcataaaaaacttagtttttttttgtaaagctaatagagcatgttaagaactttcgaatgataccaagattgatggatttggataacaaataaaaaaagctatagtggaaaa

SEQ ID NO: 24662 - DNA, 1743 bp, Heterodera glycines
aattttgctgggaaaagatggggggggaggagccgcctgctccaaaatacaccgactcactcactcacagatgtgccaccgccggtgagcagtgcgcgcattttggagtgcaaccaaaccgacccgctggtgaccatcacatttgaccacttggagcccgaggaccggacaaagccggtcgaggagttctggctgcgttacaccgtcgaccaggatgttgaccagggcaaatggcatgtgtaccccgtgccggtgaaggccttccagcatgaagtgattggcgattcgctacgccaagtgaatgggcggctcagcatcatgttgaagccgttcggaactgtaagttttttttttttacttccattcccattttgccttttattggctttttgatgaaaaaaaacattttaaattctgagttttttaaatttgtgggtaattatttattttcgatttttttaattttgggtgaactgtatttcctccccccttcctaaaaatttttttaaaacaaattttctagattttaaaaaaatataaaaaaaaacttttcaaaaaaatatatttttagcaagaaaactctaagaaattttgaaaaatgaaaaattttcaatggtaaatgattttttgaccgatgaataaatgttttcgagaaaaaattatgcaaatattagtaaaaaaaatgctcataaaatttacaagctattttgtccccctccttttcgagttccctacagtataatacctccattccccttacagtatgcctttcaattgatcgcacgcaatgccatcggggacagtgccgcctacaacattgagggcgtgtgccagacggcacagcaagcgccaagtcggaacccgtccggcgtccgtgtgatcggcacacagccggacaatttgatcatctactgggacccaatgggccgggaggaatggaacggcgaaaaatttgcctacaaaattttctaccgtcgcatggatgaggacggtgcatggaaggaggtggtggtggaagacccgtttgccgaccagttcaccatcgacttgggcgacaacgcaagggcatgggacgcgtatgaagtgggttttttggcattgatgaataataatggaattttgtagggtatacattacgtttaaaaaaaaatttttttttagttttttaatagaaaaaaagccccattaagaaaattagaaaacaaaaaaaatatttcaaatttaaaaaattttccggtggaaaacaatgcggaggagggcagggtgaaaaacgaactcctccaagttttggtttagtgtggccctatctgatggcctaataatactgctttgatcagggtcatattacaagcgtacaataaaaggcaatttaagcacactaggtattattgggtaacgtaacttatatagtacaaaaaaataaaaacaaattttaaatcctttttttaagtctatatttctttttaaaattttttgagtatattatcccattgtgtaccatttggttaaaaaaatcttgtttttaatgatcctgggttctttcctaaaaaaaattttgcaccgaaactattttttaatatagtttaccgagtcaataaaaatggctttccactcggaccccctaccaaatccccatatttttatccagcaactcatccatttcccaataattgattgaccaaccatgccatgtttttacccaggtgcagtgcgtgcaatgaacggccgaggactgtccaaatt

SEQ ID NO: 24663 - DNA, 1826 bp, Heterodera glycines
tataaaaatattttttttaattaaattcttttcccgtattaaataaatactttgtgggatagtttgttttataaattatccttaattaacaattaattacctgttcaaaacgctctgcaacatcctcttttgttacgccttcgtcgtaaaaattgtcgccaacgttcaacaaaaaatggggtgccatttctccagaagcaattttatacaattcttttttcgactttttagaagcaaacacttttgtaaaatcctataaaaacaatttgtttaatttttacaaataaaaattgataggagaaattaaagaatttttatatcaaaactttagttttttgttgttaggattaattaattaattattaattacttttcgaggtgtcactccattactcgtagcaagcgaatccatcgcctttgccactgctttttgtgccacagttggacgataatactttactaccgtaggatttttctcacaatcagccaccgttccttaactcacagtggtcacatatgcgtttaagtgattattgtatattcctattttattttctctcattttaaaatgttattttgttctccctcttcaacttaccgtgtccttccaccgtacactgctgctgtttgccctctaccgtatactcctccccaccgatgtcaccgatgacaaaaaagcgcaaaacatttccctccacagaacagccataattttgcgaatttgaaacatttgtgcatttaaagccaagttgattttcggggtcggcaacagaagaaaggaattgaatagaaaatgccaaagcaatcgaaatgagaaacattttctaaaggtaaaaacaaaattattattttaaattatgataaaagaaaatttctgagtgaattaattgagcagtgatagccttttatgcagaattttctacttaatgatgtgaagaaatcctcttattgacgtaattagctgatcattcattgattggaaaatattatttaagcattatttccataaaataaagatgaattattactatttctgtgaattattactatttctattgctagaaataaatgcagaaaaaataaaatatagtgaatttcgatttttttttaataaaagggcattttcatggcaatgatgtaaagcaaatgttaatagcaggtgggaatgaaattattttttaaaaatgataaatatagcaaattttcgattttattttttggccaaaaagggcattttacatggcaataatgtaaaggtaatgttaagcaattaaaaaaaataataaaaataataaatttatttttccgaaaaactttttaaatttgtaaatttttatttattagtagggctgggaataaaaatcgccaatcacgaaaaagtcataaaaaacatcaaaaatctcgaaaaaaatgtaaaaaagtcgtgaaaaattaggaaaatgtaaaaaagaataccattattgaaacaattatagaatagcatttgcaaaaactattaatttcgattacaattttccaaacttgtcatattaaaacgcattgtaaaatgggacatggaattgggcaagacttcaacaaagtaacctttttgtcgaaagaatcggactgaaccgtcgtctctggactgggatacagcgctgcgcgctttttgagcttcgctatctctgtaagctattgggttgtgaaagaggtacaaccacgggttgaagaggtacaaccacgggtggaagtttaaattaatttttgaaggcgcaaaccaatcaatcacttttctgatcaattgctcaagctatatagtacagcaatttcaatcgttttgttcaccg

SEQ ID NO: 24664 - DNA, 1347 bp, Heterodera glycines
aaacaaatagacaattttatttactagggttataccataaaatcataatctgtttttttatgatcaactattctaatgatttagcaaaatttcaaggttaattagccgactgaaaaaagtttttatttgtctatcaattggtaatattgttaatttcggttctcttgctcaaaaagtcaccattataaaattggccataacattggtcaaaatcgcattttctatcccatggtacatattcattaatagggctccaattttttattaaaaaagtaataaaattaagccatatcagtcttgagataaacaatttcaaaaaagcaaaacttgtcaagaaaataaatttaaaataatttgagatgaattttataaaaatttttcatttcttagtggtgtatttttgaaaattttcgggtcgtttcttagggggtgtatttttggttgctctataaataaaacctagtaaattggcactaataaactcgaaaagtagtttaacaacaccaaaaaaacaacttattttcgtgcttttcaggccattaggagctcagaaaaaaataggcaaaaacctgaaattgtagccctcattattcattataatcttttcatcattagtaaataaaaaaatttgatcaaaaaacgacaagtttttatggtacaacctagtaaatacatattaatgataattagctagcaccttcttttggagcattgcacaaaataaagaaactcaaccacttttcatcagtgttctcatttttcttttctatttttgccaatattttccacgaaaatcctttgatgtgccaagtttcacttctccgttcactcccaataacttctcgctcaaattcggacaaattttcaatttccattgaaagtgttccgctggatttgttgggatcagaaatgaatttctcctgcgttttttcatcattcaacgtgacatcaatggccaatgtcactttgtcaacatttttctcgtaaaagtcatttttcgggttcatcaattccttaattggccaaaatttgtgatcactgatcaattgtggaaataacataaattcaattatcactcaccgcaaaagtaataaaattaccaaatccaaagatgcgtaaattattgaaaacacaatcacaacgtgtcccaatggaattcgtcgctttgctctttttcgatacaattcgaaaggttgccgaacaaacgcagggccagtggtcacctatcattagttgtgtatttagtatcattcggtgcagaataccgagatgaatcaaaataagtttatcgttgacccaaacttattacggatttttaatacgtaattagagctggacatttgaaaa

SEQ ID NO: 24665 - DNA, 1705 bp, Heterodera glycines
ggtaattaagagcgttaattggtttcccgtggcctcacgaaaccatgggcttcggtgttgccaagcaaagcatcgtcgtgaaagaagttctggaaaaagcaaaatgttcagagatggaaaacaatgaatcgattatttagactccgccctctgccaagagactgaaaacaaacaaaaattcaaatattacaaaattgggaaattatgccctttcagtgatttttagtaaggcctgttggctatttatttactaattaaatgcgcttttagtggtacagtacagtaatcaaatcattgatgggaattctcatcatgggaagaacccccccccccctcccccgatcaatttcataattgcgccatgtttttgatttaggcatgcttattagtgccttcatttaatatcactcattattagatcatattttttgggttggcgcttttaattctactaaaatttgtacattttaaataaaattttcattttttttgaattaaaaaactattccattaataaaaaaaatctaataattttttgaaattttatttttttttagagtttttcacctaaaagtgccagccttatactaagcatttttttaatttgattttttccccctctttgttgccttctttttccattttcactcaacttttttgtggtaatgtgtctgcttttagcaaattcaattagtcccttcatttaattacccaaccaattaattaatgattattaattagctcatccgttatttttggtgcctttcccccatttttgtgctctttcttctttccttttttttgcatctttccttttcaccaattcctttttcattcaaaataaaagcatttccattttcatcaatgccttttatttaaaatttcaataaataattaattaattaattttaattgtttggcccaccttcgtgccgaaagaacagccgaaattggagggaacggacggcccaatagagacgagcaaagccatcgtttagccgtttgttgcccttcagaagaattggacaaaaattaatgccatggcactgaatagattaaaaaagtaatcgtatgttttgggtgcctggttacggtattatttgactacaccctacggtgaatggtattttcccgttttatggccaatttgaatatttattaagattcgtagtgttcggtttttaagttaaaaattttgccataaaaagagaaatttaaaattaatttaaaaaatatataaattttcatttaaaacagaaattttgtaatagaaattcaaataaaaatttgggttgaaatccaaaatgtgtcaaaatttattaattcatactattaatgaattgtcccaaaaaattgtcggcccaccggaaaaatttgaggcggaacggcatacacagaataaagtgctcgacttgtatcacttctgcagaataattgaaaaaataaaatggatttaatttaaaaaattttaaattatgacggcatttttttttttggaaatttggcaccaaaataaaaaataatggaaacaatattatttctcatgggaccacagggttgccttgggacaaaaaaaagggagccgaaaaattggacaatggaaatttggacaccgatggaatattggatatggtaaattagataccgtaagatgggcacctaaatttacatttaaaaaataataataaaattaagaaaaaattta

SEQ ID NO: 24666 - DNA, 796 bp, Heterodera glycines
caccgttttaattttacggaatttgaactttgcatgcaatttaaaaaagagaaaagtgctggtcagcatgaagattttgcagttttttctctgtctccatatttctctcagcataatgggaaaggaatgaatgattctctttttctcattccgcacacactctttcgcctccttccccatctcatacttcttttcctctccgctcacacacactatttcctctgtttgcatcaatatctctgctcctccctatgtaccaatatgcacaacccatacattttcttttaattaatttccattttagttgcatattttgctgtctgttcatcgcttctcggccttttggctaagatcaaagtgtagttacagttctttacggcttaatctccgtaacggcccttaccgggtcaaagaggttaaccaatttttgggaattggtcgttgcagggggcttgctcccgctcggctgtgcgttggcccgttgtttcacctgcttacgggaacggcgcgtctcccctgcgggggagaacaaaattaattttttttttttgggcaaaccatcgtcaaagcaaatttggcaatggtacttgaaagctccccagggttacaagaaagcgggacgtgactttggccaaatcccataatggtaatcaaatttcgcccaaaccttcccctccatccctttcaccctctctctctctcccccgccccgctctctctctctctctctcctagctcccatcctctcttattttctctctctcttcctctctttattttgttttctctctctctc

SEQ ID NO: 24667 - DNA, 1845 bp, Heterodera glycines
  misc_feature (1723)..(1723): n is a, c, g, or t
  misc_feature (1733)..(1733): n is a, c, g, or t
  misc_feature (1800)..(1800): n is a, c, g, or t
taatcacttgtaattttctaaaatttgtcatattttcaaaaattttccccgttgtcaatctattaattactggcttcgtatccgtaattaattataaaaatggaaggtttgagataataaataatttggaatttgttaaaaatccaattgttaaataaaatttatttccatattcatcaaacgctgtcactcatcaaaatgaggactttcgcttgaagaaacttttatccattggttttgccattcattcataaacaattcccaaaggcggaaattgctaaaaataaacggatgtgactttttgctctattccaatttaagcgtccaatggatgagcacaaaaaattttcttaaatatactcgaaaattctaatttcggatttctcattgcaatttctttcttaagtcagcgtttaccagagaatttaagctttttttgataccaagaatgtaggaattttacagccgctaatatttaatttgtcaaataaaattggatgtcaaatatggaagagcaaatggttcgataattaaattttataaagtactttttcaatttttgagacgttctcgagtttaaaagtttaaagactctcctcgagaacggaatggaaacgcactcatccatcgttcgtcacatttcatttatgcaaatttctcacacccaattttctcatgaaattggaccaccaccacccgaggcacacaaaagaggatggattaattaccaatttaattgaatgggaaagaacggcgaagagcagaaaaaattggggaaaattaaatagatcaccgaccgaagtaccgtttaatttcgctgaaatttgcgagtaatagtaaagaagtttttgagctgccgaatgataccagaattaattaatccttaaatatgctttttatggtcgtgtaaactgcaataaagtccaaagtaattcggtcgcaaataaagcatttttggcgttaaaaacttcagctgacgagttaaaaatgtaccgacctcttttgccactggccgagcggccaccagatctccaccatgtccgtagctatgtcccaccaatagctcctcagcggccttgccggccattgtggcacgaaggaccatattcagttcttcaatagagcaatcttggtgttcaattggtgttgagtgggttaagcccaaattgattgcttggaactattgttgttgaaataaagtcctctggcattccttccggcagaataattgccaatgaatggccagcttcatgtccagctgtcagcgcgggcgtgtcagtttcatttatccgcgccaaatcgatgccagcataaaatttgtgctttttgctccaccatctttttgcagcctttgaagcttttgatcttggtggcatttttgttcctggtatagtaaaaaacaacaagatttatttggtgtgacatccgacccttattgtacaattaagaaaacatagaacatgctatcttatataataaagttgagtgtgtgtatgtatgtatgtttgtatgtgtcattgtttgaattagtgtggcgttttgtttgagttttgcgttaaaaatgaatttgaaaaaagatgaaaagaaattgttttgaaaaagaagagaatataaagaaaagagacgaaaataaatagttaagaagaagaagaagacaaaagaaatagcacagaaaaagaaggtaaaagatttctccttctaggatgtagaggttagagggagnggatggtggngaaaatagtgcactgtctgattgtctgtctacgcgggcagcggcgggtgagaggggcatacagtgancagacgcgtgctgctgtgcagcagcagtctgttggacgcgtgcgt

SEQ ID NO: 24668 - DNA, 1410 bp, Heterodera glycines
  misc_feature (1043)..(1043): n is a, c, g, or t
cggaggtgcgataggaaattgtacatgcacaaaaaagcatacaattgtgaatgcacaatgccaacattgcctgttcacaacattgaatcgctcgagcacaattttataaacgcacccgaccggatttcagcctaattgatccggtctcgataaatatccagggggaattcttggctgtgtcaagccgttttctgaatatttgaaaacaaaggggtagtccgggcggggggggggggttgatggcttattattctgaccatttttattcgaattttagcatccacagcaaccgcaacacataaacgaatccattgacactgtcgatttgagttgtttggaacagcagcaggaagagagtggggatggaagcggagttggggcggaacaacaacagcagcaggacgaggaacttgttaccgctgaaacttcgttttcaggtcaacatgaaacggcgatggaccaatatcagcatgaaggtgggggaacactgacgcgttgacaacctgcccctgcattttaagctattcggcaaagtcacagtgcatcgccgtcgtcgatgctctcttccggttcgtccagcatgcatgaactgctcgaccggttgcccaactgcatcaaccgcaatctgatcgatgcgggtgcgcttgactttttgcgcaactacgcacgcagtaaaacccatcggaaacggctggtccaacactttttgcaggtaattagttgttaaatttatttaaaaatggtcaataatgctcgctctatatgacaatgctttaataataccaattaaaaagcaataaaaagcgtctgatcttttgccagccattttaggcccccgtcgaccggttggatttgctgcctttctacgctcgctttttagcaacggtgcggcccgcttatcctgacctgacaatgcaggtaacggggcgcattaattattgtttgttatataagccaatagacatttttattcccaaaaatccatgtgaaatataaaccaatattccgtcattttggaaagtattagtgagataatttcgctnttatcccttctatcatacaacgccatagattggatgtcttgttttcagtcttcatgagcttttgctccgcttcgcattgtcagtgggcataacccaaccgatgggcgcgggtgccccgcaaaaagtgggcgaagtgttgacggaatgacaagactggaggccagctgcactgggcacctttcttgcggaactgtcagctttcgtttttataaaccaatggcactaaaaaaattcaacccattaaattaaagttttaaggaaaaggtttttttttttttttttttttttctctctatagaccccacccccccacgttttttttttttttttttttttttttttttttttttttttttttttttttttt

SEQ ID NO: 24669 - DNA, 1218 bp, Heterodera glycines
ctgccgaaacagctgctgccgaacaaaattcgctttgatcgactgaggatccagtgattgaaaatgttttaaaacattattgtattaattaccgtatttattgaaatataacccctgtggggttctacttttcaacccccctctcgaaaggggggtgggttctaattcagagcggctatactatatttcaataaaaacggtattcacagtgtacccaattgttcttatcctctagattgtgcttattttcaggtttcagataaaaaaaaattttttttttgtcaattttaattttccaaacattggcaatttctctaatcagaaaacattcatattttggagtcaaaatcaatgagtgagtccatttttcagttacatcgacataaaaagagtccatttttcagttacatcgaccactctgtgatcgcttttctccgtcgcaacaagcaaatcttcgacaaaggcaccaatttgttcttgtctctgattgatgaaggcacaatttgggaggtggtggcacgtgaagtttggcccatctttgagcctggcattcgccacttggcctttcggtggggcaaatgcctggacaaattgcgccgtctcatttcgccaactattctcactgatctgaatcccaacaccattgattccggtcaactgttccccaatctgatcgggccaaataattgggaaagcgcaactgccggccaagcgcttttcatttggttgcacacgccgagcgccgacggccgagcaaagcgattggcatttcgagacttgaacgggccaagaagcgtccaatgggtcgaaaatttcgtagatgtatgtcagggatggcattccgaggcaccaaaaattttcggaattccgaaacccaaaaatttttcggaaacaatataactttttaaattgttgaccgaatccaacagtcttgatatcattggaaagctcttcacaggctctaatagcctactaactattactgtaaggaagaagctgactgtgcgcttaaatcgtggagatacgatcagtaaaagaaagggcaaatgtgcctcggtagctcattggtagagctgcccacggattttttttttctgagctgcgtaatcccttataaatagcttataaatatcttctaagcatttaagctttcgaatgatatcatgtagtctaagttagtgaacaaagaaaaaagcatagcatttttaactttttttt

SEQ ID NO: 24670 - DNA, 1642 bp, Heterodera glycines
  misc_feature (5)..(6): n is a, c, g, or t
  misc_feature (20)..(20): n is a, c, g, or t
ctctnnagagtcttgaaaanattttgtccaaaaaattttacgttggaaaattttcggtttttatcggtaccggtaccggtggaaaaagttggtaccggtaccggtggaaaaagttggtaccggtaccggtggaaaaagttgttaccggtaccggtttttgcattaccggtcagtaccggtaccggtttttttacaattaccgattaccgtgcaactctaaataaaacgaaaattaaaccccaaagaaacaatcccaaaaatttctgaaaatacacccttaaggatcgacacgaaaattttcaaaaataaaccctatgaataaaaaagtttcttaaaaattcaatgccttctttatattcatggttgctagcggtgtatataattttctttacatatgctaatataaaatatacatattgtatacatcaaatgccttctttattatctatggttgctatttctatataaattttcatttacacatcatagaaaattcaataaatcaattcgaatgtgtttttgtttgaatacaattaaataatttttcgggcagaaaaagcaaataattcttacaatttggtcatttttctaaattctattaataatttcccctctaaaattgaaaaatgagcatttaatgcctttaatctccaccattttctttatttaataatatccaaaatataattttgcatttcatataccgtacttcttcgaataaagccccaggggctctattgttcaaccgcttcaaaaatggggctatattcgagggtgggactgttttgttcagtcccttcaaaaatggggctatattcgagggtgggactgttttgttcagtcccttcaaaaatgggactatattcgagggtgggactgttttgttcagtcccttcaaaaatggggctatattcgagggtgggactgttttgttcagtcccttcaaaaatggggctatattcgagggtgggactgttttgttcagtcccttcaaaaatgggactatattcgagggtgggactgttttgttcagtcccttcaaaaatggggctatattcgagggtgggactgttttgttcagtcccttcaaaaatgggactatattcgagggtgggactgttttgttcagtcccttcaaaaatggggctatattcgagggtgggactgttttgttcagtcccttcaaaaatggggctatattcgagggtgggactgttttgttcagtcccttcaaaaatgggactatattcgagggtgggactgttttgttcagtcccttcaaaaatggggctatattcgagggtgggactgttttgttcagtcccttcaaaaatggggctatattcgagggtgggactgttttgttcagtcccttcaaaaatggggctatattcgagggtgggactgttttgttcagtcccttcaaaaatggggctatattcgagggtgggactgttttgttcagtcccttcaaaaatggggctatattcgagggtgggactgttttgttcagtcccttcaaaaatgggactatattcgagggtgggactgttttgttcagtcccttcaaaaatgggactatattcgagggtgggactgttttgttcagtcccttcaaaaatggggctatattcgagggtgg

SEQ ID NO: 24671 - DNA, 1217 bp, Heterodera glycines
caaaatccacctctcttcgtccaaaatcgattcaaatccatgaattcccctattttctattcaattcagtgcatttgaatcgattttgaacaataaaagtggattttggtgaaattttttttgtatcgacttttgttcgaattcgggtccgggcttcgaaattggtcgaaatgaatgccatattcgtgatcagcgacccgaatagccatggaaaacacacacctttttaccattaaaaacaccaaaatttctgacctggtcatacacccgttcctccagacaaatgatgacacaaaatttctccttgtaattttggaatttttgtggacattttctgaagaggacaaatgaacgcaatggaaaactaaaaagttttctcactttatccgtcgattcctgtccaacatgttcagcagaccgttttgggtatagctaaaattttatttggaaaaaattgaaaaaaaacacacacaaatttttatagtttcgttagagagaggtccaaatgctttttttcaactttcgttagagaggggtccaaatgctttttttcaacaagtattttttagacatttgtgatttttcgttgataaatttgaaaaaaaaaaaatttttttttggcaaacaaattgggacctcccctgccccctttggttataggcttccaatcagtgaccatctttagtgggtacaccccaaaatctcgccacccaaaatttcaaaaattttttttcaaacttagaaatttttcaaggaaaaaattcttagaaaattttttataagaaaatttaaaaaaaaattatttgttaagtttttttttgaaaatttttcgaaaaaacagtaatttatcattaaatttcaaaaaaaattgcttaaaaattttttccttgaaaaatttataagtttgaaaaaaaaattttttgaaatttctgaggcgagatttcggcgtcgagattttgtcccgtcccctctttagtttcctagagcataattctttttttttcttacttagtcaatgccaacattcttggtatcaaacaaaagcttgaagtctagagaactttttatttaaaagtaaatttggggcttaaggcaataaacaaaaaattattcttaattatacttgaaaaaggcggaatttcttgtttcctctttgtaattttttttcttaatgacagtatttgctcttttcttatatttctaaattccccaagact

SEQ ID NO: 24672 - DNA, 1203 bp, Heterodera glycines
cctatatccgcttcctttttgaatattttttttcatgttgtcgagtgcttcagccctacaacaaaaaaagaattagctatccatgtgaaacccgaaccaagtctgccttgctcgacaagaaagtaacgggagcgggtagcttctttttcgattgcgcacctccttccccgtatttttcttgctaccattgtcgtcgttctttccgctgttgccacctttgtcatctttgccggacatttcttatctgatttctaacgcaaatagataaaactttacgattattgtcaaaatattccgttgaaaatcagacagtaaatttagaacatgacgaataatttgtagtgtatttttattaaaatcacaattatttttattcatatccaaacggaaagacttcatactgctcatttattattcctttttggcacacaggcacatattttttgcgcatctctctcgtgataatgcgactatcacgtgtcggcattattttgttgtagcgaaatactgagggtgcatttccattattgtcgttcttccgcgtattggtgccgttgttcagcacagaccacaccgtcaggaaaaccgctggcctcaatctgccaaaaacgatgttccgttacgtaaatgtggtcacttaccttaagctttatgagaagtctgacgtagtctttgaatatttcgtcgctcctaaattgaaaaaaaatgtacaattaatcttcccgccggtacgcacccataccattcgtcgtagtgccaggctctccagaatctgtccactctgtagcctgattccaacgcacgttccagttcaatgtgtgtgtagttgccagtaaacgcacgttgctcatctgtgtgtatacatttatgtgttcggcgcgtatttgtctttcggaatgctgttgcacaatggtggcagcagcagaacaggaggcggtcgtcaattttgagtggtaaaacgggtattcgaagcccccgcggagggattatgcggaccctatagattccacgatattgtaattgctcagcccgagtccaatcgacaagcatctcctcagcggtcgggtggattaccgacggaacgccaaccggatagtcggcggaataatttacccatggatatagcgatataatatcgaaaactgatattttttcgtcctctttctgggtagcgatcagctgaagtggcccggttctaccgcc

SEQ ID NO: 24673 - DNA, 1092 bp, Heterodera glycines
  misc_feature (5)..(5): n is a, c, g, or t
ttttncggggcagtccccctgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatattttttttcagaaagtgctctaaagcgcaccaaattttatttacaacttaatttagcactctgatgctttagtatcaaaaaggaagatggagaaaaaatttttaaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcaccccgaaaaaatggatttaattttctctccttcggggatttttttccattaagtcgtccgatagcgttcgattgctctagtcaatttttaaaaattttttgttgaaatatttgtcgtgctctgaagggcgggggggggg

SEQ ID NO: 24674 - DNA, 983 bp, Heterodera glycines
ttctttaaataataaataaattattaaatacaattatcttctatttattatttgctaaccggttttcgtgaaagaaccgtagcataagtttcaatgctagatgccacgttttgcgtgtttgtagttttctacagaaaataagtatatatttttgaactttattatattttttattttaaaattttttatgtgtatatttttttttgagaaattatttaatttttttttaccataattgacttttcgttgatataacactgccaatttttttcttacacccaggctttcgagacaaagaccttttttgcagacaaagtcttgttaacactcttaaatttttattatattcggtatgtttttgatgttcacctcaaatttattttcaacaaaattgatgcctgaccatccgttggacgtgatccatggcaagctgttttcacttttcgcactgtcctcagtcacagtctgcaaaatatttgcatcattctttttatttaatattttttaaatgtactcacttttccattcacaattacataagaagtttccatttttttgatagactccgataattgtggttgcgcagatcgcaaaactggcttgaaaacagttttgatctaatattttatataaaattagaaaattaagaaatatgttttactggagaatatccaattggtgtggaaagcttttgcgccacaatttacaatgccttagcaggaaccggctaaaattcgtaaaaattgtaagttaacagagaattaattaatattacttttccattttcacggtcatccattgatttttctttttttcacatttcaacggcatttttttagcacactcattcactaaattcttttctttgacctataaagatggacataatttgaattaaatataaaaaagtttgtataccggagccaaaccaacaatcggtccacagcgctgtgcgagaattcgctggttgcgctcctttttgc

SEQ ID NO: 24675 - DNA, 1032 bp, Heterodera glycines
agcatcaaatccagcatatgaccatagcaacatacgcttggaattcatgtcacaaaaaagttttttccgtggaggtatctcactccagttcaatagaatgcgcattttgttcaagtatttgggaattattttgataaatattggttttcaaaaaggaaaatttttttacggaattttttcaaattttataacaatgttttgtgaaatagcccattttaaatcatttactggtcgatggaccataaaaagcggagtcgtcaccctcgtcaaacgaatcctaaattaatgctaactaattcattttaattggtaatttactctttggccacgcgaacgtttagaccatgatttgcactcataatgaaattgaacctcgtcctaaataatttattattttttacatgatttatattgctattgcacctgctctttttggtcaattcaaacgaacgcgctatcgtcacactcatcgaatgagtcctatatttattttgttaatacttatttttaatttattttcattactctcattcctaacgctgccttagaccaaggctttggctgcttcttctaaaattgttgaatttaatatattttattttttatagattagactttttcagtgggttgtgttgagaattgagagtatccttttggacgctctacgggtggaaaatcagcgcgcttgtattgcgacatggtcctgtaattattatataaattatgtttaacgttttaattctttacaattctttcgggtcaacgaatgtgagcccgggtggtgatttttgcaaggcttttccttgactcgtattttggctttgtgagctgatttctaagtatagataattgatattcaattattttttgatcatttctacctttttttgggggttttttcaccaccttgttgcatatttaaataatataagtaattaaaacactataactcttaaaattgagcggaattttatatttaattataaaggattataggcaaatagcaatatagcaatagtggaaaattaaaag

SEQ ID NO: 24676 - DNA, 1327 bp, Heterodera glycines
  misc_feature (15)..(16): n is a, c, g, or t
  misc_feature (26)..(27): n is a, c, g, or t
  misc_feature (80)..(80): n is a, c, g, or t
tctttccatactttnntcattcattnntataaaaataaactataatcgactaaagctactttttttggtttaaaaatgtntagaattcagtcaaaaatccataaaacgctttttaatgttcaatatctgttaccaaatcatgcaaaattttcgaatttccccggcgcatcctttatttcaaatttgaccaaaaaaattacctttgtgaaatatgttaaattcaaaattatctccggaggtgcctttcggcaattgtcgccctccatccatcagattttttggaaacaaaaacaaagtgcgcaagcgcaagaagaaagcctttttgaatttttttagcagatttcactgaagttacaaattttaaaaacattaaagttaacagtaaactaaatttctcactttttatgcaccgagaaaatcttagggaatttgaaaaaattcaatcccgaaacgtccaaattacgatgttccaattgttttcttatttttttaaattaaagactaatgattttattaatttgaaaaataattaataaatactttttttgatggccctggtttattgtcccggtttttcctaaaattcgatcccttgcatctctactcaatagatttttttggaataattgtcttcaaaaatttaaaacaaataattaaggaaaaattgaatttaaatacgaatttagaaatgctacattttccaattctcacgtgtttgcttcgacacttctgctggcgaatgttgaataaaaagggctcgtccgaagtttgagttcatctaaagtgaacaattaatgttccctataaaaaccaaaaataaaaaataatttttttttattcttggaaaaggctcaaaaaaattaatcagtgtaaattaataattttatttattttcaattgtgttttattttttctcccattaaattcagttcggcacttcctaaaaatttttgttatttcaaattaaaaaaaaaggatccaaattgaacaccacgacgggctactttcaagtgtaccgttgacatttaaatattaacaaacctggccttttatacattcgaacatcggccaatcggtcgatttccttggccatataagacacttgcttatacgcctgcatttcgccaacttgttgagcaactctttcggcagtttctgttgccacctttagctgctgaatcgcatctttgcccaatttggagtcttttacatttgatacaatctgaaaaagtaatttttaaataaaaaaagtggtaattgtgagacaatgcaaaaaacaaaacatcataataactgacccgcgtcatgtgatctgtgaattcttcaa

SEQ ID NO: 24677 - DNA, 1079 bp, Heterodera glycines
gagtggactttgggtccaaaatatcgccaattattatcattaattaaataaaaataatatcgtatttaaatccgttaaccttgccctccttttcccaaaatccctttcaatgaatgcccataattttccggggatgccctttttgtttttagagttgacttttggtccaaaatatccccaattattatcactaactaaataaaaataatatggtatttaaatacgttaaacttgccctccttttcccaaaatccctttcaatgaatgccaataattttccggggatgccctttttgtttttagagttgacttttggtccaaaatatccccaattattatcactaactaaataaaaataatatcgtatttaaatccgctaaacttgccctctttttcccaaaatccctttcaatgaatgccaataattttccggggatgccctttttgtttttagagttgacttttggtccaaaatatccccaattattatcactaactaaataaaaataatatcgtatttaaatccgctaaacttgccctccttttcccaaaatccctttcaatgaatgccaataattttccggggatgccctttttgtttttagagttgacttttggtccaaaatatccccaattattatcactaactaaataaaaataatatcgtatttaaatacgttaaacttgccctccttttcccaaaatccctttcaatgaatgccaataattttccggggatgccctttttgtttttagagttgaattttggtccaaaatatccccaattattatcactaactaaataaaaataatatcgtatttaaatccgctaaacttgccctctttttcccaaaatccctttcaatgaatgccaataattttccggggatgccctttttgtttttagagttgacttttggtccaaaatatccccaattattatcactaactaaataaaaataatatcgtatttaaatccggcaaaactgccctctttttcccaaaatccctttaatgaatgcccataatttttccggggatgcccctttttgtttttaaaagtgacttttggtccaaaa

SEQ ID NO: 24678 - DNA, 1173 bp, Heterodera glycines
ttggatcactggtatggcgcaattcccggtctcgcggcccgccttttgtcgcttttatcccggtcttacggcaccgttttcgaccatttcggggctcatcattttttattttcatttctgtgttgatatgaatgattttgaatttgtggcttttaatttgaaatcgtgtcaacaatttccaacaatttcaggacattttccactttttcaattatgctgatcagaaaataaacacccacaatttgctgctgatcagtccacgcttcagcttcaccaccgacacacttttccttaccgtagtagtcaatttctaggcatagactcaccggctactgtagcgtcaaaagactacaacaaaacaacaattttatcagctcccggcgatcattgacgccgctaggagcaaagatcgtcttctcggcattcttcgttcttcgtccgttcttcgggcaaagatcgtacgttggaaagtgaaatatatgatcaaagcctgatcaaaacattaccaatattacatttacccaaaaacattcggataattagtattttgcatttgttatgtgatcagactggccaatttgatcaattctgagtaactgatcggaacacaataagcaaaatataaaaaagctgagaatacataatttcgttcattgttttctggatttgatttaacttaaagctccaattactaaactcttccgttggccaaatattttttggtaaatattttttatcataattagactgaccattttcgaatatctgattggtcgcgctcttaaatcacctgtcaataattttgatagttcgaaagtgttcttgccggcttagtgtcatcctggtccattcatattcatttacaatctcttttttcattaatgctcgagaatatcgctttcgggtgtctcgacggactttctggcaaattttctgtatcgattaaggcttctttcaacatgacagtgccagcatagcagcagcagtgccatgcgccctctgtgccgaaaacactgacaggagagcctttgctggtcggtcttcgctccgctacgaactttggaggaccaccagcagtacgtaaatttgaaaagcattgcttttgaacaaatgttcaataatgtaaagatgtcaagcatttaaaggggattttgattttgagtctaaattaaa

SEQ ID NO: 24679 - DNA, 1455 bp, Heterodera glycines
aaaagaacggcccgcggaggttgcctttgtacacgacgtggtcgatgaagtaatggagcgagtccaaattgtccaaaaagccttaagggaacgaatgccctcctaattggacaccaattaacgcaatcgccaaagaccttcaaatcggggctcatcgtgcggagcagctgatcccagccaatttccattgtgtattccacctcaaaatgccgctttttggggggaagttccggcggggaatggtcaccagaaatgccccgtacaattcccacacttcctcacgactcattttggccaatgcgctgacactttcgacaattgcgtaagtctccgagtcggggtaatgctgatttacgatgttctccttgccactttcgaagcccgccttttgccttcatttgcaacactgtttacttttaattatctttatttttaaattgacaatgcttcgcgccaaaaatcgtcgccgaacattcggatcatcagaagacggatggattcgtggataaagccgaactgaacagaaagaagcgaaatatggaagaaggacaaacggacggaagggatcaattaccatttggaacagagaggagagaaatgaggaaataaattcaaaaattaattaattaattggacaaaattattgttttattcagtcagcccaaagcaaagcaattaattaagggatgggaaaaatatgagagattttgcaaattcccgccacttcttggctttctctgcttttatttcgtaaatatgacatactgttgaatggcaaaacattttgccataaaatattccacgaaaatttccgtgccaaaagggaaaatcgctgacaaatgaagccataataaaaatatccattagtgaaataaattggacgcaaatgattaacaattttcgagtaaatttccacaaatgaattcttttcactcatcaaattgggtggttgagaaggaactgactgaacgcgtagtccatttgctgtgctcgccattggggcgcctaaggcattttaattaattgactgctaattaagcaaagattcatttacaaaattcgcccaccatatgacccgcgcctcgaacttaaattgtaaaatgagtgaatgggtggccaatcacttggccaaacccgtgaggaaggtcaaaaagcctcgggcataaattgttttgaagccggcgatttgtctcgcgactttccacggctgtttgttgatggaacgctaaattggctaattaatttgcttttttcattgcaaacgcgccgaactttaagaccaagttgcgcagtgaactgttgaccaagcaaaaagttgcacgccatgtccgtgtcaccgtaatacaaaagcacgcggacgtgcgccttcagaatctttttgacgaacggcgaagtgtcatctttgacgcgggataattagctgataaatgatcggacaattaccgtattgccttt

SEQ ID NO: 24680 - DNA, 1423 bp, Heterodera glycines
aaaagattaattttatatttttataaaacaaacattataaagcttattattataataaaaattagtagcattcaaatccgaaatttaaaacattttatgggaaatacgttttttggaagagtcattctaattaaaatatttatcaatatgaattatgaaattcattagtatgaagcaatgcttttgacacattattcatcggatcatctatcaatttaacattagcacaaagagtcgtgcaagcaaattagacgagattcgaagctcaggaaatgtttgaacgcacaactaaaataccaattaattaagagataataccgttattaattataaattaattataattaaataaactcattgaataattaattctaattactttggtcagatcaaacaattttttctgaggcgcattattttcttcatcaccagcaaatcttgagtaatgaattgcattttttggttattcaacggaaattcactgacaatgcttctcaatttgacgatataatcctaaatattattcattaataaatcacaacgttttgacattttaattggccacctgttccatgccaatccgttatgaattccatgtccaaaacggcgctttggctccccaattgtccatgggatgtttgttgttaaacaacattcggtagagcagcaaaccgacgaaccacaccaagtctttgcccgttgttgtgcaacgattatcttgaatttcatttaattgtaaatttaattaattatttaattgggtaattaaatgggtaattaagtggttaatgacaaactttgatttgctctgggctcataaacagcacatcttttagccaaatcatcgggtgttttggtctctgttccgatggaagtgtcctttcccgtaggtctttgaccttttccaccatttcgttaaattcaattttcaaatttcgcgccaattcttcgtcgccaaattcaaattcattttgacgaatcaccgaaaaatattcaaatgtctcgggatacagtaagacaatctttgtcgccaaaacgcttttagtctgatcagtgggacccaattggattggatccgttgcagcgagtgaacttccgggtgctgaaaaagtggaaaattttaaattttgtaagaaaatttaaatttgcagcatttcctaatcgttgtttttttgtggtccctgttttcccaaactgtggaatcataatttataattaagacaataacttcttacaaagcacagtcaacaaaacagtgagtcatcatttcggcattcctcggcaaatttttgatggcacggcactgtgccgaagaattgatcagcttgaatatgttctggcgacacacaaatggtgtcaacatctgaatccgtcgtaaaagcatccaacatcattgatccgcttaacaacaaatcgctttggc

SEQ ID NO: 24681 - DNA, 1683 bp, Heterodera glycines
  misc_feature (1642)..(1643): n is a, c, g, or t
  misc_feature (1653)..(1653): n is a, c, g, or t
  misc_feature (1657)..(1657): n is a, c, g, or t
aattttgccttgtcaaaaacaaaattggacaacatgaaacggaactgaaatgcaacaaaatgcccatcatttgattactaaaaattctaatatttatatttccatttttactttttgaatttcaaaagcctcaataaatatttggcggcggaatggcgacgggaacagtgtgaaaggcacaaaaacgcatgaatcaattcttaaaaatttgaaattaaaaaaacaattatcattacctatttaattaccgagttttcgttttgtctgctcgcgttaccatgccaatgtaatgggcccaaatgatggcatcatccaccaattcatttagatcagtatcatcttgtacaaatgtttccactaaaaacattgattcataaatttgtttttggcatttaacaaagtcataatttttgggccatatttttatttataattttaaatttaagagacaaatttaagtagacccaaaaatcgtaattctcgggccggctttctttaaattatatatttagattaatttaaatcgaaccaaatatcgtaattttcgggccatatttcattaaattttaaatttcagagactttaagtagatccaaaaaatcattatttcattcaggattttctaaattatgtattggaatttcatagacgaatttaagtcaatccaaaagctttgattatgttcttattgttgaaataagaatgtttttcttaaataaattttaccaatgttcttcacatcggttgtcccattgttcaaatgagttccgatgaccaataaaaatgaaatggcaaagaaaaatttaatcattttcatttattaggagtaatatttaaatggagaatgcttaaacatttccttttcctttttacataattaattaatattcataattttttattaaattaaaaaataaattgctatttcatatgtataagcaaattgaattaaaaaattctgaataaattaatttacaataattattcattcagtttttatataatttacaaacatatttgcaagtttggtttattcatttttacttccgccacaaattaatcaactaaaaatcaatgtttataaattaatcgtttttttgagaggatatgtgccaaaacaaataagcatgaaataaatgtgaagatttaatttaatttatttttttgaatgaaatgaagatcattgcaaatccgagcgatcagaattaaaattggagctaatgcaatttacttttactcttcgtcacaacttttttttatgataggcctaatttttttaaattttatgaaaggctggaggctgccgaaaggcagcgccatggaaatttttaagaaaatatgcaaaattgttggaaccagtaacttgaaaagaatgtttgtcacttttaacattaagcaaatattttgcaaattaaaaatattataaatattttatccaaaatattttcaatttccttttcagtaaataaaatatgagtcaattaagtaatagtctatatcattttttaatatttatcctttaaataataattacataatcaagaaagtcaggaattgttgttgaatttaatcccgaaatatgaaaaaatagcccgtaatacgaaaagactttaaaataggaaaaatagggatgccaattagnnaagataaggntcanatagcaaatatcatcatcatcactct

SEQ ID NO: 24682 - DNA, 1769 bp, Heterodera glycines
tcatctaaatttcaaaaaaattgttcaagttttagcaaagttatggccaaaagtacacaaggggccaggttttcgaatattttttgccataattttttgaaacttaatgaaatttttttgaaagttttcaggctaataaaggacacatagggttatcgaataatagcaagaaaataaaaaataaaaataatttttaactaagaatttttaattaaaaataaaattattttgatcatcaacaatttgatcaaatgctcaatgaacagcttaaaaagagctgcccattggttggcaatgggtgggcacattcgatggtcaagcgcatggacaaaaggggcacagaactgaaaagattaaccagcttcacgatgctttggcatttcgttgctttcaaacattcatccgtttgtttttgctcacttcgccaaatttggtgcacactctgtcgtccatgcaatagaagtaagtgccggagagattctcggccctatcggacagaagcagttccatcgactagaccataatggaggccaaatgccggcataaatctggtattgggtgccttagtttggccaaataccctcgtgaatggcattctgtcccccttttcggtgactccgttccccttacatattgtatcattccatttgattacccagcgatttcgctgatctctccgtgccgttccaccactttcttaagtgccatgacaatctcttctccccttcgccgcacacaaaagtcggacggaggaaaagcgcgtggaagggctgtcctcaacaaattggcaatctgtcattattaatcatttgttcttttcacatttcgcatcgtccggaagggttttcccgcatttgtctcgcccggccaattcggcctttgtccgctaatggccaagcaaaaatttggagggtaatccgcgatggatgtgctcagcgctttcgaacgttcgcccgggggaatgttggcgaaaacatcggaaagggaggaaaaaattgtgaaaacggaggaacgaattggaaaaaggggaaagagaaaatgccagtggacggacacaattgaattaggccattctaagtccaggctgccaaaaaaatttcggtggggtgaatcctaaggctttttagctcataacgggcctaaaaatctccaattgcagcgccgggcaaaaattgccattttgccaatttttgggttcaaaatttcaaagaatatggccaaattggagttcgtcattgccttaggcgccgccgagaaaattttttggaatataaaagaaaaattgaattgaaatttggaacttcaaaaaatctatttatttttggccagaagagaaaaaaaaacaattcttcgaaaataaactgtctttattttaataattgtagcactggcccacagtcgaatgagcatgtttttttccacaaaaggacaacaccaatttttgagcgcggtaatgctttataaaatagcttattttaatgttttaaaatttattttatattttttagacaaaaatcaatgtgcagaatgcgctcaatgccaacctgtttattctgtttgcgaatcgaaaagttggagatgaggtaaaaaaaacaaaaaacaaaagattttacctggttttttcgacttttacctacaaatttttaaacactaagtgttattgattctaacttaaaaacctaaaattggggaatgaatggcactcgaaaaccgaaattggtaaatattgatcataggccccaaactcaaaaatgcttaaaacggtcaga

SEQ ID NO: 24683 - DNA, 1993 bp, Heterodera glycines
tgacaattgtcggacaaaaatgggaatgagagagagagagagaaagggaaattagagatcgctaaaaatgcaatgaaatttaaaaattctaatgaaaaattacttataattccatgttcaaatgctttctcactttgattgtctctgcacaatttcctcccctaatacttaatttataattgtttaatgtttgctcgttcctctcacattttacaatttaccactttttcagattgttctttcaccattggcgaagtgccactaatccatctgtgccaaattaagggattaacgcattcaccggaggataaattcgtcattttcactattggggggattttgatttggattatatacggaaaaaacaaattccaagtaaatccctctcattttttgtttcttttttgggtattgaatttcaacattttcgtttatgtaaatttttcgttcctccgtaatttgcaaaaagaaatgcgatctttcgataatttattggatattatttttttgtctttgcgtttttccaattacaataagtctaaaagtggaaatgccatcgtcactaatctgataaaaatgccctcccccccaaatccccccaaatcccatcatccatcattgttattgttcccttccccttttccccatttataatttacgtttttctccgattttatctacgccttgttttttttccaaattcattccttcgctctttcgttatgttttccctttgctcactgtccaatttcgtccccgggaggcaattatccgcaaaagaatcagtccatttgggtaactttgcccgggggaaaggaaagggaaggaaaggcacacatttgtggaacgattaggggggggggcacgtaattgactgttgaattggacagatggtcaaaagtcgagcgggtaaaagttgcgaacaaagggacgggggaaaagaaagcgcacatctgccggggggggggggggggaatgccccgggggaagggggagagaatgtaacggaccaatgacagacaaagagagagagagagcaatgggacagaccaacggaatctgttggcgcgaatcgttggcattaattaaaatttatgacgcacaaatgtcaatttggcccatctgttctgaaacttttaaaggtcgaaaaaagaaactttctacccctttccctctcctatcctcctctctctccctatctcttgttttctctcccccccccctctctctctctctctttctctctctctctctctttctctctctttttctcaatcttgtttccccaacaataaaaggttgaaatggaaaatcggagaaaattggaagatgatgattatgaaagaggaaggaaaagaattaatggaattgcaagtgaatttggcatggtccgatgggctcagagaaagacgaatattttaaggcaaattataaaaattgagatgaatgcgcaatgtttgaaatgggatgtttcttcaggaaaaggcaaatattttttagccaattgaaagagaaagggggggggggagcgatcgaaggatcaccagagggagactgatcagtcccttctgttcagtatcatttgctatccgatcggtcccaccttagctttacgccgtccaatttgtcactcacccaacacaatcacatgggccggttcgcttagcatttgctgtcgcgtctccgtgtcgatcaaagcgcagaaaaagcggccgttgtctcgtgcaaattgaatgcttttcagccgcaaatggtaggccccgttctgatcacaaatgggaactaatcacagaatgcgtttgcttttcccacctgtgccgcagtgtctgtcaacgaatagccatctttgccggagggggaaacagccgttcgttccgtgaaaccaaactaaatttaaaattaaatcccgtcacatcaatggctatgctatttaaaacatacattgccgtttcgccacaatttggtcattccatttctatcggcttctgtttcg

SEQ ID NO: 24684 - DNA, 1295 bp, Heterodera glycines
aaaaatcgattcccaagggcgccctttggcattcaatcttcttgctgggctatttttggttccagaatttatacccaactgtgcccttggcgtttcaatgactatttctgtttcctgactaaaaaagcaattcccaacgacttccttggcgttcaaggactatttttgtttcctgactaaaaaatcgattcccaagggcgccctttggcattcaagaacgatgctgggctatttttggttccagaatttatacccaagggtgcccttggcgtttcaatgactatttctgtttcctgactaaaaaagcaattcccaacgacttccttggagttcaaggactatttttgtttcctgactaaaaaatcgattcccaagggcgccctttggcattcaaggatgatgctgggctatttttggttccagaatttatacccaagggtggacttggcattcaaggacttttttggttccagagtaaaatgaaaacgattcccagggcgccctttggcgttcaaggacttttttgtttcctgactaaaaaagcgattcccaagggcgccctttagcgttcaaggacttttttgtttcctgactaaaaaagcgattcccaagggcgccctttggcattcaaggacgatgttgggctatttttgcacttaccaatgtcttttttcatcgacaatagccattcacgagtgttcaacagatcaatcaattgatctggtggcaaatccgtatgtttcaacaaatcattcatttctttttcaattgtctttttaaattcgatgatcttcaccgtttgattaggatttttcgattttcgcaaaattttttgcatgcattcagcgaataattgacgactttttttgtattcatcaacatatttttcaattattggttcaaggaatggaattttcatcgaaggactgaaatttaaaatttgaatattcaaaaaaaaaatttttttttcggttttctgattatattcattatcctaaagttattagcatactaaataatgttttataaaaatttttaatttttttataaataattttaaaaaattaataataacagataagtgctaaaaactaggccaatcataatttggtgtattgatggaaaaatatctatgaatttttaatttttttttaccaataaatttttttaaatatataataaaacataaaaacatacatataaagaactatgataattatatatttgaattttctattaataatttgttaaaagatcagataactaagccaaccatcataatttggtgtattgat

SEQ ID NO: 24685 - DNA, 895 bp, Heterodera glycines
gaagcatcccccctctccaatccaatgcttaatcacttcccccacctctccccctaattattagtctgatcagcccatcccgctcccctaatcttccattacccttcacatttccctccgttttcttacattgtccccaagagacacgtgtttgtacacaatgtccacacaaaaccacgagccctcattgcctattctgtccaaataaacgcgcatcgcatttctctcctgtcgggccggcgaattcttttgcatcgtcaaaaatttgttggatttcacatgcaataactgatcaattgggggagagaattagttgaaaaagcgaaccaaatacaaaatggaataacctgaatggaggagccatactgaaatgggaagaagggcaattagacaaaaagtagaagcagcaattaggaaaacaggggactaatgagaaggggtttacgacagcaacctgccaattgtccccctttattccctgccgattggtttctctctctatcccctgctgatcaaatcagtatccattcccttgtgccccccccttcgatttacttggaccacactgcccagcattttgctgtactccaattcgttctgctcccgctccttctccgccgccactttgagcttctccaacatttcctcgtccaccgtttcgcccatccgtgcctttttctgctctgcccaatattgcttttgtgctgcgtagcgattcacagaacaaatgcgaaacagacagtcttttgagggtcaaatttggcatttttcattggcattcgtttggaaaattcagtgatttattgcgaattattttcatttgtccacaattttcacctcggaatgttttcggtggcgattggattgtgccctttccctcctccacgacgcatcg

SEQ ID NO: 24686 - DNA, 476 bp, Heterodera glycines
aaaattttcaaaaaaatcaataaaatcccgcataatcccgcacaaaaaatcaaatttgcggatcccgctgcgggattggaactcaaaattctttgcgggacgggatcccgcgggattaatcccgcaaatcccgcaatcccgcaaatcccgcattttccaaaaaatgcgggattgcggactgggatcccgaaaaatcccgcgcgggatcccgtcccgcgccggtctctagttgtgaccatgtgccattgggacgaggacgcccaacataattgtccaaaagcctaaaaacttattctaaaattgaaaattttatttgctgaccaatcaatgagaggtcgaaaagccgccaaatttccaaattccatgtcaagtgctgtcactgcattcctgacatcacaaagcggaacgaatgcgactgatgtgagcatccgaacattcaaagcaaacaccggatcagaacaataacgcttaaattt

SEQ ID NO: 24687 - DNA, 1484 bp, Heterodera glycines
acatattagattcccgaggttcctttacggactaataatcacaaaagtcaaatttatgaattcataaaataataattcttgtattattttgtaaaaaatgcactagaagagttaaatgaagaaagatgggatggttcacttatatttatgatggatggcgagcacataaaataataattcacggcaaaacggtgacccaaaaaagaaacaaatttgaattggattttgcttatccccccatattcccattgatttttatttcagcaaaatgatgacccacaaatgtggggagagattttctcaaaagaaatactattacaatgtgcaacagatagagaattttgtacataatcaaatgtcgagggttcaagatgaaaaattgaaaaatatttaaagaaatttagagaatactttaatttaaaaattttttgattaaaattaaattttaaaagaaaagattcataaaactttgaaaaatatttcataacattaaaatatcaaaagaaaaattatcaaaaaagaataaatatggaagagttcaatgaataaaatgaaacttgcgacaattcatctgaacatattttatttttttaaaaataaattttgggtcatttaaaaaaactaatcttaaaatagctaatacggctacgccatgtgacaattcttaatcacatttttacgaaaaacttgcgcaaaaaatagcatgtcagaagaaaacgaaggtgccaatgccacaactaataaatgaaaaattgtagggagagtttcattattctaaaaagaatatttatcatcggttttgaattttgtaaaaatattaaagttgtgaagtaatttttagcaaatcccgtcaaaaaatgatttatcttgaaaaaagcttcaaaataattttttaagtgtaagtcaaatgaaaagcaataaacaattattgcagggctcggattcgtacttcgatgccaagtacatacttagatttcggcttttgtgcttggaaaattttaactgtacttatttccaagattgtacttggaatcgggatttttgcatatgaatgtaaaaaatatacattttatgaaaaaaatttcaaatttttggcattttgtcaaaataaatattaatttttgctaaatttaacccaaaaaggtggctggacatttcgacaatgaccgtttcgacaatgaccattacgactatatcaaatcgccaaaatttaaaatatcaaattaaaaaataataaaagaatataaaaataataaattaattataaataattgtttattatttaatataattgattaaatttaaaatcagggttgccatcgcatttcacaagcttatagccgagatttaaaaagatatatcaagataaattacactaaaataatattctgaaattatgtgcgaatttggactaccttttacaaaaaataaacagatgatttttgaaattaaaagaacacccatgatttgcacagtagaagccc

SEQ ID NO: 24688 - DNA, 1709 bp, Heterodera glycines
agccttacaaataagtaaatagaagtttttcaaacttcttaggttttaggttataaaaaaacagaaaataggccctaatattcagtatcttaacaaccaccaacaaaatgttttgcatacgcttcagaccatagggaactctgaaaaaataaataaaaacctaaaaatcgtatcttattgattacgattctgacacctattcaatcaattccgaatttttttcccaatctgaaaaccaaaatttgtaataatttaattttttggatagggattggtcaaaattatattaacaagcatcgggggccaccaataaaagtgctcaattttccacaaaattcaaattttttggtccaaaccgtttcagaatttttgaatgccatttgtaaagaataaaagtatttgtattacaacccaatataatcccaccaaatggttagctgtatttagatgttttttccaggcaaaattataatcagaatttaaagaatgaattatatatttacaaaaagcaattaaaatgtttgtgaatgcattttactaatactaccgatgataatgatacctcccccgcctttcgaaaaaaaactcattttcttcttaaggaagttgatatatttctcataatctcttgcacgataatcactgttaaattatatagtattatttcatgcattttcgtttaatttgaaattttgttcgagtctgggtcaggagttcgaaattggtctaaaaattgttgtcagaatcgtttctcagacgccgaaaacccgtttattccgaaaaagggggtggcgagtaccatcggtagaaaatattcactaagttcaatgctccgcaaaagtacggcgtcttttgggcgtcggtccgcgccgtccgaccgcggcactttccgccgccgcttctgcggttcgctcgtcattgtcgctcctcgattcttccgccataagcaattcatcttgtgaagattcttttcgcggctgttgatggtacgaacgggcggaatgggaggaacggcccaacgatttgtcaccattcaccagaaaatgctcctgcaaaggcacaaaaccttttttaaatgccgggtacggatttaaaaaatacaaaaccaatttaaatatattaaattacggactttgggcaatccgccgtttggagggttccctccttctgtcgaagaggcaattccggtgcccaactcgagcagccgggaagaaatgggcgaagtgaccgaagacagcgaaaaaatcctgtccatctcgctgaactgctgcttcggtgcctttttctgtttcgcgttggcggacgatgagaaaaagctggaggatgacgaaacagcagaagcggagctggcggacccatttacggagtcgagcaatttaccaaaacttaaaaaggcattactcggtttaacgccaatttcgaaccccgaatttttgttacgggtaaaaattcgtattaaactcaactcggataacatttccgccatgttccatggcctcctccaaatacgttgtttcaaaattgtaaatttgcttctccaagtttgcgagagcaatctgaagttggagggtaaatagaggcaataatctcaatatattctgataaaattgacggaaatatccgttcgtcgcttaacagctcgacattttcttgttttgcgtctgcccttgcgttagtcataagcaaataaaaaaaacgaaggtgcgcgc

SEQ ID NO: 24689 - DNA, 1928 bp, Heterodera glycines
  misc_feature (1833)..(1833): n is a, c, g, or t
  misc_feature (1892)..(1892): n is a, c, g, or t
tcatgtctaagaatgtacatatgtgtaaaaacaaaaaatatttttctgaacgaataaaaaaataaataatttaataacaataaaaaaagaattttctacaattattttaaaacatttaaaattaattttgcaattttctttttttttaataaaaacattacacataaaaaaaataaatattttcttaattcaaatcaaacaaaagtaaacaataaatatttgagcaacttcggaatgcaacaaaatcatttatgaagaacaaaaataaatgcaactttaaataaattaaagctaatagtcatgtacggcagaataagaaatatgacgccgattttactcttcacaaggtacattggccatgaaaatttttataaaaattactgtaacactaaaagttaaaaagagaaataaaaactaattataaaaactaaaataaacatcaaatcgacaactaattcttcaaaaacaatgctcttctataagtttattatatcttctaagaaaaatattaatgattggtaaaaactatatttatagacaaactgatgagatgtttatctatcatttcccgggcacaaaatatataaatttttaaaatcatttaaaattaaaaattctaaaggaataactaaccaattttatttaattggtcattgttattgcaaaataatcggtttgcatatatctttttttgtaataaaaccttgtttttgtgattaaatattcctaaagattatataaattgcatttagttgttttcatttttagttctcagtcactcctcctaaattttgtatttatttataaagagaatttatttaatagcattttaatcagaataataaaaatgcaagtaaatgaaatgcattctttttgttaagatttaatttattaaattttcgcatctcaatttttcgataatttctaagtttttaatttattcattttgatttgtaaaataattatattttttttaatttattgtaaagtcttttaaatttaaaaaaagatattaaaattttatttaattggccattctaagaattaattaaaatcggaacacattaaaaattagtaaaataaataaagtaaaatctaaattttactaaatttataatataataaaaaaattagaaaataaattaatttcgaattttgttgattatttaaatattatctattaaataagcgtttcttttttagacttcatctaaattaatttaattagacgttattaatttagtaaaattaccataaaaataacaaaaattaatttcttatatttattttattttcttcatattaaataaaaaaatttttattaatagaaaatttcaaataatggttattctgtaacaatagacactaaagtttgtttcaaatctttataaaaattcgaattcagaaatattttaaaaataaacagaattaaattcattttattttaaaatttttaactttaacaattattgactttgctaatatacaatggcatcatatttttgaaaaattttttaaaaatatttcacagttaatttttgtcatttaaattttattttatatttttaacttaagacagatattgggttgctagacaaataaatttaaaaatttggaaaattaaaagtaaaatttttttatctctttaatttcactaaaaacacacgcctaatgatttaatatgctattgtatatatttaataaagaattgttacataaaaataactgagttttcgaaccaaaaaacttaaaataaaaatcaagagattatccaaagaaaataatttttaaaataaaatttaaaatattaaattacaatggataaaatattanataaaccaaaagaaaaaaatacttaggcaaaccaaattcaaaaattcaaatgaaagcanaaatctaaatggtggcatgctaatttacatattacg

SEQ ID NO: 24690 - DNA, 1487 bp, Heterodera glycines
tatagtgaaattacgaagaaaaaaaacatgattgctaccttaaatcataacaagcaaaaatttacgacccccccccccgcctcgccggccttttttgcgagcaaagggggtggatcgacctccccaaaataatgtaagcatattgcagtattttagcaatgggatgccgacaaattccatcggatacaaacattgaatggccacactgatcaaattgatgctcttgcaatcacttcggatggaagaaccttggtaaaattgccgaatttttcgttagcttatcattcgttatgttattaatgcattattccctcccattgtcagatttccgcttctcgtgacaaatcagttcgcctgtggcaactcaccgatgaactcattgtgctgcaagaggaggaagagcgcgagagagagaaggaatacgaacagagactggtcgacgaggaggacatcgtttgtgaattcgtaagccatttccaattgcctcccaattcttcagatacctggcgaaccatcggacactcttgaagggggtttagcgccattaaaaagcatcgacaccataaaatccaccgaaggcataatggaggcgattgaaattgtgcggaacgaacgaatgtcgcgcgaagccgaggacgaccacaaaaggcatccgctgctgatgggctattcggcaggtgccgaacatcgcttcattgcggacggtatgcaaaaaatccgacacaggtgcaatttagggattttcgggtaaatgggcgcattttacaacatttacagtcacttggagaagagtttgatgacgcttcccttcacttttgtgccggaccttttgaaggaaatgggcaaatgcgtgcgttccaattacaaatccgacctcgctgagcgtgtcattcttttccttaccaggttatctcggcgtccgccttggttttacttctgaaaagaattcctattgtttttttttcagaatccatcacaatcagatcatccattctcttgagctgctttcactgatcgacgacctcagaacagttttgccaaaacatatcgctgacactttggttggtgttgcgatgttttagagtgatcaaagggtcattaaactttgtgcttgcctttttcagaattgcgttggcctcaatatagctgcgttaaaatttcttcaaatgcgattggaaagccgacaaaatgcaaaaatgtttgtcgctccgcgagcagaaaataacgaaaaggcttcaaagaaaaagaagcagcgacggaaagtgaaagaaattgcctttgtttcatcagttatatgataacattttttgttgcattcaaatcgttgttcacttttcaatacaagaaacactggtacaaaatgagaacttgcaaaatcacaaataaggaatataacccgttcaaaaaatcacagataagaagccggacaaacaaatcctttctttgatcacgacaatgttttaacatttgtctgtgcacttgtgatt

SEQ ID NO: 24691 - DNA, 1172 bp, Heterodera glycines
aaaaaaaaagtccaaaaattataaaatggaaaaaataaaaatggggaatgatgtcaatttagaggagttactcaagattttcggtattgagcagaaaaattcaaaaaaattcgggaaagggcggcaattttttataagaaaatctcaagaaaaaaatctgaaaaattttttgaatttttttaattgaattttctttaaaaaaattttgacagtagattttttcttgaagaatttttatgtatgaacccccctcccctccaattttcgggtacaccccaaatatcgccgagacaaaaaatcgccgcagaaatttaaaaagaaaatttcctgaaaaaaacattgaaacttttttttttgtttgaaacatttttttgaaaaaacttgtcaattttcataaatttcgaaaaaatcgctgataagtttttcaaaaaattttttcttaaaattttcttgaaatttcctaagaattttttatgaaaatttctatgttagaaaaaattttttaattaatgcggcgatattttgtgcccccccccccaattttccccctaccatgtgggtagcacgtgaatccggccaccaacttggcggtctcgccggccaccatgaattgccaaatgttctgcccgtcctgtttgccgatgaatgtcacggaggggtcttggattttgctggaaaaataggggtgataaatttaatcattttttaaatggcattaagcaaaacaattttttcccctcaatttccacaagtttaaacgggacgagacaaaatcgcggcgctgaaattaaaaaaaattttcagaaaagaatagaaattttttttaaaggatttgtttcaaaaatgtattgttctttcttggaattttcctataaaaactttcagttttcttaaatttttcttatggcgcacacttttaaaatgaaaactttcggaattctttataattttaatgctgggtgtaaaaaaatccattcatttttttcggttttctattttaaattaaaactccgccgccaaaactccgtgccctcctcgcgacggatgcgacgcgcacactcaaaggcacgcacgtgcaccgggctcagctgcagccgcgtctcaccagccaaattgggttgattgcggtggcggtgaccaacgctaaacaaacacagcaaatttagtgtttt

SEQ ID NO: 24692 - DNA, 826 bp, Heterodera glycines
ggggggggggggggtggtttttttttttttttttttttttttttttttttttttatataaacaaaaaaaaaaaaaaaaaaggggggggggggggggggggggggggggggggggggggggggggggaaaaaaaaaaaaaaaaaaaaaaaaaaaaaaaaaaaaaaaaaggggggggggggggggggggggtgggggggggggggggggggggaaaaaaaaaaaaaaaaaaaaaaaaaaaaaaaaaaaccccccccccccccccccccccccccccccccccaccaaaataaaaaaaaaagaggggggggggggggggggggggggggggggggggggagagagaaaaaaccccccacacccccccctttctttttttgttgttttttttgtttttttttgtttttttttttttttttttaaaaaaaaaaaaaaaaaaaaaaaaaaaaaaaaaaaaaaaaaatattattttttttttttttttttttttttttttattattatatattatatataaataaaaaaaaaaaaaaaaaaaaaaagggggtgggggggtgtgtggggggggggggggggggggtgtggggggggggggtgataaaattccccctccccccccccccccctccccctcccccccccccccccccccccccccccccctttttgggtgtggggggaggtgggtgtgggtggtgggggtttgggttttgtgtttttttttttttttttaaaaaaaaaaaaaaaaaaaaaaaaaaaaaaaaaaattaatataatttttttttattatcttctttttttttttttttttttttttgtgggggggggg

SEQ ID NO: 24693 - DNA, 1544 bp, Heterodera glycines
taataattttccatgcaataacccttccgagcacatttttgaggtaaaaattgaatgaaaatcgttaaaaagaacttgatgaaatcataaattttacatagtcattgaccgacattctctagcaaaaacgttgagaaaccgcaagctgtagtaattatttatatagatatgtatagggaatggaattatatggatataaaattgcgaaaccataaaatatggtcaaaaaatagcgaaatatggacataaatagcaaaaatatggacataaatttttcaaattaagggtatactttttcaaaatttcttcaaattcgctaaatgaaaagttaacgctaaaaatcggaaccccgtcagttgggcccgtcacgtttgggccccagctgttttttggctataacttttttctttgtcatccaaatcaaatattattggtgtcattcaaagctgtaaatgtcctctattagcctgcaaaattttgaaaaattatgtaaaggttcaaaaaaattatggccagaacaacttaaaaaaccagattttccaacttttatgcccataaatttgttcaaaattgacgaaattttttgaaaatttgcaggctaatagagcagggttgcgatctcaaaatttttaaagtcctcatttcagacataaaaaatactcatttgccactaaaatacctcaaaattaaaaagtgaaagatttttaatttatcaaaaaccaaaggggggggggacccttttgtttcgcaaaattcttttgacataaaaaatcgtgaatgttcttttattcgccataatttataatttcattcgccataattgttctgttaatgtttaatattcattattatgtgtaaaaataaacaaaaaaaaattgaccaaaaaaaagtgaaaaaaaaaattcaaaaaggccctctttttaaatagcgccgagtcatatttttcgtttgtgcttttagattagggttgcttccccgaccccgccccgaccccgacatttttggccatttttcgggtttaccccgacccgaaccccgacgcttccaaccccgacgaccccgaaccccgacccttaaccccgactcgctcttctcttttctctctcttttctctctctatcttccagtctctttctcctcttctctctcttcttttgtctctctccttctctctctcctcttctctctctcctattctctctctctccttttctctccctcctctttctctcccttcttctcactctctcccagtctctctaactatctgctcgtttctctctctccccctctttctctgcgtctctctctcttttttcctccttttctcacttctctttacctcactctctctccctctctctattttttcgtccttttctctcctcaccacatactctctctctcttttttcctccatctctctttacctctctctctctctctcttattatctctctctctattttttctttttctccctcctcacctcactccatctctttctcactcactctctctctttttctttttctctcttctca

SEQ ID NO: 24694 - DNA, 1558 bp, Heterodera glycines
  misc_feature (1382)..(1382): n is a, c, g, or t
aaagtgcgtgacattggcacaactgctgaagattgagcaggaagagtttgatcagtttgtgactgatctgagtgaaaatgagcaattaatcggcaccgtgttcaagccaaagacggcgggtggtggaggaacaatcaaagtatcgtatttcagagcttgttgcttttttcaatcacttttcaaaagagggaccgtgtttttatggggagggaatatattttttgaaggtactgtaattgcaatgtactgttgcgtcaaagaaaaattaaaattaatatttttttatttcaattaaaaggaattgaaggggaagctcgtccgaacattttcaaaacgaaagagcgtaaaagagaagaaaaacagtgatgatagaatggaattgggagaaaaatatgaacattttcttagcataaaagagaacgatccggcactgagccaagtgatcgaaaaattgcagtcgtacagtaagaaagtgatgtcagcagctggtaagaacagtgccaaagatgctactgtacaatggtaatacatttcaggaaaaagcatggacgaaatgttgaaaagatatttaaaatttgccataaaatttatggcaaaacgccagcgaatttccgaacaaaaactgaagctgcagggaataggcaaattgcaagcattaaaagctctaataaaattttatgttcatgaaaaatgcgagaaagaacaggcaaatgatggtcagcaaccgagcaagtccaagtgggagcgattgttgccacttttgacgacggtggtggaggacgaagaggacggcacaaatgccaattttgcattggaatgtaagagaattaatttataaaaataaatgacaaaaaaagctaaaaattaaaatatgaaatttagttgacacaaaaaagaagaaaaagaaaaccggaggaggaagaagaaggaggagaaagaagcgcgaattagcagcctttgccctgattttgtgcgtcgcgttggcagtggcaattctgttgttggcgctaaattgcaaaagcgttggcctctgtttggcaaatcgttctggagcacaaacgcaacgccaatactcaaacgaaaacgaagcagcagttggtgtggaggcaaccgaagaagcgcgcgtcacaacactttttgaacttttacaaagcaacggttagcgcatttctcggatttttttttgtttgtttttagcgttaaaaattaataacctaataaataagcgtatttatggccactaaaacccagcagcatggaagcaatgccaccgaattgaaagcgttttcattgctctattcatcgtatctaaatattttgactccgaatcggacatatggaaactgattgggaatttatacagtttaggccacatgaatttntttttttgttaaaaagattaaaaaatgtaacaatggggcgttttggggtcgctggtcacgaaaatgacatgacacccatttcaaccggtgctaggacgaagtgacaaaaatatcagtgagagaaaaaagatacaccaagggtttcgagagcagtgctgcgtgtaggacaaagctgt

SEQ ID NO: 24695 - DNA, 1145 bp, Heterodera glycines
ttttttgaattgcaaaatttttttccttttttgaattgggttcaaaaaaaaattttaagagaatttttgatttattaatttgaagtcttgaatttatttgacaaatccaagacttaaaactgggagaagcaaggggctgtggctgggggcctaaaatttggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcggagaaaacagcttcgatatcaagaaaccaagtcaagtccagaaaggaatattttaaaacgatttcgttttggtttggattatgataccgaataaatttcggaaaatatggaaaacaaaatggagaaaatcgaataattttttgacgggaaattttttccttttttgaattggggtcaaaaaaattttaaaagaatttttgattattaatttgaa

SEQ ID NO: 24696 - DNA, 1465 bp, Heterodera glycines
aaaaagtgataaatttttttattttgagtaaaatttttcaacaaaaaatttatgaattctgataaattttagttttttttatggttttttgtcaaaattattttgaaattcataatttttcatgatttagtcaaaaaattaaatttttaatttcaacgaaagaaaaattgggttcaatacgtcaataaattatgccaatgatgaccaatttttatgggtatttttgtttaaaaaccctataaattaaaaaagaagtcaaccaggatccgaactcatgacaaaagtagtgcatgtgctaacgcaattaccactacaccaatattacacatgaatggacaaaagcaaattactttatttaataaaaatttggcaaaatggttaaaaaaaattcaaatttgtataatttttttcttttctctcacgaaaataccattcttaggggtgtatatttaaccccgaccccgagtcggggttaagggtcggggttcggggtcgtcggggttggaagcgtcggggttcgggtcggggttaaccccgaaaaatggccaaaattgtcggggttctgggtcggggcggggtcggggttgcaaccctactatagaatttaaaggacatgagagagagaggagaggagataggaaaagagagagagagaagggtgaaagagagaggaagaaagagcgaaaaggagagagagagaggaaacggtagagagagagtgaggataggagagattagaggagagagagtgaggagggaagagaggaatggagggagagagactgaggagaaaagagaggaagggagaaagagggaagagagagagagagaaaaggagggaaagagattgagagaaaagagaaggagtgagagaaagagaggaggagagaagcgaataaaataatggttaaagtgagagagcaagagagagagagagaggaaaggaggaaaggaggaaaagagactgaggagaaaagagaggaaagtaatgagagagagagagagagatagaagagcggaaagaagagagtgagagagagagaaaagtaaaaagagatagagaaaaaagaaaagaagagagggaaagagaaagagagagagaggaaaagaggaagagagagagagaggtggaggagagaatagaagaaaagataaagagtgagcgagagaataagtagagaagataggaaaggagggagagtaaggagagaaaatagggaaggagggaatgagagagaaagagagaatgcaaattattttctttaactttttaaaaatcatttgagaataaaaacagagaaccgctcgttatggttaaaagatattttaaagaaacttaataaaagataaaaaaattaatttaatttaaaaatatcacctaaaaataaatattttattatcctttaaaatattgtttaaagaaaaaagacaattaaatgaaaataattaaaaagaaaaaagtcaa

SEQ ID NO: 24697 - DNA, 1095 bp, Heterodera glycines
tagggtcgtcgctattattccgaaaatgtggttggaattcatgtgagtgttgagcagaaaaagagatagacgttttttcaaaattttcaaagccaaactcgcccagaaagaaaatccagaaaaattagggtcgtcgctactattccgaaaatgtggttgaattcatgtgagtgttgagcagaaaaagagatagacgttttttcaaaattttcagagccaaactcgcccagaaagaaaatccagaaaaattagggtcgtcgctactattccgaaaatgtggttggaattcatgtgagtgttgagcagaaaaagagatagacgttttttcaaaattttcagagccaaactcgcccagaaagaaaatccagaaaaattagggtcgtcgctactattccgaaaatgtggttggaattcatgtgagtgttgagcagaaaaagagatagacgttttttcaaaattttcagagccaaactcgcccagaaagaaaatccagaaaaattagggtcgtcgctactattccgaaaatgtggttggaattcatgtgagtgttgagcagaaaaagagatagacgttttttcaaaattttcagagccaaactcgcccagaaagaaaatccagaaaaattagggtcgtcgctactattccgaaaatgtggttggaattcatgtgagtgttgagcagaaaaagagatagacgttttttcaaaattttcagagccaaactcgcccagaaagaaaatccagaaaaattagggtcgtcgctattattccgaaaatgtggttggagttcatttgagtgttgagcagaaaaagagatagacgttttttcaaaattttcagagccaaactcgcccagaaagaaaatccagaaaaattagggtcgtcgctactattccgaaaatgtggttggaattcatgtgagtgttgagcagaaaaagagatagacgttttttcaaaattttcagagccaaactcgcccagaaagaaaatccagaaaaattagggtcgtcgctactattccgaaaatgtggttggaattcatttgagtgttgagcagaaaagagatagacgttttttcaaaattttcagagccaaa

SEQ ID NO: 24698 - DNA, 1380 bp, Heterodera glycines
  misc_feature (15)..(15): n is a, c, g, or t
cccatccaacctatntcgcccaaaaaaaaattatttttcttcctgaaatattatttttaaattttagttatggtcgattctatcacctaccgtttgagcgaagtgtatttgttgtggcgtgatgcaaaacaggaactgattgacaccatattggagggtgttacggttgggttgaacaaaaatattatccgattcttttgtgaaattgaactggcatacaccgcattagggaacacttggcaaatcatcgaaaaaacaggtggggctcattaagaagaaattaattgacttggctaaatggcctttggccggctccatcctcctgcatttatttacgatttgtttttaattttaaaatttaataattagacgacccatggaaacaagaagctgcgccgggtcgtttcataaaagtgccaattttaaataatttttgagaaaactcataataacttttttccaacatactaattaaaaacaatttcttggtctaatataatagctcttggattgctgtattagcatgataaatttcaaaaaattttattcaattttctttgaatatacttgaacacaactgttttaaaactagagaaattttcttatatttctcctgctaatagagcagcaacctaagagctattttaagaaacaaaaattatttaatttagttgggtttacgaaaactatgacgagtttttcttgaaaatctgtaaaattggcacttttacgggacgcacatcgtggcacttttttgcgaaacgacctagcaccgaaacaagaattcatttatttattaaaaaaaataaaatttattttcgagaaaatttgagaaaggcaccgaagcaccgaaaaaagaacatttattcaaattaatgaattgaaattgggaaaatttataagtgaaacatgttaaataatatttcgtataaatattttaataaataaatttttaatcattcattttgaaatcaaggaaagaaacaatttgtgaagaatgcaaatgaaattaagcaactaatgactgatttacacaatatacgtgactcaattcaacaccgaattagttacactcaaatgcatgaaatttttgagtttattcttaaaaaagaactgctaatgttatttccaaaacaattggaagacattttgtctgaaatgaaaaaaatcgcaaaaattgaggggtccaaggtattttttaagcattgacaaaaaatttttgttaaaaatttaaaaataaaattatggaaaaaaagaaaaagaaacaaacaaacattggtctcttgagataaataaactctaaaataatgtccaggaaattcagggtgttcgtgcataaccaggaaaccaggcatcaagggcgtagctaggggggggggg

SEQ ID NO: 24699 - DNA, 1158 bp, Heterodera glycines
atcgaatagtcaagtgatcaaaatcatcggtttaccttctcaatagtttaaagtaattggaaaatttctcggcaaacttttattaatccgattaattaaattaaaacctaaaacaaatttttgggtatttttaaaattgctatcaatatgtaatacctggacagatggtcatcagcgtttttaggatgaattttgcgtccgtcttcacgcggttgagaccggcgatggaacgcgaagcggcgtcagtgaacagacgagctgagaaaaggcaattacaatactaatgagacaattagtattaattaggtaaattttacagtggagaagcatcacccgacacagccaatacagtcggaagaacattactgtaatggaattggaaaacaatcatttgaatgaaaaacgaattggatggaaatttacaaattgagaagagaacgtccaacggcattcgcattggcacctaaattaattaaacaaaaaattgtaggcaaaaataaattaaaatgaaaaaataaaataaattaatttaatttaaaatttgaaaaattttaccgtatgtccgtcggagtttactgtggaaacgaacacatcaatttgcattggcaacggacagatggcacaagcgattatttccaccacaatttgcatgcttttgcgaaaggtcagcgcaatttgccaatcctcggcactgttcgcgttcataaaaatctgaggggaaacaaatttaaattctacataaattgatttaatcattaaaattaattgcctgaatttcatggacatggaatttgacgacaaggccaaccagacaaacagtgctcagcaaaatgatcagcttcatcagcacacagacggagctgtgcccggcgtagacgaactcattttcaatgatcattagaactaaaaaaagaaaaatgaaattgaaaaagtaaaatttaaataataaatttaataatttctaaaatgaatccaaatgaggcacgtcacatttgaatcttaccaatgccaaaaatggcaaaaaacagcgcataatcactggtgacgcgccttttgttgaacaattgttgcctctttatgaaacgaccaccccttaaattgttggcttaatgatggaaaatagcaatttaaaagtgaaattcatttcatttttcgaat

SEQ ID NO: 24700 - DNA, 1576 bp, Heterodera glycines
atgccctgtgccaatggttgcattcgccgcggggggccgggcgccttaagattttgctgtgccaggaaatttggtcattcgctgacaaaattcgggaactaaaaacgggtaattatcttaataaaatatgaatgtctccgctaataaaaaagattgccggctaaattgcaaattaaggcattttgcgacgcctctgcccccgttagtttcatcattcgtttgtctttgagcagttttgctggtatgtggcattttaaaaatttctagtatttaagacccccaaacatttgttgttttctgtgcaggtgaacagtttgaattgcgcaatgatcggaccggggaaatgttgagcatggaaatggtcgcgacaaaggacgacgaagacggagaaggacaacaactacagcagatcgaggaggaggacaacgacaatgccgacattctgacccactacatcaagccggagcgcaatttgtggttgttgaagcgtcgtccgaccgttgggggaggaaaatggcaaaaacagtgggcccaatgggaggcggaggcaatcggatggaattggaccaatgcatggaatgtgatcgaagttgccaatgaagaggacgtggacgtgatcgaagatggcaatgaacacttggacatggacgaagtgacttatgagggagaggcgatggacgagatagatgagatggatggcacggacggatgaacgctttaaacagacattggacgacatttaaatgatgtgtaaaatgacaaaatttctacaatttattcatttttttaaaataaagcatttcactaaccaataaccgaagaaattgttgttttcgctgctttttcgctacacatttcaattcgtttgttttcatttgcttttcccattatgccttcagaatattcccgatgattggcaaataacaaaatggagaggaacaagagaaaatttgccaaaattgtttcctcactcaaaaaggacggaatcgaaatttcagagagtgccaccgatgtgagtgccgatgttcagtcccttggataatgaaatttccgtatcgtttcctttaatttcagactttgttcgtgagtaacagcagtcatttggtgggcgtccccttcgagagtctcgagttgcttttccgtcgttttgacctgcactgtgccttcaccgtttacccgaccaacaaatcctactcattggtccacttttccgaagtgaatttggcgatcgctgcgcgcaatgctctcaacggcaccaaacccaaagactttcccagtgaaaatgctgcacaaattcatttgttcttcgtcaggcaaagtggggtctgaaaaaataaaaatttttatcttaaaccatgaattttccgtaactagtgagatagtgcttcttttcaaggattttgtatcctatcattttcccattgtttccactgttccaaattgtcagaagcggcaaaccgttcgccgccagcggcattgccaaacggcctgcaaatagtgccggatttcatttcgacgcaacacgagtccgaactcgagcaatttgtggccaattgtctagcagaaaggacaaaca

SEQ ID NO: 24701 - DNA, 1391 bp, Heterodera glycines
ctattaatactcaattttcatcattatgtgtaaaaaactttaaaaaattttgaccaaaaaaaaaaagttaaaaaaattttctaatcggtgactttccatatagcgccgaattttggatgctcaaaaaatcccaggaattcagaataactgccaaattcagaccaaacatcactgaaatgagggctttaaaaagatggaattaactgtttttatacctaaaaattccatcaacaaaataaaaacgcaccggttttcgaggttcttcttcaattttacttgccaacagcagacaagcttggaccatgtgctaaaaaaatgcaaaatacaccgaatttgtctgaaattgcaacaacaacaaaaaaaacctcgaaattgtagcgcacaaatgatttgaggtagtaataacgttggaagagaatttgtgcggtggccgctgatgtttgactcaaccgtaacagaatggcaccggattgtatcagttctcagcacaaatagagaatgtcttaaacacagggtaatggaagtttaccaatgaaaactgataaaattcttcgaaaatgtctacgaagctaaatccctattccccgtttttttggccccccaattcttccccgttttaccctctccaattcgcgattgattccgtccgccagtgacggtgggttctcgagtttggccaacgagtcggcctcgtagtgcatcaaccatttctccgccgaaatgtcaatgctggagtagctgctccgttgcccgtatgctggacggcctcactttggcaatcagcgcgtccatcgcgcactttgccgacgattgcaccgtctcaaaaagccatttgtggtaaaatagatggaataggaggccccccccccccgcccttcagagcacgacaaatatttcaacaaaaatttttaaaaattgactagagcaattgaacgctaacggacgacctaatggaaaaaaatccccgaaggagagaatttaattaaatccattcctttgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggagagcaaaaatccaacgcagaattaaagtacaggctataggg

SEQ ID NO: 24702 - DNA, 950 bp, Heterodera glycines
cccccccccctcgccgccaaataatctttattatccctcaaaaaaaatccctaaaattagttaaaccatttagctgtgagtagtgcaatatttccatggaccacaacactttgcatgttctgtagtaaagaagtgatgaaacaacaaacactgacagatggatcagcataaattcggagacccaatgaaatggaagaaattcaagaaaacagccgtactcatctggcaattaaagacaattagggttttgccaattaattattttgggattcccctttgacattattatattgggttggtaaataagtcctggggcctattcaaattagcatcgtatcaacgatgcgatgatacgatgtgatggctcatcatagccccgatgcccgttcaaattaaaatcgtctcccgcatacgatttatcacaccaagtcatcacatgtacgttcaaattcatcgtatcatcgcatctacgatgcgatcgtcacatcgcacgtaaaatcgtctgaggcagacgattatttgtacgatatgtcgtatgtgcgttcaaatttaaacatttctacatacgacgagcccatcatacgatgagcctccctctatgaaaatcgtatgtagacatacatggaaggaaccagcgattttcctacatcgtatgtaggaaaaaaattcgtaaaaaattcgggagacaccagaataaataatatttatatatttcttatagattaaagtctcagctattttgtcatataaattttaaatttttcttaccactaaaagccagccaaattattaaaaacataaaacattccaaatatttttaaaaaagtaatttatttttcataaagataatgtaaaatttaatcattttgcgttttccctctattagttaggtttaatgtaaaaattttcaattttaattttaatcaatttggtcagtttttattttaaat

SEQ ID NO: 24703 - DNA, 1440 bp, Heterodera glycines
  misc_feature (1414)..(1414): n is a, c, g, or t
gaaaatttgattttatgggtcaattaagttttattttttttgttttagatgattaaaatttttcaatttgtacaatttttagattgctagcaaatattttacttcttttttttaaattcacaaagcttttgtttttttaattttaagcttaaaaattgcatttccagaaaaatttgtttatttaatttgcattatatatgttttctcgataagggctcccaatcttttcttctcttcatgatgatttatgataattttgcattttgttaaatgaaatatatggtaataatgaataattattctattgcgataataataatttattttttttttatattgaattttgttcattcttcgtaagtttttgaagaaaaataatatagctctttatttattgcataatataacattaagcgatatttatataaaatcattatttttaaaattttttattgaatctaaaaattctgttatttttcaccatgattaatatgattacaattagcttttacacaaattatccagtaatgcataattaaaataaaataataatttcttttttcatttatgatttatatcatttcgtctgattgactcatgacaaatattcccgacgctcaccaaaatataagcagctatagatattaaggatatataattttagaaatacaaatctagatcttttcttcttaattcagcataaatattttgcagaaatgtgatgttttcatttagttttagttttatgcaatattaagttcaaaaattttattttaattaagtattttaaaattttttgctttgttaataaagtttaatagttaaactatttaaacgaaatacgatcccgagaataatcttaacaatctcgccagttgatgagaaacaatgttgtagcaggaaaattcggcatatatatttagggcatttaataaagtgtcaactatttttttatattgtagcttttttaagaataaaaaatgcttttttaatatattatttattctaattttttagcaaatttattaaaattatttaatatacattgaaagcatttttaataaaacaataaaaaattatataactttctgaaagttagtaaaattttttcttatgatatttcttacaatttggaaaaaattttccagcagcgcctaagtcaacaccgccggacccaaagtatactccttggtcaacaaaacagccaccaaaaatatttaggtgcctattttaaaatagtgaatattaaaaaaaataaatgaataattacacagttaaatatttattaaagcgattcaataaaaaaccccaatcacaaaaacaaataccaaaaataatttaataagcaaaaatgttaataatttaaaatttattattttttgtataaaaataaaccttttcgcgacataatggngtgaacgacgattgtcttagagccaa

SEQ ID NO: 24704 - DNA, 1139 bp, Heterodera glycines
ttgcatggcaaccgccgaaattcacaaatggcggaatccaaggttctttattatacaaatatttgtacagacggtaattgttagctttttctttttaaatatcctcttccgatatcaaacacactaaaactgatatttaaggacaatcagaatcgaatcctatgccatttggtggaggattttcatttacgactactgttcctccagcagctaacggtcctttccaatttggtgctgcacctccagtggccaacggaaatgtgttccagtttgctgagacgactgattgtaaggcaattattactttctgttagcattatgaaataatttagctgctgtttctacgaatgttcgacacggtgttacgggaaggaaattgctgcacgctcgaaggaagaagcgttgattgcattcaatgttagaaaaatcaccggttttgtttttgttcgttagaatatgttattttcatggaatattatgtccaggaaataaatttatttttgatttttttgcgaataaattgctgaaattctgttgttgttgttgttgtgtttcttttgtcggccgataggttagcatgttttgtaaatgtttgtgcattttgacataaaacgaaaaggtataaataaacgcaactcctccccatcataacctaattcacccaggcatttgattacgacgacggcattcattgtgccgtggatgagttgggcataaatatttatcatcaaaaaagatgaaaacattttaattgatagattctggcacagatgatcactagggcagcaaaaatatgggaacgcaattacggggactgattttgagaagtcaaaaactaaaaaggatgttttttagttttggcgttgtgttcactttggctagttttttgaacgcccccccccccctattgaagcggcccttttgacccatcaaaattgggaatttcttggaaaagattttatttgctattgcaaccctattcatcactctgagcagtgatcagtctgatcagaagtggtcgttttctcctccgtccccatgacattggcattttctcgtgtctttatttctctgccgtctcttccatatgtgctatgctctgtgtcctctcatctccgccgcttctcttcgcccctctc

SEQ ID NO: 24705 - DNA, 1108 bp, Heterodera glycines
taggggcttttttattatgattacaacaaatcagcatgccgtctcgctgatatggtatgtttcattaaggtttagccgatctacaaatttcggcactgtctattttgtaaaagcgaatcaaattcctttggattccaaagtggaattacagaattgcgacggcaaatcctaaatagacaacgacgctttcattataaagctttaagggaggaaaagtaatacgaatatttcaatttcttacttatccgaatagacaaagataggttacacacgaacatttttatagaaattccggctgaaactaaaatccctcttttggtcttaacctatgatttttggcccattatggatgaattaagtatagaaggcgtcgcagaaatacattcatattttctaaattcgggtttcagaaaattaagatttaaaagaggctgaattacagatgcttttcaaattttgggtgtatccgaatagaaagaagttggaaatcagtacttttcacgcctataaaattcgggccgaaaaatattggtgtttgtgactagaaaaatagcagatgcatatcaaatgactacagaaaattacagcctccaagaaaataattgctttgcacaagcaatattttgtagagcccatcaaacacattgtgcttataggaaaggcagaattatacaataggggcctttttattatgattacaacaaatcagcatggcgtctcgctgatatggtatgtttcagttaaggtttagccgatctacaaatttcggcactgtctattttgtaaaagcgaatcaaattcctttggattccaaagtggaattacagaattgcgacggcaaatcctaaatagacaacgacgctttcattataaagctttaagggaggaaaagtaatacgaatatttcaatttcttacttatccgaatagacaaagataggttacacacgaacatttttatagaaattccggctgaaactaaaatccctcttttggtcttaacctatgatttctggcccattatggatgaattaagtatagaaggcgtcgcagaaatacattcatattttcgaaattcgggtctcagaaaattaagaataaaagaggct
